United States Patent 10,093,940 (OPTIMAL MAIZE LOCI) - sequence listing, part 2

SEQ ID NO: 1575 - DNA, 1302 bp, Zea mays
  misc_feature (1)..(100): optimal_loci_117457_G1, chr3:157760674..157761975, Cluster 10
  modified_base (96)..(96): a, c, g, or t
  modified_base (97)..(97): a, c, g, or t
  modified_base (98)..(98): a, c, g, or t
  modified_base (99)..(99): a, c, g, or t
  modified_base (100)..(100): a, c, g, or t
  modified_base (101)..(101): a, c, g, or t
  misc_feature (101)..(195): n is a, c, g, or t
  modified_base (102)..(102): a, c, g, or t
  modified_base (103)..(103): a, c, g, or t
  modified_base (104)..(104): a, c, g, or t
  modified_base (105)..(105): a, c, g, or t
  modified_base (106)..(106): a, c, g, or t
  modified_base (107)..(107): a, c, g, or t
  modified_base (108)..(108): a, c, g, or t
  modified_base (109)..(109): a, c, g, or t
  modified_base (110)..(110): a, c, g, or t
  modified_base (111)..(111): a, c, g, or t
  modified_base (112)..(112): a, c, g, or t
  modified_base (113)..(113): a, c, g, or t
  modified_base (114)..(114): a, c, g, or t
  modified_base (115)..(115): a, c, g, or t
  modified_base (116)..(116): a, c, g, or t
  modified_base (117)..(117): a, c, g, or t
  modified_base (118)..(118): a, c, g, or t
  modified_base (119)..(119): a, c, g, or t
  modified_base (120)..(120): a, c, g, or t
  modified_base (121)..(121): a, c, g, or t
  modified_base (122)..(122): a, c, g, or t
  modified_base (123)..(123): a, c, g, or t
  modified_base (124)..(124): a, c, g, or t
  modified_base (125)..(125): a, c, g, or t
  modified_base (126)..(126): a, c, g, or t
  modified_base (127)..(127): a, c, g, or t
  modified_base (128)..(128): a, c, g, or t
  modified_base (129)..(129): a, c, g, or t
  modified_base (130)..(130): a, c, g, or t
  modified_base (131)..(131): a, c, g, or t
  modified_base (132)..(132): a, c, g, or t
  modified_base (133)..(133): a, c, g, or t
  modified_base (134)..(134): a, c, g, or t
  modified_base (135)..(135): a, c, g, or t
  modified_base (136)..(136): a, c, g, or t
  modified_base (137)..(137): a, c, g, or t
  modified_base (138)..(138): a, c, g, or t
  modified_base (139)..(139): a, c, g, or t
  modified_base (140)..(140): a, c, g, or t
  modified_base (141)..(141): a, c, g, or t
  modified_base (142)..(142): a, c, g, or t
  modified_base (143)..(143): a, c, g, or t
  modified_base (144)..(144): a, c, g, or t
  modified_base (145)..(145): a, c, g, or t
  modified_base (146)..(146): a, c, g, or t
  modified_base (147)..(147): a, c, g, or t
  modified_base (148)..(148): a, c, g, or t
  modified_base (149)..(149): a, c, g, or t
  modified_base (150)..(150): a, c, g, or t
  modified_base (151)..(151): a, c, g, or t
  modified_base (152)..(152): a, c, g, or t
  modified_base (153)..(153): a, c, g, or t
  modified_base (154)..(154): a, c, g, or t
  modified_base (155)..(155): a, c, g, or t
  modified_base (156)..(156): a, c, g, or t
  modified_base (157)..(157): a, c, g, or t
  modified_base (158)..(158): a, c, g, or t
  modified_base (159)..(159): a, c, g, or t
  modified_base (160)..(160): a, c, g, or t
  modified_base (161)..(161): a, c, g, or t
  modified_base (162)..(162): a, c, g, or t
  modified_base (163)..(163): a, c, g, or t
  modified_base (164)..(164): a, c, g, or t
  modified_base (165)..(165): a, c, g, or t
  modified_base (166)..(166): a, c, g, or t
  modified_base (167)..(167): a, c, g, or t
  modified_base (168)..(168): a, c, g, or t
  modified_base (169)..(169): a, c, g, or t
  modified_base (170)..(170): a, c, g, or t
  modified_base (171)..(171): a, c, g, or t
  modified_base (172)..(172): a, c, g, or t
  modified_base (173)..(173): a, c, g, or t
  modified_base (174)..(174): a, c, g, or t
  modified_base (175)..(175): a, c, g, or t
  modified_base (176)..(176): a, c, g, or t
  modified_base (177)..(177): a, c, g, or t
  modified_base (178)..(178): a, c, g, or t
  modified_base (179)..(179): a, c, g, or t
  modified_base (180)..(180): a, c, g, or t
  modified_base (181)..(181): a, c, g, or t
  modified_base (182)..(182): a, c, g, or t
  modified_base (183)..(183): a, c, g, or t
  modified_base (184)..(184): a, c, g, or t
  modified_base (185)..(185): a, c, g, or t
  modified_base (186)..(186): a, c, g, or t
  modified_base (187)..(187): a, c, g, or t
  modified_base (188)..(188): a, c, g, or t
  modified_base (189)..(189): a, c, g, or t
  modified_base (190)..(190): a, c, g, or t
  modified_base (191)..(191): a, c, g, or t
  modified_base (192)..(192): a, c, g, or t
  modified_base (193)..(193): a, c, g, or t
  modified_base (194)..(194): a, c, g, or t
  modified_base (195)..(195): a, c, g, or t
tgggagggagggactgcaaagtcaaagctcatgcgccacttttcgtggacaatgcaatacgcgcgcacgtcaaaaaagtctagcacagagaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcgcgccgacaaggcatagcctcattttcatcaccccataggcccagtaggagaaaacgtttcgcatgacccaaggcaaacagagagagggagggggtgatgtgcacgtccgtgggcacatccgtgcgtcgtggactctaaaataggctttgacccatcagagtagacggcttcgtgggtcgccgtcacgagcacccgcagagtcgtgattcgtgaatcataggcagcaccacaataattgcagagcacgcgcgattcgtcggaggagaggtacttgtgaccacgggcccggttgcggctttttcctggcacggcccacgaagcagactccctcctcgcacactttttctcgtggcctgctgggccccgctcgctacacaggaaaaatgagaccacaaggttgatagcatatagttggaccatatgacgatgggtcgtctttggaccatgtcatggtggtttccaaaaaggtgatgacgacccgtacgtcggtacgtgcgcgcgcgccccttttattttactttattttattccgatcgaggaaatcccacaccacaccaaacaaagctttccgttgacaagccgtgcagtatccaaacaaaacctctgaataattgattgattgaccattgaagatccctggaccggtcctagtcgatcatgggagggagggactgcaaagtcaaagctcatgcgccacttttcgtggacaatgcaatacgcgcgcacgtcaaaaaagtctagcacagagaattcaaccgttgaagagctagcagccggcccctccgagatgtgaccggaccgataatgatccatgctactatctgctttctgcgctcgtgtttttgctagggaggcaagatatcacaacagcaaaatagaaaacatacatcctacatagtatttccaacagctatcggacattaatctaacgttataagcgagggaggacctaggcctctcctcgtttctttattgcaagtattagtatctagattttcactgttaagtcccctgctgagtctaactaagatgctctcgctctagtattttaatgtccatccttataagtatgtcatcgctcttgttttattctaggtccgctt

SEQ ID NO: 1576 - DNA, 1014 bp, Zea mays
  misc_feature (1)..(100): optimal_loci_117597_G1, chr3:158448500..158449513, Cluster 10
gagaccatgagacagaaccggaacagaacactgtacgtacggacacggtcattgcactgctccggcagctggagcagcacagctgctcggcaccagtgacacagtccacactccacagctccggttgtcgagagaaggaagaccagttgccacaacaccttttgtcgacaccgtacgtacgatgatacaaatacacgaaacttttgcctcgtcggtcgcgttctctaaatcctattctggtttagcctgacctcacaaaccaaagggacaaaaaaacggtgtctgctggtattttaagacccggggcggcaaccatcgatgcgttggaaaggccatcagaacattcgaaaccaaacagtattgtttaacatgagtaagtgcacatccacatcagaaaaaaaaagagagaaaataaaacaaattaccacgtcacgccttccacgatcagacagacgactggttccacgcatcattcatcaagcagcgtggatgagaatgacagcgtctgctaccctcatcaacacgccaaataaaatgtggccagggtagatagaaccaatgaggtcactagcaaccacagccaccaggggaaaaaaagatgagctactatttttccccctttttgaagtaaaaaaatggactgctacataataaatggagcaacagaaatctgtgttagggtactgggtactgtaacatttcagcgtaggacaatgctgatgtagtggtgctagggtaaaatactactaccatggaccaccacccattgacagcaaaccatgtgcccctgacgatatcaaagtactaccaccacacatcatgtttcggtttcatgagaggctgagcaagacctactaacaggtaccaaacagaagcatggtttgcatcccacttgtaaggaacagcatctcataaatggatgtggcaaggaccccaaaaaaaacatgtgtggacatgaacgaaatacacgcaaagaaccaacgaaatgcagacagcatgagattctattcagag

SEQ ID NO: 1577 - DNA, 1151 bp, Zea mays
  misc_feature (1)..(100): optimal_loci_118123_G1, chr3:161639872..161641022, Cluster 10
gtaaggatgacatttttcctagggacaggccctcacggttacccgaccccaaatggaccgggatgggactggaattctccccacggcccacgggaatggcttagcaagaactcaaaacttaatggagcagggtgaggataaaaattcacccgtgtggatccgatgaggacatagattagtagtcagatcctccccctcacgcggtctgtgaaggttcaaccaaacaaatcgttcccactgtgaccacacataaagatgcaaaatcctcaatcactaaccctaacccttgtttcattcactcgaatgtcactcgcccacgtgacaaagctagtttgtgcgtatacaggttggagaaccctctgacatgttgcgatagtactatgtaatggttttggtagcagcataattgtatgcgacggtgtagccagaacttcaaagtgactggtataataatgtaacataactatcttcttatgatactgtacatgtaataatccaaatatatgatttactaaaaaacagtataaatagttttctctgtcgagggctgtataaacagcatatttaaatatcgtacgcctgtaatacattgggccgaaatgagtggtctatggctcaccacggaaggaagggttgcaatacttgcgttcatagattcgtgggcctcggcgctgggcgggacgaggtccagatcaggatcgttcaatccccgcgtaggtgaataatgtcggtttcagcccaggcagaaccgttgggcttcgcacgggagcccacgtgcacttggactgaacagtccgtagctagtagcccaccgcgcaaccactctcgccttttccttacaaaatcttgcccgcccaaccatccttttttttgttccacaagatgcctggtcctggagcataaaaacacaaaaatatcgcaaaccgacgcgtgaagacggtttataatacccacacccatattctttatccagagacatgatttcccaaacagaatttcctccaaaaaggcaatcaatctgaatgtcgtccgaaaatttcctgaggacgcacttttttcccggttgacgattgtgatgccaccccccaaaaaaagtcagcaccacggcaatacgggtacgggtacggcatccgtgcccgtgaagaatgccc

SEQ ID NO: 1578 - DNA, 1403 bp, Zea mays
  misc_feature (1)..(100): optimal_loci_118761_G1, chr3:165734799..165736201, Cluster 10
attttactacacgaatgaaaaaacttagcaggtgggcgcggccaatagctggagtacgtacggtcacagcagccgcggtgcgctctggattgaccaggcttgctcaggtcctcactattgctcggcagtgggtggacggtggcgagcctcccattagttcccgtccgcacggtgactacatggtggccacggcccacgggccacggtcgctgtctcatggtttctttcggctggacgccgatggccacaaagagtggtggtggagtgctaaaagctactactaggccgatgtccggcatggaaacgtggcttcttgccctttcgcttttggagggcaaagcgccgcccatgctctctgaaacggaagcgtcacgaaggaagggaaactgcacccacgtcagccagttcgtcgtccgtccgtccgtccatccattcgatcgatccaccgcgcgcacaggtgcgacgctgcgaaagaaaataacccaggtgatgatgatgcgtcaaaggctggtgatggctttgcctagcttctcggataggataggcacatccccccgtcatcgcttgcggttcgcagcagtcgtagttgagcggcgacggctgcctacgttttctttatcattggcatcatcttcttcctaatagtattaatattaataataataaataatcggtgtcctgtatctgcctgacaaatcaatcaaccgatccatggttcatttgtcctgccactcggtggtctctctcgctcgccgggactacgggataccagaccacaagcgctggcgatggcgaggaggggcaagtcaaagggcggccgaaacggacgtgccaaccgaaagcctttcttcggcactcactcacctaatgcataagcctcctgcgctgcggtgcgctgcttaaccattgcgacccctcgcgtaaccggcaagggaaccaatcccccccagattttctcgttgacgaattagccgcgccgattcgaatggatccaccgaataaggaaccttcgcgtcttttccttttccttggcgagacgccttcggccgaataattagagttccttccttttttttttgaaagattgaaggagaaatggctttggaccgacgggactgttgggctgggtgaactgtccgtccgcagtggagtgccgtacgtgtacgaggacaatgcagcagcgcagccgcgcaggtgtgtgtgtgtgtgtgtttccaatccatgcgatgttgtgaccggtgctgtcctgcaagttcctgcgagctttgtttggcggtccaactactaatcaccagcttagactacgttgtgcgttgctgttgctggtccaaaaagatgctcgctagacggcactagagcacgcacgcgcgcgcgcgtctgtgacctgctttctacggcggcaa

SEQ ID NO: 1579 - DNA, 1068 bp, Zea mays
  misc_feature (1)..(100): optimal_loci_119006_G1, chr3:167069322..167070389, Cluster 10
catcgtaattcatttacttgtttatagaaatgttggtcttgtgagtcgcgggcgatccacttgtgcatgtggcgtgtcgtgcgtggaggagaaggagaggacacactcacacagactagctgctgtacgtgtacgtggagacacggcgggggccgccgtgcgccggcggtgggagcgggctctgacgtggccggataagcgcgggccgggagggcgcgagcttgtggcggagaagcggcgagcgccggcgccccctcgtggcgtggcggggcgcatcgtcctagctagcagtcgtgtcgtgcgtgcctgccgcgcgcatgtggcgcgtggagcccggcgcggtcgcggtcacggccacggcgaggcgaggcagcaccggcagggaatctgctgcacggcacgggtgtatattcttgtacatgtgatgtgggttccgcctggtgcttccattggttggagttggacgcagcggcctctccctggccacgattttgatccccctcctcttgaagcgctgtgccggccgctgactgtgacgctatgccagttgtgtgtgcctcgctttcgccctactgctgctgaaggaaggaagatggatggatggatggatcctgcgtgcagggacgtgtgcaatctgctgtgcgttgcagatgtgcagcagggatgcattgtatgcgacgaattcgatcgtctgacgcatgtggcaaaaaccaaaaggaggcggcgcggtcggtcggcgacatgcacgtctttctcacgaatttggacggataagtcctttttttcccctccgtttcacgaacaaagacttttcgcacttatttgcgccaaactgtgaagtcgcagtccacctccgagaatcttattaattattattattacgatcgtggcctatatacctagagggattccacgccgattcttttctcccctcttttcttttggaaaaaagaaactgcaaaaataatctttggccaaatttattgccgggtcgttgtcctctgtccggcgcgaagatgctgaatttgctggaccaccaagtccaccatcccgctaactgagagtcag

SEQ ID NO: 1580 - DNA, 1164 bp, Zea mays
  misc_feature (1)..(100): optimal_loci_119971_G1, chr3:173374521..173375684, Cluster 10
acggccgatcgcaatgattaaagcgtcctctggaacggcagcgggactgacccggggagcagcgcggctttctgctgcgcattcaagaaaaggacccctggccctttgccgcctgtgtcgctcgtcctcgtcctcgtcctcgcacccgtcggtgtggtcggtcggtccacggacccatgccgggccatcatttcccttgaggaagacggagcgagagcgggctgatgggagtggagggttgcccatggaccgatcggcggcgactggccaactgggtcggatcatggccagaaggaaaacgagggggggcttggtgtcgcggtcaggtcttggaagaacaaacgaggtgcgcgtcggtctgggttgaaaccggaatttggcagctaggcaccaaagtttcatcatgcctttcttccctggacaacgagcctcatgatgtcagcggctaaaagaacccggatactgccgtataagtctggatacgatcagattatatggccgtgtaaaacactcattatttacagagttgcgtgtgaaaaataaggataagatatgagagctactgaaaatagccttagatatcttcaaacaaatggtcattgttttcaggtaaaaaaaaaaacagaccataagattcattgcataactgctggacaaaaaaaaacaccaatccagacatccagggttgctctatccttccttggcagtctgagctgccaaagctttgcgtctgagacacacgccaccaaagtttgacgtggatgtagaaccgaaaaccacccccatcgcttcgcttccagagctgccagcagcaaagtgctgaaaaatgtctcgaggggggttggtgccggccttcctaacgcagtgcaggtcgtttgaggtggaggctgtccaatggcaggtccgttgaatcctagtttggcccagacgacccagagagtcctggcaaaggggcgtcctgaaaccatatgatctgcggtctctacatttcgctcacagacttcacatcaggctgtgtcaaagatcttccgcatcaagttggcccgacgttgaactcggcgaaccacgagcaaccaaataaagaactgaacccgctttggagcgaagctattctacataaatcctgcgccaaggcgtccttaattagactttatcctcatcagt

SEQ ID NO: 1581 - DNA, 1282 bp, Zea mays
  misc_feature (1)..(100): optimal_loci_119993_G1, chr3:173523656..173524937, Cluster 10
gatcgtcggactgggcagcccgcaggccgcagccctcgcctggcttgtggcttcagaaagaaggaacggaggagccgacggggctttcccttccctctttgtcatgttctgtcagataagataagcgatgctacgagccgcccagatgttttaaagaatcacatttttcatgtaaaaccaggtttgcgttaatattatgaagtttttttatatataaataaataggcttgccaactttgccgtgtaactttagacatttagtgtcggttcctgagagagttccatggatgtgcaatcaccatcggtcctgcagaaccgacacgggctgtggggggcccgcccgactgtactggattcgccgggatccgaccgatcgggcgcaggtagctttcagccaagtgcatgccaaaaaggcagcaaggatgtcccaattaagcacgaaaaccaccgccgagcgcaagcaaatgcactcacaccgccccggggggcacactgcatgctagcgcgacgcgaccgtcccatccggctccgactccagctccaatcccatccatccatccgcccagcagagcagagcagagcagagcacgacgatcggttggtgcgaggtgcctgcctggtgcccgggcgcacgcggcgcccgggtttggtacggggtcaaggcctcgcaagctcagcttcgccgtcccgtgaccccgccgggcccccctcgcgcgggcacccgggctcccaccaccacgcgcgcggccggtgggcgcgagcgtcccaacaagggagcagacgcgcgtcgcgcccgtgctctcgccctcgcccgcctggatcacactgcgcgctgaccgtgacgcgcgtaccaaccgcgcgcgcggcccggcctcgttcgccttgggaacgccgaacaccagccagtggtgtactactactggtgtgtcagtgtgtgtgtgtccagcctccagcgctccctcctgcctgcaccgtctgcctcgggccctcgcccagctagctgccgcagtgccggaactggacgtagcttggggtaggtgcggagtctccgatgctgcgctccccgtagaattgctgtcgtttacagtaggttggggttggttggttggtgccatgtcgtcggcacgtacgtcggttgacgacgtgcgtggatgcatgcgtacaggtacccgtaccaactaccaaggcatcaaggcctaaagaattgatcggtactggatcctatgaggaaggcggaatggtccgtgcccgtacatggctgtggttcggccccccggcgagt

SEQ ID NO: 1582 - DNA, 1077 bp, Zea mays
  misc_feature (1)..(100): optimal_loci_120436_G1, chr3:176262096..176263172, Cluster 10
ggccggcatgcagggtgtacatcctggcatcagctcgggcaacgacggccgtggcacatggcgctcacgcgacgcgcagcctggcgccaatggatttctgctgtgaagtaggagtatattggttccaagttgggatgctacattgctacctgctggcgggtggtggcgaccgtctcgaccttagctttcctttctccgggccagctagttagcttgagtggcttgagtggccggactggaccaacaagtttgaccgggcgcctgtctcctagcgcctctagtacgtgtgcaccagcaccatcctcctctgcttctcgctccatggaatttaggcattgtccgtgtactgtgcgactactagtctgtctacttgtaatccaaatctcaacattttttttttgcgaccgtgccaatgacacgtacatcatcaagaatgagtagagaaaaaagattacagctctttatgaacagtagctagcatttagcaaccgaaacgaggacccggaggagcagaggattgcataaacgcaaaacaaaaaacggcgatgattaataaatctcaacttttgggcgctggaccttattaaaaaaaagaacactttgggtactgctggagcggttacccatcaaccgagatgcgcggtacacaggactttagcgcaaaaatgaaaatcagtggggctaatcttatcagtatagtgcaaatgtgcaataaaaaggagagcctaataacaacaataatggtaaaggtaagtgcggtgacgggtcagcatcacttggtgccaatgccggatactttttcccttttccgccttcaactcggagagcaaatgtttttctacggtaggtacggtacgtacgtcggtagctttggcttccgaaacactttcatggatatttagaagcgcatatatacatcgaacttatgcgggcaaatttgtctgcaagtactgtacaaaatatagctaggattgtatcctaatgctgtccgtaggacgtaaacgacgtctcaaaagataaagatatagtgcaatgttccggagcctatcaacatctaatacacacagtgcgtgctta

SEQ ID NO: 1583 - DNA, 1013 bp, Zea mays
  misc_feature (1)..(100): optimal_loci_120513_G1, chr3:176560757..176561769, Cluster 10
aaaggagaataatgacacgtcgaccctgactgagacaaaaaaaaagacatggataactaaactggggccgtcccaaactaaaaaaaactaggaccaaaccgcccccatcctctccctttgcgagaaccaaacccaactttcgttccacttcagtggcgctggccgctgggaccggaactaacagagggttagactagtaggtccagcgttccgatccagggccccatcctccagccttgaaatctcaatcacacacagcgctacatggcgaataactttccaataaaggtgtgccagccagagacaacaaagggccacggatattcgtcgatccactcgtgcgccctctctcgtgcaaacgggctccatgtccccgcgtgatctcatctgatcgatcaaggcgacgagacatccggttaggtgagggcatcctccactccactgctacggcaggccaatgcttgcgattcaacctgccgaacaacacggcgacgagcggtcaacaggcagcagcctgcgcgcggacggacagtagtgacgagactgggagctctgtctgaaacgtccgcagcatgcggagaatcgtgagatgggtccctcgtcgcggacgacgcgaaaaatgcttcgacggctctgggtgatctgctggtccgttcggggccgcggcgcccgaacgaacggaaggggaccaaccgcaacagctcctgcgctgcagtgcaggaacgaacgacgggcctcaacaaacggggcgccaccagttgcctcacccgtcggccgcatgcatcttatcatcacattggctcaccagttgccaaagtgtcgcggcttggacgacgcagggcaggacctggtacctaaccacacgagctcgctcaggctcacagccgagagcaaacgccggatttgaactctcgttgtcagttgtcagtcacggactcacggtcacggtacggtccgtttttttacactaacggggtgtttggttactcctgctaaagtttagctcgggtcta

SEQ ID NO: 1584 - DNA, 1017 bp, Zea mays
  misc_feature (1)..(100): optimal_loci_1209_G1, chr1:6177628..6178644, Cluster 10
catgctagaaaccctcacatttatatccacacgtatctatcatttgcaggtcgtccacaagagcacagaaaaatgataaccaagtagtcaagtataaattccgatttatgttcgtatgggtctaaaggcggtagatgtgagggctgtaaataggagggtttgcaattgatatgcaaggattttttttccgactccatctgcatcactcttctcccgtttgccttccatattcttaccaaatcctatgtagtagcaaccgaatccataggaattggctcgccgctataccgctcaccgcatgcgtttcggccgttcagcgcgacaggttaccaaaccgggctgtggccgctggctccgtccgatgggcgcgtcccgcggctccggcacgacgaaaaagaatgggcgtctcagcccgtcagccgtgacccatgagagccagcaaagaacgcaagtgcgactcgatcctctcggcgtgtcgctctcgcagcagtggtgggacgcaatcacgccagcgtcagcgtcggcggctcagcgcgcatgggccatggcgtaagcgtaatgcctcaagacgaaacagtttttggttggcctccctggctgcttgtgcgtgtcatcacgtgtacgaacgaacgctgggcctatatatagtagttgccgggaagcacagtgaaagcatatgctgcctgtgcctttcgcggtgctggctggcttacgtggatggataagcgcaacgccagatggacgtgccatgtgtctggttgttaacaaatcggaggaagcggtcgcatactcgtgtggactcatggcgctcccccctctccctcccccttcccttttttcttctgtatactgccaggtccggaccggcataattcaagacccggtacggatttttttttctttgataaggatcaatgatatactattaatagtgactgagttaataagctctaaatttttttctttgcgtcgttacttcaaacatttctattgtacgtaggtacggtaataagctct

SEQ ID NO: 1585 - DNA, 1108 bp, Zea mays
  misc_feature (1)..(100): optimal_loci_121153_G1, chr3:180201194..180202301, Cluster 10
tccctctgatcccgacaagatttgagttcctaaactatcctttcatttccttatccaccaaaccagacctcaaagtaaaaaaaaaacgtggcatcccaaacctgttctggttactgactgaattcaatgctgtgtttactataactatgtgcggcaacgctgattatcaaacagcccagcttagtagcttacgtcaagattcgtgaagggtatccatccgccaatgatgtgagagagagggagaaggaagcggtgaatgcaggtggacacacatgccatctgcagataacactagagttacaacacagggtttttgtgagaatgtatttctgactgaattcagtaatacacttgcactcctccattgctagctcctaataatggcatcgcgcccaacacctcgcgttgacgtggttatacaaatcaccgccgcagattagcagttgcaggaggccataaacaaaacaaagtggtggttcactgaccaggcgagcataaagaagcatttgcgaaagaagaacctacaggcaaatataaagaaatgggtcctgccgctagctagggcgggagcgggatggcgtaattcacatggctcgaagtttatattatatactagtacttagattatggcgggatggcgtaattcacatggctcgaagcttatattatatactggtacttaattagtttattgctccactgcgcatctacacaaaccatgcatgggaaagaagttaaattgccggtcaaagcagcaacagcctaccagtagttagtaggtaggtcaggctcaggctacagcgaggacatgcattttctaaaccctaaacagtgactagcactctagcagtcgctaatcctgtgcgtgcgaaggcttatctataaggagcacacgcatcgtgcagctggagttttgttccagtcaacctccgctggggggatcttcgagacgcactcggagggttggccgcatttggtggccaccgatcgtagagtctacagagacatcggactgttttgtgcagttgacggccagaatggatgtgcatgtatggttagggttgaacgctcgatttgattcgttagtagctcatagggctgtttctga

SEQ ID NO: 1586 - DNA, 1226 bp, Zea mays
  misc_feature (1)..(100): optimal_loci_122051_G1, chr3:184676446..184677671, Cluster 10
ccgcggaacacaaggtcgatctcctctcgagcttacctgagtgaagaaggaccgacaggacgaagcctgggtactgatgaggcgtgaccgtgaccgtgatgataaagattaaaaaaaacagtgaacagctagatttttcttataaagggaaagcagtgtcctcctccgtaggcgtgtagacgaagcatgccatgtcggtcgagtgagtgcatatgagtacactcgggtttgcttttaatcacgggggattgagtactcctcctcttatgccttaccattaccacgcgaatttatatcgagcattggcagctggtgcagcctagtacaccaccctacagagagagaaaaaaaaggttaaagaaagtagtactcctgcgtgtgggccgtacgtggatcgctttcgattcactcaaaagcaacgtctacattgttagtatcactgtgtgcattgagagactgtgattgtgccttggggatcgccgggcagctttgtcgcgttgctgctgcgaagattcggagcgtaacgcaccatgtgatgtgtgtgattgacccatagcacacactagtcgtcccacagtccacagatgagtcacatatgtctaccgcgagaaatttatacgtacacaccccccgaagtgtgtgccctccctaactcgaggtcgaggatgctgtccgtgtcccgttccgttagctagtgttttgcttgccttacgttacgtgccggcgtggcgtgcaggtgcagccgggacgctgctggcgcatcccgtccgcgtgtggtttgcctcgaccgttgccgacggcggagggcagcggcccagcaccacccgagagaggcgagcgagggtagccgtcgacggctcaaagcacgcgccggcgctgctgctggccgccgcacagcaccaggtctgtgacgtgcgacacaggaaaggaactggagacacgagaaaaatcggtagcggtggggttgccgggtgtttcgttttactactcccgagtcccgacgggcccacgtgctttcttcttggctttcacggccacagcaagcgtcgatcgcgcagggcgggagccgggagctcgagtgcgtggcgaggcacccaccgcggccttgggctttgggccacatttattatggcgcatagagcctgctacgcccggcgaggacatgcccagatgctctagtgggtggtggccacatttatggcgcgccctgacactgccggcgcggc

SEQ ID NO: 1587 - DNA, 1270 bp, Zea mays
  misc_feature (1)..(100): optimal_loci_123391_G1, chr3:191777044..191778313, Cluster 10
aaaaaatgacgcatgacgaccgttgaaaccgatgctttaattatagtatagaaatcttccttaaatttagagaggagccttgacaggctcttgttcccaagtcccgtggtctgatgtcaaaccaaaggctgtggagttgctgttgtgcgtcggtggcttggtgagtgatctgggttgtctggtttggaggactgactagcgctgtcggtgtctaaacctgtcaaagtctctgaactgatagatacattgaacacggttcgtaaaacagattttgcgccatctcatcccgggtgggttccgaggtgcgcgtgcgcgtgcgggtccgtccgtcactagacatcgagtgcgccatcgttacgggtgctctgtattcagatttcagacagaccagcacagcacacaacatgagatgtttgctatcagattcagagctgcttgcttctgatcttttcgtgttctgtatccaccaccatggtcacggcgccgatctgctggctgggacagcagctgcatgcccactaggcacgagcgcatatctctcatcgcgcgccgggagaatcgaatcaagcaaaccccaaatcacagtaagctcgcatgcagcccagcctcatgctggtcggcggatgtgagggcctcaggatctctcaagtggcacgcgccaagttgggttgcacagcgcagcgtgcgggcctccaacagcgatagactggagaccggggaacaagagcgtgtgtgtactcgccgaggtggatcattgttaggtattcgggcgatcgcttttgcttttgttgctccccgaacaggatcggcggcaacgacacatggccgaggctgacgacgctgtgttcctgcccgccgctgctcgcagtctcagtctcagcacagtgcacagcgcacatcggcacatgcatgcgcacccacgaactggcgatcggagcctatcgtcttgggctgcctttctttgcgcgccgccacgcctgccaatcgcgaactcggcgcgtgcgcaagcgtgacggcacgagatcggccggccgatctcgccttcagttctgctcttgtagagagaaagcgaagggggggggggggggggggtgcttaaaataagtgcgcgttccctgatgctggttgctggctgcggccatcgcggtttcgcctgctgccagccaacatgctcgtgccatctccaatcctccaaatcagatctttattttggtaaacttcaatcccatgcatgactgcttgccaggcctgtgacgagtttgcatggaac

SEQ ID NO: 1588 - DNA, 1214 bp, Zea mays
  misc_feature (1)..(100): optimal_loci_124212_G1, chr3:196059336..196060549, Cluster 10
gtgtcgtcctcgctggcacgagctagcttttgaccacgggcacgcaggcaggcggcggcgactgggctgtgagctggcaccagcgccgccagcccgccacataagcgtggccggtcgtcgcagtttccgattggccagcgcgcagcagcggccgggcagagcgtcgctgtccgggtccaggcaccaggcggtccctcccttccgtggtcgacagtcccgctgcgaggcgaggtttctgtcctgcaggccgcggctctggggctcctctccccaggctgccaggcccccacggccccacctccttcggttactggtttacccgtcctcctacacttgttcgccgtgtgagagagggacccgtaccgcgccgtacgtgacgttatagatctgcggtgcagtacgtacgtctcgctgtaccacgccttcaacacgtgcgcgagcgcgaatgacagcctgttctatcgtctcttggccttaatcacggagccacaaaaaaaagttcattgctcctcggttatgaaatacatatatttctcaaactaacctaagcaaaatgattttgagtttgactaagttttgggaagataaatcaatcgacttctgaaattatcctacactaaatggtttaaaatcggaccaaatataaagaaaaaaatcaatatttatgacatccaattagtaccaatagatatgtcgtaatatatatttttgtaatcataatttgttcgtttgatgtcataatactgttagccttcattataaaattggccaagcccaaggtaatcataagagcagcactatagcttagtatcaacttcatgcttcatggtaatttactcccatagacaacatgacaatcgatatgatgcacacagatcctactcctttgatacaggtaatatttcagcgacaaatatcattgctcgattattgatcggcatatacaggcacacaatcacacactgcacgtagttaaggattgtgtggttcgaaacttcccaagtaaagagctggccacacagcaaacgaacgtctaggattgttccatcaaccaaacaagttcttcggacaattttactaaatcttataacattatcttcgtgattaccctgtcatataaataaagtgaaacatgaataaaacatatacttctcataaaagtttcgtcgtacgttttatataatttagttttatgactcatgaaaaattttata

SEQ ID NO: 1589 - DNA, 1349 bp, Zea mays
  misc_feature (1)..(100): optimal_loci_124257_G1, chr3:196353477..196354825, Cluster 10
atgtaaactagcatagttggttaggttctatgttatgtgtcacatcccaaaattggtttggttctgtttctcccatgcatggtcattccttcacatctcttcctcctccttcacacctccacatctatattttcacatgagaaacagtggggagctatcctctccacatatcatcctctcccatggttgcccctcccattccccttgcttcccctccatccctcaaaccaaaacagagtgtccttgttgtttggaaccaattttgccactttgttttccttcttgggcacccgacaaggatttggagatcctttttgctacccctctactataatataggtgatggatatcattgttgtaatggaggccaccctaatcaacgacatcatgagcatgacacctcattatgcatgttgtcgtcattggccatcatcagctttgtctcctcttactgccatcccctaaccctaggtgagtcccctcaccttccccatgttgttttcacattccttattgcatatcatgtgttatatatgagtttagaatgatccttgacaaagtttatctgctatatatgtttgtccttgtggcttagttagtaactgccaatggaaacaactatcagtgtctagggaggggtatacccctggatattggcaatactccttttgagaaatcgtaaacacatggaaactcattctggatctggttggtgccagccttgcaccattaggtctccatgccctcgagggccatgtgctgttccggccaagtttgggaccctttaggttaggggggcaaatcctagggtactctaggccaggggccaaatcttagggccctccatgcctccaagtccctctaggtcgggggtcaaatgctaggaccctctatgcctttggagtcctttaggtctagggtcaagctcctaactcagctaaatctagaggcccatacaagctagggcccacaaccaaagacccctagacattccttaggatgccctagggtgggaagccttgggaataggagggatctaggcgatatggctctagtgccacatgcacctctactcaagacaaccacatggtgcaaggtagacaagctttcgtccattgtatgaaatatgatagaagacgttgcgatgaagaaagtgcattgtcaccatgcttaaggttgcaggtgtactagtgaccactttgtggtatgtgatgttactatagatgcacctaaacatgctagcgcaccgtacgtattatagagaatagacaaatacaccatttaccaactatgttatagtgtgaaatcatttactttccactacgacatgacatacctaccactacgcc

SEQ ID NO: 1590 - DNA, 1191 bp, Zea mays
  misc_feature (1)..(100): optimal_loci_124986_G1, chr3:200696536..200697726, Cluster 10
atcttctcctctccctctttttctccttccccgggcctatagccttttattgtcatacttaagctgttctcacgggctgtagacgcgtgccatgccagtatgccactactataatcggccggccaattagacgcgcgcgcgaagtgaagcggcagtttcagacggtcgatgcatcgccatcgatgtttcttgtttctactgtgtcaacccacatgctctggtgcatccactagctgctaaatactcgatgaaggtaaaagaaaatccgtactttgcatgcctacatgaaagggtatacggatggagtagttattcgcgaatctgtgaaggatgctcttgtcgtaggatgcatgggcgatcagtgcggggcatgattactgcactgcacacaccacggccacagtgccagctactacagcttagcttctccgctgtgctcgacgacgttgtagcatgcatgcagcaggcgccacgcacgccacgattcatcggggccatgtgggctgtgcacctttggaggctctcacggtcgaaacgactcagcggcgtcgacaagacgtgactgtgcgccgtccggataccccggtgcgcggccggggccaaaacatcccgtcgccgtcggaccgatcggcaaaaagtgccacgtacgggggccacgccatgcttcgaaacgtcagctcatgccctcctcctccgatccggccttctcagaaatcaacgttgaagcagacgatctcacagcctcagcctcagcctcaggcatgtagctcacgcgcgtgatcgggcgcctgtcaatggctgacgaatcaccgagccgtgtagacttcacctgagccagcacatcagtttattaaccactgggcgattgcgcatccgatgctggtacgctgagtgcaagtgcatgagacccaataagcctggctagtggctacgtgccgggccggcgcgcgcgacggacgcgaggagagcagagcatcatgcagcagagcacaggggcactgattagcacgcgcctgggcgtgttcggcagcgacaagacgcgaccaggtttggcaacattctggccccgggggcgggggtgccctgacggcggcgtcacgtctcggtcgattgatcggggctcgggcgacgggacgggggccgggcctgggcgctagctcagcagtcgcgttgcgcgaaagccgggagcgc

SEQ ID NO: 1591 - DNA, 1301 bp, Zea mays
  misc_feature (1)..(100): optimal_loci_125235_G1, chr3:201995123..201996423, Cluster 10
tacgaactttacgaacatgtcactgctgccgaattggttcgcccacaactagcgagcgccttgtcgtgatgagctcggaatcgccgcacatttctctggacaccgccacgtacgctgagcccccgccgccccacgggcctccgcccgcctcgagctgccgcgcagtgccgtactgccgtgaagggattacgaccgtgacggcgcacgacacactgcacaagttgaattgaatttgaagaaaatacgaaccctgcatcctgctagagcgagctcacgacgtgcacacgtggtgagacgtgtcgacgggccagtggctctcctgtgaacagcgtcgcaggccacgaattgaatctctctgctcctgacaggtttttgaacttggacgtgtttgactcggagtcgattgctcaaatgatagcgcgcggataaagccgtcattggtggcggtggtaacccgttccgtgcacgccagctaagtagtactgcacaaccaggatcgatcgcctcttgcgttctactactactaactaccagccacatttttttctttaaaaaaaaggctcctggatttaggaagaaaccgacaattattgattggatcataggacgacaaaacgcggcagacggccactggtcgcgtcgtaattattgggttccaagcaggcaggcagcaggcagcctcggaatgcttgcttgattggaccagcattaactaaccggtacgtagtaatggtgttgttctgtcgtggagggtatcagcatcagcgacatgaaacgcgtgtggcatggcacgacgggatttgtgcacaaggacgacgccatggaccagtagttttttttagacacggggcggcaggcaagagaccgcgagaaactgatggccggtgactaggacaagaaccgatgcgtctaccgctagctagcgacttgcatcgaagaagcaagcaggaatgcaggatccgcgatcagatatattattggtcattaagtccataaagacattgcagatatgggctgggaaaacggcccatcttgttcgaaggacctcgacgaagacacgaacacgaggcgcacaacgtagaaaggcaattcgctgccgcctaaaattgggccttggctctctctctctctcccgcggcaccgccgctcggtcctccttttccctcccaagtaaacacatgttgtccacgtacatgaaacaaagattggatcgagttcattccaccaattattatggtgtttgagtgaataataatcttacataacataacagatctcgctgcgacttgcgagcggcgaat

SEQ ID NO: 1592 - DNA, 1380 bp, Zea mays
  misc_feature (1)..(100): optimal_loci_125753_G1, chr3:204465580..204466959, Cluster 10
tcttctatctgatcaacaaagcaaagcacgtacgggaatacgggattatataatgcaagactgtttgttgggttttaatctataccgcattatattgcttctataatattttgtctctgtaaatcgtagtccgaatagctggctcgaacaccctagcatggaaagggcctttcgctggcgagatatcgtcccacctttttatcctagcgctcgcctcgtgcatgcatctgatatgtgtatgtatattaattggatccacgcggcgccggtcggtcagcgtggctactgtcaagtcgtcgtcgatcgatcgatcgatatatgcgtgcgttttgcaaaagctgtctaggagcagccagcaggatgcatgagggagaaggagaaccctagacgacacgatggagacgcaccacgcacacgctagctcgctagctagtatagtggcgttgaggaatcatggcacgtatgattaagtgccccaaggcatagcagcgttgcatgcactgtacgtatgggagtttgggcacgtcctttacctactcagcgcggggtcttctctccctcatcgagttctcctcctgctgtactgtacgtacagtacgtccctctctctctctctctcctctgtcgttgctgctgctggctcgctactcgttcgtccgttcgtctcaaagagtcacagagggccgctgccactgcgccatgagagagcgtgcagctagctaggagggagaggccgagagggagagagagagagtagcacagtgcagcttgcatcacgcatgcacttttacagagcgcttttgggctaatagccagtacagccgagccggtgggtggtggaggaacggcatcgaccgaccgacgaccggggtaccctcccccccccccccccccaccccaccccacgtcgtagggcctatatatgctatgctgcggttgttgggctgcccgatgccaaaagacattccctttggggctgacccccatgcatgcaagcgtggaagcccgcgcgcgcgcccaacgacgacggcacggcaggcagagggcagagggccagaggctgccctgccgcgccccgccctgaattcgtgtcgagaacaatgcgaggcgtgcgccttgagaagaacaccggccggctccaaaaggcgcgtgtgtgcggccctcctgcagcgtgtttgctccccacatgcacgcacgcacgaatccactgctagggatagggaggaggaggactggcaggcagcagctctgcagctggtcacacctcacacctgctgcatgcatgcacgcacgcacggcgctctagcctctagctcgcccagtccacgacccggtaaatcggaattcggaacgcctacaatgaatgttggctgctacatg

SEQ ID NO: 1593 - DNA, 1027 bp, Zea mays
  misc_feature (1)..(100): optimal_loci_126676_G1, chr3:208825656..208826682, Cluster 10
ggaaaatgaactgatagaaatctaacaacactgaaaactgtgataaaattgggaaactaggaaatggccaccatggtacagataaaagattgaagaacaatgcttttgttggttacaccttgagaaaaccatgctgttgcagaggggtttgctttcaaatctagtacgagtaacgacaaagccagggcttgccaaaaacaccgcatgacatgcggttaccaccagtcaaggccccactcatcattgccatggtagatggaaaattgggcaatttcctaccaaaactactacagcaaccaacatttggctaaagatacatcattttagtgagaagttcatcaaggtctcatcacagccctagtcttaacacctaaacattagagatgaggccatctatggtgtatggcaagagccaaagttctcgagggcatttgataatgagttggatatgtggatcgttggtcatagtttttgttctttctttgcaaatcttctgtacaagaacttgtcatattggcctagtttgaggcttcttaggacagtcccaaaagtgtcgatggtagtttccataacattgattatcttgccatatagatgttttgctgacgtggaaaaacagttaaagaagataggtagatattgtttctcccctgagaaatgtttctcgggctccaacaggacaagaaaacacccatactgtgttggggcacccatgtcatttccatggaccaggggcttcattttgcaccacagcaggatccagtgtgcttttctcctggccaccttcgcctccctcaccccgagccatccatgacaatgagcatgcacaatcgtcctcccctgcatcattatcctgggcggagagaccctctttccccaactgatccccaaccaatgcccagctctacccccattgatcctgctccatctgcttcacatccttaatctctgcaaggatggatcaatagggaaagggaggcatggaacgagacaaaagatcgaagtcttctagctccagaagacacac

SEQ ID NO: 1594 - DNA, 1342 bp, Zea mays
  misc_feature (1)..(100): optimal_loci_126731_G1, chr3:209073940..209075281, Cluster 10
gtacgcccccattattgactgtgacggtgtgaccccgcgactaccactccaactcttgcttgcttgctagagactatagtacacgtactagtcgagatagtgctcgcctgctgtaccaactccctagctctagctgctggggggcaggggcaggggccgccgcagccaaccgtggcgcgacatgtgtgctggctccgacacggcggccgggccgccgggatgagcaagtcgtcgctccgacccgacggagggagtaagaaaacgcgcggcacgggccacgaaggccgactagtttaaagttttttacgcgcgccgcgcctacgacgtacgccagccgggacaggacaggaaccccaacccctgccataaagaaaacgtcggatagttccgcgtcggtacgtacaactcacaggcgatctacacggagatccggtgcgtcgggctcgggcagcgccgatcgatcccgtccccgtctccgtccagcagaagcttcgctggttcgaccctatagctgacgcgccagagcccagaccatgtacagatgagcgcgctacctgctggtggtggagggtgcatcggacactagggatggactgatgatggccgtgtccgataataaacattgcatcagttaatgaaaaaaaagaatctttagtcagttttagggtaactctgacaataccgacaatgcatgatctgcacatatataccgctatagtactacacaaataacaagcttggcgtcgactccgcatcagcacgaatagattcttggtctgatcacgacccatgagatcaattggtccgataataaatacaaacttaaacaacaagcttggcgtcgactccagcctggacatccaagagtactgccaggtcaaataatacaacgcggacgacattacaataataacgcgcaagcagatggatcgactaataaagaatatacctcgcaaatgaccaaatgtaatggagggatgacatggaccaaagccagatggcaatggagtggagaacgtcttgtcatcaccagaagaaccgaatcgatggctctgcctctgctatgtgaccaccatgcatgcatgaacttggcgctaaataagcaggagaatctgtccccatcaaactccttagaggagacagcatctaccccgcgaatggtcgctcttttttttggttctaatccgagtttattaataataatgggttagcgagcaatcagattggaaaaaataatggatcacgcctcgcgtgccccggccccctagttttaaatttcatctgagtctttatatttcttaggacttgttcgcttctaccttaatcaatatgaattgaggag

SEQ ID NO: 1595 - DNA, 1215 bp, Zea mays
  misc_feature (1)..(100): optimal_loci_127197_G1, chr3:211530754..211531968, Cluster 10
tatatactaagcaagatatgtcgtagacaacctaagttgagcgggaaaatctatgccacaggtctctgaagggagaacagactgacattaactatttttttttctgtagcacatcaaatgaaatttgacgtaacaaacgaatatggagcctttgttttttcacgtaactgctgaagctttcgcgtggcgattattcgttctcctatcatatacaaataatatacactgtcacgtaccccgtaggtgaacgtcgatgagcatggcgcgctattgcacgggttgttgaaacagtgggaggcgatcgattttgtttaactcccagcagaaaactagttaatgaccgacattatggtacgtataacgaagacggaacaccgtgagatccatctcagcgtgcgtgcgtacatgtacgtcctggtgttgcatgctgctacatctacatgtggatgcacatgggaccagatcagaagaagttcagaacgaccatactcagcctgcaggtggacgtggaaatatggacgtacgtacgtgtcgtgcccgcgtgcgggtgcgccccgccacagcctcccggcgccggcggtatccgtgccgacttgcattgcatgcacccttggacgtgccgacgtgcgcatgcaccatgcagccggcaggcagcagtgcagcacggccgatttctcgctttctcagtaattattcagcagtgtgctccgtgcacgtattgtaatttgggctccgcgtacgctgccttaatttggagcgtcagttacatgttgcgttcccatgaggaccgtctgtctgctgcgtccagcagttcctcgaataacgtttgccacgaatttgtacattcgcgcggggcatgcacgttgtgtgagaccgtgacgcaggcagagataatcccggccggccggccggccgctccgttcggatcgccgttcatcacgctgcgcagtcgaagcgagcgatcggattccagaaggaagaaagaacccgtcgctttccggcctcttccgtagcgtttgaggcaagcgactgcgcagtgcgcagcgcatagccgccagcccgccacacggcccgcaccgctctctgcccactgcctgcgcacatggcctctccctccgtacgcctcacgtggtgggcccctgccactgtatcttcttcgcaccgcaccgcagggggtacgtcccggcctgtgcccgggcccagcgtctgcatgcg

SEQ ID NO: 1596 - DNA, 1006 bp, Zea mays
  misc_feature (1)..(100): optimal_loci_127627_G1, chr3:213609483..213610488, Cluster 10
ctgttacaaaggttacagcgttttctcggtttcaaacacgcgcgcgccgacagcgcgtgggtttgctacatcattatgtccgagtgcaagattaataatacagcttgttaatggctgtatatattattttttttgcaggccatctcccagtcaacttagttactaataatatatattatgtttttttctctaacgaagttttttttttctacgtgtaacttagctgtaaatttgtaatctactttccttctttatttactttttctctcttcttcgcaccatctttcagctttttgcatagtttagtatttttttatacctgctccaataaacggtaaggtgcgagtgtccagagactgcgagagttaaagatgggcgatagaaatggggagcgtaaaaggttgcaacgcacacagcaaacacctatgccctgcaaggctgcaacaacaatagcatgtgagcacacagaaggcgatggtcccgtccagtgtacgtgtacagagtgatgtctgcggtcacgcagcggcccgtacacccatgagcagctccgaacttgatgcaaaaccagtggtgcgcacttgcagctaaatcagtgggtgcatcaatggtaacttcgcgagcaagagttcgtggactactcatagccgtacacggcagtggtgctgacaggcaggagacgattgccgggttgcgtaattttcggagcaggcggcttcggggctccggcaggaatgagcagagcagatggggtagtcgatgtgcggttttgctgcgcaccgacgctttcggccgggactttactcgcgccggccatcttatataaccactgctctgttgatgatctgagcacggggggcgacagacgcaacgtacgccagtcttgatggagcgagtacgagaagccatcgccatccgtggccagcatctgttatgctatctccaacaccttactctacatcatctcttatttaaaatcctacctatataaatttacaatacaaaatgg

SEQ ID NO: 1597 - DNA, 1206 bp, Zea mays
  misc_feature (1)..(100): optimal_loci_128077_G1, chr3:215476120..215477325, Cluster 10
tttgcacggcccagcgctagctgaagctcattgtgctgcccggtggacggaacggaaccggcgacgtacatgtacgtgcaaggttgacacacttgagccttggcatgctgccaggatgtgctcatttggcgacatcataagcacatgagatcgctagctagacagcgcgtacgtgacggcgacaacacaaaggtaagggaattgaaaatgcaaaagctacaaattaaactggtggcgtcatgcgcgttttccctttgtcgtgcatgcatgcatattttggggtagcagtagtagtaggttcatcttacctgcactaactgtaactctgtgagttaggttcatcctacctactttgggtccaaagtcgtcctggacttggaaaaaaaacgtttgttagcaggtgtgtgtctgaaagctgaacagataaaccctcgcagcatttcacggcaccgagccaccgagtgcgtgtgtacgtgctgcttgacgagaaagccacaccgcacaccagaagggaatgaacggaaacgaggagaagaccgaccaaactccgacgtgaggtgttcggtgtgtcctacttgtcctcgaccggctctgcactgtgcgtgcgtctgtgcgaacgcgtggagcacacaggtctccgccgttgaatcgatccgcgacatgagagaggagttcccgccgcctcttctttctgtgtcacgctacccggccggtctcgtaaatccgccggttcactctgctgacacgttctggtaaatccgccggagacccgtacaaacctacgcgtgcagctagcgcgcgccctttccgtgttcctaccagcgacagcgagcggcagccacacaacgtaaacctagcacaattgcacagacctaaccttgtatctgacactaccgaacacgtatgtatccgggacagggtcgtctgcggatggatagggaagagtgctaactgctacagtagcgtaagagctgaccggcccaacgtgcatccaagcgtacgtgcgcacatctttaatccagaatgcacgcaaaggggctccagaaaccccctgtattgtacgagtcgtcgtctgacaaccggggtgattatggtaatactattttgtttgcaaattcatgtggcggcgtggcgctagctgcaccggcaacgcattgacactcttccggtcttccctgagcgcattgacactcctccggtcatggt

SEQ ID NO: 1598 - DNA, 1137 bp, Zea mays
  misc_feature (1)..(100): optimal_loci_128232_G1, chr3:216468326..216469462, Cluster 10
caactttaacctcaaaccaaacacaccctaagaggacaacagtacccttggaatgaagagggccgtttggcaccaaaaaaaaaaacgagagcgcttctcctacagtcgtgagtcgtactactccttgcagcggaagaaaagggtcgtctgaccgcctggctttgaccgacacgggatattaaaaaaaaatgtggagcacgatacttgaggcacaaagcatcccttaaaaggtctgtaaacggcctaaacggcggcaatcaatccgatcgtcatcgatcaaactttccagacttgtgtaccagcacattattatgaggagtgaagtgaccgcgcggcgacaaggagtgcccccctgatttggtggcctcgagcacctcggtcctaaacatcagcgccgaagcaactaacgcccctgggatccgtggcgtggtgggtatgggtcggctgcacgcctgcacctgctctgcacagcatcgatccctacgcgacgaccgtactctccactccagtccgcagcgattatcggcgggactcccaacctgtgctatagcgtatccatgatttccgccgtcgtttcactcgctcgtgctcgtccatccacccgtaaaagacctgccgcgcgacctaaaagccgtcgtctcacctctcacgtttcctccctccggacggggggatccattgatggcagcagccagcatggcgtgaacgaacgtgaatcgaaaccgaatgcaccccgtgtgcaacgcagacgcagacgcagacgcagacgcagtgcagtctccccggccggacccggacacggccggccccgtgacggaccggtgcgagtcacgcgcggaccaccacgcgacgcgaccaagattcacaacgtgcagtgcctgcctcgctgacaccggccagccgggccagccagaccagccggcccagagccccagaggcagggccatggattggaagcacagcacctgagagtccgtgcgccttgcataaatccggccggctcgtcccctcctcccctggccgcggccgcgcgacacccgccgggccctctccacgcggacgatcgacagcagcacggccgcggaggcggagtagtttgcatgctacgctccacgtgatctctgctgagagaccgta

SEQ ID NO: 1599 - DNA, 1155 bp, Zea mays
  misc_feature (1)..(100): optimal_loci_128488_G1, chr3:217576424..217577578, Cluster 10
gtaagaagagttttctattcaatagttttgcatagggtctcattttccctcggcacggccctgacgccaacactggcgaacaccatggggcctggcccgggagactgggggccatgcctggaaaagacacaagcgaacaccacggcgatcacacacaagcctgtggaacggccataaattcgtaaagtgactggaggtgcatccactatccagcgaaatcgccggcgatgggagctgctgcggtgcagtgtgcagcgccggaaagcgcggcccagcactcgatgaatcagtccatggcgcgaactttttacagcatcggttcggtcctggctgtggctcccatcttccaggcctcctctccaggctaccggtccaagaagtctacagtagtagtcaccggtcaaaaaaactgcaattatttggatggaccagaccagaccagaccagacctgtcgtatcgtagtagtagtagtacgtacttactgcacaacgaacgcctccggactcccgggtccaagtcgggacaggaatgggtttctgtcattctgcgcaacactcctgcatgcgctgcacgcacctgtttttttttaactttttaaacacccgcttgcagagttttacttaagtactaagtacagtactacctaatgggctaatggttaagaaagacgtgacgtgatggatcatattcatacgtgactgaggacttggtggtgcgtctggttttgttcgctccgcgtcacgtcaggtcagctggaccgaacccgtcctagcccacccggccctgtttgtctctgtctggacagaggcctagagggtggcacggccatgaacttttgggccttttgggcttcagggcacacagcggatccggcacctctaaggccgagtctagcacattgtacctaagcatgtacaaagcactattttacactacaaataatactgtttatatagtgtaattttaaataagaggtgagatagaaaactagacaggagagctgctaaatatagcctaaaacatagcagactttccgaacgtagaagccgctgggtcctccatcgtgcatccaatagccagtgcagcccaatatttaaaaatcaatatgtggaaggtgattctaaagttaacttaacgaaggcagttccggttgg

SEQ ID NO: 1600 - DNA, 1098 bp, Zea mays
  misc_feature (1)..(100): optimal_loci_130128_G1, chr3:225830670..225831767, Cluster 10
tgcatgtccctctcgcgcaatagcattagcatgggaaatgccaagaggaagacgagaatcttgagaaggcaagttgatggcacaaaccgacatgtcattgagattccattctcggtcaattggccattggtgggctcggaggcatgtccctgtagcgtccgttcacctttcagcattgcgtgttgtgtgcgctgcgctgcactaaacccccagtacacatctacaacgggccccgcatgacagccgcagacacaggcacacaggacgacgattccaccagtgtgtttgtgtggctggcgaccatttcctcctcctccacccggacgggattgcttgcgagattctcccacttgactgccgagactggccaagggaatgcaatccaccaaatgacggcagctgacaacgacacggtttgaaaaaaaaaaggagcgaaaggagcttcttggatggcaacgccggttactgatggtggatgaaatgaaacgagagccgtcattcgggagaaaagaaaatcacgctgtgccaaaaagaagtcgacgagctgtcacgggcccaactgtttgatcgcgatagctcttttgcctgtgtgttggtgcctggtggtcctcaccttgtcccaaatttctttttagcgatttgtacgctctgacaacgacgccttcgctctagtttatcttacactatcaggcgccggctgtcatgggcacacaagtcaccaatgtccactggctgattagaatacgtagcagagcaaacttctccttgtcagtggatcgagtgaggaagtcttgtcgtcgtaacaagggaaaacatgtcccactcagaatatagcctggtatgacaactttctgcaatgcaaaacgtctggatgcaatgaactctcttcggcgctacttgcgacgaagaggaccgcatgctaccaggtatcatcagggagattaaaggaccacatcattatgaaggttagacatgcaacaagattcttcaaaaactgtacaagaagggatcttctgtgttcgaatattctcgctgtcctagtaacatctgtgatataaaatgagcattttataaatatatattttatgctatatgaaa

SEQ ID NO: 1601 - DNA, 1000 bp, Zea mays
  misc_feature (1)..(100): optimal_loci_130272_G1, chr3:226773985..226774984, Cluster 10
ccagcaagcaagcaagcagcttcgctttttatccgcaccggccatggccaacgcgacaaggccgaccacgacgtccgtctccttttgtgtggcttgtgggtagccagttagccactagccagacagcccccggctgcccttcggtcgtcactcgtcaggcacacggagccgtgacggaagacaaccgagcgtggcgacgtcgcatcgcatgggactgacggacggacccgatcgacggggcggggcctccctcgcttcctggccggcgcgccgcggcacggaagggaacgtgcccgtgccagtgcccaccggagagcatggctggtctgggggcgaggcttttgtctcgtggtagttgcgtgttggtagacagagacgggcagacggcatgggcaccgtcatttggcacgacgcttggacccaccgtcctatgcatgcagcatgcggcgcgatggtccagtccagtccagtctcaataatttttcgtgtgtcaaaggccgacgaagattagaggattctagctgcaaatctgcaagagataaagaaaaaggtgggagaagccatttcaattttgacaaagtttggcctctgtttcggcttgagtgctcggccaaatgttgcatcgtgggcgcgcctcgcgtgcgccgtaggcctttctggcccagtatcctatgttccttacctccatgggccgtggcctatgttgctacctctacggtgcttgggccctagcgtcacgataggctcgtgccaagtttgggccctcgtcgtgaagaaaggtccttttcttttttgttttctcaaaaaaaaaaaagtgcgtagacaatcataaaaatgccaaactacttttgttgcgtcactctaaactagatctacacagtagatacataatgctatatgctttagcgtaacctaattggtgtagtcgcatatctaggtgttcttgataaattattatatgatgcttttatttaattcgacgttgaatatgcatggctag

SEQ ID NO: 1602 - DNA, 1314 bp, Zea mays
  misc_feature (1)..(100): optimal_loci_132101_G1, chr4:3739362..3740675, Cluster 10
gacaagcaatctggctaggaatagttctgggtggccaatccccaagaactgaacatgccctaaaaattgaaaatgtaaaaaaaatcccggcctttctgctaccctcctgctgtgtcaatggagaggtccgcaataatttccaaacgctgggcacgtacgcctttttttcttgtttggttcactatgccatggttgatgcttgcccttgtcctgtccttgtccgcaacgcaagcaacagttccaagagagggttgcgataccttgcccatgtctgcaagccatccccggtcccaatcccaaacagtaaacactgcaggcacaagcaaccggcacctggaaagagcccagagcctagcataaatagcaatgcttgcgctccggcaggtgcagaaaaaaaaaatttgctgggcccagattttgttcaaaggttgcaaagctgtgctgcgactcgaaagccatgacagcagggctctcgagagttccaaggccgactgcgaggaacatgactgatttggtgatcaggaattattataaggaggaattacaagggtgacataggattccttcctataaatcctctgaggattcatgaccaccaaatcagccgttaatgtgtttatttgtctcatatgagaatgtaatgtgcagaatcatcaatgatgatcatgacatgatcatatatatgctcatgcatgtatggtgcatgcatatgcgcattattctggctgttgtactctttttgttctgtccatgcacgtacaagatcagaaacattccgtgcaagtttgtttgtcgatctggctttcatggcgccaagttcgagggctttgcattcaaccactgtgactgccgtgctctgctctgctctcagtgagctctctctctctctctctcacacacacacatggacatgggacggctgcagaactgttgcgagcctgtcccctcactctcatcctcatgccatgtgtgttgctgttgcaatgctgcagccagcagtggtgagaaaaggagttttctttcaccggggcggcagcaaactgatgaattgagcacagctgcgactctctgcctgaaccagcacttggatcgtgaactgtataaccactgactaaacctcggcaacgaaggcgacgcaccatctgcaaacgcatggagaagtgcctgtattttttttttttttgtggtgtgcagtgcagctgcagctgggatctatggacaggataagggtggttaataatgtttaattagtcgtggaacagtttggtgcacatctttaggggccgttcgtttttttcccgaaatggaggcatt

SEQ ID NO: 1603 - DNA, 1249 bp, Zea mays
  misc_feature (1)..(100): optimal_loci_135697_G1, chr4:20176047..20177295, Cluster 10
agtctttgagtccatccataaatatgaggatagcacaagataacgaaaatgcctttctagtgaaattaaccccagtaatcagacttgttttgaagttttccaacttccaataaagcagctaggcgcaccagcccaccgccgcgccaccaccactgccatcgtggggggcccaccgctcattaactcctcgcgcaataaaagacacgagcgccgagtggccgctcccggccggcagccgcacgtcgctgcccaacccaggtccaccgcgcccgtatctaccctcccacctgcacgcgcggccgttccttattcttggcccaccggtcattgcacaacccgagcggagcgtaagtagatcgccggaccagcacttgtgcgacaatgaaggaaaagaccggggtccgcgcggctgcgaatggagcctcagcacgcggtccgcgtcactggcaggtggggaccacggggtccatatttctgtgggaccgcacggtcagcgaacgacagtggaaggcgtcggtggaggaggctgggcccggtcccggcggcaggcgcggcacgcgcgaggaggaggaggaggagggggctgcggggcccgggtcgctgctcctttgacgccccaggtcgccgcgttcccacacctcggccgcacgtgcggagcgagctgccgcgcccgtgacctctcctctcggtcaggcgtgcctgggccgtcggtgggcgatcgaacagacgctgggacaggcagcggaacgggaagagctggtggtattcgtagggtggtatttccccctgccattgctacgggtacacgcctatactgacggtggggcggtggcacgcagcagacagcacggctttgggcctttggccttggacaacacgatcttgcctcactcattgcttctttcggtttgaatcctttcgggtcgccatcggatctgtggcggatctctatttgctggtgcatgcatcatgtgtgttctttctagtccgtttaagctctcaatgttggtgaagtataggttggttaaggtgtgtggttgaggttagtatatatgaacaacatctgttaccgatcgagaagtctctctcttctctgctgtgtggtttgaaatgtacttgtattttttgtatataaccttttagtatagtctcacctctttgtagagataaaaacgaatgagaaaattctcatgtcatcctatgcataagctggctgttgtagctcgtttctactatctctcttctcttc

SEQ ID NO: 1604 - DNA, 1246 bp, Zea mays
  misc_feature (1)..(100): optimal_loci_14037_G1, chr1:77149184..77150429, Cluster 10
gcccacgccatatattatatatatctaaaatgcccagttgtcccatggttgtttcttgcacgtaaatcctcccgatctgattgacaggtttccccagaattttcgaggtctgcagcttttgccccttgggaatatttttgagcccggcggccgcaacttggcgacgggcatctcgtccttttccgccgtccctgtgcgctggcagcttgcggctggaccggaccccccccctgccgcctcgttcctgatacgatgcattctgctgcgttccgccgcctggatgcattgcaatcccatcacgcctacggtcggaagagatattttctgctttttttgtactcttgaataaagtacagctagaacacgcccgcggtgatcgcgagtacgcccggcgctccgccatctcaggattttcgcgatcgagtacgcccgccaaccaagcggctcctatcacgccgccactagatccagcgccttcgccgtcgcggcggcgaccggcgttcgtgcaggcaggacaaggtgaggcaccgccgcgccgccgaagtcgcagagcaggcggccaagagggctcccccgctgctggacgcggagccgcggacggcatgatggtgagcgccggtccttggtggcttcttcgtcaacgccgcacggctcgcctcaccccaccccaatcttctccgtctccctgcaccaaaaatttcaaaaaaaaaaaagtaccaatagtgtttttgagagttcggggcgatcggttatagatggataactatcctactatgatgccactacgtctcgccatgtagagagcatgacccaccacaccgtcgcggagacattcgtcgtcggaactaaatttttcatgtcatacgcaccaactactaggattgagagatatagatgctagtgaacttagacgcagcaaggtggtggtgcaccgtcgagtcaaaggaagacgcgtggatcgtctaccgccatgaccacatagtgttcgccacaataccacgctatgtatcgtctgacatattggctagtcttcaggataggagaacactgttaaaagagtgggcagcaattaagcggatccacattggggtctagcgggtatgtgaggccacaagcagcaggtctgccgtgggttcgtcgctttggctctacatcgtatgacgactacaagggcatgtttgtggtggacaggccctcaaccgagaccaatgcaagtgctgcgacaatatggacattgggccattat

SEQ ID NO: 1605 - DNA, 1349 bp, Zea mays
  misc_feature (1)..(100): optimal_loci_155801_G1, chr4:151407646..151408994, Cluster 10
ccgtctggcaatggcatggtggtggcgcggcatagccagcccgagcgcccgaaggtgtgtccagctcatgcgtggtccgcctacctagcccgacgcacggccagctcgtgcagcacagcagcagcatagctggcctggcctggccaggcccagcccgacggcgttcgtccaacgcacctcaacatttttggtccaggtccacctactgtgactgtgagagcggcagatggggggaagatgcgtacaccgactgattggatatgtgtttatatatgtatttaagtatttgaattctcaaatcgatagatttatgcgtttgaatccatccatataccgcaacgcagtatgggttgccctccgtgtgcctccccaccactgccttcgattcaaatacgtacgaattgctccaacttgtacgattccagttccagttcaaccatgcatcttcgtcttctgaatgaagaggcattcatatcatctttgtggccccctatttaagccacattatttaccattctatatgcccctgcattatatcctagctatagatgtagcatttcgtggggatgaggtgattcggtaaagtggccggaggagtcatgaagggtctagtgtagaagctagcaagttctggttggaaccgctgaacaaaccagcctgataatttctgcatcgtaccttgcgcggacctactctgtttgttctatgatgccacatcgtcgtatgatttggttttgctttccattgtcaagcaggcaggtagtagagggctagaaggcaattgctgggcccctgttttggtggaccggttgaggcaattatgtagcgtgtttattagctacgtactgtagtactatagtagcacgtactctcactagtacaattttgctttgacctgtgtttagagataaaatgtgcttttttattttggtgtcaatcatttgtggtgagtgccgtcgcgcccagacctgaaatttcagtgctagaacgtgaccagcattgagcatttccagcaagatgcagcgtttcataagtagcttttgttgcacctcaacacatatccggtcactgtgtttactactgtttcctttgttttaaattatcggaagctctaacattttttttatcttatattcagatacaatgtatatcgatacattcttcgaaatgggaagtggtttcaatatactatcgcttccctttacagaaaacatatcgatacacattatatcgagatatatgaaaaaaaaatcatgtgtttaaaaaagttttaatagcttagaatttaaaatggagggagaccgagagcattctgcaatttggttgctcggaccagtagagatagatgt

SEQ ID NO: 1606 - DNA, 1295 bp, Zea mays
  misc_feature (1)..(100): optimal_loci_156994_G1, chr4:156971837..156973131, Cluster 10
gagtacttgggtgttgggtcaaccaatcctcagcacctgggtaccctttcaagtcaaatcagtgagctagtttagtcgaaaagataagagtaaagtacagtagcggtttataaatttgacacgttgtgtcacctaaccctccaacttaaaaaatcagaaaaactggtcctcgaactttattggtccatgcaaaaccatccaaatccgtatttgcagtttctagatgttcgtggaccgctaatgcactttaaagataacatatttcgtatgacactacatagtggggatttgggttcggcaggctgctgttgtggcggctggctggagcagctttgcacactgatagcttttgcaacaaaaaaccacggatcatatattattcatcgacgcgtctcagagaattccatagcctatctggcggcatttgaaaacgagatcttctagagcgtttgttgcgcgctccaacatcgtcggacgatcggatcggatgcttcctcgcgagcggggtgaaaggcgcgcgtgtcctgatagcgaaacgaggtcggctgtggaactaaaattaaaggcgccacgcatgaatcggggcggaagcttcaccgctggggccgagagaggagcgacatgatcacacgagtcgcgtgcttggaagttcttgccgcgcggtcaatcctcagccactcggctcaactgaggcgaggcgagcggcgaggattttttttttgacccgcgcactgaggtcgtgtctcgaaccacatctccctcgctccctgcactacgaatgtagatggacgggcctgtgggcaagttgccgggagtcaacggcctgttacgtttgctggcccgcggttaatggtgtagtggttattgtatactcttttcaaatttaagaggttgccaattctcaaaccctgcgcgtgtagtactttctctcgggagcgaatctagacaaaaacaaccatcgatgacatctctattaaattataaaatcattaacttatttaagtgctaaaaaacatatattctaacgaagattactaaaattcattggtatcacatgacaccaaaaaaagggcctagatccaccctgttttctctcggccatacctcttaaattccgtcaatgagttagatttatagtttaatctatgtcaaatgaagaaatagttttccattatttctcgttccgttattctcttccatgactactcggccctcacattagcccattttactaggagcagtactagtatgtgatgaattagaaattagagttcggtttactctcccatccatga

SEQ ID NO: 1607 - DNA, 1227 bp, Zea mays
  misc_feature (1)..(100): optimal_loci_157215_G1, chr4:158130203..158131429, Cluster 10
ggcgtgaaaatcagagcggcggtagcctcacataggtgtggtcagagcacgtgacatgtttctctactcccgtggattaggattagactggaccgagagtgtgcgtgggtgaatcggtcgtgacgggaaacattggttcacataccaggcagttagttttcgtgctctgtttaatattcgcggtgtgaaaggcaaccgtagccgagcaataagcatacaagggcgcatatgcaccaatattgcaataatatatacttgtaggcagctatagctgtagacatgtcaatttggcaatatagggaacacacccctacgcatgagagatgatatgcgtgcatgcaactgtctgcgtcgatcatcaacaataaagaaagaggaggagaggagaactgtagggcgagcaggagagagtggatcggaagaaaagaggcgtgcggcgtggaggaaggagttgaagtaggaagaggacgatcgacgagccgacggaggttgggggcgtcagcgctagctgtgcgtgccggcatgcagctgatgctgcgctgcccgttgatctgcccgacccgatggatggacgcgcgcccgctgatatatgaccgaccgactgaagtgaccaggcttccatcttcactagcttcctgctgcatgcctctctactagctgcctactttttgtttcctagcttccctggcccggccggccctccacacggatcgatatccgagcccgactcctacgattccgatcgatcctcccgtttttgtaccatttcgaaatcaactacagtgcgtagtacaagtaccagtctaccacgggagagagagagccagtactaccgtggcattgatcgtctctatatacgtacttggattttcgctctaacaagctgcgaacttgacgttaatcgtggtaggtggccggcaaagacctctccgatcctagctaggttatgagagcgtcgtcagagcatgcaatgcttcgtacgcatgcacgaggcgcaacgcgcaagcgggtggccggcaacccgtacgtactactgcaaggcaagcagcacaagcaacgcagcgcgctcagagtgcgcagagacactagtagctcgcgagcttgcgttgttgaccgcgtcgtcgcgaccgccaggcgcggccgacgcccatgcatggccatcaggcatcatcagtccatgcaatgcaacgcagggcactgatacgaattgggagaagaatccagagc

SEQ ID NO: 1608 - DNA, 1047 bp, Zea mays
  misc_feature (1)..(100): optimal_loci_158719_G1, chr4:166860977..166862023, Cluster 10
gcactgaacagatgtacccattcaattgtgaacgttagaggcccgaatgttacattcagttattgaaaaagtggccagaaactcaaatcaaaagggacttgaagtattgtaatatttatgactttatctctagagttaacacacaataacttcgttatatccaaatattaggaacctatatatatatatatatatattgtctcgagcatgtgaaaacagccttcaaagacgagtagacagccgaacacgcgagcaggaaacagacactgctcgtgtgctccacgttgcagaaggactgatgattgcttccctcccgtcccgtgctctgggccggatcgacctcggccagcacacagcaggaagattcgacggaaacgaagatggcgagcacgcgctatacccaatggagcgccggtcggcccctacctgtcgggactcgggctcgttccaaacgacccatgccgcacctgaccgtatcgtgcgctgccgttccgttggaaccggccggccaaagttgacgcgtcccacgacggcaactataacccgcgcctggcacggccagccagcccagatcgctatcctgttagcctgtcgccacctaaaacccgcccggcccacgagatctccagcggcgccatctcctgtgcaaggggcaggcatgtggccgtctctgtatgtaggtttatgacttatgagcaagctaatatacttgctactcaccgtacactgcaggcggttggacgtgggagtgagcaactgtgttaccatgtggttttgtgggtccttgctcgtaatgatgtgtctaatcatgtcccaaatattagtacttactgttgatgttattataacaaaagcactgccgtcccgagttagctcagcagaacgtacaaaaccaaaacccatttcacggcggcacagtgccacacgggatccggatcgccggttcacttcagcctggtggggcctccctccaggcacagccaggtggacaccagtctcgctgctatttttctagtccccaccacccgggtccgctccgctgtgccg

SEQ ID NO: 1609 - DNA, 1145 bp, Zea mays
  misc_feature (1)..(100): optimal_loci_161072_G1, chr4:181893404..181894548, Cluster 10
ctactagctagggagctagcacaaaggaagatgtgggttgcttgtgacgtcgatcggggtcggggcacaggcacgtgtgggagcccacgggccacggctgccttccgcgttgggcgagcatgcgcatgcaatcgggtccgccccatgcatgcagtaaacacgcgacggcgacgttcaacttggtccgatgccttgcacgttgcaccccgctctcgtgcggtcctaccacaccgttactactactatgagcaacttgccattggctacaacccgactctgcttcgaccttcgatcgcttcacagacagggctgtcagggcggacaccggacacgtacctgctatttaacgatcgtacaatgctaggaattaaggcattttaaaatttaatttaatgtagaattataatatacatatacaagtgaaatattaatactctgctactcacgaacttaacaaatatacaacatgactttgctgagggtccgagcacccattacctgttcctaattgccttttgccgtaccttctttaggctctggacccaccgggcaagcttatcaatctttaggctagctacacgaggatggatcacactcctacatcatgcgaatgcatgcctccatggatgcatgaatactatacatgcatgcaacacatccattgttgatgactttcacctatagtttacacaaccacccagcacaagtggcggattcgtgatccatctctggctggaggttaattatcttcttttttatcatattttccaaaaaaaaatccgcctctcctcttcctctttttctctctctctctcttcctcatcttcttcatttctctaacttcattctcttcttcctccctcccccttccttcctccactgttttctcatgcgcagggaggctgcagcccctctaagacccgccattgaccccgcgcataccacaaaaaagaccggttttggaaatggcagaggccagagggataggattcggaaatgaggtgccaaacatgcaccctatagcaaataggtctgtaataagtatgtggagaaaacatgagagagaagagtagagtactagcttatataacggggttagacacaagaatataaaaaactttgtaaaagagataagtcgagaatgt

SEQ ID NO: 1610 - DNA, 1035 bp, Zea mays
  misc_feature (1)..(100): optimal_loci_161722_G1, chr4:186051971..186053005, Cluster 10
tctaaccaaacggggcctaacttgtggcctcgtatgggtctcttgaagaatggaatgtaaaaatcctattttgggtaatttgcattgggagaactcattctgtgacgtacataaatacgttttcaaataagagattatgcactagcagaaagtaattttctctcttaagataaataagcaacgaatataactttttttaatgagctttcaacaaaattcttggaagaatgaataatgtgtgtgttgcattcccttattcctttaatttgcttgaccgagatctccagcagggatttgaagcgattgaagatgatgaaggacagacgacgatgcccaagtggattagcttttgtcgtgtgcaagtggcaggacagatgatgggacttgcttgccatcgagcggcatggctatggcggcgaggctaccggtgatgtgcatgcgctagtcatatatatataccgcgcgcgggccggggaagagacgactgcggctggatagatggagtttttcgttctttgtggcatgcggcacgtggcgcgagctgcttgatgcagaggtttgcatcggaggagtttgtgtgcttctaagagagcaaggtgagcggatcaatgctgcatctcaggaggctacgagacatcgggcttagaactgcaccgaagaaggaagaacaagctaataatgtggcaaataatttcttatgtggctcgaattgttgtcaagttctcggtgccacctatgcagttacgtacgtcgtcgtcgtcaagtatggtattggattcaactaactcttgtctaagggttagtttggaaagtcaaatctccttcaaatctcgagggggatttgaattcctaaactagccattaaggagagcagacatgcttcgactagagaaagaatctagcaactttgatccgttcagccctaaatctaaccgcgcacgctggcaaatttcctggatccagcatatgcccttagcttgatggtagaaagtttacagatgcgatggagaaccgacgcgtattaacagaggtggt

SEQ ID NO: 1611 - DNA, 1089 bp, Zea mays
  misc_feature (1)..(100): optimal_loci_162954_G1, chr4:191958011..191959099, Cluster 10
aacacgagaagcacatgagctcgatcttctctttttttttttaacagggacgctcgatcttctctttggcgtcgtccacactccacaacgttagaacgtgcgtgtcgttccatgtgcgtgcgtgcgcccacaaacaagcatctggacaagcaaagagtgcagagtactcgactgaagcttgctcgacactggacggaagtccaagcgcatgccgtggaacggagactgaccgagcgacgacgaccatgcatatgcatggcgtgcggtggcatcgctgtcagtgcatgcatggaagcaggaacgaatagtcggcacgcacacagacgacgagtcgacgacgacgacgacaacgatgcggccggcggcggcgactgactgcgtgcggtttgtaattgactggtgcgctatcgttgtgttgtttgttcgccgccgccgccgtcgttttctggcgctgcggtgccgccggtccgtgcatggctatagctcgcgtggcgtgcgtacgtatctctctcccgactcccgactctctgtggccggccgggggtctgcggtctaccatgcccatgttaccgtgcaattaggaaatatacagtgaataatgtcttgatttgtgccttcgactaaacagtttagagagctgaatgtcaaagacacatctccatggacgaaccgacgacctgaagacaagtggggacaacggggtttatttataaaatgtctccattttacagtgaagacaagtggggaccaacccgcaattaggaacgggcagggaggaggaaaaggtagtgctaactgcagtctactagtggagtagattgaaatgacaaggaaattaaagtgtatgtatatatattaggtacggtcaaagccttacacacgagggcacatcagcaccttctgtacgtcttctatactactagctttgtttagatataactgaaagttagttaaaactagcgctatctattagtgtgtattcaaacatgaggactagctaataggtgaactgttttttgttttaaccaagtctttgactagttgttaatcaaccataacaaatttagggggtgtttggtttctagggac

SEQ ID NO: 1612 - DNA, 1078 bp, Zea mays
  misc_feature (1)..(100): optimal_loci_168_G1, chr1:981361..982438, Cluster 10
atcacaaaagtaataatatatttgaactagttggtcctacaagagtattgtctaaaattatcttacaatttaataaaatattggagaagtgtatatatctttgtaatatggttagagagcaaattagttaaattaatgatcaaaatgactattaagggcacatacagacacagtgtatgtaccagtcgtatttattcaagccttttttacgaaaacacctccgtttgtttcgtcgtctgatgaagcgatgagcacgggctcgtgctcacaactagcagcaccaccagaagccacggttgtccaggtcaatattataagtgatatataatgacagtttgtgttatccttcacaaattttaaactatgtagacaatataaatagacaaaccactatataatatgtttgtttgtgttgtctatatacgttttctaatatatatacagacatcaattgtttgtgggctgtaaacacagcagtcagctaagtgtggcggtgatgattgcgatgacgattattaatccattgccagccggttcgttgaccgccacgtcaccgtcgtcgtcttccttgcgtccgtccgtccgtcctctccatcaattgcaattggttggaaggttggagagatttgatttgctggttgtactactgtcgaaccccagcccgtccgtaccctacgcatcttcctctcccatccatccactctttgcttcatcgatccccactgctgtgctgtgctgtgctgcgtagcttatccgaggggacaggtgagggagtcgagggggacggcgcatgaaagaaagagaccgagggggaggcggcgagagcgagaaggcaccgccgacggcgagacctaggatgcagacaaggccaaatccacatcgatggagccaagcccgatggccgttggtgttggcggcccaaagaggaggtggacgcgcagtcggaggcggaggtgcgtatgcccatcgtcgccatctagctgcgcctccttatatgcccctccggctccgattagcttacctccatcgatctccccaccatggacgccaacgccaatgccctcggcatggacgctat

SEQ ID NO: 1613 - DNA, 1009 bp, Zea mays
  misc_feature (1)..(100): optimal_loci_170952_G1, chr4:233216961..233217969, Cluster 10
cttttgcaccccctctcctcactaatgaaccacaaaggttgatgtcgcaatcagcttgatgcagtgcatgatcttccttgcttggacactgcctcgagtcaccggataatgcccattaaaactgtttaggtcttgttcggctgcgtctgaacgtaaggagattaaattctcttctatttaattttaattaaaattttttacatttaattttgactatgaatagacttaatcctcctcaatccctttgatctagacgcagccaaacagacctaagacgaccggtacatttatgataaggacattaagaaaaaaattaactgagaaaaggtaagggaatctatgtaaggtatcacatttctattaggtatcttagctgaccatttttttttctcttcggttccggtaagatgagggagctccgccggctacgctaaacctggaggagctgttgacgccgctatttgggggcccaagaaggcgccgatacgagcggccatctccaaccctttccggtgctctgctgtctgctcctcgctggaagtgaagagggcgtaccggaatattcagaaacgttccggagtaaaacatcggaaggcaccgcccgcgtttcgcctcggcttcggggctccgacgcgcgcgccacgttccgtttccttcgcttgctctgctcatgcgttttttgcttccgctgccgtgcaaaccgtttaaccgctaaacaacagttcttcaggtttttcttaagtgtttaggtttagttaaactctgttttgttaattctttttgaataaaacggaaaggaaaatacggaaattcgagtacagggggcatgttccctttggagtggacacacctttggcgtaaaatctgtactgctactgcctactaacgtgtccagcgtaaacattacttgatctgcgttggagaaagcagctcgaagccaaagctaggtacttggcaactaaaagattctcccctatatatatagcgcctcgtacctaaatacctaaat

SEQ ID NO: 1614 - DNA, 1012 bp, Zea mays
  misc_feature (1)..(100): optimal_loci_172761_G1, chr5:2256315..2257326, Cluster 10
acttctattgcactggccgcacagtggttttctagcatggcctactctaaccctctctacctgatgaggacaagcatatggatggatggatggatggatgaacctccttttttccatggcaggcaatggtggtggcgcctacacgcgaacgtttttaaaatgcaagaatgtagccattggagtaagtgattaattatccatacattctggggatcatgatttgaggcagccagtaacgagaggaataccttgccgctcttgcattgcatcccagcaagcacgcacgcactgccttctccggtgtccgtagtgccgcttcacatcaatccatcgccaagggtaaattttctatctgggttcagtcgttaaccagcacatgcacgttcccatacaatcccgaattaccgagtgccaatccgcatcaatttacatcgctacacgagtagcgtagccacccccaccttgacgagagatcgcgatcagggccaaagctgcctgccactgcaaccggtgaagagagaacgacgcattggattctgatgctacgagcgagccaggtttctagaacggcctgcaacgcatgcatccatgcttgctttggcctgcaaagagaacacacacacacacacacacaaaagccggtcaatgcatggctatgcgcgttctcggcgaggggacagcacacgattcggcagaaaacgtttcgcgtcgccgggaatcccccccgtcggcgcagacgcgcacttggcaaatcacaggcaagactcaagaggcgcgcatcgagcgagagtctgcttcgggctgaaaagactggcagttttttttttctttttttggtgtggacagaacatgttcttcgtcttcctccctccttccctcgagcgagagtcttcttctctcggcggcagctgcaggcctgcaaatggaggtcgcaagttggtaaacacctcgcaaatcacaaggcgcaaggatcgatcccggtgtcgctagcagtggcgcccctgccttattc

SEQ ID NO: 1615 - DNA, 1354 bp, Zea mays
  misc_feature (1)..(100): optimal_loci_173534_G1, chr5:6609408..6610761, Cluster 10
taaaaaaaagtgtgtgaaggcaggtgttgtagttcctgccgctaagtgctaacagttgctacttgcagcaggagtcatcaataatctacccacacgctgtagcgagccagatttccttgtcgatctatgggcgtatcggtcaggtttagcagggagtagtagtagtacaaagtagaaacgcactacgctaggcaagtatgcatcctggctgctttgagtaaaacaagcatccgttgccagtcgctaaactccacgcttggcaacagaagctgtgaccgtgaggaaagactgggactcacgagaccttctctcccctgtgtgtcacatgttgcagtcagcgtggttaatgttaataatctcgtctgattataagccctgcccagatgatctgatgtactagtactagtactacgtgcggccgcctttattccatctcgcagtttcctggtgagcccatgaatgcggctggagtagtgacgtcgcttgggctcgaagcatacgtaccgctcgctgtccactgcccgctgggccccacccgcgccattagttagtgcgacggaacggaacgccaccggaacgatctactaggagtctaggacgagttctgtcgagatgggtactactactctgaccgaacccgttcgcttggccgattgtgacgggcctttcaccgctggacgcctggaggactgccgccagcccgcgacgtcgcccactggcgcccgccgcgtggccgtggtcgtgttcgtgtccgtgtcgtcccgtcggatgggcgtggggtgggagtgtgggactatgggagggcgacacgcaaacaacacagacgggacggcggaggcagccagcgttttggcttcgtcctcagcttcctttcctactccgccgttgctcctgctctcgcggaatccgaggtcggaatgaagcccaacccaatccaccagacccgaacccgatacaagggtggcgacccggatcagattacgcgaatagtagtgccttgattaagtagtgtcgtgatcagtgtgtagtgctcgcacgctgtctactcctcgtgatcctgacaaaagggcgtgcgcggggctcacatgtcaggcccaggtatcgggacgcaacgcaaccacccacacagacccaggccgcgcatcgacatcgcatctactgcctactggtactcacaaacccgagctgcatgcgccactttctcagtctcagggccggggggtgggccccgcgtccaggcctttgagggcatctgcggccgcggccattggatcgaccaaaagaggcagaggaagagaacagcgaatacgggtacagtacagcgccagtacagttgattgattgttttctccaa

SEQ ID NO: 1616 - DNA, 1086 bp, Zea mays
  misc_feature (1)..(100): optimal_loci_174619_G1, chr5:13299668..13300753, Cluster 10
ataccaacgcagcacgcagagacgctgatcgcaagccgggattttgccgatgctggtgagaccgtgagagcggccatgttggcccctgttgagtgctggactgctggcccctgttgcctgcccaacacacagctgaccgatgcccttttcgtttcttacagattgggtggcctaaatagtttctgaccggattactttactaatttattgataaactttgatcggatagaacggtttcgagtgtaatcgatataaaacgaacaaggcaattgcacagtcccaactcagaaagccgaaccattttccattgttgtttgttgactttggttcaatataaacgcacaaatcatttcaacgaaagacgtactaattttactatcaacgtgatcgagtttgtcgaatctttaactttttggggtcctccgccactgcagtgcggagaatcaaagaccgccacatttgctactcttgtacgttccaaaggttggtatcgactcgttttcgtgctctctggctgcaccaaaaacgtacagtgcgtagaatgctcagcagtgatcagaccaatatatgcatcgacggttacatttgttttgttacggtttctcaagtgcctcgagatgcatggtattacctaaaagatttctgtccttagaactcaagcccgatcgacttctgtctcagaagattcgtacatcgaaaatcctaccaagtagatatatatcgaaccaaatatccagtgccaccttagcaaaagtgcttattagcatcttaatacagacatgggcttctccacaaccatagtatatacagcatggtcatctagcattaattgaagaccattaacacaacacagcaagtcaatctctccaaccaacttggcttcaccaccgacgacgaccgttaggaatacattgtcagttacctaatcagtaatcacaacaccccagattgatagccaatccggtggtgcgtagcttggtactcgcattttagtaagaagctttgttcggatggttattgttcggttaagatcagcggcagattcaggaacgagtttagggagaagctgattttctaacatgggcc

SEQ ID NO: 1617 - DNA, 1262 bp, Zea mays
  misc_feature (1)..(100): optimal_loci_174680_G1, chr5:13652873..13654134, Cluster 10
tgtgccaaggaatcttatgatactcccttgagaagaaaaaaaactggatcaacagtatttctaatcctttggctgctgattttaaggacgtaagctggagctgcaaatgctgtatttatttttttatacaacctgacgcagcagcagaagccagcagccgaacgaggatcgtgttcaaacttcagcgattcagtcagccatggttgccgaccctgtactatggttccgggaagcgaaatggtccggctggaccaagtggcacgagtacgacccccacgacccaagcctctcccgagtcccgaaacagagaccggggccggcgcggcgcggcgccgtgcgaccgtgtccattgatcccttcccagcttgcggtcgtgatcccctggccggacgccgggccctcacgtcgtccgcgtcgctctcagccgccatcccatgcagcgccgcaatgctgagagccgccgaccgcgaccagacccaccgcgtccaagcagctcccatcggccatcggccatcggcctatggcctatgccccggcgaaccatcaccacggggatgcgtcacgtactcacgtgcccttggtaccaggaaatgctgatcgatttgattcctcggaaatctgcagcatatcaagcggcaggcccaacaaaaccagtgaccgtgagatctctgtacttgcgaacccgtagcgtcggtcgccgggcacgagcaggaagacgttggagcgtttcatcaaccgtccggtcaggagcagaaatccaatcgggtgagtggaaggatgaagaagagggctccaattattcaagctgggcaggagttccgtgcatggggggttggatgccgctggctcacggcggtattccggtcacaggagtgcggcctggatgtggttttggcgccggcgataaactagtgccattagtggcggaggtctgccattgctgaagggcgggcggtgatgtacccaagcgaggaggggagctaacaaaaaaggctgagttggtacaccacaaacctttagttttggcgccggcgataaaaagagtgccattgactgaatgattctgtagaagtcgatacggaataaagttaaacaaacaagctattagatgatactacttgtattaaacttgggtaagtttgaactttatatacgatgctacctgtacagtgatgtatgtacccaagcgaggaggggagctaacaaaaaaaggctgagttggtacaccacaaaggtttagttttatgcgtgctcaccagtca

SEQ ID NO: 1618 - DNA, 1000 bp, Zea mays
  misc_feature (1)..(100): optimal_loci_174758_G1, chr5:14108767..14109766, Cluster 10
cctgttctcaaggtatcactaggggcctcaggcccccttcgagaagggctccggaccccctagcggtcctttttcaccttacttcatctgctcttgggcccccagacccctctaggtggactctcgatcccatgatgggctcctccagacaaccgttacgctgaccaccaagcagggctcatggccccactacatccgggctccagcataccctagcttgtcgggctcccgacacgccacgtgtctcggggcccgcgacaaccatggtcaatgggagggcttcaaactcgccgcctggctagccgtccatgccatggtcagtcaaggagttggagttagaagacataatgctcctgttcgacatggcaagtgcaactgtgttaacatcatgtccactctctggatgtcaggccctagtaatctggggagtggcgccagcgtggcactgtggcgacatgcacgctatagggcgcgccctggcacgaccactatggcaacatgagcgatactcgtcatggtctatcacatcatgggacatctactttatacatcacgatgtctaaccaccccggtcattcgtgacgtacgatacaactctcaggtctcatgtggtggcatgtagagcctgctcctcctgccatgttctaggttttcggcatacaggcacatgctcgacatggcactcgggatatccggtacaggtagggcatgtacctacaacgccactgacatttccacaggacatcaggctgacatcagcatggtttccataaatgcagcatgggacatgcgccagggttggccccacctaccagatgtgaccctcactcccttggtctataaaagggagagggggcctcccttaaggaggaaaactagatttaacacaacagaaccgaacacgcccaagttactctagggcttgtcttcttagacgaccccacatattttcactcttgtctctaactagccttctgtattaggacgtagccaatctctt

SEQ ID NO: 1619 - DNA, 1041 bp, Zea mays
  misc_feature (1)..(100): optimal_loci_1771_G1, chr1:9054000..9055040, Cluster 10
aagcgctgttttaatcagcaacggccacgcaaattttaacccttagtttctcctaaaatacatatcgtttgccgatggattagtatcgtccatagacctgctaaatacaaaatgtgctgatgtagttttttcttctgttctgtcatgaactatttggatagctgttagtcaaagtttgtaaaaaaaaaaaccgtcttctcttaatttgtacaaatacgttgggacagaaacggtagcttgagaaagctgaaagcgtagccccccttgatttcggttcaaacgaaagcaacagccgctacgaaactagcagggggtgacgtaaaagctttaaatatcgtacgtacacctggaagtagggattgttttcttagccggcgcggtgaagccctaaaatctcagcctcaaacagacaactttttttgtgtgtgtgttggtgtcgttgaagatttgttgaaatccatttgagatcggggggcgcgacggcaccaggccaggtggacggcagcgaatggatattttccggcgggttggtctcgcggggcctcccacgtactcgcgcgcaaaaaaagaggcggcgaggacggcagatctggcccggagcgctggacgaacgcggtccttttggctccacttgctgtttgactgtttccagagaccagaggcgtaggctggtcgcatttgcatcgtgcattttgctaggagactggagagccacacacaccgaacgctatccaccgccgccgcctccttctactggtagccaaaaattacacaaaaaaaagaggagagagagagagagcaagaaagagaatggaaagtcgacggaagtgtctggaactgccgctggaggaccacgagccatggctggttgcaggacgaacttatctattgtcacgtgaacttcctgctcccgcattcacgatttgtcaccgggctctctgtctgtttgtaaaaaaaggaagaagaagaaaagaacaatcggtctatggatttggttcgcgtggatacgaatagtcccggcgttggcgcagccatgggtgg

SEQ ID NO: 1620 - DNA, 1006 bp, Zea mays
  misc_feature (1)..(100): optimal_loci_181751_G1, chr5:53008097..53009102, Cluster 10
tgccgcacgtgttatgttgtctccaacagtcttcccttctcaccccgtgccttgctccatatttcaaatttcactttataaacattacagtctataatgcaaaacaatgattaccatttagactctgtctaaaacccctagagctattagttagccagctaaccaattattagctagatcgagctagcaaataaactaatttttagttgcgtgttagccaacaacaattatgtggagtatcagttaggatattcaaaacccctaaagctaattttagcatgtttagcacctacgtaaccattaagaagtggaggttccaaacaaggcctttacaaacagcatgagatctcgaggacaaataataccacgcatgtttgccgatgcggttgggagtgtacagagaaatgtggaccctgaaataatgatgcgccccattggccgcattactgctgcccattttggtgatatgaatttaaagagagagagagagagagcgtgaaaagacccagctttaggcctgccgccggccaatgaccgtcacacaaagcgtggccggccttcgccttccgcccggtgcgctcccaacttttccaccggtttgttgatatggtatactgtatcgatattcgaattcgatacaccaggtggggccggtggatgtggctgtgcctgtgctgcgcggaatctttgtcattcgatacacgactggtttgtttgggcggcgcacgttcttcgacctttgcgattagaggaaggcagctagccagggtcggtcggtcggtcagtgtgatcggcggcatatactgtgtgcctggctgtgtgtttgctttggtttgcagccacctgtgcttgcgcaaggcatccagggttttggataggttttcgcacgtccacgttcgatcaggtgggtggcacatatatagccgacggttactacatctaaagttataaggttatatatgtaactcatatatctcataaaggttattgttaaactatatatata

SEQ ID NO: 1621 - DNA, 1118 bp, Zea mays
  misc_feature (1)..(100): optimal_loci_181873_G1, chr5:53903288..53904405, Cluster 10
atttgacctgaatacgagccgacccaatgtttcatcaggtctaatcacaactcacatatgcaaggtaccagagatacacacgaacatgctccggcaattcatgtatgtggctggatctcgcacttcattgcacgcgttcccattatcgatttcagacaaggtctggtccctctgcctctccacgcgtacgtgcgtgtgtatgtgtcactgatatgtatatactcttattaatgtattacactattacagtagatctgactactcatcgtccgaaaaaactaaccacaaataatcctggtaccgtacctaacaacctacctttgctgggtcgtcctcgccaactgacacactgctactatatatacgtgcttgattgaccaccatgcatgataaacctagcttttttccccatcagctatgatagtacgtggtattattccaaaaagctacccacgcgtgcgtgcgtgtccctccagggaccgtcgggtcagcaaagtaaacaagaaaatggtgccccccctcccatatccacgcctttgtgaggtggccgagaacaatgggataggagtagcgcatatactctcgaccacatcatgctttcaatcagttgtgctggtggcgcgcgggcgcggcatggagacggacggccggccatagagaaagaacggtcggccggcgtatccgtccatacatatcccacaagtgtagctcgggttcagaaaagacatcggtgggacggagagtggtgcctatctttaatttacctgtcatttctgtcaaagcaaagcaatccatcgatgggtggcgagtgaccggcccattctgaagtcgatccagcaacagcaattggcgcctccactaccacttggtccgtcgatagagacgggtgtgatgaagatgaaggcgtaggtcgatgcatgcatgcatggcctaatactatttgcacgaattgcttgcttgctgttgctgccttcttcttttgcgggagatagataagtttagctagagctatatagctgcctgcagggagctagtagtagtgtgtgtagtgtgtggatatgatgcaggtgaaacgggatgggcaggtgcaggtgatatggtatctctgcatggatgat

SEQ ID NO: 1622 - DNA, 1347 bp, Zea mays
  misc_feature (1)..(100): optimal_loci_185582_G1, chr5:80823742..80825088, Cluster 10
gcccagattattccactgtggtctttgtcatggaaagaaagaaggtagaagataggggagaatggtttggctggccttgcttttctatgatcaggtcgcatgtcacggaaggcaaaaaaaaaaaaggttttctgaacatgtaagcaagtaaaccaaggaattgaattgattccctgtgtgaaccacaaaagtcacacgcacacatcgatcatcgacctactatatatcacagagtcgatcaatcaaaatagaggcaaatataacatataataagaaaggaaccgaactctctgatcagtcgcttagcatctatctatatattactatattagcttgaaaaaaacagcagcagaaacgatgaagcagctgaaaagtctcaagtgatgtgctcgatcgatctctctctctgtctcgatctctttgaaggaggagtacgtactaaaaatgactagtgtggttgtagtaggtgtgtgtgcatgtggtggcatggctacctcgtgaagcacaagcacgtcgtcgcaggtgagagggcccccgcagcgtgctgacgagctagctagctagaagagttcgttgcgacgttgctgtcaggtgtgagtgagtagtctccttcctactaccacccacgtctagctagctagctagctgctgtcacagacaagcagctagcttattgtgtgaccagtatcggatgcttcggttggaatccaaaacggagcctctagctccgatccatgcatatgcatgcatgcatcccttgatctatagtccacgtttacaacaagcacgcagcttgatcgaggttggttagacacacacacacgcacgcacagagtagtttgggatggaatggatggcagcgtgtgtgtgcgtgttaggcgaaactggactggaccttggatctctttcacagcgccggccggccgggcacgaagacatgcaaccaagagtacgtatgcaacagctaagctaagctagtaacgcatgctgtacgtaatatctgacgacaattaatttatatatttatctgcatatgtgtattaattattattgcgttatgtcggccggcgtcttctaacgccgccgaacctttgttgacgacggcgcgcgcaggctgcgaacgggtctcgggttcggaggaccaataaacgacacacacatccatgatccatctgtggtttttgtcacggtcgtcgtcgtcagttagttatcacctacccccctgctagctagtagatgcaagccatgctgtctctcttcttccactgttcctctacctttttctcgtgcatgcacaagctgagagagttctctcgaaggctagtagatagcagagcaaggaactga

SEQ ID NO: 1623 - DNA, 1045 bp, Zea mays
  misc_feature (1)..(100): optimal_loci_198027_G1, chr5:162758667..162759711, Cluster 10
gttgatagtaaccaacatgcatccatagtcacaaaccccaacacttccattctgataatctgaaaggaactaaacatataatacagacccagaacggcaacagatgatcagtattagtgacaaaaggctgattttttcaaaaaaccatcctactgcacctcatttctgaaagggtcccgttcctaccacatgggggcactagtccgattaagcaaaactgaatgggagagcaacctaaatgcagtaaagtccaatgaataaaccgccccctaaaaatagaagcaaggattatgtcagtgtacttgtcaccactgccagttagcacaaatgagcaggcacagtccagggcctacagaatgttgctatacaccagagagttaagtcctgcggacaggagcttctctttgaagcgtaaatttggtaacaaataaaagggtcagcgcatatcacctcgtcctgcaataaggctccaaacgctcatacggctacagagaattgcacgatctaacatttaaaaccaataagtacaaaaaaaatcaaggcttgcccctcaaagactcattgttaggcgcagttcttgaacaacagcagatatgttttatatggttgttacgcataccatcgtcgacctaacgggaggggaaaaacatgaatcaatcagaaacaggtgggtggcgagacgtctcgcccaaccacctcctcagccacccaactctgggcaccccgcaaaaaaacgaacaatccgaagaaaccctccggaacgcgagaattccggcgccagcgcgtcccaaccaccgccaccttccaatcaatccgccgccacgagtccacaacaacaacaaaactcacgacgcagcgcaggaacccgccggcgcggaaaagtacgacgcgaaattcagtaacgacagccagccagccagaattcaggaacgaagacgacggcacgcgcgcgctgggcagcggcgaatcggccgtcaatgcagcgcgacgtccaacaggcacggagaggtgtaacgactaacgagacggtgaagagggtacatac

SEQ ID NO: 1624 - DNA, 1172 bp, Zea mays
  misc_feature (1)..(100): optimal_loci_199571_G1, chr5:171169523..171170694, Cluster 10
tacagtataaactggtacggactaaagtcaagtaaacatacttgtaaggattagattatattctcctcctccacaaaagcacagggcgcagcatcattttgccctttattcaaccggtccatgtcctgcccctctctctctctctctgaaaggtgctgtgttctatatatgttatctttgctccgctcaccttagtatccttctcacttggcattaggatatggtactatatattttcttagaaagaaattggccatttgatgtactagctgcttaactttgggaggagtcgttggcaccacatcgagtctttgaccgtacatcaggtcaggccggtggaaacggataatccatgatgacgacaagaaagttgcgtttttttatatatatgcaagtttactcgttatatatatgcaagtttactcataatcatcgtcagagggctttgaacgctggacttgatacgaacagaccccacacggactcgtacgtacccgctacgacaaggcgtcgcatgaatcccgctggctcgcttgcagggatcccagatccacgggctgaattccggaccaagaaaatgctccattggtggtgagtggtgacctctagatccatcgattttcaagcgaaagagacagttaaaaagactatacacatgcgacggagtggctctaaattatataattgtaaaaaaacaggctctacgtgaaaagacagtgtcttttttttcacatgttggcacttggcagcgcagcgccactcggtagtagcagagaaccgaagcaacgtactactctagatcggaaagcgaggcaggcggcgatgggagcgcgccatccacggcgagcacgccgcttttccccgtcgtcagtgcgcttgcggagagagacgggatgcctgcagctgcagatgcggacgggcacgcgcaccctttccccgtctcgtcttaatctcctttgttaatttgtttagtggagtaaggtaaggtcctcttttagaatgccagagctaatagttaattattagttaataaattattaactggattgagctaatgagttaattgttagtagtgaggtagctaacaattagctttggtattagctaatggtgtttggaactgaacaactaatttttagtagctacctgttgaacatcagaaatggaaggac

SEQ ID NO: 1625 - DNA, 1152 bp, Zea mays
  misc_feature (1)..(100): optimal_loci_202240_G1, chr5:186834231..186835382, Cluster 10
ccgctcccatgatattctgtttgacgaagaactcgcgtggaacagctgcatcctaatctcggcgagggaaaagtagtgggtgagttaggatgacggtgtttgttaatactcctgtctagggttaggtgaagaatggcgaggactggtagattcgtgtgctccaacctgcactgcaccaccaccttttgtcggtggcacacgtgttgtgtgaaaaaaactgtttcacagaggactggtgcagatgcagaagttcccgcagacactcgatgtggacgcccggtggtttcagagtttcagttctccttggattcagaaaagaagaagaaagagagtttcagctcccatctgcgcttccgcaggtatctgcggtccgtcagaataagaatcgagggaacataacgccatttgtggattctcctgcacatgcgagatcatgcgaaagaagggccaacgaagtagtccacgacgaccttggtccattgagcctgcttgggagcccacactcccggcggggaaccaggcctatgggccgtaatgctttacagattcttgaaggctctggcgctctgctttggattccatcgcttcctgtggcaaacgggcaagctgcgtcggtggtttggacagcgcaattcttcaattcagtcccttgtttcaaccctagcgagcgaacaattccagtcatcaaatcgagatctttcaccgcaatattccattgtaagggcttgtttgaaatgcattgcttgaacgcagcgattctttagcaccacaactacacctgaatttgtactaccagttcttgcgttatcaatgaagacagtgacactgaaccaagaacatatttgggatcatgatatagcacttcatgttggtctcgttaaagatgcatcctgcatgattgctaagttttttatgctgttagtacagtgctttatgctttaaggctaattaaactggacactggttgatggagaaggcaaagcagacaccttaagctttgcttagaagcatagctagtacataacaaatttgtgtttggatgtatgctcctgaatgttgtgaccgcatttcatgttcatgttctgcaggacacggatcttgccaaaatactacatatgtcctaaattaaatcaacttttagagttttcttat

SEQ ID NO: 1626 - DNA, 1222 bp, Zea mays
  misc_feature (1)..(100): optimal_loci_202526_G1, chr5:188487768..188488989, Cluster 10
aatcacgatctcgttcgttataattagttagtgttaatataaataataaagttatcttaacaaattttaggaatggattcataatattccctctcaccccggtcaagtagccggtgaagacctaatgcttgtactacattggttcgagtgaccggtgtggaacagtggaagcattgcttgtactggctgcgagtacttccattcatcatggcttgcgtgccgagtgccttttccctggagcaccgggaaggcgggaaccctggcttctcttccgctgtactgtcgtactcgttgcaccaggatctgacgatcggcagacttcacggtgatggacggatggagcgaatctgattcgtggcgggccaattttttccttctcttcttctgttccgggatgcgactagagacgatccaagaatctccgggcgcggcggtggcgcccctcctgtccactgcctgccgaacacgacgatgaacaggaaccgggtgaactgtttgctgactccggcctccggggtgttttttttttgtgtgtgcgggtgacggcggcgctagtaccctttccatccatcttgctccctgttgctatagtatttatgtccgttaaagtgtttagatttaagtttatataaagtaccagtagcatttgtatctctaaacagtttattaaaagacagatctacctgatgattctaattacatactagtatgtaatgaccaaacagtgacaccgagacggcgtcattgaagagggtgggtggcagtggcagctgacaggtcaggcgcgtgctgattttagagttcaaatgaagaaaaaaaaacaatgaggctgcgataaaaatagacttgtcgcacgtggtttttgacttcgagcgtgtctcggctagtcggctatggaagccggaggcggcattttgagcccagcctagaagcccacgaatcccctctctaagttttgagccattttgacttcggcccgttattttcacgcacttgcatctgccgctgcgtccaatctctccatctatcgtgcttttggcagcacccaaggcccacgctgggccgtactcgtaccacgcttcactagtgtcagagccatcgtgcctgataaatcattgtaccccataatccagtactacacaaattattgcgcccgacccgagaagcacacccccgatgctgtctccgtttttattattaatcactgggcgatccagacatg

SEQ ID NO: 1627 - DNA, 1165 bp, Zea mays
  misc_feature (1)..(100): optimal_loci_203938_G1, chr5:196179263..196180427, Cluster 10
agcatggagacgcaaacgttttatcccgtcaaagtagatagatacgtacgtgtgctttgacttgagccggtccgctgccacagttccctatcagatgcagccggatcaaatgcagcgtggtggggtttcagaatgtaaggcgctacgaatttctagccctttcgccagcggaatgaatattccggtattggttcaagtgcagcatggtagggtttcatgaaagcgatgctgtggatggtgcccgcggggctcgtctcgtcctcctcggtcggcaccccgctcgtcgcgtggctctccgtcctcgcctagggggctaggagcgtgtcgcagcttttctatttctcaatcatccgtcctcggcacgcgcatgttcttggtcctgggcttaattatgtatgggctagccaaggcctcatgctgtgagagatgcttctcaaccctagggcccagttgggtgcagtgctgggccttttttaggcttgggcccaaagactcagcggcggcggcactgcaaagcgcctggccgcctgggacttctttttttccatttcttcccgtctctcgcggtgtgtacggatccgcagaggtcatgttgaggcgagctctcacgatcaatacagtctttcaggggcagaaaccagctgtcctgtataattgcccgcccagaagcaagggccacagggacgggacggggaaggcttcgtccctgtccctgtccaccaaagcattgcatttgcatgttcctgtcctgcctcctggtcatcctgacctgaggggaccttggttggtggtcgaatggagaacggagcgtatggctccagaatgcgtacttttcaccgcttttcgtttttcttacagtccctgactgacatctaacggatcggtcccatcccccgctagagctggtgattatgcagttgatgagtacgatgagtatgcagcgacacatgcacgcgttgacataggtaaaaagcaacggtacacaacacagtaatgctagtatacctaaaaaccaacaaaaccgagaactatcacgtatccgcatcgcaaaccatctgatgtggccaggcatgtgctttttttgtgcggacgtgattcagacctctccccggtagcgacaacattagacctggcatttttttccagctaacttcgtgtcatgttg

SEQ ID NO: 1628 - DNA, 1031 bp, Zea mays
  misc_feature (1)..(100): optimal_loci_204455_G1, chr5:199202709..199203739, Cluster 10
agattaggctagtgggtgaacgtctggcacgcgagagccgccccccccccccccccccctatctgcagcttgattggtagcagacgaaagcaaaacacgcgcgacagtggtcaactggccattctctcctaccacgtgccacagcacatgcatcgtggacaagatataactgcccggcagtgcaggctccagaaaaaaggagaccgagaagggaggaccggaggatggggttccattccatcacgcgtgccgacgcgatcacgcgggtgctttgctcctttttcctcacgcggcgcacgggatacccacctattgcgggccagataaacgggagttgacgagccgggctctggagctcctttttgggcttgggccttgccgcagcagttgggtcgtccgcggggtgtgaagcggaaggcctcaacacttgagggacacggtggttgtgcgggctgcgtaggagcatctgttcaagttcagagacttggaacaaatcgtcggtgtcaggtaaaagtctggcgatacctgggcggctgtagaagcagcagctggcttgagcagtgagacgtcgaatacttggatgtaccagcgatgtatgtggctgtagactgagacttcacgtgtggtttgttcatgcgtgccatatcagggccaggtgacggaggcttgcccctggccaaagaccgatgctgtacaggggaggtctgtctgattcaggcgctcgtaaccttttcttgctgcctagtcccatgctcgccggtgatgaaaccaacaaaatcgaaagcgtgcggctctcgttgacaaggcaacagttcatcatgtttcccatcggttcacgtacaggacaggcagggtgaacagtgccgcctcgagctccggctactgcccgctacatcgtccgccgccagccaaccggcggatggtgccgaaacagccaagggaagaggcgggcgtggccgctgctggcggcggcggttgtgtagtagctgcctgtttccaagcaaagcaagccacgggagttttgacgcggc

SEQ ID NO: 1629 - DNA, 1335 bp, Zea mays
  misc_feature (1)..(100): optimal_loci_204461_G1, chr5:199231709..199233043, Cluster 10
gttatagtatccgattcacgcgcgcaaggaaggtttgccaacgcacgcaggtggtgttcagtagtgggactcattcggcggcgtgggatgtggtcaccagtgtcagcgaatcacgctgcattatacgtacatttggttccggactaccggcgtaggagtgagataatgctagggcatggagggacgctgtgttattaaacgccgttacttgttgagacaaacaacttcgccgtacgctggctgcaacttcattcctattacgtcagcgcggtactgatcctacaaccaaacagcacagagattctgcaggttggttttagttctgactgaagttctgcacgaccgaatgaaactaaacttatgtagtcactagtcaggcagtgcagaaacgctgcggaggagacatatagaccgcaatgcagagtgcgcgtacgtccttgcccgtgtggtgcgccacccctagtaatcatcagctcgcctatctattataccttgaaaaagaaagcggacgctccttgtcatgctatgtctaaactctaaagacgtccactgggttagtcacccaaatcctgcttaaacaagatactacctgttggtaagcagaccaggcttcctaatatagtaatgagcaatcatgccccttgtgggtatggtatcgccatatatattatatatcctattcggctattcctgcctgcttgctagatcaaatcagatctgttccgtagtggcttgtactgtttttttcttttcttttttcagttcatgaattgcttaatgcagcagcagtaccccctcgtggcagcacgagcgtatcgcgttgccatttgactgatgagtcgtcgtttctccatgtcaacgtcacgggattaataagttacttattcgtcttgtccgtgcacggaatccggtgtcctgatttctctaatccgtgagggtttgctactactgccagcacgtacgatgcatgtcacggtggtgcactgtagtacgtctgtacctgcgcgcagcagcagtatgtatgtatacccccatgcatctgcatctgacagtcaaattgcgggcaaagggtgcggttttgactgtcggtagctggaccgggacacggacggtggggctccgctcctggcgagatgatgggtgggaccgacgccggccggccacgaggcatgcgaccacggcggtgatggaggcggaatcatttttaccggcggtgatggaggcgaccccgcgcttaatgtgtgtgtgtgtgggactgactccacatcgcagtcacaaacagctccgtccgagaagaggggctagctgccgctgtccccatccgtgcagatgccg

SEQ ID NO: 1630 - DNA, 1292 bp, Zea mays
  misc_feature (1)..(100): optimal_loci_205136_G1, chr5:203043125..203044416, Cluster 10
tccaccgtcggccggcccggcagccctggggtaatccgcccgctcgcctgttttcacggcgccgacacgccgaggtaaaatggaattatcccgtcaggattccggagagccagatcctgcgcggtggttaaaccggtaaggtgtagtttgagagccataaatcataaatcggagggtattagatggtataaaattctctttttatttaatttttaataagtgaggatctttgtctgtttaatctctttcagttttgtggttccaaaactaacctaccccggaagaatacgctgcaaggggagggatggcacggcacggcacgatgcgaaaataagctatcttcctctaccagcgtatttttcttttgtttgttattgctggatgtaaatatatgtggtactcgacttggctacttggtcgacaagaccactcctacgtacgtggtggagatattctgtttccgcggacggacaagacaagttcaccgggttattattataagccgggcaaacaacttgtacgcacatgtgacccaagttggcatatactactacgaccacacaacacatacagtacgttgtcactagcacagtccacatatacctcgccattgtgctgtgtccatcagtttgctacagtacctttgaatcgcagaaatgcaaaacggcaatgtcaggctgctacatatatgtgtgtagagattcttgtcctgtgcagtttcctttcctgtgtgctagttttggctggtcttgcttgcaggtgggccgtcgcacagttttcctcacacaacaacacattgggtccgtagtgctgctagttcagcacctgttagttgccaacccacggcgtcgatcgcctgaaacaggcagcgatgggtggctgtacctgtggctgtgtggcagtgtgtaagcgcaactggttgcaaaagtacgcacgcaatgtatttgcacggatccatgaattgcagatggctggagagtggagagggaccggaggctgctcactagtagtagtacggctgtaagcgactggatttaaacctgaaagtcgtgttggtggctggctggtcacagctgggagtctcttcagacttcgtggtttgcagcgcgtcgtcgtcgttcaatacatcgtcgactttacatagggtaaatgcgcaagaatacatgagactttagccacgtttgggctcccaatacgaatttctgtgatggtgattcggttacagattactactgtatgtaccagttagtatcatgtttcgataaccacacagcctaaccaagtactaaccg

SEQ ID NO: 1631 - DNA, 1080 bp, Zea mays
  misc_feature (1)..(100): optimal_loci_205637_G1, chr5:205744546..205745625, Cluster 10
aaacgatcaccaaacgccatcactttcttccaagaattaaagcagtccccagcactggcccaacacatcacgtcgatggtgaacctgaaagagctcgctcgggccagcggatgcggatcgccacgaccgcgacccggcgctccgaaaacttccgacgacgtgctccgcgtcctctcgatgacacgggcttggtaaagttggagccggtggtggccggccgacgccgcggcggcaccacaccaaccgtaccggacctgcccgtacgtaataggggctggaacgagagaccggtagcttccaggaggggtgggtgggctggccgcctgcctgacgtgcatgcatgaaccacaaggcgatcgagcgacggcgatcttctaaacatcacagggcgatgccgttggccagtgcccatcattggcatggcatggcagatggcactgtccagccggcctaaaagaactcgtgctcttgtccgcccgggagtacgtacgggcatgaagcatgtgaaaggaattgaatacaatggcgtagggtggttgatgaccaccagtgtgtgtgggggagtggggatggagttcatcgcactcacaagggtgataccgagatggaccatttggccctaataaaaatcatgtaaaacaacatcttttatattgtagattgtattatttacatgatgaaatttaagatgaagacgagataagagatatgataggtaagctgctgtagacagcttttagccaaaaaaaaaacgaaatatgaaaagcgcagtggccaagcaggatgaacgaatacaggcaatcattagttgcacttgccttgcgtttccacctctccagcctggtcactgccagcttccagcctgtgcagctgtgtgtgtggcgtagccttacacccctgccagcatgccaagcgatgtgggggaacggacatcgtgcaccaagagccgtccgatttggaagtagtggccacagtttctccccgcgcagtatcaccgcatgggaccatgatatttaggagagtgatttgatttgatttgttttgtattgtttttcagaatcctatatatcatgatcacag

SEQ ID NO: 1632 - DNA, 1128 bp, Zea mays
  misc_feature (1)..(100): optimal_loci_206072_G1, chr5:208159476..208160603, Cluster 10
ggccacacccgcaaccgcaaccacgcgcgccgcgcgggcgatttgctcgctcgcccccctttcggtccacgtcaccggccgccccacccgaaacgcgggggcgcgtcccgttccattccacctttcgcgacggcggagcccacatggatccgcggccacggctccagccgaaccaccgggcgcgtccgcatctcgtcgccttctcatcatctctcgtccgcgcggcgcgaaccgcgtcaacatcccgcggctcgaccggatgcgcatcaccagatattttgctggcgtgcctggaccagaatcgcagcggttctgtcagtgctccagcagcccttctaccgtgggcaaaatttacgagccgttcgttctccagtttcctctggtcgcgagttttcgtcggtaggttgcaattgcaggacgcgtcgggcaatagcagttctcggccataaaaaaaaattcaaccccaaaatgtccggacgcgcaacgttgcaattcaatggcttgtccggcagcacgttgcaatcgccttttaccgatggcgcatgcattaatgcgcccaacacgcatttgcaattttgcatccttcgtgaccagtttgacctggtttaagtaaagcacattatcctcctccccttgatgcttgtattctagtacgttgggctttttttcaataactgaataatagtttgatctgctgaaccagttacaagttttattatttttttactattaattagcttccaggtgatccaaactggattgaaaaaatctcagcgaaacggctccaatatgacctcagccagcatgtggatgtgtggctgaacatccaaaaccatacagtagcgatgactcggtcttcggtccacttcgaaatcgactgggaaccaaccagctttgaaattttttcccccttcaccccgccttattttcttgctctgttgctctccaagaactgactttttttttttttgctcctcatgtttttcacgaaaatggcttgtgacgaaacagccttctcacgtggctacgaagacttctggaaccatgattaaccaataagaaaggcataaaattgtacagttgccggtagcagcaggacatacaattggggatataattgaggaggta

SEQ ID NO: 1633 - DNA, 1081 bp, Zea mays
  misc_feature (1)..(100): optimal_loci_206112_G1, chr5:208353075..208354155, Cluster 10
agaggatagcacctaaagctagcctaaaggcatacatatatagctagtagcctttatatccgaaagaaagaaagaagtagtggctgttatctactgctgcactataccatacgttctagctagctagtatacccctccctgctccgcgcgcgcgcgcgggccacagtccacagcagtcttgcttcgacgaagctccaacgccatggagatgaactagctcttcttcttcttctttcggcagcttttttgattgccgcggatgaagcccctccatttccacgtgcttttggcctggcgacgtacgtgggggcgtggggcccggacgacatgcatgcctccccatgcacgcaacgtacgtgaggggacgttagcgcatgggagcccgacccgcctcgtcgttgtctccgtggtcgtcgtcgccctcttgacttgttcctcctgcctgctccggtccccgtggccccatcgttaaattacaaaacgcgcggagtgggttgattagcgcgcgtttccacgtcgctttcagggttgtcccttgagttggatggtgacagagcgtcgttcttcaacacatatatatcatatcaatggatcctagtaaaagctatatatataagcgtcgtcgtcgtcggatctcgctcaaagttttaaaattactgttcggtcagtcaggtttgtaatggcagaaattttcccaaattaagaaccaaacacggcggagagaaacgagaaagtatcacgttttctgcaggcttcggcaaatttcgacttttttgttactggttagaggaacgtatatgacaactaatggcgcttggctgtgatgattgttctacgtatctcctgcatgctaatttgaattatgaatacaaaatacagcgaaatcctagtcgagctagtaggttaattatttaacttggtcctgtatgctctgccacatttttcaagctctgcttatcaaaatgacatgcatacatcatccacttgtctagtgactaattttagttttgagctctgtcatgaggtgattgctgatctgtttattcgtggctgcatatatatatatgtatatatatatatc

SEQ ID NO: 1634 - DNA, 1192 bp, Zea mays
  misc_feature (1)..(100): optimal_loci_206150_G1, chr5:208568231..208569422, Cluster 10
aactgaccctttgtatgtaggcccgcccctcaatcgaaccacatgtgtggcggtctccaaccaggtttggtcaaacattgtggttggtcaaacattggtgggtcgtggatttgttgctcgtgtaggtcagcgtagccagtagcatggtagcccagtggcgagtggcgagcagtacatccgggtggcagtccgcagggtgaaaagccggcaggaaaccattcacggagaacacagaacagccatcgatacgtcaaacgtctccatcggaacaaacagtgcgtatctaccggtacttggacaacgccagtgccttttcacttttctcatcggtgtagtgtgttcatgccaggcttcacttcacgcatcggcagcggcaggtctcaaaaagaccagcgccaaccacagcgtcgccgtcgcagcaaacccaaaccatgccattgccatgttgaaggcagaggtcttcaagctgcatctgcaagcaaaagttcccccagcaatggcaggtggcagtggtcgtaaacgacgatcgacaggattctcgggagctaggatacgatacgaacatggaacgacattactgcggctatgcctgtttattgttcattgaattcgacccgttccggcggggcagcaggagtctgtccgtgcctactgtgcggcggctatgcctgcgtcctgcgaccgagatctccaaagaccgagagctttttcctgctgcaccgtggccgatgggaaggtgactgggctctgccgtgcggcgacgagacgagaggcgggagcaaggacggccggccggccgggggaaggggaaggggtaggcaaaggcaagcaaagcgttgctgattgcgagatagcagttaactggatgggacgcttcgagtggagctgacacgcgggcacgcggcgcttctcgggccggattcccacagatgcggctgtggaaagctacgctgggctacccagttcgattctctaccgaattttactattttacactgtttttgtccatgcatattgtaactgcatcagtttaacaatcgactttaatctaaagccaacaactatagcatacttcagaatcatttgtctatccaccggtatatatgtactccgtcgtctatcgagctgacgctttagggcttgtttgagaactttatttctcacaaccacgtactacggtttaatatatgtc

SEQ ID NO: 1635 - DNA, 1122 bp, Zea mays
  misc_feature (1)..(100): optimal_loci_206371_G1, chr5:209725570..209726691, Cluster 10
cgtgggagatgggcgccatgatgtagcggttgagaggagcacgtacgtcacgttcgagcgtattgacggcgaataaactactagtaggtttagcggcaagccgccgatcgagatccatggatggtggtggggagatcttgggaggcaagtgcacaaagtataccatcgatgatggatcaaccagctgggatgggagagggggcacgacgactagcgagctttgcttagaaaactggcgacagggcgggcgtatgatagatagtcagtcaggcgtaagtacgctttgtgaagatccccaggccggagacattccgcgaaaaccatcaagtggtggcactgaaactttggtctggtccttttggttagccctgggtcctagcctgggtagctttggggtccggtagtggcaggggctcattcctgtcacctgcttgccttgcctggctctgttgcggtcggtctgccaagacctgttccatctgcagctcccccacctcctcccatcccatctactacaagaagaaatctctttcacagactactccgaacgagcccagagagatcgaaacctggcagcctggagtaaattcgaaaaggagagcctgctgtagtgcgctgtggcggtggacgtaaaaaacaagaacgagcctgcagggacgaagggaatgacagagtttacagcagagatggatgctgtcagataaaacgtccaaaatgctcgccatgaattcgatgcgacgcgccggcataataaatccgctggcgctactagtggtacggatcgtatggtgtctgcaaattctggtggagtagcacctaatcatcgatctgtatgattcgatcggcggttcaggtaagcgacaggcaaatccaccgccaaggtgaggtggaggaggagcacagtacacgcaaaggaccgagctgctatagcggcgaggtctgtgcctcagccctcagccaaccacaacttcgtttagcaccatgtagtcagggcctcaggggtacttggtgttgcctgttggcctgtcgcacgtacgcgaccccccccccccccccccccccccgctctccgtacgtacaccaacggattggatttgtaattatgggggcttgctgaactag

SEQ ID NO: 1636 - DNA, 1290 bp, Zea mays
  misc_feature (1)..(100): optimal_loci_206376_G1, chr5:209736647..209737936, Cluster 10
ccccaatggcgaattgatcagcagcaaaactacattgctgatctcagatttgctgatcagcagcaaagcatggtcctaatgatgagttgaggtgagcaagagaactacgtgctccaaaaatgacagaaccgacagagcttttcttgcagtgatgcatttaacttttgtgactgcacatgtgatgggatgggaacgaagaccatgcacgctcgttgtgaccccgaatcctgctttttttaagggaatcctacggatctcagggagaaaagaaacacatagttccaacgatcaatgcaataccaccctcggacagtacagatcccaactacaccctccagcgaaaaagtgttcatccctgaatctcacgctaagaactaacagattcgtaatcgccgattacgcaagagtgcaagagcaagactacttgacggacgttaactatgcctaggggatgcgtagaacactgcagctgtcagccaaatggacagacttcaataaaggacagcagcaggagatgaaagcggattttggtttgagccgttggtctcctgtccgtagtacagatctctcactcttctctgaaccttcttcctttgcgagcccggctacatgccgatcgccgactaactttcggacaggcgagctgaggcgggtacaaatccgcaaggccatgtgcacaagcatgcagtactgtactggtctactatgcgtaacataatcatgaaaaaacaaacctatttgctcaaagatgcacttatagtaatgcatatagcgtgctacaaagaaagtgaaatgtcttcattatggaacgtcatagatacttgaggtggtgctctatccgcggaaaataatgtggtttcaattcactcctttgtgggctttaaaaaaattggctcctttgtggacggagaatacacatcccaccggaagttcaaaacccatcatatcatctcgatgcttggagcgattcacattcatattcctcctgattggttgccgacagccacagggccttgcttgcgcggggctgcaccggtggaaacacacgtgagttacatcccagtgcgtatgcaggccaacgagcgtaaaatggctttgactgcacccgcatataaagactgggcgtagccgtgtaaccaaccaatcaggaacgcatgcacgatcaacgcttgtgagagcctgggcattaggagctgggcaaccaatcacacagattatgtatgaaagcaagaacatggtgtaatgtttggcagcacaaccgtccgtaccaccgtctaccaggacaaacga

SEQ ID NO: 1637 - DNA, 1133 bp, Zea mays
  misc_feature (1)..(100): optimal_loci_206567_G1, chr5:210758106..210759238, Cluster 10
cgctagtgcaggccgcagaggaagcagacaggccacggcggcgtcaggggactggcccgccggataaaaggggttcctcttctccaggaccccatttgctcccctggctttgcttttgcatgcgtggttatcgtctgaacagtgcaggccacctatctaaagctgcaggtggacacattcagatttgctaatccactccaatatattatgcatcgaaagtattatccgcggcaatcatggacttgggaccggttattccccccccccccctggcttaacgaattggaattggaccccatgcgatggcacacggtgccaatgagacgagaatggatatgttaacagcaccattgcccgacgctaatggctgcttgataaataaaaatgataagaagagggaagtagggggccaaagccaaagccaaaccgaactcgaaagagaaagatcgaaaggcgggatccacgcttttcttctctattgccctgtcgatcgctcgtttgtgctgtagtttagttttttaccctttacctctaaaagcatttctcactgatgcctgacgaagcatttctcactggcgttgggcatgccaaatggggggcaacgagacagacggttaccccgatgcgaacggatgggacggagacacggcgccagcggctgtcgcagtaaggattggaattcgaatccactggctgccggccccggcaggcaggagcaggacggggcacgtcggacaagtctcggggtcgaaagaaacgggccgccaaatctacgcagggccggtagcagctgtcgaccagcagagcccacccactctgaatttctgaaacaccagcctgtattcctcagtcccattcttgagcgcggtaagctcttgatgatctgaagaagatattaaaaaaaaagaaagaaagaggtgtttgccggtgctctactgctctgtacatcgctggatagtgacttatatgttatccgcttttatcctgcttcgtccaatgatacggccaccgctttttgcgcttttctatagatccacggtgcacgccaggattttctgccctttcgcggctgctgcaccaactaactttcgtttcaatggcgtattggtacacagacagcctttgctttgctt

SEQ ID NO: 1638 - DNA, 1297 bp, Zea mays
  misc_feature (1)..(100): optimal_loci_206572_G1, chr5:210771799..210773095, Cluster 10
attgacttcccggcgcgcgcccccgtgatctgaatcttgacccgcgcactcggcgagatcgcaacgtacggcgagatcggacgtgcctctcctcctttttttttactgcggcttgcattggcgcacgcacgcgcgagatagtggcttccgatgcatagaatagaatagaatacgatatttcctgtccacggtgagcagtttggttctgtaaaatagtcgctcgtcgacgcagattagaaggccgggttggtccaacccgtacgtgcgccaagtttttttcccattttctttttggcagttagataagcactgaagacgtacgggaccaagatcaaaaccaaatacccacacacatgtgtgtgagcgctgcaaatcagggactatccgtgacgtccaaataatattactttgccgcgtaattaagcaaatcagggacggacgatcggtccacacggcacgggccacgggcgcgccgcgcccacttgcattgcatgcggccatgccgagccagctcgctagcggcccgtggcgcgcggggcggcggagtgcgacgtgcatgttgcgtcgccggccgccgcgcgctgttaccgtgacggaggagatgcctgccgacggctccgatctgacccgacggcgaacatggcttcgccgctccatgatgcgatagatagatagatagatacatgatccaggtccagggatctatggaccatgcatgccaccatggcccgcgacacctcaacagtgcaccaccttatcaaatctcaagtactgtgacggtgggaccggccggggcgatgcacgcacctccgctccgcttgtgtcgtgtgggtggggcctacctaggcacagggcgtcaagatcgcagtaataataacaacatctgtatagtactacatgattggttaatcattatcgtccgctaccaactccctcggccatgcaacttgcaatcactattactgttacaggaataattgttgtcgacgctatgattttttttagcgatgattcgtaaagagtaattctaaccgattattcatgaaagggtagacgtcataagaaatgtaaccgtaggttcaaggccagatacatctccaccggtgaatttcctaaggataccactagcgcaaatcatccatctatatatacgcatggtaggcttaagacaaccccaaaattaacaaatacaatggtggctgttaagtccacttccaatgtaaacctaggatctgtattcccggtaactttaagtaaactattaggggccgtttcgatccattattttgaaggaatt

SEQ ID NO: 1639 - DNA, 1167 bp, Zea mays
  misc_feature (1)..(100): optimal_loci_206653_G1, chr5:211201081..211202247, Cluster 10
tcctcttttacatatacaccgcatgcatgcatgcaccaaatagtagctctcacaacggttttttttttttaataatggaacaagccaggtaccactcgctcatgataggtaataatgaacacgtaaaaaagattctgtttcaaagattgtaacacaaaacacacaagtagatcagctgacagggaccataaacaaattgaattgaagaatcaaacaacaacaacactggaacgatcgatcgatccgttacatctttcgtgatgcacataagaaataatacatataaaagaccggacacaaacaaattaaacgaatcagcacagtggcttattgcatcgtctgccatgaaacaacttccgacgacgacgctctcagaacgtggaacggtcatgcgttgagagctctgaatcgatcagtccttcgtctggggtgacgagcagccgcagagcagctgccagatgctcttcttcaccttgttacggcctcccatccttcttccagtggctgccggtacggtgccgggcggacagcacacaagctgagatgctccgataagatgttcctggaaacaggaaacagaacgcccggcccgacatgaaagctagttcgccagtgcaaagctgctgcccagcccaactaataaaaatatactgtacgtaaaaactactcataggtcatagctgtcttcgattcgaatactgcaagtaaacctgccaatcggacagggcatgcatgcaagtatgcaactcgatttctaggataagaaaatacctgagaaactgatcgaactgagcaaggcaggtttgccttcttcctttgcattggtgcaagtgctagcatgcttagctcctttttatagtgttaaggatgtagcgactgcgcttattagtagcatcccctgacctgaatacctgatacttggtttagtaattcaacgagaatttactataggaaaagttcgcgaggatcaacacgaacattcagtgaagtggtagtccagcttctagcaggagtgtatgtatcttgaaacgtgtggtcccggcggggcggcaatcgcggaaccttggattggagcgcaaggaagttgaataatcagtatacatgcttgatgaaaaatgtaaccttaaactgacgacccgtttggcccccgcgtcgctcccgcgtgca

SEQ ID NO: 1640 - DNA, 1072 bp, Zea mays
  misc_feature (1)..(100): optimal_loci_206713_G1, chr5:211533664..211534735, Cluster 10
cggaggcatgaatggtgggacgtgggcggggtaggcagcagtgtacaggcgagggtatatgtggatgatgaggctacacttttaatagagtagtataaatttagataaaccatacgattgaagtctgagtagttcaccaaaccaagtttaccgaagcacgtcgacccgaagcatgcgcgaccgataggacagctgtgcgttgcaaggcgctaccgaccgatctcccgtcgccatcagcgtcgcagtgacgccgtgccccgtccgcgacgcgcggcgtcgcccgggaccctctggcctctggcaagcgggggcggatccgcactgtccggtccgcggcagcgatagcacggcccggcgggatccgcgcgtccggtcgttttccaacagcgatgcgcctcgggccgctccttccttccttccttccgggaccgcaagcccccgtaccacgccaagcgccgaaccatgcgtccatgctgtacggcgacagctcactcgcgtccgcgcgctcgtgaccgttgcgcgcgcgtgcgtgcgtgcgtgcggggcatgccgcatcccgcatgcttgcgcgcagaacgtcccgggagaaggagaggccgagggactagtgactagtgagtgacatctcactttggacggacgtcggacgttgcaagtgagtggcactgtggtttggtttcggtgtgtggtgggctgaccgacgcgacacccgagagaggcaagctgctgcgtgtgtggatggtgtaccaccacttctatactcttggttggagtttatttcaactgaacgtcatgctgctctgatttaaaatcttgatcgagtaagggcagtcatatcggctctttagggttactgcgagagaatatatagtcgactcaaccacctgaggcgcgcttccctgtaatcatccatgtttttataatgatgaattgaataatgtggatcttagcttcatttgtttcccatagtccacaccgaccaacctaaggaatgcaacttaggatatgcgtttcgccaacgtatatatgaattagataaagttgatatcagctctcaggagacaagccgtcg

SEQ ID NO: 1641 - DNA, 1127 bp, Zea mays
  misc_feature (1)..(100): optimal_loci_207049_G1, chr5:212789252..212790378, Cluster 10
ttagctagggctttactatctatcatgcatgatctgcagagacaccacacctccaccggcaaacgtacgcacgcagcgcagattaaaggcggttacgacgtgcttaataagccggcgcgcctcatttgtttttgtcctctggcccttatccctaaacaagcagcagtcttgtccttggcgtctagctccccgatccgctttgttcctacccatctgtggcctttgtcgacctagctaagctagccactactcctctccgatccatctccttgtcgcgaccgagcaagcttcacctactgcgaaaaaaagatcgatcgataaaagcttggggtggttttatttactaaatcacttctgcatgccgttatcatcgtccaataatttatctgcttgccagatcgagcacgtacttgaagcaaattaattaagtcttcatgcatatattttcactctggttcattcttatcccattcccatgcatcatctatcccaaactgcaggatggacgaaacttacatgcacgtagtaacgtcagtagatgaattgtttggcggtagtacatctgtgatgagaaagatgtcgctttccaattccacataccacatgcatgggccgccagctgagaccttttgtatattaatgcatgcatatgccccctttcagtttcagaggctgcccacgcacagcagagagtggttataacgaaacttacagcgtgcatttatttgtcctctggcccttatccctaaacatgcagccgttttgtctctgtcagctaccgccgcctagcttagctgctctctctctctctctctgctctgttccacgacagaccgtcattattccctctctatcccccttccatttcgacgcacgatgcgtacctacgacgacgacgtacgtactagctgcatatgcgctctgccatgcatatgatgggatagcgtagtatttattcttcgtgtatctctaggggatagcattggtgcttgtgtacagcagtcaagattagttattcaaatatgcccacagcggcagcagtagtagtagttttggatgctttctctcttcctctttctcggaacagactgaagggcgtacaagaaaaagaactgcaacttgcagcc

SEQ ID NO: 1642 - DNA, 1310 bp, Zea mays
  misc_feature (1)..(100): optimal_loci_207052_G1, chr5:212863755..212865064, Cluster 10
gttttgatccttacttaaatgtacttaaatacagtagagatttttcttattactgacgcaattatatgacgcgaagtttggctgcaactagttgcaggttcagttggagtgacctattgtaactagttgtctttgttgtccgtattgttatcttcagttggagtgatctagtttgttgtttgtctttgttgcgtgttacgttggtcttgtttggccggctgccgcatgcactttagcacaccacaccatacttccttgcgccgcttaatttaacgtgcggcgttgttagattggttcgtttgctgcgctcgcggccggcacggcacgccacagtggaagcacagcatgttctttttttttcatttttcgtacgtcgacgatatgcatgcatgcaaatgcatgaattgaatggtctgctggtcgacgacggagatgcggacgccatgcatgggtgcttatatgcatgcatgcacgagcactaataacaccaggttttgtacatcattagtgtgttccgctgtgattcatccatgcacgaacgtaggtagcagctaggcgccgcggtcgtcactcccaactcatcgtcgccaactgaaccaaccaactaaaccacgcaagaggaggcgacgcggtcgatgtcgctctcggccggcatagatgggatcggatcggagctagacggtcatcggcatataagggcggccgctacccggccaaggcgcaaggcaacaagccgcaaaaggggagagctagcgtgcaccaccagtccaccaccgcctgtgctgtgttgtgtgtgcatgtggcgcccatccatggtggaaaaaggaaaaaaaggtagtaagtgctaggggagcgtccgcgcgcgcgggcgcatgtatgaatgcgctgaggcgcaccgaggagcaggtacggtgagcgccgggctgcctacctaccctgctgcatgaccacagtatatacgcaggtgaccgccggaggccgccacgacgacgacgcacgtacgtacgtacgatcccgatccggcggtcgatccgccggcccagcctgtgctccacacagccgctagctatctgcttgtccgcctgctccgcgccgaatcatacgcggccggcatatgcactggaatgcacacacacaggttcactgatacacataggaatacacgtatagctgacagatatgaaaaacgggctgggcttggatttgggctaataaggttgacgtcatcaggactcgatcggcccaaataataagtccaatggattggagcttgaacggtagcagcacgacagcacgtacgtagtgtgtta

SEQ ID NO: 1643 - DNA, 1153 bp, Zea mays
  misc_feature (1)..(100): optimal_loci_207123_G1, chr5:213269375..213270527, Cluster 10
ttccagtttcatcataaaatagctccagcaaatagttaagatagattccaagaacgtttgacttacatatgaactctatcttctattgtataattaatttgtgtgagtttttttttattatctttgatgattagtgggttgtcgcatagagaacggaagttgtatgttgcctaactagtggtattataggtaattttcgtacagcttcacgtgaagataaaaaacattgtttttgaagcagcttctatggagctcgatgaattttattaatttgacctctaattaattttttaaaagctagtgctcgtgaagctagatctgtttgggtggaaaaatttagaacgaattttttaagtaaaactctcacgaacatgggcataggaagcacgtacgctgtgttacgccgagtagaggattgtacgggtgcttccctgcgtacctgcaccgtatgcgtgtccgtgcggacattgcatgggggctgtcacgcaatgacgccgcgttggtgttttgctgtctggaaggtgggtggctccaggcttgggaactggagacggttcagtgcggcgctgaaaacggctgccatgctcgccgcgttgggctccggcgaaaggcgctgcgctgtttcatgagtccgcaatgcctacgtacgtacatacattaaccgataaatcgccgagtcccgatgtcaagacctggacaaaaaaaaaaaggactaccactgcaagcgaaggctatagtgtccctatttttattagtacttacttgccactatcaagccctaaagtgtagtatgagacggtgatgtaggctcattcatattcatatgcttcgcttgctgtctttggtcgcgggcatacaggctttaacatatctatatgcatacttgcacgatcctcggtgcaggtccacggcaacgttagctgacacgatagatttcgtcgcattccgcaaatataagtttacactttacacaagccttatgtgagattgtagtaaggtgttaggtgataactgtatggtctcgttatgcgcaggatagaagtacttatagggctgtccgaagtaggtaatccaaactacggtcctatcctgttcatcgactatctgatgaatattccgcgtaacactgtaattacaataccgtgctcttagc

SEQ ID NO: 1644 - DNA, 1148 bp, Zea mays
  misc_feature (1)..(100): optimal_loci_2103_G1, chr1:10974235..10975382, Cluster 10
cgaggaggcggtgaaccggtgagtgaattggcgagtcactgacgtctgtgcagcagcagcatcgaagtcgcagggcagttgtagacggcgaaaagacgtgcctctgctcatctgctgcctccctcgtgactgtgactgtggagcgcacgcatggcgattggcatagcaccccctctcgtacacgcctcgtgcaggagtaactctccctgggtccgcctgtagaaacggcgaaggttcggtgtgcagtcctgctcctaacctggacgtacaggtacagacagggttgggcgtccgtgcaatctcttttgctctccgtctcttcttcttcttcttctattcaagtgctcggtcgtgctcccttttctcccgtaggccatacttgcacgggaaaaaaaagagaccgtgcgccacgccccaaaaataaatgcacgcgctcctgtctgtgtcgggtatttccatccgcaaaaaagagacagagcgagacgagatacgcctcctgcacacatactgccgcgccgtgatcaccgatcggacatgagcagtgcattacttggtactgcccacacagccgaggagacggcacgggggagagatgtaaaacaacagagcccaaaatcattgtcgccccggccggccggccctcacctcaccgacagcagcagcgacagcaaaactagaaaggctctgtctctcccccttcctagagtggtagtagttcctacttgtagagcccccctccctcctctcgtgtaactttgcgttcgttcgggcaccgcgtctcgccgtccaccatttcacgtcctcggcccgcccccacaccgcacatcgcctgcactgctgcccggcgtgcggcctcgttccgttggtcgtcgtcgccggggcgggggcggttaaaaggaaagggaaaaaaaaaggcgcagcgggcgggccacccgtccatgcggctgtgtccggcgccggccgtggatcgccgcgacagcccaacagtgccccccaacaggagcagcagcagcagccagcaggccggtcgcccgcccggcgtgcgatgtgatctgatgaccgtgcggttggtgccgtggctactcagtagtacttacagtcggtggcattgccgccgcggtggtggcggtgaccgagccgggagcatg

SEQ ID NO: 1645 - DNA, 1364 bp, Zea mays
  misc_feature (1)..(100): optimal_loci_2104_G1, chr1:10975416..10976779, Cluster 10
gcgacggcggatgggacgtgacgtgcgtgcgcttccgctgtgccgcactgccgcccgccgtggcgcgcgcaaccaaaccacgcacgcagacgcagttctggtggtccgctcccgcctccctcccgggccccggcagcgaaagcatatatatcggccgaaattagaggcccaacacgagggcgagcggaccgggtacgcggtggcgtggcggtgccccccggttctgttgggctatataggcctcagaaagtgacgccgccacgggagaggccgagctggcgccaacttggccagtgcccaaaatggcgactccctccgggtccgggccgccgctccatcgactagttggcggtcgctgcgactgcatgtcacaggaccgcgcgctagcttccaagcaaaacccacggctagtcggccggacagggacgtccgatgcctatgtttttttttaatatcttagtaccgtgaactttggtgcatgaggtttgaacacgagctagactgctggaacgtatacgtatatacatcaacagctagcactaagctctgtgtgcattcgtttccctgtcaacgaccagccatgcccgcccgctgcccactctacgggcaggcatacacacatacgccgcgctgacttgagcgagccgcatgcatgcttcctctcgatttgcccgacgcggaataaacaagacagattccgttccagcggccgttcatgtgcgcgaatcattcgccgccacggagcaaggcctgcttgcaccgttgcacgcatgctgccagacgcaagtcaacccccccccgtgacgcgctgcgctaaccaagtggagagagaggcacatggaacggcgcacctgggcaacaagcaatcgtcgtaatccggccgtttccaagcctccatttctttacacgatcaccgtcaggcgacgcaagctggccgccgtgccactgccaccgtcgatggtcaaccctgcaatttattatcgctttgtgtggagggacgttcacggtcacgggtcacatcacataatagttatcccctcaggtaacaaaaaagaaaagtatcggccttcagctcatctcaccacattaattatggctgatagtatcatatactgcttctgctggtgaagacaaaataaaaaaggcggttcggttaaccaaacctgcatggtgttgctggacagatggtggcttgcatgacagtgcactacacttaaagttaatcgctttggcgatgtctgcaaatttggtgggttacacaaacctacctcgatgatgttgactgcttgtgggggccttgcgattgctgcacccaatggggtaagcgagtgggagaggatcccctgcgctgatcttatcgtcgt

SEQ ID NO: 1646 - DNA, 1114 bp, Zea mays
  misc_feature (1)..(100): optimal_loci_2107_G1, chr1:10982088..10983201, Cluster 10
tcgtttccggccctagtctagggggctctatgcactgtccagacctatacttgccgacgacaaagcaaagcgtgctatataccatccgtccactcccaactgccaagacgtgtaccaccaagagctctgcgtccattccgttgatgttggccttgagcggagccacgcgctacgtcgtacgtccactccatttatgttggctcttggagccacactagacgtactccgatggaccaacgaaacgaaaaggggcaaataaaaaaaaattaaaagatcagtatccactagccatattgttcgttccaatctcgatcgcagcagcgcatatagattagagagcgcagtgtaccagcgcgagcattctgtcgtactagctagttgctaagaactgacgcgcatctggcgccgcgctgcgccacgtcctcccctgccccctcggcacggcggcgaggtggtcgcggcgctgccccctgctatgctactcacagtgcggtcgcccgcgtggccgcgtggacaccggcacggggagtgcgcgtgcacgtacgcctcggcatcggcatcaggcagcttccctgcatgcaggcggcggcgcgcgcgcgcgaccagcccacccgagcttcacatggacgccgccagcttggcagcggggatcgacggcgcggcgcccgcagcgccaggccgggcccccagtcccccacctgcgcaggtgatcgcgtcgcgcgccggcccggccgggagacgatagagagatgcatgggacggacaaggacgaccaagacggcgacgcgcggtcgatcgatggcgagatcgcgcggctttccaaatcattgccgcgcccggcagccgtgcgtccgcgtcgcccgcgccccgaccccgatcgatccctgtccacttttactcggcagtcggcaaacaagttgttgcctgcaccggcggatggagatccaagctccacttcttcgtcgtctttttttttgccctccatccggccggcctgtttcgacgaaccacacgtagtattacgacaccggcagggctggtcatgcatgcaaatgcaagggcgttagtccatttgcgctctcgtcagcatcaatcgcgacccttcgccgagtgt

SEQ ID NO: 1647 - DNA, 1212 bp, Zea mays
  misc_feature (1)..(100): optimal_loci_220195_G1, chr6:80989078..80990289, Cluster 10
  modified_base (496)..(496): a, c, g, or t
  misc_feature (496)..(595): n is a, c, g, or t
  modified_base (497)..(497): a, c, g, or t
  modified_base (498)..(498): a, c, g, or t
  modified_base (499)..(499): a, c, g, or t
  modified_base (500)..(500): a, c, g, or t
  modified_base (501)..(501): a, c, g, or t
  modified_base (502)..(502): a, c, g, or t
  modified_base (503)..(503): a, c, g, or t
  modified_base (504)..(504): a, c, g, or t
  modified_base (505)..(505): a, c, g, or t
  modified_base (506)..(506): a, c, g, or t
  modified_base (507)..(507): a, c, g, or t
  modified_base (508)..(508): a, c, g, or t
  modified_base (509)..(509): a, c, g, or t
  modified_base (510)..(510): a, c, g, or t
  modified_base (511)..(511): a, c, g, or t
  modified_base (512)..(512): a, c, g, or t
  modified_base (513)..(513): a, c, g, or t
  modified_base (514)..(514): a, c, g, or t
  modified_base (515)..(515): a, c, g, or t
  modified_base (516)..(516): a, c, g, or t
  modified_base (517)..(517): a, c, g, or t
  modified_base (518)..(518): a, c, g, or t
  modified_base (519)..(519): a, c, g, or t
  modified_base (520)..(520): a, c, g, or t
  modified_base (521)..(521): a, c, g, or t
  modified_base (522)..(522): a, c, g, or t
  modified_base (523)..(523): a, c, g, or t
  modified_base (524)..(524): a, c, g, or t
  modified_base (525)..(525): a, c, g, or t
  modified_base (526)..(526): a, c, g, or t
  modified_base (527)..(527): a, c, g, or t
  modified_base (528)..(528): a, c, g, or t
  modified_base (529)..(529): a, c, g, or t
  modified_base (530)..(530): a, c, g, or t
  modified_base (531)..(531): a, c, g, or t
  modified_base (532)..(532): a, c, g, or t
  modified_base (533)..(533): a, c, g, or t
  modified_base (534)..(534): a, c, g, or t
  modified_base (535)..(535): a, c, g, or t
  modified_base (536)..(536): a, c, g, or t
  modified_base (537)..(537): a, c, g, or t
  modified_base (538)..(538): a, c, g, or t
  modified_base (539)..(539): a, c, g, or t
  modified_base (540)..(540): a, c, g, or t
  modified_base (541)..(541): a, c, g, or t
  modified_base (542)..(542): a, c, g, or t
  modified_base (543)..(543): a, c, g, or t
  modified_base (544)..(544): a, c, g, or t
  modified_base (545)..(545): a, c, g, or t
  modified_base (546)..(546): a, c, g, or t
  modified_base (547)..(547): a, c, g, or t
  modified_base (548)..(548): a, c, g, or t
  modified_base (549)..(549): a, c, g, or t
  modified_base (550)..(550): a, c, g, or t
  modified_base (551)..(551): a, c, g, or t
  modified_base (552)..(552): a, c, g, or t
  modified_base (553)..(553): a, c, g, or t
  modified_base (554)..(554): a, c, g, or t
  modified_base (555)..(555): a, c, g, or t
  modified_base (556)..(556): a, c, g, or t
  modified_base (557)..(557): a, c, g, or t
  modified_base (558)..(558): a, c, g, or t
  modified_base (559)..(559): a, c, g, or t
  modified_base (560)..(560): a, c, g, or t
  modified_base (561)..(561): a, c, g, or t
  modified_base (562)..(562): a, c, g, or t
  modified_base (563)..(563): a, c, g, or t
  modified_base (564)..(564): a, c, g, or t
  modified_base (565)..(565): a, c, g, or t
  modified_base (566)..(566): a, c, g, or t
  modified_base (567)..(567): a, c, g, or t
  modified_base (568)..(568): a, c, g, or t
  modified_base (569)..(569): a, c, g, or t
  modified_base (570)..(570): a, c, g, or t
  modified_base (571)..(571): a, c, g, or t
  modified_base (572)..(572): a, c, g, or t
  modified_base (573)..(573): a, c, g, or t
  modified_base (574)..(574): a, c, g, or t
  modified_base (575)..(575): a, c, g, or t
  modified_base (576)..(576): a, c, g, or t
  modified_base (577)..(577): a, c, g, or t
  modified_base (578)..(578): a, c, g, or t
  modified_base (579)..(579): a, c, g, or t
  modified_base (580)..(580): a, c, g, or t
  modified_base (581)..(581): a, c, g, or t
  modified_base (582)..(582): a, c, g, or t
  modified_base (583)..(583): a, c, g, or t
  modified_base (584)..(584): a, c, g, or t
  modified_base (585)..(585): a, c, g, or t
  modified_base (586)..(586): a, c, g, or t
  modified_base (587)..(587): a, c, g, or t
  modified_base (588)..(588): a, c, g, or t
  modified_base (589)..(589): a, c, g, or t
  modified_base (590)..(590): a, c, g, or t
  modified_base (591)..(591): a, c, g, or t
  modified_base (592)..(592): a, c, g, or t
  modified_base (593)..(593): a, c, g, or t
  modified_base (594)..(594): a, c, g, or t
  modified_base (595)..(595): a, c, g, or t
atgttcattcgttcgtgtcgagtgaagacgggcgagggggacgcgcccaccgacaacacagccggcgaggacacggccgcgcgcaaagacgggcggccgaacaggcatggacaagccactgcagctagggatggcacttccgcgattatagaaaggagcgtgggcgaggagtgctggcagcccaatttcagacaagagcagaagagcaggacggagcagagctcgctcggactaagtccaaaggttcgtatgcacaagagtatcgcaggcgataatcaggctatattgtttacggaagaatagagaggggatgatggatcgcgcccgcgagacgcgaaatattgggaaaagcaaaaaaggggggagaaggcgcggctgggtcggcttgctatcaaaggagagagaaacgtagtgagcatagaaagatcgtcaggaaatgaatcagcagatggaggtggcgcttgtcgtgttattcatccgggtaaggtgagaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattccatctgtttctataggcgtcaaatacgcaacacaagctattaaagttgtaatcctgtccccctcaattacacgtatgcgatggataattcaaggtagacgtcatactttgggcatgtctgtaggttaatcagtctgatatcggaacatgaaagagtagacacgtcagtcgtctgtatgctttgacacgtatcatatcataccttgctatatatcatcggatctccaaacatacttccgctatacacgattgccaactctaccgtacaccgaaggctgtggtaaacgaagctatgggcctgggaaaggagatctttatgcatggttcctgtgtgctaggggtgcggtgcaatgtcatgtaaagttacaagcatgcccttgaaatttatacagatggtgtacgggtattatatcgccacaatggtcctcccttcttcgttggtgccccccgaatggcggcggcggcgttttgtcagctgcgtccgcgacgcctttggttaggtagacggagagagtgaggaggcgactgaccgggcccccgaggagggaattttggtaaaagaaaaaaggggggagaaggtgcggctgggtcggttgggtccaaagggggggaa

SEQ ID NO: 1648 - DNA, 1326 bp, Zea mays
  misc_feature (1)..(100): optimal_loci_222089_G1, chr6:93584126..93585451, Cluster 10
gtgataggctgacaactagattacccatgaatccatattccaaaaaaactctatagaaaaaaaaacggtagcaaacagttagatggttttcttatttctaaagataggatcttccgtgaacatttttgtagataataaaaagtaacaagtgatccggctttccactcttgcaaggttaggggccaacagtttacatcagtagaaaaaaaccatcccaacaagcaggaaggagacaacctcaagctaaatcttagaaacaaactaatttaaccgtctctaaccggcaacaagcattcttcaacaaagacgtcatcaacttcacttttttttagctgaggccaagctcggagccagtatctttcctgcacgtattgttaattgatcagtttaatatggaactgttgtccaagcatgtcacacgcatatattggcgtactgtagctgcaaaatgatagaagatacaagtcatttgtacttgatgtccattgggataaggcaacgactacacacattggttgcaaaattttaaccccaaggtttcctacctttctctgcgatatggtggcatatatacttctcttgtgaccagcgctttgtccccatcgtgcaccaacaggaaacagtcaagcatgaagcatcatcacaactcgtgcaccaacgctttgtcccccgtctccagcgcccccacccggccgcccgcatgcgcttgctacactgttcaaaccacgaccaccatggccgtatctcaggagaggtattccaatcccgatgacgacgacgacgagcaatccgtcagggcaaattccggagcggctgccggcgcggcagcgtctcgccttcctcgtcatgtcccattcccgaatcccgactccagtccaggcccatcaagtggtccgtgtagtggccgggggagcatgagaacataacacatgaacttgcttgtagatcgtagtcagcactactacgctactgacgctggtaatcgatgaagactaccagaaccaggcgtggctcagaagcaataagcaagggggatggaatcatagcggaagagcagcttgcgggacaggcatctgttcttcctcctcgtgcaaaaaggaggggaatcgacttgactcgactgatcataacgaggtcacgccgcctgatcagcagatcaatggccgacacagccgtgggatcacagctctttcaagccgcgttgctgaagacggaacatgcgcagagttggaagaacggaacgcatctgaggatagtggcacctagctacagggagaggatggaaaagcagggaaagcaacatgaaccaaaattgcaaaagaaccg

SEQ ID NO: 1649 - DNA, 1237 bp, Zea mays
  misc_feature (1)..(100): optimal_loci_223692_G1, chr6:102305927..102307163, Cluster 10
tgctaggactcaaatacgggacgcgtgaatatttgggagaagataggaaaactgttggatgtggtatttctgatttctatggctaaaacgagttttggggtatgtttatgtcgctttttagacttgctctaagatagataagtctagtggagaaaaccaacgtggcacaagacggtccccacacaaccacctcggcccgacgcttctaacgacctctgtcctcctctagtgacctttgtcctccgttcaaagtactctcacaaacactggcggaagactcttatggcaaggtatgacaaatgtcatattttgatttgattgtctagagaaaatattcctctaatctacaactacaagtctaatctatcggctgccatgtttgttctggcgtaatctaaggaagagtacatgacacttgtattatttaggccactctattgctatattctatcggtttgtcgatgtctaaatcctaatagtctatatataactcgtctaaactataatagtcttcgtgtatgtactggtagtagcttgctttcttgtacacattagttactcgacattatgaatgatgatgatcagtgaatattcttcgctgtcaaagctccatctttctttcacttgtacaatctctctcgactctcgttttttttttgttttgtaaagaatatatatatttccttggtgagcagttccttggccgatagctagatcttctcgccgcgattgaggatgaggaggaggtgctctgccgggttcggtttgtccggcgtcttgtcgccgggcaacgatcaggcgttggtgttgcctgttgggcacggatttgcctttgcttatgttgtggaggaggcgcgaggcgggaggtgggactgggaggtccccgtccggagtcgggactcatggctgcgggagctcgagcgcgaccgccgcggcggacggggccgatcgggatcggaagcgtgctccaccaccacaccagtgacacggccccgcccctggaccccggtccagcgtgcggcgtggcggcccggccgtgacccgtgagctgcgtcgccgtccgccgcggaaggctccgcccaacaacgatgaccgccggctgttgacgctggagtcttgacagcctgctgctcgctcgctcgctcgtgtgcgactgcaacagcatgcagtgacacccaccaagttgacgactggaatgggacggagagaacgtgatcaacagacgctcgatccagag

SEQ ID NO: 1650 - DNA, 1238 bp, Zea mays
  misc_feature (1)..(100): optimal_loci_224238_G1, chr6:104970841..104972078, Cluster 10
cccctctcgcgatgatgagtcggtcttacgcgcagctacaatgacatccggcacggcacttgcgtcgactgagccgatggtgatcgatgcgaggctgaaaacgtcttcggctgcgtacgtcggcagttgtgtacgcgtgaatacgcgaaactaacgccgccaatgatggtatgatcgcgcgccagcgccaccaaccgcggcatgctgtgactgtgctcgagttcgtcagcgatcgtgttcgtgtggtgttcgtgtggcgtggccgattcgattctatggcgcttgaaaacgatccatttcgttggcttgtcgtcgttgctgttaaaagccttttgtttgcatctcgatcttctttacttgcattggctgctagagtttttgaatttgacatgccagctctcgttgtacctgtacgtacctgatacgatcggctccggttcaaagggcgtcgagttggtccgatcgacatgcatgtatgtctcttttaaccttgcgacgacttgcgagaaaacgacgaacaatttaaataatgtcatgaataatctagctatatatagatcctgtacaacgtacgacacctgatgcagaagcagaaatcatttcctccacaatcgtgtttttcttcttctcttctctccttagctaatcttcttataatatatggctatatattaggggcatggacgacgtttcgtcaactgtacgttggttggagggtacgttgcttgcttcagtagtgttttacttttgtgttgcgtggttaacgcgagtttttaatttacctctcgtgtcatgacgactgacccggtcaggcggtacggtcaccgattgtttggtacacttcaggcttaatccacatgtgctgagttggactagagtacctaaactagtcttcagtgtttttatgtagcggtgagatatatgatcaacaacttcttaaaaaaatgtccgtcaggcctagctacaggtatgattttcgtacgtagagattcaatacccctgttgtgttccgatattacttggtaacccagtcatttataatttatcttggacggaaaaaacattcagaggccaataatatgaaatgtcaatagaaaatacaaccttcatagttgtttttatcttcaaccataaggcatatgagaatttagtcataaataaatcctagctttatgtttcatgctgtcgtcatcatctagaaaaaggccaccgtcgctcgtggggtccacttgatcttg

SEQ ID NO: 1651 - DNA, 1001 bp, Zea mays
  misc_feature (1)..(100): optimal_loci_225895_G1, chr6:112963784..112964784, Cluster 10
acacctacgatcgacatgttcgcgtatccggctgtattcgggtatcgtcgtcgttgcctgactgaaggcgacctcgacacaccgaacaacgacgacggtggtggtttcggtactatctttctatacgcgccggcgttagaaaaacgacagagaaactgcgtgcagagacgccaggagaaggtacgttacggtgtcctctgcggcatacggcacgtacgacggcaggcgcggagtagtggctcgcggagaggagacccggccaataagtcgtcttccatggctgccatatcatgcatgcatgcatggccaattggccatggtccatgactccatgtcactaaaactcgctggccggtcattatgaaaccgatgcgtacgtgtggctggcaatgtgaaactgatgcgttatcttgtcatctcgatcgagcagttaatgaatcgatcggggctccatcaacaatcggatcggatcagttcctgacaagggtgcaatgagtggcttgatgttgcatatgggtgcaagcaaagcgatgcgttttcttcttcgctgcgcatcaattgggaaagggattggagattaggctcgtgatcctgcatcctggtgttaatcacggggatgcccgagcacggacgccgcagagtttaggtattggggatcagctgggactctgggaggagctgaagcaacccgtcgggcgtacgtggccacttttctcgcctcgttccgtagcagctgcgggtacaagccctagttgatggcgcgcagtgttccatccactttgtatatctaaccaaacacactctaggctggctggctggccgagagggtagacagagacacagacggcaaataaaatcagtctgcgccggctgaccagtagagaagtcgacgcgttcatcggctttacttgaacaactgttgccgatcgctgactctgagtggaagccggccagaggcagtttgcaggctgccggctcatgtctagctatgccgtactttg

SEQ ID NO: 1652 - DNA, 1080 bp, Zea mays
  misc_feature (1)..(100): optimal_loci_228586_G1, chr6:128057817..128058896, Cluster 10
cccaaaacccccgcttaagctagcggttgtagcacaaagaacacaacagcatacagtgagagcagggtgataggtatggctccgaactcccaacgtcgaggatggagaccaaggtcgtgctccacttaggggctcggggccagctatgacggctatcagaggcgaggctgccctaaaggggagggggcgacgagggcccaaggtgagccagatccaatgaactcaacgactgctgcacgctacaactgaggtggagtgctgcctgaatcgcctcgacgcggggcccaagggagtcctctagagcgttggttttcaccttgtagtaattttaacatagtcatagaaaaaaagcacatgttacaagatgcgtacacataacattaggctgcaaatccatcaagccatcacccatgtggcacgcacgttttttcaatttacacattctcttcatggcagctccgttcattcacatcgtggctatcttcggcctccccaatccataatccggagccctcttttgatgagtttctggatccgccaccgagtggtgtaatatacatgataagtaactgttggactttacgtgttaagtaacaggtccatgaatgaaaattcacgcgtcagtcatgtttcattcgtagacagcgaaacctgcgatatgaaccgttggatccatcgtctccgccggattagtcgtcgtcttccctgacaggaaaaggccacttgctaccgtctactagttagtgcagtagtagtgctaccgggttcttttcttccgtactcgctgtccctctcaggttagcatccatgtagcaatcatcgagaatactacgttgggagtgcaataagtaaagtgacattatttgtttgctagcatacgcaaacactgattactgtcttactcgcacttgactccataaaactattctttgtttttctcaagtataagctcgccaagtcttcgaggtgtccatgcatccttacattaaaaaaaaacatacgtgttctcgtcaaaactgccacctaacgttagttccacgaaagcaaccttttacaacaccgttccgcgtgtgcctacaa

SEQ ID NO: 1653 - DNA, 1194 bp, Zea mays
  misc_feature (1)..(100): optimal_loci_229827_G1, chr6:133201965..133203158, Cluster 10
acaaaacaaaacaaaactggaacaagtagcagctgggccccgcttgcttgggaattggattgagatccgcagccagcatgcgcagtgtccaggctggaacagaatttggttgtgcaaacccaaggaaggatctcatcttctcttgtctttttttttccggtcaaaaagaaataattaagggaaaagggccgacggtgggtttaggacataataataataatgatgatgatggagcatggttgcaaccgcatccccgcaatcgagcggtagcgggcccacaaccaccgcacgagatgtgagagctactgccacgcgttgctgcagcactgggtcacttgccgcgggccacagcgagaggcgaggcccgcgtgtcagcgtcactcgcctgtcgtcggagtcggagcgaagcgggcgggccgcggggggtgttgatgggccccgcggtgaagtggagtgtggttgctggtggggggacaccccccactcccgtccctaactccgcggggtccacccgccgagaaataatgcgccgcgcgggcccggcgcacccgcacccaccctccctacggtctcaatgacccgcgggaccggccttgttgggggggaggggaccacatgtaggtgacgcaacacagctgggcgctggtgcatcggggcggaaagcgagcggggcgagcgcccggcatggcgagctgtgcggatggcgacgcggtcggggagcagcgcccggcggcagtgctgccagtgcgggtgatggcaacggaggaacgctctcggctctccccctggaaatggagctctcgctgtcactgtgcccccggccgctgtcccagtcccaccaccatctgggcagaccgcacgcctgcaatgcaacgcctggtcatgagtggggtttttatgaggtcgctcgctcacactggaacgtgtgggatctatttaatgccattataacgctttgtactggttttactacaagaatttggaaggtttttgggtgagaacaggcagattggtttcttgatttcttcagagtaagcaaactctttctacttttgaccagctatagttgaacctcgttcatactgccttcgatggaaaaaaatggtctaattgtcttccttttttttaataaaaactgtcagactctgcaaactttgaccaagattgctctttgaaatatctagcattgtcatt

SEQ ID NO: 1654 - DNA, 1156 bp, Zea mays
  misc_feature (1)..(100): optimal_loci_232213_G1, chr6:144671749..144672904, Cluster 10
taaatagacaaaaaaaaatgagagagcaagtttccacattcacggtgatagttaggaaaagatggataaaataaggttgagaaattttagctctctaaaattggatatatgttttttaatcgaaacagacatgcttatagtgtgaatgagtcgagaatatcatagtgctatatttttaagattttattttttagaaaagatctagaggtttgaaatgaactattccaggtggactgctagaggtggatgatgagccaagcacttttttttttgttttctttgaaattgacgtaaccttatttatcaagatttcctgaattgtttgatatctaactctaagctgagtttaactagccaagtcgaagtcgtcaaagttacgcaaaatcaattcaattttattttaaaaagcaaaatgacatttctgaaacgagtcacgtactagtgtctagccgtaaagtggaccacattggataatagcccgtgcatggtcatggtcgtagtaggatactcgtggtttaccggatccttttgtactgcacattttatgacgacgaaccaacgagaatcttcaattgagagtttgtaatacaggaaccttggctgccaagaaatcttcagcggacgtccagtttgattgactcatcagttcttggaacttgattggaagaagtgcctcgatgccggccggatcgtccgtccgtgcactacacacgaatacgatgcggcacattccaaatccctatactctcgggccaccgaaaacaaacacgatgtaaaagtccatccgagccaaacgaaccaaaacctttccgaaaacaatgtagcccccgggtgcataaatcctccccccaatgagttcaccgaacgacgtacgtcgtagcgatggcaccccggcgatgtgctggtgcggccactgcggcgccgtccaccgcctccggcggagggcgggttcgcgtcctacgcggcgtgcggcagggtcctcatcctggacctgcaggaggatgcggtggcggctccacctccacggcagctgtggcgacgtaagaggggagggccgctcatgacggttacggcggcgtggcgggtcgaggcgccggcgcgagacccgaacgcggagatgtgtcggacgctgactccgccgtcacccatacaccgg

SEQ ID NO: 1655 - DNA, 1194 bp, Zea mays
  misc_feature (1)..(100): optimal_loci_232311_G1, chr6:145312630..145313823, Cluster 10
tagttttggtgtctttgtgtggtgatctttcttcttcaatttttttttttttgtgtttttatattgagcatattcaacaatgctagtgattgaattgtatcttgtcgccttaatttagttacaaacccaatttagctcggcctagactagaagatttaattctcctatagttataaattaaatttggttatcttatagttctaattaaatttgcctagtgtctttttttaatccttgatcctataatacggcttgatcatataatgcacaagtgctccgacctcgacggaaaactgcctccgcttttctttccctgatgcgatgcgagatgcaaggaataccaatagtgtaaaaaaaacccagacataggtgatggatgtgttggatgctaatggatctatattgatctgaatataataaggtaataaattccaccgaacacacttgtgtagacctaaaacgcgtagtgtggacagaagcctgatttgcatgcgactgtatggtaggaaaaaaggtaaaataatagtatacttcagaagcgaacgactcgacaaacatgagaagaagaacgtaaagcattttgtttatgttcatccatgattcgttttcctctgcgtcatggcaacgctcggtagaaacttcgatcctctcgtagcaaaattgaacttgtcaactcccgaccagagctaagcttggaagaattttctagggaatggaatcgaaagcccccaacggctctgctgagctcttctgaacgaaccgtcaacagtgcagcagtagatcagatctggctcatcagtcacccgcgacctcgaccgggagtgcacgcagcacgcagcagagagagagggctcagagcgcgctcgctttcaagcggaaccgtatccgccgcatggttgcgcgtgctcgttttcagcaaagaaagtcgctttattatatacccccgcccgggcattttcgatcaagcacacaaatacaagcgggctacgccaaagctcctcgagcaaaaagacgccatagaaggagcaaaaagtccctgaaccggcacagcaggcgcctagcttggcgcgactccacatcaactcgatcgcatgcaaacgagcgagactgaattggagctcgcgcgctttcgctgcattgaagagccctcctcgtctgatcgggggaacaggtaggcagcagctagcactggag

SEQ ID NO: 1656 - DNA, 1297 bp, Zea mays
  misc_feature (1)..(100): optimal_loci_234616_G1, chr6:155447376..155448672, Cluster 10
tcctgttggcctcttttctaagttggataaatccgcatctgatgcaacttatcctgtcttgtacccaatgaaactgatctcaagggaaggtctactcctcctgaatttatgatgtgggtcctggaaaacacccaacccaagaaaaaaaatagggaatttcttgagagaatactttggctcctgaacatgttagaatgtcacttttgctaacacgatctaaacggtaaataaagggtgacccattgtttatagcctatgataacattaatcctaaccagttaatcggggtgctagaatgtcacttggtcggatcacggatgcactcggctccaagcctccaaccctacctctacctgtgtgtctgtgttattagatcagagcaatctctgaaacccgacttggtcagctcggtctctgtttccccgtgatattccgatcagtcagtccatcgctacgagtagcttggggaccgacctaatgcatggtttctttgtcctggggcacctagtggcttgcactgacgcaacctgtgctgtgcagcaacggcgttcggcgtccagcgtccagccatccaccttctcgtccatgacgaccatgagtggctgggtcgttttggcagttccattctgatatctacgctgcactgttcctccttgaaccgtgtgatttgttgcaggggaagtttttttttccgccatgtacagcgagtgcgtgccgtgctcgtgcagtggctggcatggcatggagtataccgactactatagtgcataatcctagcgcagaagctactgaaatgcctaccgttttcgttggcgccatgctatgatgctatgcttccaagttgggagaaccggagaaggatgtcaccacaagacaagacaagggtttccacattccaactccacagctctgaactgggagctgcgaaaccacgggcagcgcaggtccacaccgctcgagagattctctgatgattaggctgtctcctgaagctattctatcacatactctatttcaattacactatagtataatatacagtaaaaatttcctattttaccctattttacactatctattttacacgaatggtataaccataaaaatataaaatgctatctctactattagcacaagtgaattctctagagctacatcttctgccttgttgcaatatgttaaacatagaagaaagttattgagtaggagggtcctattttttctagcttaccgtgtatgtgtgccactataaatatgagtataaatatgaggtgacccacgagagtatcatgttatt

SEQ ID NO: 1657 - DNA, 1273 bp, Zea mays
  misc_feature (1)..(100): optimal_loci_235815_G1, chr6:161466907..161468179, Cluster 10
tcggaaaaaaggcccacggggaggtcaaaccctgcgagtgtgacgctgacgctgatgcgagcgagtgcgatgctgatacagccactctatggcgctggcaacgagcgctcaagctcccctgcacaccacccctcgatcgccacacatgccgatcgagccattgtcaattccacacccgtcgcgattgggcgcaggtgcaatccggcgtggctgggacgccaggctaataagagggctcgagaagaagacctagctccgaggtgcaaatatcctcagcccgcgatcgaattcatgtgccaatcggcgtgcgtctcaccgtcgaggatgggagcagccggcagcggcgggcaactctgccttaaccatacttgggttcaaagacgaactaggggaagagagacgaaggaaaggtatataagagagacttgatatatgatcgtacgtgtgctacatatatgtcaacatctgagatgagatggctatttaaagtttactgtgttaattagaattttttacatcaacaaatggttatctgggtagtaccatacatatagctgcgacaacgtaccgattcatttgcacttttagattacaaaaagttgtttctatatatacttgcttaaattccgtaaccagcagcagtatccacactatggtattttaacacgatttttttttctttcaaaacctttggagaaaataagaaagaccgattattactgttatcttaaggatttatatatatggactacataaaatatgatcgtatcatggaacacccaagattctccacacgcaaaaaaagagttccgcggtcccctcttaatggcacgtgcttggttaattagtatcccaaacaagtaggttgtagataaggacaaaaaaagaacctttgtgaccactactacttggttaatccttctagctaggtccaccacgaaagaagctgcaaacgcccacttttggtcattctcaatgaccctctctctcttgctattgtttatacttaatttaatgaaggagcaggtgaagctagctttcacgttttacagatccagtttgttggttcattggacgtacgatgcctgtagtgatgtagatgtagtgcaaccttttcttattggtcgggctgtgcaacttctcgctgtgtgtatttgcgtctgctgccgccaatgcctgtagtgatgtatttgtgtattctcggatgtgagcaagcgcgcatggaggcggggtgaaagaggatgcaaacgcgagcgcttcacaggaaacacgt

SEQ ID NO: 1658 - DNA, 1367 bp, Zea mays
  misc_feature (1)..(100): optimal_loci_235934_G1, chr6:162139345..162140711, Cluster 10
ggggagggggggggggggttggcccatgcatacacaatgacagcctgtgtctgatttttttctccctgaatacacagggtcactcgtagtatggagcactatattgccagtttttacctgtgtcacaactgctgtcagtcagtgagtgagagagagagagagagagtcaatgcacagctgagcccaaacgaaagcagagttgcgatttgcgaacctgcagagcacggccaggtgagaacgcgacgggatgacccaaatgcgaggtcacggctgacgatcaaccgagtgagcgtgcctcctccggccgttacaccacccaacccaacccaagcagagcaactgctcctgctagtccagtctctcaacgcacgcagccataccatctgaaccaaagactcgtcggacttgagtattcctcgcgggccgggtcggtccacgaaggaccagcttgtagtatctatcttcctgaactggcgttcaataaatattgccaaaggagagaggactactattgccacacggccacgggagacgaagacctccatgcctccaggtccaggcgccggccgtttttgtgcgtcacggccagcgtcaacagcgggcgcgagctggttaagcgctgacgcaccacgcagcttggactttttttttccgttctcgttttcccattctgttccctatttctggaaaggaaggaacggggactgctggcatggttccaataactctctctctctctctcattctccctgggtttggggctgagctgactgacctgaagaacgcttgaccttcttcatggggtgacgctacgcctgacgcaggctcacgtaacgactgattgttcaggttcctgggagctcagctaacctaacctctgacaaaaagtcagcttaggcgatgattccggtcagccacaccgtcgtcgttcacgacggcacctggggtttccggaaccatggatggatggggcgtgcaagtgacaaaatctggcagcccgtttggtggctccgcaccacttgtgcccttttgtctggcctggtccctttggggcccggacgttgcactgcacacctggactgctggacaggtctctagatgcagcaatacgagtatgcatgccaagtttgttgacagttggaggagctggcacctggcagccacacaagaattcttgggcagggctgctctttcgtgggtttaggccaactgacctccagaacatgtgcaatctactactagtattaagtggcatctagatgcgtacagtaaaacgcgctgtcagcggtaacaaaccgttggtccaagatcggagaaggctgaacgatgctgccacggacaagggaaaacaaaaaagatcactgcca

SEQ ID NO: 1659 - DNA, 1098 bp, Zea mays
  misc_feature (1)..(100): optimal_loci_236036_G1, chr6:162566681..162567778, Cluster 10
acgggtggatggatcgacttctcgtcgtaggatgcatcggcgcccacaaactaagtaaaaggtgatcgccatgcatgacgtgcgtacgcaattaattaattagttaattagtaatgagagcaaacaaaagcgtgtgggccgtggggtgaatgcgtggtgagtggtgacgacggcatatataaacacgtggaagaatcacagaaagatgtgtgtgtgtgtgtgtgtaagacctggacgatgatggacacgcacgccggccgccacacccacacgatagataaggatggatggtcgtgtccggcgccctcgtcctcgtccgtgtgcttctcttgctcgatcaatcgcaaactaaacagtcggcaaccaaccaagttgcggcggtagatagatagcagaaatctctctctgtcttttgtgctgccgctaaagaatggtatactataaaacaacttggggctcgtgatgaggtcacgacgattcgacgcgtatataaaagaactggataaaaaaggatcatgtgcatgcgtgcgaacgcagatccagtaggcttgcggccctgtcagtgcacacgcgaaataggaagcgctggcgtcagccacgcgctgatatatctatctatcgtctatatagctactatacatatataccacatgacatgatgcccttgattaagtaataacctcccacatctatctatctatctatctatcgcataccacgattaaactagttaatccccacagtatccgatcgacatccatcgctgcacgtacatgcacgccacttctctgagatgagatggcccaacccagccgccgctttcagataaaatgttctctttcccccctctctttttttttcttttaaaagaataaaggaacgatgcttatgcatgctagcaccagttaagcagagttgattaaaaatcatagaaaccgtcttgctgcaaaaacaaaatgccctattttttaaccgaaaattgatgattgtcttttaaaattttgaacggatttttttttaaaaaaaactaaacagacgggaaactgatcctgaaccggaggaccggtatcagaaaatagtctcaaaagtcaaaaccca

SEQ ID NO: 1660 - DNA, 1154 bp, Zea mays
  misc_feature (1)..(100): optimal_loci_236038_G1, chr6:162568074..162569227, Cluster 10
ttcagtttatcggtcgacacgtacaccgtgtgtggacatgggacagagagcgccgccatggcttgcaggacactggcgccgccatggcttgtgtgtacagcagggaggtcctgccgccgaccgacctggacctggcttttccaggtgctcaggcgaccctagctcgtcgactggtgtggtggctgtcaaagccggatggaggtgcgcagcgcgttccgcagagggctcggtgctctgatgattttggagggtcagtagtatcactatcacggcaggcgatgaggaccctctctgcgttgctcagtaggttggatgtctgtctgaaactctatagttagaagccgcgaaattaaagcattgggggcactcgcaaaccaacccgcgcgcggatccctaccaaatctgcatattttctttcgtaatcctgcacttaatcatcgcttgatgtgtgcagtgcagtgcaagagagggacgcattggcatgtatggcagctttgcagagcagactggcagggcatgatggatggagacgaaggtgcagcaccgatagaatagaactagggaggtcgatgggcagggcgaccgagcaatcaaacaagcaaaaaatgcgacgggcactgtcgctgttggcgatacagctgctgcacctgcactgccgctgtccaggggggagccgagctaggggggatgcatctgaggaggaggatagccagccgcagccgcctgctctcctctgccgctggtcggtctggtccacacttcatgtgaacgccacgccgcggccgcgcgcgcctgcctccccttccccgtcctcggaccccgcagccgcagcgcccccatgccactgccagccagccgctgtggtgtggactcctcggcggccctgctgcctttcccatcccatccgccgcatggcgcacgtcgccctcacggaacggaacccacgtggcgcggcaagggggtggaggcagctgggtgggcccttcggcttgcctctctgctctgtcctggttcgtgtctcgccagcacgaccccgcccgcgtgcatggacactggacaatcattggcgcctgaaccctggatcgtcactcgccacgctccacttatactccgctgttcatcaccaataatcgcactcacctgttgacgcttca

SEQ ID NO: 1661 - DNA, 1307 bp, Zea mays
  misc_feature (1)..(100): optimal_loci_236039_G1, chr6:162573892..162575198, Cluster 10
caaacagtcggttttatattttctcgttgattctatgaggtggttctgaaataaatttaactgtacaagtgaaagccgattactgctggccctcagcaaaaaagttcaaaagtccatgcatggtggtctactatactatacatattctccacgtatgtgtcccttgctctgatggtcctctcttagcttccttcaagccctgcagtagtgcatctcacacgccacatgtgcatatgatcagtgggcgcgatcgatgtagtacatgtttgcgaaaaaaattttcaggccatcgatgatcggagtcggacattccgggcagtgttataatgaggcgataataaatgtctttcttgtaaatcttgctatcgatctgatctgtgacgactgcatgcacaccactggcctggctgcccgcccggaaagcaacggaaagtacgtctagctgtttggcgacgtcgacgtcgatcgagctagagaagagaacgtggggatccatggagaaaaaacagtgcgcggcatctcgaactgggaagagcacgccggcttctagagaacactggccgggcgtgtgggctccaacaactaccgcttcccagtccatgcagtctcccctaaaatttaaaacttaaaacatataattctcattaccaactatatagagttccagtttcaataattgttccgtgtcactcttcccgcttaatataaaaataaattaaaattggcagatataggggtttaaatcttagtcgttgaatccacattctcaccccacctaattttttttactccgtcactgagtgtaagcgatatgatttgtcattttactttcttctcttcttggtgtttaaacacacacaaaaagaaatggtccccggtagatgcgaggtaaattccagtgggaagagacacgggcaacagctagcctagcttcaccgactggcgactgctccagctgatccatcgaaacagataaactaaactatggcagccatccgtgcaggcggcagacgaggctacacgtctcctgcagaaaagacggacggccgagctagagagagagcaggcacgccgtgctggcggactgctgcttcgtacgaggatacctatccatctgcactgcctgctcaacatgacgtggtggccgtacttcgggattttttactcccgcgagctaataatctcttcaacttaaaataaaactgaatatctaaattattttatcatataaaataacttttattctcaaaccagctatgcttaatattcaatctgaatactagtttacttttatatgtattcgatca

SEQ ID NO: 1662 - DNA, 1295 bp, Zea mays
  misc_feature (1)..(100): optimal_loci_236404_G1, chr6:164553788..164555082, Cluster 10
catgcatatcagtactttttgatcggttgttgcagtacaactacctcatgcttttccggatttccagctggttggttgaccccgtgcagcaatgtcagcaaatcagactatataatttttaatgttgctgggagaatgtgcagaagcagggatcccgtttttttggttttgtttcttcattttcattgcaaagagaagacgagcaaacagaagagatgagagacgtgtgacgtgagtggcgtgaccgggtcatcatccaccgatccacggcacacgcaaacgtaaaaatcgtgccgccgccgacctgacgagacaggtttggcggacgcgctccgaatccggcacgcgtacggccggtgcctcggtctcgactctcgccgccgcgcgtgtggcggacgagcgcgcacgcggtcgagcgcgtcgtcgctgcgccgtgccgtgccgtgccgcatttgcgcggtcgcgcccgcagcggatcgatcagacgtttttctcgcttgcagacagccaccgcgtcacccaacacataccaaagcatgacgcgatcacgagcggccattgcaaggacgtgactcggactcactctgacgtcctactcgttggcagctccccgtcgaagcgtcgacagcatcctaggctcctagccactatagtcgtcacggccgcgtaagtgagtatgagtctgtttgagacagctcagctcaatgatttcaattcttcgtcagagtgattttaagtaatcatctagtagaattaaatctaattggcgtaaaacattcgataaatagccgagaatgatttttaaggggttggagagtaaggaacaggagcacgtcgggagcactgtaagtacaaaacagataatattcgcttccaccacagagcatgttagctttttgttgtctgttacttgagagtgattttcgctgtaaacggagctacaatatatttcgtctgttggtgggtgttgaaaaccaaaattatctatcttataaagtatactcctactttgttccagtgtaatacctagaacgaactttattttctgattatgcgtgcaaaggggctacgagcctatacttcgatgatacttttaaaaaaggcagatatctcacataagtccgtaaaaagtttattaggactagtttataaatccataactttctataattgaaggatattattaaggggaagtaaacatttcccccctaaaccccaacggatttaagtttcaaactagtcctaatgtagaggctctttatgaacatgtagactaatccattaccgtgtactgc

SEQ ID NO: 1663 - DNA, 1295 bp, Zea mays
  misc_feature (1)..(100): optimal_loci_236662_G1, chr6:165975716..165977010, Cluster 10
agggcgcgcgtcaagacactagtactatttactcagtgggctagcgacgctgcccgtacagcactgctgatagacaggtgtagtcctgctctgtctgctcgggatggcatgccgtcgctgcagtctgcgccatgctgcagctgcctcgggatggcaaaaggggatggatgcgactgcggctagggcgctaggcatgtactcctacgcttgccgcttgctcctctagctggatcagctgagctgagtgccctgggtgactgggtctgggtgtgcttgatcccatgcaggttgagaacagaagcagtggatccctgccccagtgccccggattccacgtcccatccccaatcccactcccgtgtacaaagggagagcgtattgtactgtacgtactactagcgtcgtacagacctgctgctatgcatgcagcagttgccctggccagcaggctgctgcagacatgaacacacgagagtgtcggcctggcgatgagcgcccgctgcacaggcgttccatccccccccgtaccacgagtgtccctggtgcgggggaagcacggcactcgtagcactactagtctgtcgtggttcttcttgcgtcgtgaaacttggtttccgagacgggattcacgattcagatccaaagaaaatgcagcaaaaaaacatgcacaaggactgccgaaaggacagtcagatgagctactgtacgccagaccacagcacgtcggtatggggctatggccatgggggatggtacaggcccactataaaagcagacagaattcgagtcttttgagagcaacatggtgacatgtcctgactgcccaacacgacgtgttttcgttccaaaactcgagcgcaaaaaaaacttttgcacgcagctggtttaaattagaagtcctaattatatactccacgaatcaatggttaaactctacatgtaaatataaagatgattgctttataaaaaatacaacgcttctaaacatctttatttttttacataatatttaaaaccgccaacttaattaactcaagaatctagtcaccgtagctctagggggggtgtctaagccatgaagctcagcaaacaaaaaaaatccatacctataaaaggcacaacttctaaccctagtgtacctagaaggccaccttattacctggatgtcgtcagtgtcttcagttacagttaatacataggatgaaaaagaaatcgccattgctaactctgactatgaagaaagtgcatatcttatgtcagtagcatggagtaccatatggggtatttacctctat

SEQ ID NO: 1664 - DNA, 1107 bp, Zea mays
  misc_feature (1)..(100): optimal_loci_238375_G1, chr7:6304622..6305728, Cluster 10
ggctgcttctgtgattggatcggatagccagaccagatgcctctgcgagggcgccggctagtggccaaccccaccctgatgcgtgatgtctgactggggacgggactcagcatcagcgtgctccagtcgagcaggagtgcgtggtagtagtacactgacactcacccatgcatgggcggaagcggaatggcatctgctacctccgatccgtctctctctctctcactgtctctgttattacgtcaatgagaacgaagaatgtaaaatcttgcagtatttcttgtatcgctagccgccacaggacaggacaggacccaccattgcagacttagctcgatcgatcgttcgttcccaaaattaaacgacagtgactagctagctagcccgggccgaggagagcgaggacgaccgtcggccgatgacgcacgcggcgctgcaacagtgtcgtcgttgcccactgccccgcgctgcgacagtcactgttgtggctgctacacatatataatactgctatactggccgtggccggccagggcgacgtgggcgaccaagcaagctctcatcctgctgcaacagtcactcttcgcgccaacatggcaagatcgtccacgtccagtgcatgcaactagctagctagctagctgccgaccggccggccggaggcctgccgtcgccattcttgccccatcctgctcgatcgccatgcacggcccacgccccggcctgctgcgtgcgtgctgttagaccagcggtcaagacgctggagtatagcacatgcacacacaccccggccggccatctgtctctgtttgtcgttgcaagagtgcaagacagcgcgcgatccaagagagatgagctgcctgggagagggcacagggcaaacgacgacaaacgagggacagggaggcagcagcagcaggggttcaatcgtgcacatcagaggcgtgcggcgtttgcatgcattcatgcatggattattgattgcatgcagttgcttgtcttcctaggctcctatagctacctagctagggtgtactactgttttgggacacaatgcaatgtgccactatatatgtgtgccagctagtcgcagctctcctccctcat

SEQ ID NO: 1665 - DNA, 1399 bp, Zea mays
  misc_feature (1)..(100): optimal_loci_250331_G1, chr7:85704354..85705752, Cluster 10
accttaattacaaataagaataaaaatatatgtgcgaaatattgataatgccggcgagaatattttcccaaacgctgcgtcataacgcatcagtatatatgacacgtgtagaaatcattgaagtagtttacgattccaaactctaacaaattatacttaaataagcaaaaataatgcaataggtaagttgcccaatcgccttggcataacacatacatgagtctgatacccttttactactcaatttaggcgtcattctaacttattaaactttttacataaataggcataccaaatcaagagtccatattcgtatctaggtactacattgttcgtaagacgaaaagtcaaagtaacaatatacttattgtcaggaatattttttaaacacaaaatacatggtaaaaaaacgtagaaaactgaaacaactatataaaagaaaaggaaagaacatgcattatgaatgtcggaatgctgaataaataacataaaaaagatattttattactcagtagtcgagtatatccgtacgttggtttggttttaatataagctgcagcaatccaaacagctgtatttaatccgaatcgaaatatatttaatattcggtgtcgcattagtaatcttgtgtttatagttgatatgtcgaactaagatatatttggtgtttatgtttaatatctgaggaatatctcgtagtatgtattaatttttttccaaattaacatttggaaattctcttggttcgaacttgcagtcaggaatctgtgcgaggcggttttgggggagtcttggtagccaaggaaggtgtgcacgagagcataagcccatcatgcccatgcaactacctacctccaccgccactagacgactcgagacgcgagcgtgtgggtgtgggtgtgacgctgacgactgcctgcgtggcatcctacgagagtacctccgccgcagcctgcagcatcgcgtcgcgtgcgtgactctgcgggtcccacacgcggccactcaaaccggtccgacctctccgccttcggcctcgaaccgattggccgtaacggccccattcatttctgcggccgcagcagcagagcatccgagcggtcgggctctgggatgaacggttccgatcgccccgtcctcctcggcgtggaacgggcaggtccactgcatcgtggcgcgcgcccggttttcttggactccaagtagccgggtgttcccgccgggtccaccacgccacgtcgccaccccttcccgttaccggcgcccccactctgcagctgaaccgttgctcctgtagcctcgtcggctgccctgtgcacaggcgcacagtagggccggctggagacgtcgcgcgcaaggaacgtgctcggctgcgctcggttgcgttttttttactttgata

SEQ ID NO: 1666 - DNA, 1404 bp, Zea mays
  misc_feature (1)..(100): optimal_loci_25586_G1, chr1:155187202..155188605, Cluster 10
ggggggcgaggggacagagaggggtgggccgccgctggcggtggtgtctgacaaccctagggtttggggggtgctggcgcaaactcaggaagaatactgacaaggtgagtgtctaaaaaatttatagtgtaaaatttagagactattaccatccctaattatgagtgattttagtgagattatatctcctttttttctctctcgctccgtcctgtcaatatgctacgtagtaccttgagcagcgcagagatttatagattctatctatatacatacattaggcagtagcacagactcctttgccacgtcagcgcgtcgcgctggctatgcccctgctactgctagcctgccactcggtccggcggcccggcccacacgcgcgcgagcggctcttcggcacggcacgagtggacgcatggatgatagcgacggatccagcagcagcacgagccgacgaggcgacgacgacgacgaccctgcctgcggctgccacaggcacagctgcacggcgcggtggctacgacgatccatgcatggcatgagggaccagcagcatggtggtgtgtccaggcctccggggagagcacagtccgtgtttctggccacgacgtgcatgcatgggccagaggcccagagatctctgctcggccacccggctgctctgctgcaggccctgctctgatagtctgatgggaatcatgggatacgcgacgccacggggagccgagctggagagaagggtacatacccatcccgaccgaaataactgaccgtacgtcctacattttctaaaagctccttattcggctttactttaatccatattgatttctactgcttctatagtttaaattacagttgcattagtctaaactgctagcatcggcacacatgaggacggacacggacctgatcgacaggccgctgctgcgcgagctagcaggagtatcttgccgcctgctcaacagcaacagaagccttggcgcgccgttgctgtccgtcagtactcagcattgttgacagcaggaaggaaggggcggacggacggacgggtaacgtcgctgtccgtcagtcctcactcactagtccagtcctgcagtgcgacccgcccgggacagcgagtggggccccgcctccccgcgcgcgccgggcgggggcggcgggcccggcaccggcaccggcactggcactggcaggggggcaccgccggcgtgcgtagcggggcggttgtctcttctgcttctggcctcaccaccaccacaccgtccagtccagtactgctagcaccagctggggaagaacaactgaaacaaacaactgtgtcacgtacgtacgaacgtacgtcgggacgattaggactaataccggctgccatcatggcagcctggcacactacacacacag

SEQ ID NO: 1667 - DNA, 1201 bp, Zea mays
  misc_feature (1)..(100): optimal_loci_256599_G1, chr7:121221842..121223042, Cluster 10
atcctagtggcggccccttctatctcaattctcaaaagaaaaccgtgccataatctaaacggataggaagttgtgaaatgctgacgtggtgggaccatgtttattattttggattgaaccgaatctaaccctctcgtaatcctataaatgaaccaagggcgaccgtaccgtcgtctctttttccatgtgactttcagcttcccgcacaggtctgcgccgtcgctggtgacgctgtcgtcctggccggcgcgggccccgtgcatcacgtttcggttcaagagagaagccaacccttacacacccgccttagcctaatgatgatggttccaggcccagcacggccgttactgtaggacgaccaacagctcgcacgagatattttttttgttcagcgcttcgccagatgtccttttaattagaaaaccagatgcgacatgcatggcctcggatatttgcagcggctgcagctagtgctagtgtgtcaactgtgctagaggcctaccgtaccgagcatggaccagcaccagccgcgaaaatcacgtgcgcgtgcgctctcaaatggtgatccctgctctggccggcccccttctttgaatgcgatgggataacttgcatgtgcaccgccgtaggcaactcggcatatatgtgcgccctggtccgaaacgcaggtgaacgccatgaatcgcttcttgttttatgcttcgtgagcatgtactagagttttcgaaaaacaaatggaagcacgtgtgtcctgcccagtgccggcccggctcgcatcgaccaagaaggaaagtaggcagtagccgtcgacggccgctcttccggtcgcagaaacgacgggctctaactctaaccgaagaacgaagacctgcagggctaaggtcatactagtccgtacaatgctgtaaaagtctgggcgcagggaaagatttgaaccacagacagagccactgggctgtttttcttcggcgacacgccgacaccgacgcgacaccgacggagagagcccggacgagagcgcgcgtacgccgcggtgcgtgcggaccggccggacagagatgcgtgcgtgcgtgccgaacccgacgcgctagctgtcgccactcgccagacgccacgggtggcagtggcacgatggacgtgccgaggcgtgcagggacggcaacgccgacgggcgctgcggggtcgcacgcaccacccacag

SEQ ID NO: 1668 - DNA, 1248 bp, Zea mays
  misc_feature (1)..(100): optimal_loci_257502_G1, chr7:125857805..125859052, Cluster 10
aaaaaaaccccggaagcaatctggcctggtgttaaaaacatgtagctgggcctaccttttagcgaccactacggctccagaagccttgttctatgcgcatacgcaatgggctacagacgaaacacatcaacttcatccaagtttcttcctgggccggatgacctcgtccggaagcaagaggaactttcttgggcctttctacttcattacggtttcggccttgagtaggttagtagtactcggcccttaaggtcaatactttgggtctagcctgttatacaaggcagcggccgttgcctgatatatactggtatacagctgtagcacacgataatacagtagtggtagtactgaacaatggagttttattcaacaatttcctcatgtgattctttttgttgactatatgtctgttttgttttggaagccgtaacaagggaccgcacagaacgatacgactagtaggaactaggaagagaacagggaagggggtgggaaagtgatgacaagttcggaattcctgcagccaaattccggtcctaggcctcactaatttggaccgagagaaaaagcagacacatatctcttccgtcttagcagtcaaacgaaacacctagcagaaccttctctgtgcgccgttatccgtatccagttcgcttccgttctcgcgtgagatcagcaaaagaagctagccttgggtttggactgaccagctggcctgcaaccgagcggatggatgcgcgccgggggtggctccaaaagtcagcatcttgtcgcgtggcaacggtcagcgctggcctcaattttctccgccccgcttctgtttcagttggtgtgaggcgtttacatgggcgatcagatcaccgagttggacaagcaattccccaaccaacaaccccttcgcttgcacgccagcatggtggagctatgcttacagaatctccggttcctgcactggcagaactttttttttttgggttcttaagattatttttaaaaactctaccattttttcccttcaaaattaacttggatcacgctcatttctctagccacggtcaaatcacattgcctcgcaattcagtctaacgcggttagtcgattgctatgattaaaaaaatatatatttgggtagagatgtaaagaattttagtcagatcaaatacgttacgaaacttggttgaatatagtatagtagttatatgttctctatgcttcggttagttatttagttagaaatctcctgat

SEQ ID NO: 1669 - DNA, 1160 bp, Zea mays
  misc_feature (1)..(100): optimal_loci_260479_G1, chr7:142815406..142816565, Cluster 10
cagctctctcttgttaattagtgaaaactatattttcaatagatagttttacacacatgtgactttcctgtgttataaatttatgtaggatttcaatagcatgaccattctaatcatgcgttttattcctgatttttgagaattctgtgtttccaatgagtccttccttagctttgttatatcaaacgggcccttgccctgccatgctgtgttcagccaacctagcctgctgcccctcgttgaatgcactcacgattgaacggtcgtctgcggtgccactgccagatccacatgccctccggtcactgtactgcactcactcagggctcatctcatctcacgagccacgaccacgactcacgggtacggcgcacgtacggtcgtggacgtggagtgagaccagttgcaggtgcaccggatctggtcttgtttactcctatactgatcaggggataaaaacaaaatctaaattagctagattttagatcatccaaacctaccaccacgacaccaccccttgactagaaagcctgagaccaaccagcggggcctgtgctccggcctccgtgtcgtcgtcgtcgccggacgcgcgaccagggtccgggggcctgacatcacatcagtcgcatgaaagatccgtcgagctcagtaaatgcttcacctactaggctactgccaccgccaccgccaccgccacccaccacgctcctccctgcctcaaacggcgtgctcccaacgtggctcagccactgttgatcgttttctgaattcctgtcccgggtttgatccggagcacattcttgtgtcttacaaaaaggtagtagaagacgaacttttatgaagtttgatgaaacattactgtttatatatatatatatatatataatgtgtaataaatagatttagatcaattacaataaatttattttgagataaatatcgatactgttttattaagaagggagacagataggagtactctttgacaggatgtagcagggagaagcacgtgcgtagcgtggagctacgaactggggaactgccggagcccggatgctcctggctggtgtcatgctactcagagcagtgctccttcatgaggcattactctgagcattgaccttaagcaggccatgcaccggtaccgaccgtatccatcg

SEQ ID NO: 1670 - DNA, 1007 bp, Zea mays
  misc_feature (1)..(100): optimal_loci_261029_G1, chr7:145720572..145721578, Cluster 10
gtacgttcacacccctaaagcatagaaagaaagctacttcggctgatggcactgcagtagaactgtagaagtcagtcaagtgagggtggccttcgcgttggctcagcgctagctcttttgcaggcaccaaggcaggcaggcagcttccgagcacggtacagtaccggggcggtagcagtatatgtatgcctgttggctgttgcctgtatatatcacaggctcaggcaaacatctcgccacgccatgcatgcatgcgccgcttgcttaatttatctcgatcggcgaggagcggaaggactcaggagaaatctcagggagagcacatcatcgtacgtgttggagccagacgaggcaatcggatcggacaagcgcgtgaatgaatataatgatggaccatggtggtgggccacacagcacacacactgatgagatgagatgagatgatagattgatgagcttgccgtgcctcgctctcctcagctaacttcagttagctttgcatcacctatacggtgtgagtgtgactcatcggtgaacggtgataagaagctgtcgtcaattgattcgatcagctctgattgagggtacccaacgactaattaaaccaccggttaatttcttcgggcttcggttggggaatgcagtagatggttgaccgatagctgactggtcattcatggttaatttgtttaatcgtgtatctattgatttttcatcacgtacggccggaggtatttatcctggcccatcaatatctacaacgcctctatttgatcattggaggggactctctgttcggcagttcgtgttcgattttgagggcgccctactatcgatccgaatccgatatagggtttgatctccatgctatccagcaacagcccaataaaacgatgtgtgacttctcgtgcaatatttctgatgggtcagagacatctcatctcgcatgtcttctcggcctccatcttcgtcaccttccaccatggcatgcgggattagggatgcac

SEQ ID NO: 1671 - DNA, 1235 bp, Zea mays
  misc_feature (1)..(100): optimal_loci_262398_G1, chr7:153825804..153827038, Cluster 10
gacagttacctcggccgacgattttatttggcagtcggacggcattgcgttcgttttgggtttgtttctgtggactgcgggttcacgagcactgaccaccccaggttcaggggattgcttgcggtggagcaagtgtataccatttcaaggagtgccgccggcctgcggtagcaggcgtcacgctttcacttactttccagaagaaaaaaagggcgagagatacgggttacgaattctctgtcgcacacagagtatcaaaaactctatattttttcttcgtcctcgacgcatatatttacaccaatctttttttttttttccaaagatctttggtggttgttggtttcaggggacggggatatatacagcggtagggctcgacatatggaccacgcgtccggatcactcgtgatcttacgtgacatgtttcggtgttttcttgagaaacaagattcgactggtaattttctacataatttggtaaaaaaaaactgtcggaccacgacaaagttaacatgtgtgcttaacccttctgcttgtgtatctccgctactactagttggtttggctctttcaggttcggtttaaatagcgattgaatgatgctgagtaacgtctgggcatgaccggacggtctggtctgaagacggtctgctcttaaaggaggacagtctactatacgatcagatattcagattacattaggtgacacggcatgagcagcgcgctggctagctgtcgtaggacccattccatcgtgagctgatgaactgatgagcggtactgagctgagcaagttaagcagcatgcaccctctcagggtcacgactcacgagttctgccgctgactgacgggctcgaatgctcgatggagcaatgccgtgtcagatatatatgcagcattattgcacgttagatcgttcgtgatgccaggtacgtacttatgccgacttgttcgatagatacatagcaaggttcttacaacgactttaaactacaagtaagtttcattttgtttttttcccttttgaaaggaaaaaacaaaatgaaataaaaggacccagacttaaacatggaccttgcagagttagttgccgagcagttagcaccctcaagctatgttgcccaacgacggtttgtgcatacatgcggccggagatatcaggagcggagcgccatgtccgggcctgccaggtagctttgcgtccagatcggatcactcacacagtcacaca

SEQ ID NO: 1672 - DNA, 1369 bp, Zea mays
  misc_feature (1)..(100): optimal_loci_263401_G1, chr7:158455498..158456866, Cluster 10
acgcagagactgagacatggtcttgatgtggcggcacgcgggaagaacagcgtgatggctagtgggatagagcagcagcagcagctattggagttggagatgttctcgatcatctacgctaagaatgtcagtgcgtaaaagcagttttggtactcagaacttggatggtgacacaaaacatgcacttgttcagcctttccaaaacatgccgccgtgcatccctcaagttcttggtctgtaatctagcatgtttgtttccccgcgctgcctcctctgacactccgcccgtttttgtccacagccaaaccggagctaacgacccacgtcaccgaggcccgcctgccggccggccggcgtccaatgccgtctatccgtgtgtcgtatatatcatcacatcgaagcacaccgactgaccaaccccttgcccgtatcggtcattcgatcccctactcgttctccgcccgcgtttaatcatatataaacgcgcgcgcacgggcatcgccgagtccgtcccacccacccacgaacttctacgagttttagttcgcgcgcggcagggcgtctcacgctcgatcgcgcgaccgaggcgagggccgagaatgaactactacaaccagcagcaggcgcccgtgacaggtacgtacggtcggtgatcctcaacgagctcgatccggaaacttgttttttcttccgccacctcggcttcgatcacggtttgaactgaccgcgtgccttttccgtcgctctgccaagcagcgtacccgccggcgaccgcgcccccgcttccggcggggcagccgtacgtgcagccgccgccgacgcaggcgagccacgtgcagcccgcgccgccgccggggtaccctggcagcttcaacggtggcatgatgaaccctccgccactccaggtggtggcgccccagacgcagagccgcggcgacaagaccttctgggaaggatggtaagcttcgtgcctttcgatcgcatgacaccatgcatatataatgttactgacccccactcgctcgctgggctgccttgcagctgtgcagccctttgctgctgctgcatcctggacatgtgctgctaagcaatcccggaggaagcaatagaccaaaatagtacctggaagtatcgaacgaactacggcatgctctccatttgtatctgtaagagagtccgtctgtacctggagaacaattagtgtttgctacttactacctgtaacgtgacatacgtaccgtcaattttattgtgttggcatgaggtttgtatttgtgaattgcgatgaaggtaataaagagttatcaagcagacagacaagctggaaataaaggggaaaaaacagataaatgttgaacatcaaaagtgg

SEQ ID NO: 1673 - DNA, 1047 bp, Zea mays
  misc_feature (1)..(100): optimal_loci_263644_G1, chr7:159860381..159861427, Cluster 10
ggcccactggtcactgcagtgcacgcaggcctgccttctcgcttgttgcattgcatgcgagtctgacggctagctagctcgggcggggggcaagagatctggatgcatgcatggcatgggggacgacccaagaggcctcgacagctttcacggtccatgttcttgcccggcggacagacgccccccggccgccggtttgcttcactgccggccttgttccgcatccagatcgtcacatgtatcagccgctgtcctgcagccgcaactgtttgaatatataaaatactgtaaaaaccataacccccaatcggattaaagccgcagcaaaccccttcccctcgcattagtattcccatccaccaacctgttctcgatcttaccatgaataatacagtcacgcacgctctttgtttcgctgtgctttgctgcatttcgttgggctgggaagagacctgaacctaagatagattatatatatgagtccaacgtctgcctaggtttttctactacgcatgcaatggaatcttgatgcacatagattattgagcatcgcattctgatgatctatctcatctctgaactgaattgaactccgtaggacgatggtgatgatccctagctgtaggacgtagctagctggagctaatcgatcatgcatggtatcagaggattcatgagtagtgtttgccctgcgtcgtcagtccccaacgtcccccggtcgcgcacgtcgcagatgagactgcgttaatacggccttgggcctgcagcccacgccacaattcaagagtcaagaccgcccaacctccagcaggctgcacgctaccagcaacgccacaggctacaaatacagagagggaccaggatggaaaacacaggcctttgcaatggattactcctacacgagaatatcagcaagggcctgtccgcatccgaaccaatggcgatactccacatgcgctaggctgttttcagtagatcacccatatagctgtgcagaacacagtataagagcaactttaagatgctctctataaaggcagcgactgt

SEQ ID NO: 1674 - DNA, 1162 bp, Zea mays
  misc_feature (1)..(100): optimal_loci_264301_G1, chr7:162981741..162982902, Cluster 10
ctatagttatctcttaaccagagtttatgcaaaagacccaggcttctttaggtgcaactacggttttgactaaatatgagtaaccctattctaaaaaggttatgcaacctttgttctagaccttaccaagatatcacaacacaaaatatggaagctttaaatacgatcaagatacaagctctcgttgacgcggcgatatctttagcgttgactaattcaaactactagttcttcataaaatacatatttttgttagatatcttaactgctagatcttcgtaaaattcaatgataaatattcttcttttttattaatctcgtaattttcactatatcgagaaacgtgaaagcttttttattcggttatattaacacgatagataaaatagttagaggacgggtagatagatagataaccataatttaaaaaacgaaggtcccttggtgcacaatcaaccgcgacagcctgcctccctacgataatatatgatgataataccggtgtagcgactgacaggggagccccaccccacgtgacgtttttttctggagtgtcggagacagcgactgttgttgggctggacgcctggacccacgtgtgcttgaaaacgcacagcacatgctctttctctgtgctgatcagctcgattccgttctctggtagcttaggctggtagccgtaggaccggaagaactgggcaactggcggcagtgcaccacaggcccacacccacaggtagtcaggtacggaagcacgcttcgttaactcctcgatcgcgcgcgacgcgacggcaggctcgcaagtcgcaacccgcggcggcccggcgatcgccttcgctcaatagcctgtctgcaggctgcagaaagtttggtaccgcaaagcccatcccagggcggcggatctagaaagcttagacaccaacgacgctcttggctaaattcgccgctagatcccaaggccgtcgttcgtcgtcaagctcgcacactcatccacagttcactccaggcggcgcatgcaggccgcccagccccgctgaaacgagagcgcagcgcaatcatacaagaagcggcaggaaagtgtcagcgtcggccagccttttttgcctttcccgagagcgtcgaccagcttttgccgagactgcagccatcggccgatcgtggt

SEQ ID NO: 1675 - DNA, 1168 bp, Zea mays
  misc_feature (1)..(100): optimal_loci_264305_G1, chr7:162998974..163000141, Cluster 10
cacgactagacgggctcagcctaatttccagtactagtcgacgagatgggggtgggtgtgctgcgtacgaagcgcaagtcctggattgtttgggctaagcctaagatagaatttgataatagcgagcagcgcgcaagcaaaactgaataacacgcgacagcacagcacctgatcctgcagctactagactggatggctgctggagactgggcttggcatcccatagtcttgacaggcggataatcttctttcctgctgttggatgcaaaaaaatcacctgtgaagcgctaatcatccggatccagtaaatcttttgcctctccatcgtctccgagcaaaagacaaataaagcgtacacccatgcattagccgatgtgtcgtttcagaacctcgtacagccacaaagacgcgagcattgcatggatgggagagcggtacacgtagacgatagatgatggcgcaggcgcgcggaccatcatgacagggcaggcacgcaagtatgtacatgcatgcaaatacttggctttgaagctcatgaaacccggcccccactctccgctcgatgatgcatggtctgaaccttactacagcagacgttagagattgttgtacgttggtgctgaaacctagctagaacctgaagggttccatgaccatgatggttgctaatcagcgtcaggcttgatctgatcgtcggttcgtcacggcccctagcgtagcttgtagttgatgtttccgaagatgcatgcctcgcttcatcacccacccctagcgatgcttttccagagcactgccgctgagggtgacgggtcatgcatggttttcccgggccctgccagcttcacctacccctcgtacggcgtacttgttcgtgtagtgggcggggcgggcatggtggtgatcatggcatgcacgatcaactgggtggtggcctcgtgaggacgacgctcgtctcgactcggcccatcctcacgtctctcacatcactgctcgaatcctcctcgtcgtcggcaccaacgtgatgcattgacaacagttgacaggtggcttacaaggtcacggacggtaatcctccttttcgacacaatcacaatgaggtttgtataatactccttttcgactggcctgacgttggtgctggagcatcttgggcgagaggcttggcgac

SEQ ID NO: 1676 - DNA, 1035 bp, Zea mays
  misc_feature (1)..(100): optimal_loci_264694_G1, chr7:165471876..165472910, Cluster 10
gggggcaaccgaggctcaaagcacgcggcggccagcggctggccgccgaccgggacggcgcagccgacgactggactggactgatcgatgcgcggtgtacgtgggcagagggtgaccctgcggtgcaggtgcaggtgcaggtgagcattggcttgttgtcctcggttggagctggaaccgcgccgcagcgtgctgctgggcgcccgggactcaccaaccgggaacagagaagatggttgggtgttgtgggctggtggtggtccacggctgatgcttattagtgcttttcccagggtgatggccggcttgcgtcctgcttaattctctgtgatttgatctgaagatgatggatggatggatgctgaaagtggagacagtggcaagggcgtgcatgccctctcgtcccgttgctcacacgctcgtctcgctccaatcctaccctaccctaccctaccctaccctcggtgtgactgagtcggtggccaacctctgagaaggtgccaaaaagaaaggtacgagtgttgcaagccaccgcccaccgacaacgctgcgcctgcaccggccgcccagaccccagtgcgccggaggccagagctcagagtcacagcacagcacagcacagattgctctgcgcccacgccacgcccacgcaccggacacggcgcatgtgatgtgacgccagcctgcgcggccgccccgccctcggcttttcaccgccgctagctgccgggagtcggtcacgcactgctgtgctggtggtgctggagtggagcgggcacgggccgtagtagaaccttgctattattgctgccgcttccatgcatccaaaggctcagcttcctctgaggcggactccagcagtccacctaaatcttattataaatattttttgcactgttctatatggtagactgtactgttcgtagaatatagttcaaatataggtatgagtatagttaaactgctggagagagtatgagttgacatgtacatatacattgataccggtagaaatggttaccatctagctaagag

SEQ ID NO: 1677 - DNA, 1174 bp, Zea mays
  misc_feature (1)..(100): optimal_loci_265119_G1, chr7:167814413..167815586, Cluster 10
taccaccgatcgtctcgacctgccgtttttttacactaacagagagctcactctctatgtagtagcgtgcaacaagcagaaacgtactaggccccaggtgtgctgtagctattatttttgacacggccggtgcgcgcgttatttcaaagtacgtactctttttcgcagccggccgctgaagatttgctcaaccgatcaggttacgaacgagaacgagccccctgctcgcgtcggtctgtctggtccgggaccgggagcacggactggcgacggagtcgacagtcgagcaagcagcagagcatcgtcctccgtactactcgttcaaaacgccaaactttgaggcccgtttcctctgtcggcctgcaaccaattaactactcgtaagatgcaacaggcacctgccgacagctcttgcgatgcaaatgcaccagcaccagtccaagttcatcaaacaacgccaacgccatgccggatcgtactgcacggcgccaatcctgctgcaatccatgcttgtaacgctagctgtcagtctgcagcattaccagtatctgtcgttgcaaattgcaaggtaacagcacacgctagggctaagtaagcccgaccgaccagatctgggttaccgcggcgtcatgccagctaatagcccgtctctctcgttcatgaaggcaaacgaggcacgcgcgcacgtggcagcgtcagaccgtgcccacggcgtatacgcaggcacactcgtacggaccccgccggccgtctggttcgctcgtcgagcaagcgcgctaaccaagttggcctcatccgggtgtgcacacagcacgcacaagctgacacgcaccgcacagcaggctcctagctagccgtggcgcttttttgtaccgagacccctggaccccaggcgacagtggcccgacacacgtacgggccagcgaggccactggccggatcttgctcggctccgcccgacaccagatccggatcagcgtacgtgcaggccataagaaaatgggcaggggggggtgcgggatgcggctgctgatcatcgacgtgcgtgcgtgcgatgcgaatgcttgctggacagacagggtggctcgcacgacgtcggccgtccggctagcgcggagcaatttcgacctgtgggattccctttgccggccgtacctgtggggctggcagtggc

SEQ ID NO: 1678 - DNA, 1040 bp, Zea mays
  misc_feature (1)..(100): optimal_loci_265141_G1, chr7:167946648..167947687, Cluster 10
ctgcttgacgcacgcagatgcggtgctagtttcacgtcaggttgggttgcgcttgcgctgcgcgccacgccgcgttgatctgcggcgcgcggggccgagcggtgcacttgctcgtcggtgacgccgacgtcgtccctgctgcctccatcccttgcagagccagcagtgccagagaggcgaggacgagcgtcgtacgccggcgcaccaaacttaacaggcgtcggcttaaagctagcaggtgatagatgcttgctagaggggtggtacccgacgtcgcaggtgtccactagccccgagatcgtgtttggtggctacttggggaccccgtacgtgtggcgttcgcgttgagattgagatccggtggacctcacagtgaaagcctgaaaggggcatctccgggacgcggcagcaagctttcaaccagctgcatctaccgtacgtggactgtgcttgcagagaataagtatagactgcctgttttttttaaaaaaaaaaactgtgcacaatacaatgtacaccggccgtgtacatcataatatttttttactagtagctccgttggcaaccgtaattaggtagagagactcatcgtctaggttatgcgtggtatccccgtgtctcagtcctaagtcctaacccgtgacctcctagacacacaaatgcacacaaaatgttcttacaaataaattataattaccatgtgtgtgtatagctaatacagatgtactgtacatgtgtcagctccacccattcaaataaaactcttcatatatatacaataatgggatgatcgtccattttgaactggtctaagacgatgatatatatactctcctgcatactgttcacgggtcgtagtacgtacgtacgtcggtacgtagtataactactatatatatacgacgaacgaacatatatgcgccgtgtgcgtcatagattccgtgctagcatgtggagacccggggtggcgtgtacgtacgtacggtagcagcaggggccagcgagacggcgaccatataataatatactgcatccattaa

SEQ ID NO: 1679 - DNA, 1205 bp, Zea mays
  misc_feature (1)..(100): optimal_loci_265142_G1, chr7:167947821..167949025, Cluster 10
taactcaatattttttgaaacaagacgagtatttaaagttttttaaaattaacgatatcatatatttataaaccggggtatactgcagccagcagacagttcttacgcatgcacgcggtatcttactacataaaccgatgagtactgcacatgtcagttcgtaatcgccgaaagatcgctgcccagcaggggcgtgattagtttagtttacgactaataaaataggggtccggtccggtcaggccgggtaatatatatatatatgcacccgacagctggagctgctgttggccaacctggagtcagtatatacgtttcctagttccatatttccatccagctctctctctctatatatcaagtcagccatatgctccatggatcaggctcttactctcctcgctgtgttgtacttttgtgtatatatgcaatgtatatatatatgcgtgtgtgccaacaaaacaattcgtgccatatatacaaataagctagcggcggcatttgactccctgctgctcgatcaggcatccgatagtgtgtgtattatcagtgtatatatatgtagtccagacgtccagtccacatctctcaccgttgttattacctgctccatcgatcgatcgtcgtacatactacatacgcgtgtgcgatttcttggttattatatatacatgtacacatattctctgcgtacgtgccaagtcaaataagcttagatgcatgaggtgagcttttaacctaacagcttgcccgatcaatattatatggttgtggcggataatgaactgatcgatgatgcatatgcatggatcagcatcgagatcttcttggagctagcagcagtggaccgcaggaggagcatgcaccacgcacccgtcatgtcttgtccgcgctggccgctgggatctatatcagcagaactggatcactccaaataattggtgcgcgcgcgcgcatgcacagttcttgtagcgcaccatgcaagacatatgaactactacctagcttaattagttagttagtttggattgtagcgctaggctgctactagtggctgctactcttttgttcgctcgtgaagagcttatatattggttgggaaataaaaggttggttttgtctagttattgtgcgttagatttcgttcatgtggaatacatgcgtgatggacgaagagaggccccggcgtggcccactcgcaagac

SEQ ID NO: 1680 - DNA, 1234 bp, Zea mays
  misc_feature (1)..(100): optimal_loci_265643_G1, chr7:170820932..170822165, Cluster 10
ccggggagaatattttagcgcaccaactcggttgcttgcaccaaaagtgctcccaggcctccacccatccagtacgtgacgcggagtcctggatcccaaagcaacgcaaggcaaggcaagcaagagcggcagttttgacttgttaacaatctttgaggaattctctgtgctggttaacacggtgtcaggctgtcagcgagatcgtattatatattatgttatatgcagtcgcgcgcacacaggcagcagcagttcttgcagttgcagacgcacagcggatggcatggcatgcacatgaaggccacatgcagcagctagctagcttggaggaaacggctactgtattattggaatcccccccagggtccattctagctagccagccatctgatgaatatctagtctagctacgaatctcactggctcaagaaggtcaagcagttccattagtacctagagagagagagagagatagatagacagggagatcgaggtagacgtttgaggaacagatcaagatgagaatgggtcaaacaggacgaccagaaacagcgaaggcatgtactccgtttcagaacaataataataattccgtgcagggaatggaactgcactgaacattgtcaaatgccaaatctctttatttatttatttatttatttatttatttctttaaatacaactactggatgaaaataccactagctgttggcttagccggccacttgacacacacgacctgtgcttttggaccgtgtaaaaatggccctcggagcgccgaaaaaaaaaaccctcggttcgaagagacgaggggtgcaagtttcaagaagagccttaaacccgccacctcccacaccgcgcctgctgatcgggagggaggttttggatcgccggaagaaccatttgtttgtgggttttgaagcagacgatgatgggatagggatcggttactggttcctcaagatccaagcttagctacccagtcacagccacagccagcaagtcctgtgcctgtgcttacgtgcagtgttgaaaagccacgccatgcttttctgctgcccaagcaacaaacagctcgcacgtctctttcgggcgcgttgcgacgattctggaaacgccgatgctgtgatccatcgtgagcagaggagacgaggctgtctctcatgtgagttgtgactgactgactgactgactgtggatttgaaccagcaactcaaccacgctctttcaacgg

SEQ ID NO: 1681 - DNA, 1071 bp, Zea mays
  misc_feature (1)..(100): optimal_loci_266226_G1, chr7:173482318..173483388, Cluster 10
ctcacctcacctgttgttcgttcctggccgaattcattcctaaacacaacacaaggaagctgcatgcatgtcatcgcaaccaaatacaccaaccttatatattgccacttagatactaaaccgcgtaatctggagatctttcctatagaaaaaacaaaacaaaacaaaacaaacaaacaaacaaatggaaatttggaggataatcaagcatgccaatgcactgcttaacttgattttgccatgcctcggttccgcgcaggcatgtcaaccattttcaggatgttgcatggttcaaaggcctgccggagttttggtatcagagggcatcttttggtgccatcttccccatggtaacttggccttctttcaagaagatgggccttttgacgctcctttacacggcgagcacgggcggggaactagcaaaaaagcaatccagagtcctggtggctaaaaaagagaaatgtgtgcacagagcattgttttgtttcatcaacatccactggccggcaaagcaaagcaaaaaagaagcgcaggtagtacatgcaacaaaagtgaagtgggctactagtgcaagcacagactgcatttggtcttccacatcctttcagactttggtcagtagcacttcactacaggggggttcagaaatttagctaaaacatcttcagttctgttgttctactgttgttgttggatcatcatcatccctccatctccatccatataccaaagtcgaccaacaagggaccagttgggccaggccatggaggcacagcatagcagcaaaggtctgacctggaaacagatagcatctcgtcgtcgtcgtcgtcgaacatggattcctgttgggcaccagcagactatgggccccaaacgcgcgtgacaccttacctgccaacacatcattgcacgcttgtaaccagggtttctacgatgtaaaccggatgtagccatagcttcatcaaagctcccaccttcggttgttgcttcatgaccaagtttttagggaacctacaagtcgtgaaacgagtgcaggtttggcctttttctagctttgtctcgtacagt

SEQ ID NO: 1682 - DNA, 1234 bp, Zea mays
  misc_feature (1)..(100): optimal_loci_266456_G1, chr7:174331317..174332550, Cluster 10
ccatccaaacatatgtatgtcaatgtatctgaaactgaaagcagcctactcgctgcttgctcatccatgcatactactacgactgcgagcactacactaccagcatacaccaaaatagatttgctcggaccagggaagcatatgtagcagactggataaagagataggcagcgccgacgcaacattcaggtgctattaggatcgatggaatggagatccaagtgagcgcgatggcagcacgccatgctagcttgctcatatatatcatgctgtcgcctcctttgactgatgagaagggaagctgttggatgaacaggaagagtacagtgtgagtgtgtgacatgacgacaatgtggcttgccggtccatccatgaccatgcatgctgatgcattgttatgatacctgtctatttttgaagtttgaactgctaacggaaataacttaattagtagcatgtttcggctgttatgtagctacagctgcaatccataaagacaaactactatagaagtcgcagccggagcaaatatggtattttaagcatagatgctggatgcttgtgcttggagttggagcacgccaccaaatatatccatgcatatagaaccacaattaatacaataataatataggataggatgtataggacgagagaagcagcagtagtgcctgtgtggtacgtagctagtacaagcaagaaagctacagagcctgagcctccacaggaggagaggaggcaaacaatggtggctggcgatgtttgtttgcaggcagcacgaacccattccatgcagatgctgacgatggcagctagctagctggctccaccccctgctccctgctgtccctggtgtgtggtgtgcactgtgaactgtgcagctgcagcttcaggtcgtcgtcgtcgtcgtcttcgtcgttcagttgcgccagcaggcagtagcaggccacgtacgtacggcagccgttgagctgtgacgacccggcccatggtggatgccagcggtgccacgccaggtgaaccctgtgcagccattaacagacgactcagtgttcaggtttcagcatctgctagctgcttattaatcggagagaatctaacctgcctcctgccatttgccatgcatgccgatgccatgccacacactgcacccggcctcccaagaatttattgtggccacgttgtcacatgcatgctagctataaactgcaccagcacctgctcctgctcctgc

SEQ ID NO: 1683 - DNA, 1236 bp, Zea mays
  misc_feature (1)..(100): optimal_loci_267584_G1, chr8:4254781..4256016, Cluster 10
cacaacgaacgagaacgagactcaagtctctatccaaaataatctgacttcgccatccaaacttgttgtataattccaatatcattgaaccaagagaaataaaggttttttatcccactatatagacccgagcacgtcttatatgaaataaaaggaacgcagagattatcaataatgaacgtggggtagcagtagcacaatgcaagaagtggacaacacagtttgtaatgttcttcttcaacagaatctttttcattcactcggggtcgttcttaatggctaacataccttcggcttcattaaaaaaacagaaaaaaaaaaagaacaaacattcggcttcgatctttagttgctagctagctagcatgtagtagcacaaaaaacggcacagcatgtataggcgttgatcaatctccatctaaggacagtagtcacggtacgttcgtctcatgcgtctccgtgagctcgtggcgccgcatggccgcatgacgacggcggggcccagccgtgactcatccagctcatcttctcgtccgcacgttacgtagacaaggccttagtaagcaggcggtggccaatcccgccgccgccgacgacgacgacgacgaagcagcagcagcagcacaagcgcttcggcgggtggcccatgcccatcccgtgctacctcgatcggaaggaacagcgaccgcgatccagctccacgactcgcgcctgcaatggaacaagcagaggcgatcgaatcggtccgtgtcgcgcgtgccaggactcactccgatctggtcatctgggttcaccggagtcgtggctgcggcgcggccacgtacgcgcgcgcgcaggggtctttgccaccatccagaccagactccagaggagcttctcagtgtccgactgtccgctctgcacctcggcgtcttgttccggccgagcaggatccgatcacaggccggactgtgtgcaccgttgcctagggctgcgtactacggggccatacccggtacgtgatacgtacaattcacgcctcgatcgtgaggagtcgggcaggacacttgttggtcatctctcgcacgccaccgtacgtgatgtgattgacggcacgtacgggcatgtctttgggactttttatatataaaatgcggcgctcctttttttcacctcgttttcggcgtgctcttaggcatcttcgacattgttttgtaaaacgctgttttatataaacggaactaacaatttcattta

SEQ ID NO: 1684 - DNA, 1068 bp, Zea mays
  misc_feature (1)..(100): optimal_loci_268883_G1, chr8:10867839..10868906, Cluster 10
tccatgacataaaagtcatattattcttcaccaaagaccggaagggggaaagagaaagcaactgaattcgaacagcctgcaccttgaagcgcctgaaccgaaggaaacgacacttcgacaccgcggataagcatgcccagcgtcggcggtggaacagacaggagacgcggcgcacggaggcggaggtgcgggagtaagtggcgggcgacgaggcagcgggccatgaataggtgggaagcctgacaacgatatccaaagaccagagtggaggaaaatcttgtcagggtggagggcagagttggcgcaatggaaatggggttgaagcgtcgatccttacctaggtccttcggtggtttcagaactcggctggcgagttgctgtggcagcggttggcgccctgttggcttcctcagtccgcgtcgggctagctgcggcggcttgcgtccggcgggcgaagaggcggtggggaagggggaacgacgccttcggccgcgtgccgcgggaaagggcagatacgtcagacgcggcgcaggcggcctggcctggcggaggcgcacacgacggcaggtgctcgagaaggggccgtgggctgatgatcatgggcctcattgattgatgatatggacctggtgcagcttgcatattggcttcacatgtttacctcttcccacgatccaaaaaaaaaacgatttggacatttcgttttttagagaagtcaaataatttaaactttgactcaaattataaaaatgatattagttataataaaacattaataataagtaataattatataatatattcttataataaatttatttgaagacataaatattgattatatatttgattacatgactagaacagatctcataaccattttttaaaaagagagtacataacaagaaaaattgtatatacggcctcttcaagtattctgcaagttcgatttgcctcccttaatgaaaaactagatttttagattcttagaatttttaaacggtcaaatttactgtttgagcgatttaaaaaaatattttgattgatatgtcatcacattaaccacga

SEQ ID NO: 1685 - DNA, 1179 bp, Zea mays
  misc_feature (1)..(100): optimal_loci_269090_G1, chr8:11802195..11803373, Cluster 10
ggtcttgagctcggaacgcacacacaaatttatttgccagagataagttcgaaacacggacacttagccccttttgatagatcaaattcgaatacggacaaataatataccttgcatccctagttttagtaacggttgtacatattcttttttttaacatacgatttttttttatgttttactagttatatataaataaatataaaccctatgttctagtatgcttctataacaggcatatttagataggagtataaatatggatacagtttattatgagttttaacgtattttttgcacataaggttgggacattggaagcattatttattgaatatccgagtcctgtccttgtttgtcgtctatagcgaaaatatcgtccaggaagttttcagttgggcacaggttggtgaatggtgatacctattttggttaatcctaggacactactactcccatctcgttatggtctttaatcccagttgtctactagtagtatccttctccctgaccatgatcacgcgtgtactgtggcggtatgggccgaaggaggaggaggaggagctgtgcgcctgtgcccgcgtctcgcacggcacgggcgccatcaccgccggtagtacgtactgtacgttccactggtgccagaaaagccggtgcgcggtcggggcggcgggcggcacgtactagtagctggcatggagcgactagcgaggctgctgttgcagcacgcgtgcacgtacgaatggctgaggccacaggccagctactagctaggcctagctgtagcgttcgtgcgtgcgacggttcccgtacgaggcagccgaggcggattgtcatcggattctccactgacgtgacatgccacggagtactccaactacagcttactaggtcaatcacgtccggcagctgcagcgttcgtccgtgccacgtcgctgccgccgtggccgtgacatgactccggctagcagtactgccttgtcgcgtttcttcgctgctagcgcgtgcctttgcgaactaggaggagtagtagtagtgatcacaggtaaagtagtgccatgtactgacatggctccagctagtagtactgcatgtgcactacacaacaccgcgctgtatattttttatgggcaggcaggcaggcagggccataggcggccgcactcgcatgcgcaatcc

SEQ ID NO: 1686 - DNA, 1327 bp, Zea mays
  misc_feature (1)..(100): optimal_loci_270191_G1, chr8:18430985..18432311, Cluster 10
tgatctgtggaagtttcattgctcgcatttactgaattattcaaacaatagaataaccatttactatcggaacaatacttttttttcaaatcatatcaattgctaggattaaaacataccattatgctattatattgaccttgtcctcaccattgatctatgttaaccgagcacaaacggaaaaaaaatagattgcagcttccaactgtttaactttaggacatcgatgaaatttgtagcaagcggcaagggacggtgcagccgtggagtcgctcatttttattggtattgctgcagcagaaaaccaaagaaatcatggagtcccttgtttcactggtattgctgcattataaaagggggaccagtgtcgactgagatggatccgcacttctagttgcggctgcgtttccttcacttctccgacgtggagctgttcatcgacccaaatgggggcttctccttatcggacatcgacttacactctctctctggatgactcacatgttggctctgaccatagcctccgtctgaccggcacccaacgtgaaagtggtcattcagcagctggcctactccgccatgaatgaggcgttgcgcgctgagtcatccgtctggcattcgaagttcaggcgagcgacatttgctctcgaacctcacaaaaacatctgagtagagaaattgtggtggaagatgatagcaaaatacctcggcgaagcagccagacgaacgcgaacgcagcgcgcgaggagggaggtgctcgaccagggactgacgagggaccgcaaacgccgtcgctatcgtggacgtcgacagcgtggtatcctccatatttttctcttcgtgtgaactctggaaagatcctcctcttgtgaattctgaaaagccctcggtgccagatgagttaaacagacagggagaacgctccactcgatggggctcgtctgtgaccgtcgatgctaaatcttgcgagtgagatctgatagggtgacgtggacgcgagagacgagatttgctcccgcgattaatatatagaaataaccatttttattaacctgaatattttttttaagtttatgaataaagcagttagaaatataacattatacagttataaaaattactcagttatatatgattttttgaacggcgtaccatttaaaaaaatcctggtgttcagaagctagcgatgaactgatgatcggctgatatcgttctgcgctatagcaccgatggagagccaccgcaatactcttattttgattttctgcgaacatcatccgtaaactttgcctctctgcgggtttgcgagttaactcgctcgcagcag

SEQ ID NO: 1687 - DNA, 1047 bp, Zea mays
  misc_feature (1)..(100): optimal_loci_270455_G1, chr8:19855368..19856414, Cluster 10
gagcctcttggagaggctacgtaccattcatacacaagcagctggtgtgttctgcacgcaaccaatcatcgtctccgcttgagcatggctacacaagaaactttaattttgatcgcggtccattagcatccctaatggcagccaataaccaggtcatgcatgagctacgtactcgcgtgtgaacagtggagtacatggcagtacagccgcgtcgacgacgatgacgagcccggccagtcacaggacaggccacaccgtcggcgtcagcccacgcgcgtaccgtacgtgtatatatatcgccatgtgccgaatttcagaggagaaacgcgtcacagcatgcagcatgtgcgtgtggtgtgaccagtcgagagttcgcgcgcatttgattggctgccagaaatagaacagcagaaagataggatcccgtcccgtccctcgtgcccgtgcatgcatgcgaaaaccgagctgcgatgcgagcgcgagtgcgcgacgcacgcgcctgctgccttcctgctgattccatccaacaactggcaggcgcaggcgaaggcgaccgcgaccctcccatccatccagtcggttgccatccacgcgcgacggctgcatagctttaagcgtgaagcaaaataaataaataaaaattcaaaacggattttgattccatctcactggcaatggcaagtcgtcgtcgcagcgcgaggttttcgttgagattccagcgaaggcccgttgaaggggagggggcgctgacctcactcctcgccacgcgatgagatcgtccaccaagctgtccgcgaacgtgttcgcatgtgggggcccaacgccgacggcgaggacacaagcgatagggagccggtgaggccgcgcgcgcggtacatctgaatcaacccttttttaaaaaaaaaccatgacggcggcagttctatctcttgctaattgaggataaataaaattggcctgtatgaaaaaaaaaactcaagccaaaaccattgtgttgaaattcgactccaccagagatgatcatatgacaaaaaaagctccatactc

SEQ ID NO: 1688 - DNA, 1174 bp, Zea mays
  misc_feature (1)..(100): optimal_loci_27178_G1, chr1:164644535..164645708, Cluster 10
gtgtagtctttttttatatatcatatcatcgtgggcttagtttggctcttattggggcatcgtagctccagatgggcagcccaataacgtttcgcggacgccatggcagccaccgccccagcctgcggcggcgaggaagatgctccggcggatatgatggaacgcctcttccgatctccgccgccgtcgtcccggtggccgggggcgtcggcatgtgcctggtccaagaacttaacttgctctgtgattctgtgaacttgataggtaagataaacatctgttgtaatcacagtggtttttattataatgggttctatccaagtttgcatcagtctatccaagcttattgtcttacgctgtttacatactgaagtttaaatatggatggataagttgatgaaggtagcctactgctcgttgctgtgaaagctgccattttcagattctccaagcagctacactacagatatgtatggacgggcaattttctaccgaagttttggacagagaaagtggacaccgcatctgccagccatagcttcctaagcgcctgtttgaatctcggactgaagtttagtacgtacagtttttggatgctaattacaagggctaaaaaaaggtaatggcgctgcagataagtggtcccttttgcatgcatttcgccttgtgcaactaactatctcatcaacttgccttttttttcactacattatcatggaatctgtattccatccctacgagtgcatcaggtcattttgtactatacatttggctgtcttttgccctgcaacttagtgcattgtctcatccaatggcgtcagtagttaccagcagatcctctcttcacctacatgtgaggagtagctgcagaggatcttgttgcgtttacaggcggatttgagcatttcttgtgagatgcatcgcatccatgtgcgcttctcagagctgccgagcccatgcatatgcactggtcaaacatcgggaacctatatatatatcacacaagcgattaggttaaagtgtgtgcaaaggttagacgaccttttggttagctgctttaatctgctcgggttggcatactaaagtctggccaacgtgcaagggggcttatccagctttttttccatcaatgatggcaacccaaacgcatacaaagctaacctgaccctgagga

SEQ ID NO: 1689 - DNA, 1112 bp, Zea mays
  misc_feature (1)..(100): optimal_loci_277835_G1, chr8:72301368..72302479, Cluster 10
gtctggacaggcaggcagccagaacattaggggcctacagtataccattgacacacagtttcgtttataagctgcagtgatggtctgaaatctgccattttttcagagatctgtgagaggtatgattggtccttactcctgatgtaaactgtgtgttctgacttgaagtatatactaaggagtaagtataaatttgtgttttaactcaccgtcttgcttggaaaattgggtctctgctgttttactctgtggaagttgagttgcattgcctggtaattgatatagcttttgttttagctcccccccccggcagtcaaggaagagcggcaattgcttaccaggcaaggcatacaattcggggtcggagtcggtatcagtgcagcctccaaacacagtacagagcatacgcaaattgtcggcgatcgttttggaaattggaactcctcctgtgctgtgcagatgtgggctcctgctgcttggacaccatgccgcttggagctttccaagagcgatcgctcctctgcgatgcgaccgcctctcgctctcgtcgtcggcgacttctccgcacgcgtctcgtatctaccgtaggtaataaggcccacctgtcctggatgacgcaacgcgtgctcacgctcatgacgccaccgcgcacgtagtggaaaagtggactaatgctgctggcagggttagggtcagggtcagcccccttcagtagttcagtcatcggcagatgccctcccttttcgcaccggaagcaaacaaaagctcggtccggcacatccatcgaccagcgccacgactccggtcagcggcggcggccaaggccaaggccagaaagaaataggaagattggacagctcgggtcacggcctcatacaactttaacgtcaaaccaaacataccagcatgcgttaagaaacgcaagggacacagtgagatgcaatgaatgtatgatactacatccaaacaaaagctatcatagggaaccaaagaaaactagctagaggtctctttgaaaacgcaggatcgctaaaacatagcgataagaaaaaaaatgtagatttgtatggcacttaaagttccatatatatatatatatatatatatatata

SEQ ID NO: 1690 - DNA, 1285 bp, Zea mays
  misc_feature (1)..(100): optimal_loci_282656_G1, chr8:102707112..102708396, Cluster 10
caaatttaccactagatatatgggcatgcatttttatttctattggtgcctatatataaattatgaaccgccaacgaaaaattacaaccattagcaaaactcgaccgtgtatactaattaatgtgtagttctatggaaatatagagccaacaaacgatgccaataaaacgacacacggttggttctcatccctaacacacaagcatatataaataaatgcatgtatccgatgctgccccactccccacctggtctagtagctcgctttccccggccgaaataatgcaggccaatccactccatggcaccgctagcttttgacctttattatatctcgccggcggtcgtcgtagtgcttttgctagtaaatgatcgagtggcgtcctatcttggcgcttttgttcgaaacgtgagcgcacattctctggccctggtttaaggttccacatcaaccggctgcccagctaggggtagtacggtctacggtgtaagaaagggcaccgggcagcggggacacgcgcttggatatggtcacatgtcttgttcagagtggcaacatgttgatgcctttttccgtactagatcagctggtcgcctgacccactcagtggtcgaccggtgggtggcggcggcgatgcccaagtcatgcgcgtcgctgcggttccttgcaacggccaattttacccaccatgtggcgtccaagtatatgtcgctcgctgctggtcgtcaaggcgagatccagagggccatccagagaacggcagcggcacatgttggaggtgcacgtgcaaggaacagccagctagcgcagccgcgcgcgcgtacgtacgaacgaacgttctccgactggcggacggacaggatgtttctgctgccgtcaatgaccgggcggcgacggcgacggcaagcacagcggcctgggcccggcaagcaataatgagccaccgcgctggatcagtcgctctgagtctgagagtacgtgagaggcacgcgccaaagagaagaatcaattattgtatctgtagtggagccgagccgagacgagagggagggttaggaatccccggagatccttcccggaggccggagatccgaccagtcatgtcgatcgatcgtggtggccagggttgctcagcccacgtcgcgtcgtccctgtgtccccgtcgaggggatcctccggtgctgacacggcggcgcgggggagatctcctgtgctcctggaggctggggccttgcctgctgcctgctggccttggggtctactctttcgtctttccagctcgcg

SEQ ID NO: 1691 - DNA, 1347 bp, Zea mays
  misc_feature (1)..(100): optimal_loci_28517_G1, chr1:174286222..174287568, Cluster 10
gtaaacaaaaccctacagtttatggcactggacaagcatacatatatgagccatggaatatatatatgttttttgaacaacgagaaatatctaacctctgccactgccagccaggcaagcaatcatggacggatggacgccacgtgtgcccgcgccgtacgtcgtagtagtaggatccatccaaagcttggcagcaactatccaaaaaaaaagaagaaaaaagaagacaaaatacggagtgcggacatcgacgatcgcggtggtgtacgtttgtttgtctccgtcaacggcggcatggccaggctccgtgattgaggatgatcttgtcaggaaaagcgagggccagtcaggccaacgcatgcaagcggccgtgcccgcccggcatggcagccggcgccggccgcagcccagccgccagccagccagccggccactgcgcgcacgccaacttggcgacgcctctatcgcctcgtgcgccgcggcctcgcccccatccatcccactcccaccaggtcaggtcacattgtcagttgtcacagtcacaggggaaagaaggggtcacagccggctgggcgccacgtgtcgacaccctatcggtctgagttattccaactcttttttttttacaaattactgaacatatatcctagtacaggctagtatataaataatgctgccatcgcacgtacgcaggcagtcggatttgggcgtggtacaacaatgacagcttccagttagtactagctagctgatgtcaaaccaagccactgctaagacgtacagtacgtacaggtggcgtgctgctaagcagtggcgtcaagagcctaccgttactggctccaagtttcccgacgtgtcgatttctagtgtagctagattaattgtttctgagcaagcaagaggaaacagcgatgaacaaccctgcagtttattaattgatcacacacccttttggatcgaagaagaagaagacgataagctcaaattaaaaacaactgcgcgctttgacacttttgcccgatcgatcgagtaaacaaatgcaaaagtatcaccactttgcattggtaaagcaaacaatcaggctgttaattgtcaggaggagatttgtctgttctcttgtgtgtggatacggacagaagccatgttgtccttgttgcttgtttgtgtgtcgtctactttttagcaatttcaacatatggaggttgcaagcatggttctcctcgcgtgccttatcctcctatagctagtagcaggcagcagcatggggttttcatttgagctttttacagatccatcaaatcatcagcgccttttgatctcaacatgataggaacgttcacctagcta

SEQ ID NO: 1692 - DNA, 1019 bp, Zea mays
  misc_feature (1)..(100): optimal_loci_285800_G1, chr8:119379104..119380122, Cluster 10
aaagcgtcgttcacacggccacccgggaaagctaacggctgccactgcgctgtccctgtccccgccggccgccgcctcaccgggcgcgcatcgcgccggtggattcgccgtcgaaaccggccggtttcccagccagcccggatcgttcgaggcgcgcaggtcttcgattcgccatgcacgtctctttcctttccggtcgcaagtcatgagaggcaggcaacgtggcggcggcgcgcgcgctcggatccggcggtgggatcgacgagatgtcgatgtcctgaccagaccgccgccgagtccgatccggcacatggcgttagcttctcccgagtgacccgatcaacgggagtactggagggatcggacgacgcgaccacacccggccttttacgcgccgcgcgcgcgtgcggcctccccgcccggcgctcgatcggcgtcagcgcgcgccttcttctctccatcgcggacgctgaaatgcatttggtgccgctggccggaccaccatgcattattcacacgtgcgcgcgagggcagaggcagacaactcatcaccggggcccggccatcatgaccagtgattgaacgaacaaaagaagctatagcttccagtgacacagctagtcaggccacacaccactcttgcattggtgtgtgctgctcggctggtcccagccccacacggccccggctgtgccgtgtgcctaattttctgcagccgcaaaacaacgggcgggcatgcaagtgtaggatcttgcattctcaataccctagctacaaataaagttactatgggggcgtttggttggtttcttgctcatccaaaaacccgtgtttgtttggttggttggatcccgacgagtggtggatatctcgctcggttttcaccgaaaaaacggtaaaatttcccattcctgttactgggaaacgaaaacaagtccgtttttcagtgtgtctcggtttaaaatttgaaaatataaaatttaaatttggtcaagaaaacggctttttcaaaagaatca

SEQ ID NO: 1693 - DNA, 1152 bp, Zea mays
  misc_feature (1)..(100): optimal_loci_285907_G1, chr8:119898391..119899542, Cluster 10
caatgtacattatcaaaaggttcacgatgctcgtttgcatgattacaccattgcatctcaaaagtagactacaaattatcattcgtgaatcacgagcgcatatgatggtgtgatgcccgaagctcctcgcgctcacatttctcatcaacaatacaatcaccagcgacaccgactgcattagcacgctcgcctgtgccagatggagtgggctcccctaccattagctctcggagccatgctctgcctcaccattcaaaagctcgacgattcattgacgccgctcgtttcgccctgttggatggaccaccgacaaggcatttgattgtgattcaaatccaggggcactaagactgaagacggtgatgcttccagctgttctccggttcgaacatgcacaatgctcggatttgcgcaagtggctttggaggttggggtgcaccattgacaaacttgtcagaacggaggagctccgtcgtgaacaggtaagatccaaaaattccaaatatatttccaaaaagaaattgccttgtgaaagagctcgttcgtgctataataattgagatacaaagattgaagctatggaagggcacactacccaaacctaaaatctcccctcccaaaatgctaggagatgtggttatcaaggacaatcgatcagacatacccatctgcaccaaagatgttgaagcagatcctacctgcaacatcaatcggtgaggagtcacaaagcccggtttaaattcaattgagcaacattgggcatcaggagccatggtcggagcttgctaccatggtgactgcaacgtgctcaacagaaacacaaaaaattgcgtcgaacacgtcacaatcatttgacgggcaaaaatgcgtcgaacacgtcgcagtcatttgacgggcacccagaaatcatggctccaaaggttcagatttcaaaaggtggcccaccaaagtcataggatttttcgagagtttgcttgattacaacaatcgacgaactagctccttctcgctacactcaagcttgcctattctatgggccaaagttgatgcccctccagtaacaccaatccgtaccacacaaccaggtgactcgacccacttatcattgctaggatacaacctctccaccaaaccgacatgatccgcattgaa

SEQ ID NO: 1694 - DNA, 1151 bp, Zea mays
  misc_feature (1)..(100): optimal_loci_290732_G1, chr8:146477950..146479100, Cluster 10
atagtgtgcttaacattggccattggtctactatagcacagttttggcttaggccctcacctgctggactagcgggcggtgcactgtgcccatagcaagtcttcattatggccttcgctgccttcaaagtagaggtaatgatagtaggcgtcatcccgcatcaaagggtttggttatgtgggaagtgaagtctattccgaaagtcttcaataaatccttctttcatgggcaccctaagcgaggcgggcaccctaatgatcgatgtcggccttctcccctacaatagaaatgctaagtttaggtactcacgggtggaacatttggtttactgcaaatcttgagagattatgcaaggtataaaccatagtaattttgtacatatactcgtgcaacaattttttttttctttttccttgggaccatcatcagttcctcacgcaggtttgaatatttccgaaattccatggaagagatatgccaatcgtatgaagttccagtacatcaattagaaaacatgtcgcagtcgtacccatatctgcttcaacggtgctaatcaatctagaaagtcgccccttctttttaatgttgaaaaaaaacagaaatatcaaaagtcaaaaaaaaggaaccccactacaaaaccatcccaccagtagtatagcagatcagcgtccgagcacccctgtataatccattgagaaaagagtggaaccactgtgggtccattgagaaaaggtctaggacatggggactgcacactggactggacttcccaacttctcagagcaagtcacggtcgtttttttttctacgagaattgttaaggaatcatagcgattgtcatcaaccgattttacgaagaaaaaaagaaatcagttcgaaacccttttttcaatttggcaaaaccatacgcatatggtttagaaaaataacagtatggcattggcacccgcacctccgctactgctagctggcgcccaccaacagaagccgcggcccgcggagctaaggaactccaggccggaaacggcagaggcttcgtgctgcttggtctctggtctctcgtcttcatctagaagaggatcaacagcagcactgaactgatggaatcgccaatgccttttccctgccgtctgcttccatccgtgcgcgag

SEQ ID NO: 1695 - DNA, 1004 bp, Zea mays
  misc_feature (1)..(100): optimal_loci_290967_G1, chr8:147711488..147712491, Cluster 10
ctattgtctccggaaccttgtattgtggaagaacctccataaattgggacggataggatttttggacagcaatcgcggccgttgatctatactatgatatctacggacttcgacagcatcgcgagaagaactcatcttagaccagactacggcgatcctcgcgactattaatgacgaatttctcattcgcgtttctactatatatatatgtccaagatatatttaatctgctacgtggacatgttttttatttgctacgtgtagagtgattgctttattatgattttttttaagaaaaaatgcaacatcttctaacattacgttgctgcgattggaaccgaagaatactgcgcaatcaccatcaatgcgtctcgcagcatctttccacttccaccaacctaaagccaccacaaataatcagccttgtccaatcatccttgacactactcatatatatgctttatatcaagtcggattattttttataaaaaaaaggaattcagttttctcacctactctactccgctcgcccactcaggtcagcactatcgtcaccacggcactagctgaaagcctgcaacgctagccaaatgagcccttctgccgttctgatgagctctgtctctgcgcatacgagctcgatccgtactgccatgtcctgtactgcaactccatggctaggcgtatacttctgcggatctgttgactgccatttattccatgccttaaggcttaacccgtgccaagtcttccgaggtccagtgtcgccgtcagagcaaaatatctagaagcacttaaactacggtcgaggtcacaaactaccagtcgttctcggtagaagcgggcgggtccagcctacgcctaccaccccgacagcggttggaagagccggccggccagaaggggcagcagcgcttgcagacaagaacaacaacgaggacaccgtatccttatccgtccacgtacgcttccacgatctccctcgtcgccgtcctcgtcacggc

SEQ ID NO: 1696 - DNA, 1231 bp, Zea mays
  misc_feature (1)..(100): optimal_loci_292356_G1, chr8:154658977..154660207, Cluster 10
gcagctgctctgctcccacaggcacagctgtcttccgctatagaagtttggaatatttacaacatcaggcgaggggcgagcgccctacattggcttcaagaacaaaggctgggctagtcctaataatttttgtttcttcttcttcttcacctcctaacgaaatttacatcaagaggattatagaaaaacatctgtagacatatacactgtttatgaaagatggcctaggttaatttctgaaaagtagaaggctttccttaaaaaaataaacaaccaaccatagatgtcatgtacagtactacggtagagtgagatcaacatgcatgcatgggacaaagtgaataataggtcctcacctaaagcaattccttactagctcgaaatgtctttcccttaaaaaaacataattgaatgtcatatctgtcggtagttgttgttgttgtgggggggggggggggggggggggggtcatgttgaatcatttccgagaaatggccagccgctaaaccggtgaggaaaaagggaataattatacagaggaaagtgtgtgtggccgtgtgggagagcaactcgaggtttaaggtagtaccgaacaataattaaaatagagataaggttcctgttttcatttcaaaagaagaaagttctttagatagaacgtatattatatatagaggggaaaaatcctccatgagtaaaggtgaattcggaaggctatctatccagaaacacatatcagaatcccagcttggtgctcggatcctgaggcgggcagaggggccgcgttgcgtcatgagcagcgagcgatcatgcgcgctagctcatcgccacgcccacacacttatgagtaatactccagtattcctgcctatccgcgtagaaaagggatgtgcccctcgcttctcttgataagcacttgctcccaacttgactcgcatctatcctccctcttttagtttggccgttccctgctgatccttggatttcacgcgtcaaagaaagattatacataaaaaggtgcccggttgccttgtgttggactcgagacctgcagcagcacgttttcttgttgaaggaggagctggacatgtacattagtacaacacagcacgagacatacgtgacttgcagatgcttcacggccggctgacgctgatgcgaggcaagcacgtcgggatcggatcaggtatcaaacgtgaaacgcccgcgcgccgccacccgataaaaaaaa

SEQ ID NO: 1697 - DNA, 1028 bp, Zea mays
  misc_feature (1)..(100): optimal_loci_292684_G1, chr8:156370240..156371267, Cluster 10
ggccagggaggtgtgagcgggcgggtggggcaagggcgcgtgcacagtcggggaggtgccatggaaggcgtggccaaccgtgggagggagatgacactgttgttcgaggaaggagattatacaaaacataagaacatgtatattatgttggcttagatggtgtgaatttgtgagtgtatattatttcagttctttaccatgtaaatttgtgtttatattagttccagactgatttttaaaaaaagaaacaaaacgaagtggggttacttgaacggtgggtatcgactgactacggggcctgtggagcggcgatacctacaagggattcgacccactcttcctccttgtctcctatggaaggaaaggaacacacgttgcttccgcggcagagggacctaaatttagcaactaatttgcacaaatcaagcgcaaagtcgagcagtgggcccgagagcagctgtgtttgtttcctcagcaaacagtccatctggattggagtctccggttcttggatgactacactgactccatgtctccgacgccgatgccatcgtgggccatgttagtatggatagcatgacaaaagtgttttgcttcacatggagaaaaacaaaagatagctcgcaatatacatgttcgagaaactgacaagcatctacttactttacaaccatttttgaagagccttagttcgtctctccggtttgaaatgtgtcgacttatttctttacatctccagctctctccggattatcagggactggaaaaaatcctactatgcaggacacagcaatcgcgcatctcatcaaagcaggggcaggaggcagttccaacagtcgaccgctcaacgagccatttcaagcatgcagaatctggcagctcgaaggcgtcaggacgctgaactcctatggagcatccacatcctgctagcggacgaagtaggctggccccctgctaccaggaccgaaagcgggctcctcccacacaaggccaatcgcaacatggatccggcctcgcccgacgacaac

SEQ ID NO: 1698 - DNA, 1016 bp, Zea mays
  misc_feature (1)..(100): optimal_loci_293940_G1, chr8:162540395..162541410, Cluster 10
tgttggggagtcatctataatagtgccaggacaatatatatatacacttgtcccgatatcataccagcatttaaactttattttaaaatactttgcagtctcgctatccaattaatctatattcgtcctctcaatacattttcctctcttttcctggtacatctctatgcctcttttcttatggagggcatttgttttttacctacagcattggtaccaatatatggttctaaaagtccactattttaatactacacacacacagagagagagagagagagtataactatgattaagaaagaagatattcttggtagctgttagtacgttcagagttaccactacaactacaaagcggtaacccagtaaagtggcgctgcattgccaagtcgcacctgattgattcggaggagacgctagctgaaaggaacaccaacaccgctcgtcgtctgcagttaccaccagtaccacggcgggacgatggtccatgaattcccctcggattttccactacagtgacagccacagttgcgctagtgatcagcgacgccctgcagctagcgtaggcgtagctgcgtaggatcaccgactgactgacgttcccggtggcccgcgaggcgagaggacagcccgcgaggcccctgcgcgttcaatgcaatgctcaacaactgaactgtactcctaccggacggacgacggacgtttgtacgctactgtacagccacagcgtctcttctgctgcgcgtcgtggcgtggctcaggcgttcacaggccggtggtggccggagcgccggagcggagcactcactagtcactcactactcactcactactcagggcagcttgctccgctttactacagcggcgctagagagccgagtactcactcaccctgctcagggtgcggccggctcctagtttttaaaaaaaatttttactgggacggggctgggagaatgtcagcagctgcaagggccgcaaggcaggagcagcagtcagtcactgattgggagcat

SEQ ID NO: 1699 - DNA, 1334 bp, Zea mays
  misc_feature (1)..(100): optimal_loci_294298_G1, chr8:164630636..164631969, Cluster 10
gtgttagaaaccttcagtgagaatgtccttatgtgtatagctcccgtttcataggatcgggcgatcgggggtggggcggcaccgtcctcctcggcaacggccaatgagcggatcgggaggccagcggcggggctgcgggctaaacacagccaagtgatgctattgaatgcggcatgcatgcatgtactagtaagtaagcgaggaaggaacgcagatgcatgattgagaggcaacggagcgcccccgatcggcgtccttttccaagcccccactcgaccaggaccctttcttcccattcaattcaatgccgtgatggccacaattcatgcgtcgtcgacaaaccagacactcggccatcatgatgacaaagccccggcccccggccctccctggctgcaggcagcgaatgattaggagaatttcgagtcactcatccaaccaagcggtcgatcattatatttaacccggccgcggccggtcgatccatggatggatggatggcagcagatgtcgatcgatggatggcttggctgcagatgtcgatcgagtactgctcctgcttctccttcttcttctgcatgataatcgctcgtaacttctgggagacgtcaaatcgacatgcatgctgctgtgctgatcttgttgccacagagactgcagactagagggctgggctggaccacggctggtggccggctgccatttctagctcggccattcaattccgcccggcggtttgacacacgaggtaccgcccggccggccattcaatcggcgcgggtggtaccgccccgccgcgcgctcgctcgctcgcggctactcctccatgtgttccatgtcgctggcctgctactacgtgtatgatggtgcaataatctagtatctaccactagtcctccaccaatctgccgccaccgtggcggtgctccgatatgatttgagccgtggctggtcgatgccgtcagcacgcgcgcccggtgccggcgtgttttttttttgttctcatcggggtcaacacaacgcctgctgtacgtgcgagacgcgcccgcgccggccggcttgttgcgttggtaattaacagcccagcccaaacaattaaccggcgtggcggctccccggaccccgccggagagcggagaggggactcggagtcgcgcgcgcggcgtgggcgtggggggctcctgtcgggcggccggccgccgtgccgtgcgcgcggtcctggcggcggtcatgcatgcagatgcagccggacggacggtatgggtaggtccggataataattcagctcggcttctccgtctcgctcgatcgtttagcggttcgtccagggtcca

SEQ ID NO: 1700 - DNA, 1040 bp, Zea mays
  misc_feature (1)..(100): optimal_loci_295369_G1, chr8:169250182..169251221, Cluster 10
atttctccttcaagcttcaaatcctactgtggcaatctgtgctaaacggggccctacagtcttggagacttggactgcttgcctcgcggtcagggctttgtaatgtccgtctccattttggtgtcttgttcagcccagttcgcatgcacttacaacaaaatgacgccaaaacagagcagccagcagcttccgctgatccaaatccattcgatcatcttttgaaaggctgccggtacggtgttctctagcaagccggcgctcacgtcgttgctcgttatggacgagtccggggttcttttttcccctgttgttcgtatcgcctctgcccatttggctttgatgtttctgccggtcctcacagccatgcgaccaagccatgccagtggcagttgggtttcaagactatgattctacgaaggttttgaagagtgctcgagttcccatctccatttctccaggtgcaggggagtcaaatggtacaaataatggctaacaaactgaaagtttctgtgcgtcaaagccgagtggccgaggcagaacagtagactccaaagtttcagcaattctggttacatggaagaccgactggaatctatactggtgctggtggtaattatttcggaaacatggtagactgatatgtacaccgatcgtcaccgcttttgtctctccagtctctgccttcacccccattcagcacacgttcacttttcgtaaaagtttcagtctaccttgagctttatggatggtgtattgagacgaaggcacgcacaccgtcgcacgacctcatcagcgatgatcaccaggttacccacaacataggaagaagaatttggaaactggaagggggcagaagaagaacagaaagatacgcggaatgattcgcttgccccccccccccccctctctctctctgtgtggtgccaagattgtgcctttgcttcgacagacatcgaatagaaaacaaagtgagtatttgtttgtgcctatagactaatatttcaggtacacgtctgaacttaacttgtctctgatgtttt

SEQ ID NO: 1701 - DNA, 1366 bp, Zea mays
  misc_feature (1)..(100): optimal_loci_295976_G1, chr8:172229825..172231190, Cluster 10
tagaggtttggaacatggcctaaactgacaactcttcgagattgaagaagtcaccataaaaacctcattatcaacaaaagcatcctatatcattgaaaagtttaccactcaaggtaaaccatatattattctctagagtcaactatcatgcgctcataaaatagaaagcgcgtagaaaatttaggcaagggtttactttggtggtgatggctcttggattgaaaaagagaggaacaataatataatatcaaccgatcaatactacgacacacagaaattgtggtttctatgaccaatgcaaactatgctaacctgtcagattaaaaccagtcatctctctagaacccttattttaacaagttagcgtgcaagcaactttgaatttgaatcgttctttaccgtagacattagtgtgtgtgtgtgggggggggggggggggggagagagagaagttgatctagagcaggtggtccagaccaccttagatttacaaggaacaagcacaactgggggagaaacttctgaaatgatctgggcatgttcgtgttcgtgtacccattgaccaaaattcagaaactctagaaggaaaccttgccgccagatttttttattttttttacttgagcatcttttcttcttcctctcccctgacgggccggggcaggtagaagaagccttcttccaggtagttgccttggcatggcatgcctgctggtgcccactgctgccctggcctagacgcaagttgttggttggtttggttcagacgttcaggcgatcaggctgagaaacgccggaacaacggcaagttattccagtcatgcgttgcgcattatttgctgctgttcgcaaggcgtgtcctcgtcagcctctgccacacgcgttcttctggtcaactagaattatctatacacaaaaaaaaagatcttggcactccaaggtgtttattagaacaattgattagcgttgtgccgctgtattgttaaaaaaactattttgaaaaagatgcgaaatggttcctccaactccaaagcttccagtttttcctgtctcccgtgccgtactagccgcagcaaagaacaaagcctgaagtgcactactcctgctgctgcatctgcaatggattggtcacatgcgtaggtcaagcaatcgaatgtgctacacggaatctacggatcatctagcgttctaacgtgtgtgctgctttgtttcccaacccaagttgccggaaccggtggtctgatctgatcctgatgtgccgtcctcttatctgaacaatataatgggggtactcctcaataactgccttttggttttggggggcatttgtttagtgctgagttggttagggttgataaagagtcga

SEQ ID NO: 1702 - DNA, 1192 bp, Zea mays
  misc_feature (1)..(100): optimal_loci_299997_G1, chr9:13486320..13487511, Cluster 10
gctagagatatgcgtggttaaatgaaccgtcttttcagaagtgtcgccgtgtgtggtgattcgaattgatcggaaacacatgcatgcatgcacggcgcagaagctagctggagctggagcccgatcgagaggggaaggccaagaaccagcatctcttgcgatttgtgaagaagtattttttccgtagcacagtacgtcgtaccaagtagctaggggaggagtacgctgattcattcattcatggcagcgcgcgcgtagtactagctgctgccggccttgccactacacggagctaaagctaaagcaaggaccatatgcatgagatcggtctgccccccggccggcccgatcgctctcatcagcaattactatgaagaactagtaggtaggagcagcttgaactcgctgccagccggcgagccatgggcgacgttggcgcgcggccgggcatgcagatgctgatgcagcagcagcagccagcaggtcaaaaacgagaggatctgcagttcatttaaaccccggatttcgccggagtgaatgaaatgaatgctgccgccccgcctcctcagtcctcacccgcggctgctagtactagtactactttttatttacgtgggcaataactgcggatcctgcggaatttggcgcgccccccgtactggcgcgggctgccgtgggccgtggccacactggccgagttgccagtgcggcacctggcggctggcggcctggctctggcttcgcacaggcacagcacaccgagctcggcgccccggcccaacgccaacgccatccctgggccctggctggccagacgagacgcgaggctgcccgtctggcggtctgggcctgcaggggtcgccagcgctacgcgacgcctgaaccgcatgtccccgtccgttgctcacggtctccgtttccgaggaagggagagagcatcggacgggggaaggggaattgatgatgcgcgctggcggctggcgctaccctgccctgccgtctgctgatcgacaagagcgggctgcagaccggtgctcgccgacatccacaacttttgtagcacccgtccccacaccacacacacacacacgcatcctgcagattccgatcctcatgatgatgatttccgctgtacgtacaaaaagtactacgtagtactagtacacgtaccggctgataccgtagataaatg

SEQ ID NO: 1703 - DNA, 1134 bp, Zea mays
  misc_feature (1)..(100): optimal_loci_300335_G1, chr9:15361529..15362662, Cluster 10
cggaggaagcgggggagagcaagggctatttatacagaaaggaaggaagaaggaaagaagtatggcctgtgcgagaagagggggggagatggcagcgccgggtttggttggtgtgggactgggagggaggctaagcaggtccccaatcccaagaagaatatagaacctgaacactactccaagccacaggccaaagccaagaaagctctctctctctctctggacccgacccatcatctggctttttgggcagatcgattcaaggagctttgttcatgtgaggggagacaaagggccagttctttaatccacacttggatcaaatatacacacacacccagtgtgcgtgcgtgcacaggacaactgaccggtgcttgatcggcttcctttgtggctagcacggtgggcttcgcggtgtttcacgcacgaaaacatgcctgttaatgcggctacgatcgacggacgacgacgctaaaggcaagcagaggcagcgggaaagaccggagctttctctcttgggtcggctcagtgagtgggatacagttcacctgcatccagtgaccggtcgattggacagcgtttccacgagcaattctaaagcgagggatttgcatggggccgtggtcgatccccctgctgaccgcgcgcgcgcccgcgcaaaaggtgtcacggattggcgcctcgcgtcgcttgccttgtttgtttccggcagagagagagatcagcgggtggggtacgtgtgtgcgtggcctgaacgcgcgctcagcttgtttcccgcgaaaggtccgaggcccggccggccgccatggacgggcaccccggtcgcccgcccgctgccggccatgttcgttctcgaggcctcaaaaggagcacgcgcgcgcgcgcccctcttcctttccttgacagttgcatccaccacgcacggcaccatctatctatctccattctccaacgcgtacgatggatcgcccgccactgccgatgggatctcaggatccacggcttcggtcgctccaaggtgagcaggcaccgcgccacgcctgctgacttgctgggacggaggacgctcgggggtgccgcccgggcccgtcaaatttggccgatccattagtcttacggcctcgatcagagcgg

SEQ ID NO: 1704 - DNA, 1008 bp, Zea mays
  misc_feature (1)..(100): optimal_loci_300497_G1, chr9:16650937..16651944, Cluster 10
tgccgcacaacatagcttcacgagatcctgcagttctagcaggaggcaggccggccagtgattctaactaacgcatcaccctctgcaagtttacgtacgtgccctggtacgcttctcccttttatctaatggctatcattgttagattaattatagatttagtagtgctacccccttcctctaattatcgtgatgctacaataatttagattcgtcaccttgagatcaataaatacaaaacactcgcatccaaaagctgcttgcagggttcaagctcttcccacattcatacacaaggtcgccactattttgggaattgctcctgtaagaagatcaaactccacctgcactttttagaagattttgaatagaaaagcatcacctataagattttgaactgcaattgaactttacttgaactgtttagaagattttgaactgcacttgaactgtaaactactttctggacacccgcatctgactagtttgtctgaaacatttaacagctggtagtggaaccgaaacattgacaagcaaacttgtgggttcaagctcttctcataatcaaaagaatagatgctggctacacataaagaaatatttcttccatgagaataagaaatatttacattataccataatctcctgatagagactaggaaacaagaagcagacgaatcacttgaagaggaaacgggacggatgacaagcgtggtgcgtcggtggctgggtagaggagcggctaacgccgacggtatgaggctgtccgcgggtggggagctggccgcgtcggtgattggggagctggccacgccggcgggggtggatggaggcgcgccagtgactgcccagcagggatcgccgtgcggctcggccgctcgggatcatcagcgtttggggagggaggcagctggcaggtggaggaggcggcgcgatggaagattcgttgcctcgttggtgatcgcgaataggttcgctcaaccgaggcctcatatttacgtcctctac

SEQ ID NO: 1705 - DNA, 1002 bp, Zea mays
  misc_feature (1)..(100): optimal_loci_301793_G1, chr9:23531631..23532632, Cluster 10
ttcggacgtaaccacaaatcttttcattctttcttttcactgtatcttttctcatcccaacgccatctttcccggccacggcgaacctcgagttcttgcatggtctctaggttgatggtatagggcagggcacgcacgtgtgtgcttaacctgctgtcatttttgtttagcaaaaaactagtagcacagcatgtcagcatcgttatccggggacctctcatgcttataggagaacaatgtcgtgcttctttcctccacaaataaagaggagaactctacttcgcagttgcggcgtcagacatctcaactcttgcaacgtacgtttccttgccgcccgggcaagtccgagtccgtacaaggaaccggtcgtcgagtcgagtggggcatctgaaaaagctcagcatccggtccggtccggtccagtccaagtgtcccacactccagctgcagctcgacgaacagaggtgacacgaacccaacctgggatggggggggggggggggggggtagagagatcagtacgtttccggacagagctggaacggttggtgcgccgtgcgcagttcttgctgacgatagtttagaaacgtttcggttggtgcgcgcagttcttgcggcgcctgccatgtctgaacctggacaccgctacgtctagctccgggacaggagacgagcgctttgaccggttctgattgtacacgagtccggagaagtgatcgggattcggggacagttgtgaagcttcgcaggctttgactaccgccacacacgtgtgtgtgtgtgcttgtttactagaaagatggtttggtttggtagcaatagcgacggtgaatttgagataatgacatctgctgctgtctgctaagaaagactggtcagtgactctgaataaaagaacctgcatacatgcagctagatataaaagaaaagaaacgttgaagcgtcgcatacctacttgtgcttgcgttacctacctttacccctgttggctgttggaaggct

SEQ ID NO: 1706 - DNA, 1144 bp, Zea mays
  misc_feature (1)..(100): optimal_loci_307149_G1, chr9:59404399..59405542, Cluster 10
tgccattgcaacacctaacagagtaacaggtgtaggatcggagatggtacggctatttcagctcatagccatagccgggccggcggccggacaagtggtacgtggcgttggcgtcgtgccgtcgtggtggtgcacagcaaggggacagcggggccaactagccaaggaagtggcactggcagtcgcaggtagtcagggaccaggccagggacagggagtggagccaaggaaagcaaaccccgctagcgctagcatggcagaggaccgcggcggccaaaccggcggcagaccgcagatgcagatgcacggcagggtggggggcgaagctgaacagcactactacagcaggacggcggcatccagtgcaataatgtcggcaaccaaatagccaaaacacgagctgggactcgaggttgagctacccgaatcattctcccaccataaaatcctttaggttctcgttactccgatctcgtaagagcatctacagcaggatctcaaataaataagcttctcaactaaatttgagagattatatcacagagacaagtttagtagggcctctatgaaagccttaaaaaataagtattttttcacggctcctcctcacctctcatttctagagaccctacttcattccgctctccgcgtgcaggtggaatcgcctttagcaccccccaagtttcaatttgagagttagatagaaattttatttaatttagtgaattatcctttttatatgtacttgaaactaaacaaataaatggcaaatacaaataatttgtgtgtcatgctggattattttttattgatgcgttttaagtgcagactcaaaatttgaagcatggtttaaaatttgaaatttgaaattgaaatagaaaagaaaaaaaaaggaaaagaacggttggggcgtcttccgaaggtcctcaaaacactaacttagcggctatttcttagcttgttcgagtgtcataggtataatgccaagggcaaccttcgactggagtgaccacgcttgtgaagatgaaggtacaagcttcggatgaatggtacgagtacgtagtggatgaacaagtcaagaccaagagaaacattgaagacttgttcaacaagacaaccgaaggaaaaaacaacattgtcctta

SEQ ID NO: 1707 - DNA, 1119 bp, Zea mays
  misc_feature (1)..(100): optimal_loci_313519_G1, chr9:98671824..98672942, Cluster 10
atatcaatataacctgctcgagttgtttcaattttttagttgattttctttcttttagcttccagttttcatttttttagtcagagttgatttgggtcaacgtggtgcgtggttttatttacatctaattactttatatagttttatttttctattatctaataaaaaccgcggcaaagcttctgccgtttttttcctaatcaataatataactcgctggcttgggcttgtgatgttttttttgttgtcactccatatgtcagcctgatagcaatgcccgcctcgatgaccgaaacaatagttaaggacccacagccccatgaaagatatcaccgaggactggctcggtcggcacactgcgccgccgtcgccatcgtccgccggaggcggccgagagaatctgccatggcacctgaccctgatccgacaagagaaaacgccagcagcaacgcgtcgtggctgggtgtcgaacgcggctgctcgagcgtcgaggtgaacgccgggcggggacgcctgggtgggtccgcggcgagcgcgacgcgggcgccacacgcggcgacagcgggcgggcgggcgatgaggcagcagcggcaggcgagaagcgcacgcgcagatcacccctcggggcccgcgctgcgctgcgctgtgcacgcggcacgccggccggatcaccagatcagtcagtccgacacggacagcgtttctagtctcgcttcggcgcttcctgaatagtcgggcccacatcgcgggtttccgtgggggccacagagcagttgttgcgttgttttcgagtggctaggatgcccgagggtgggggaaacgtgcgtgaggtccaccgatgcgttgaggcctgattctctacgcccacagctatagatgtgccagcacaggagtagaatagaatcccaattttagagcgagcgaacaactgatttcggacagtgccattcgtgcaacattagtttttgagaaatttcacatgaaaaatccaaagtataataaatgaatcctagtttgaaatataaatcaaaccactgtgaagtcaagtcagtctcagcggaaatttcaagtcagatttctgtgtgggttcccgtgagcagatcttgcgttggatgctgt

SEQ ID NO: 1708 - DNA, 1041 bp, Zea mays
  misc_feature (1)..(100): optimal_loci_315535_G1, chr9:109309277..109310317, Cluster 10
ccaagcgtgcgtgagccgcggcagctttgctttgctagcgccagcaacggaatcggcgggagaggactagaggaaagggttcggtccacctgctcccggccgcaacgcacacgcactctgcactgcaggttgcgcacgcttgcacttggataaggtctggtgcaaatggtggtgcagtagttcgagcgtagattaagtggaccgcgctcctaatccatgttacctatacctccccgcggatcagtagtgcacagcgtcacagcgcagtggacagtcgcacggtctcagaaggtagcttggtgtcgcgttccccgcgcacgtaaaaagagaaccacaaaagtgctgttggagttaagcaccaccgctgcagctgcagccgcaagtgcaggcaggagtggaaggcgtggagtggcgtcggcctgcggtccgcgtctgcgggagtgcttgcgcgccgggttttgtgccaagcccccctcttctctctcggcgcttttcttggtgggaaacttgtgccgacccgctaacatcacactctactacgcactcccatcgtggacatgggagtcgtgttccttcttcacaaagacgactgtcgagtgtcgacgactgctcctccgatcacgtccgttgttcactgtcatgtacgactgcttctcactagtaagtttactggcactggcaggcaaggcagcaaaacatcggcaggacggcagccggaggcgttcgttcgttcgagcgtggccagcaatttggaacctgggagccagggcaccgtgggtgcagtgcagtaaatgaggtgttgcaatggcgatttatcggggggtggtggtggagtgaatggatccacgagtttacgttggtgctcagtgctgctctgccagccaacgtcggatcgtattgatgcgtgcttttccctggctgtgaggccccgccgccgtaccccgtccgtgcgtcataggatacgcgcgcaggcaggggcagcttcgtgtctgtgtctgtgtctgtccaacgtgttgttggccgtggatgaggacgagatga

SEQ ID NO: 1709 - DNA, 1175 bp, Zea mays
  misc_feature (1)..(100): optimal_loci_316095_G1, chr9:112337130..112338304, Cluster 10
gtgagagacgccttgaggaatttgcataatattgagcaccttgatttgagccataaacagcttataggggcccttcttgtttcattgtatggaccgaagacaatgaaagaaatggtacttgacaataatctcttgtccgggcaatgagccctgctatcgcacaactcaagtatcttaagaagctttctgtatcctcaaattctatgtctagtgccattcctccagagttggacagtctgcagaatatggagttcctggaccttcacataaatgcacttaacgggtcaataattccttgtaccttgatgcaagccagaataatatctgcggctcaatattccctagaataactgcaatggcaaacctaattacaattgatctctctttcaaatgcattggcggggtcactactcactacctagggaaattggtcagatacagaatgctcaatctttaatgttggatataatggttttaatggaagcactcatgaagagatcgatgaactaactgctggaggcagcggcacgggtgacgtcctgacggacccctctctgccagtctgcccccatcgaactcgaatgcctctactgcagtgctgatcatctcatctatatctggcattgatgctgcaactacaacatcaccaacaccagcaccttggggcactgtcatcctcctccatccatagttggtcctcactccactgtcctgttgggatcctcgccccctgtactttggctcctcctcctagtcctgaaaagtctctcccaaaagagagtcttttttactgggagtcaagtagggtaagcgaggcagcaagatttgaccggcaagaagtgagtgagggtagctcccactcctagcaaagctctatgctccgcgtgcgtgtgtgcgttatgccttatgccgtcatgtaatcctttagcttcctcaagtaactgcgcagtggtgcccagcgtgagcccttgcctgtagtcgcagccgctatgaccattgcctcgtcgtcgtcggtgtgcaaggacaacgatgacgacacctccttcttcgacatcgaggttgcagtgtcccccaacgagagcgccgcatcagacgtcgaggaggagcgggtagagttcaacttgctgtggtgcccgaggccaccgtcatgatggccgtggaccgtggacgtgccg

SEQ ID NO: 1710 - DNA, 1003 bp, Zea mays
  misc_feature (1)..(100): optimal_loci_31980_G1, chr1:196435231..196436233, Cluster 10
aattaaaaatggggaaagggctcgatggtggtgaagtttcaccaccacgctggcacccatcacaggcgacgacacagtgacactgacatcgagagagagagagagagactcccaagccttgtgattagcaataacctgcttcagatccgtccactgcatgtactgtcaagcgccacattgtatacgcatgcatggtccagacagatcatcgccagtcgcagtcgcagagagtgtggatcatgcagtgaggcaactgaaaacagttggcgagcatgtgctctcgcacagaaggaattgttttttttttttggcatttttcgtttatatccatatccagatggcctctaagttttcttaaaaattttccatgggcatgcatgtggcggctgaacaggaaggatgtcggcacggcacggcatgtaggcagcagatcagagatgatgaggctcgctcgatgaggttccccggccatgcatgaacgatcggtacccatctgcaggcaatggctggcattattgcgacgaagaatcgaagcactcactgactgcctccgtctcaaaaatgcctactgctgtgctgacagtatgttttttttaacagtacagtaaaggagaccataaccagtatctgcagaagaggccggcggccggcccacgggcccacagcaagcgtaacgaccttccactccagccagccagcatgatgcgatcgatgccagccatggctcgtggtgtgtgtttgtgtggtatgattctgcaagccaagtgtcatggccccacgaaccgaccaagcccaagcagagtgagacccactacatgatgagaggaatgttgcagaagaggcgcttccttcggatctacctacggtactactagtttgtgttgtcaacgtttcaggagcctttgatgagagaggccttgagagcatctccaacagctgcttcaaactctggtccaattccctattttaggtaaaaagaactaaaaaacatctataacaatcc

SEQ ID NO: 1711 - DNA, 1097 bp, Zea mays
  misc_feature (1)..(100): optimal_loci_319854_G1, chr9:132817636..132818732, Cluster 10
gatgtccggatgcaggttgctttcagtctggtgattagctatagggcgcgggttttgtcgtggcttatccgatctggtgattgcattgacgtcgtctacggcccgccagcacgcatcagataaagttgtttaagcgcgcttcttccctcccgtcccggctttctttttctgcgtcacgggaatatgcgagcccccctgtgcggcggacgtacgtgacgactaactacgtacccggcgtatgctgccgcatcgcatattcgcatgggtctccagaacggaattttccatgctggcccggttcctactgtgacggtggtagtatgttcgtgatactttatatatatttatatcaagacatgttgtggtgtcgagatcggcatctcatatttagcttgtacacaggaggaacgtaggccagcaaagcccgtaacgcaccggccggcggctatctgtccgccttctctccgtcggctagcttagctgtggccgtttaatttcttctctgccctcggcatgcatgcgagctcttctagaaaacacagagccgaaacaagtggccgttgcactacaataatacactacactgcactgcaatttcgacaggttttgtgcaaccttgcttttcgtttgatcctcgagctgttgagcaacagagacataaaccaaatgcatcggatatataggccggtgatcccagatagtacttttggggaaagggatccaacgaaaaaaaccttttttgtttcataaaggcttccattccatattctagctctcgttgacaactgtgtttgcggcgcacacgctcgctctatcgttgtccacctgatttgggctgtcgaaaagtgtttagggtttagatagatagatagaccgtgtagcccatgcagaactagatgttatatttcttccgttaattcatcgttttcttctcaaaataatcgaaacagactcatgttataagttttgctcaacgactgtgtcaaaaatggaggcgtaaataggcatcattcgtcgagcaactagagtagtgtggactgtactgtgaattttctccgagagacgactgcagattccatgctcagcgttctggttct

SEQ ID NO: 1712 - DNA, 1211 bp, Zea mays
  misc_feature (1)..(100): optimal_loci_32090_G1, chr1:197066462..197067672, Cluster 10
gtccgcaaattggcatgcatagtcaagggccggctaataatcatagatcgtcacgcgcccatgcatgaaatgaagactactcgatcacacgcgctgacctgacgacgaaagcgtcgtgcttcaatatttactagtattaaaaactttactacgagtctacgacgtgtacaaactgttgctggtatcgctagctcttccatcattcatgtcaatactacagcgcgccctctaatctgaagagattttttttttgggttctgtgtgcatatatatgcatcagctgagagcatgggtctctggacccggtggcagctgatcgaaggcgaggtcactcgcattcatgctttatcatgcatgcatgctgccactactgagctgagcactgacaactgctggagtcgtgtatactgtgtgctgctttaagtcaactccagctagcatgcagtattgagatctttattttttttccccaatgaaccgaacaagacgtacgtagagacctagcagttcttcgaagcaagatatatatacatacacagaggcccctgatgcgccccgaaagtatttaatgtttgtctagtatttattttatctaataaaataaaaatctggattacgatatcttgtgtctgctggcggcgcatgcatggatgtacggtacaggcgtacagctatgtagcacaccgcgtaggtgtatagtattattcatcaatacatgcatgatgccagagaaacgtcatgcgcgacgaccgtgcgtggaaatgcaagcgcacagagacacggcaccagtctagctacgactatacgaggatggatccacgtacgtacgcttatacatgcatgagagacatgtcatgtacgacgactgtgcgtggaaacggcaagcgcacagagacacagcaccggtcgacggaaccacagattgtacgtctctctcctgctagctgctgcgtgggtgtggatcgataacgacgacgggaaggccgcgccggctaacatgttcgtatcttttatgacccgacccgatcacccgaccttgatatatagtgtacgtccatgatgcagcagctgtcattctctggccggcggtggctgctgccgcttgctttcttttgccttgccgtgccagccggcctactgaccaaccaccctccggtgacgcccgcttctctcgcgtccatgggctatctcttgcgcgcgatgcgttgcat

SEQ ID NO: 1713 - DNA, 1309 bp, Zea mays
  misc_feature (1)..(100): optimal_loci_321300_G1, chr9:139741700..139743008, Cluster 10
taattcggtacatcttccacggagattcgtgcatctgtttcgctttcgcagtgtggaaccaaacttgttggttttattagcatacaaaattttaatcttttttttatagtgcgactaaaggtatactttagaaagagctgcgggggtggtcagatagatggccccgctccgctgcgtgcgatgcgaacgcgttgttgggcgggtccaccatcatccatgccgcccgtgcgtcggggagggtcaaagaaatgcgccgcgtgacgggatggaagaagcttctacccccatgccaatgacatgctcttctcgtgcatgaattatatgcatagtatagataatcctaatcgtccacaggccactactgacagcgaccatcccatccccccttggatggttaatcatctgtagcgctcgccgttatctgttaaccaccttgttgcgttcgtcggttggttgcgagtttgcgagctcttgtggcactagcagtagcagccgtctgttgaagaccacggcacggcacggagtcggtcttcttcacgtgttcctgcacgccgcgccacctctctcccttttacctgcccaactcggactcagacttgtgtggaagattaaaaggcgtgttacttttttctctatacgattgtataattctaccagagagacggacggcactggctcacgtacggccggcgctgcgtgtcgtcagtttggttccaaattaatgcacgttctgacggaatttcagagacgacgagaagagaacagttgctcagatcggcggctaggtattgtggcaagcatgaagcattccgtcaccaacaaaccacaacgctcaattgcccgtccaaaacactcgcgcatgttccggcttgccgaagcacaggggcatgcaacgatgcaaggtgtcggtgcccccccgggatttctctcgcttccaagcaacagctaccacactactcaatcgcatccagccaggctgttcgtcgctcgaccttgcgtgcgtgcgtctctcctgtgctgtgcccttactgcttgtacctttcttctaatcctggtttatacgccaccctttgttgcacgcatgggaatactctgccttcgatgatcggtcctccaaatccaatcaccgcacgccagtccaacacgcacgcacgcggtattatgctttcagtacacggaacacgcggtcgttctctttcagagcacgccactcaaacacgcgggtttacggtcagagttaaatacgcatggtctccggacaaatgtacaggaataaggcattttgtttcgatcgcaaaacagagtgtgc

SEQ ID NO: 1714 - DNA, 1004 bp, Zea mays
  misc_feature (1)..(100): optimal_loci_321646_G1, chr9:141536682..141537685, Cluster 10
atatgtctcaactctgtcggcgtttccaaatcccaatcatccggcatcactacactgctttcttccactccacattcctctcctcttgatctatatattccgattccttcggatgatctgctcgaagatatcgtagtacagctgatggatacatgcacgcatcttcaattaattccaaacgcacgcatgtgctcatgcaacttgaagacccaaataaagcgcgcatctgccgaccagtgagcgtggtgaccgtcacagcatctgggggggtttgacgacatcgccgccatacatatgccgggttgacagacgggtggtgaaagcgcaacaattaaccgcacgcgcgcggtcagcagacttgcacgggcgtgcagtcccatcagccaaagatatgggaatattatatttcttgttcttgttctttttctttctcgtcccatggccatgctttggcgatcgagaagcccctctgaccggcacagtactctgaatgtgctgctggactgaaaggaaggggcgggcgagatagataggtcaggattctcgagagatcgatcgatctgccgggcagattgagattcccggcgaggaggacaggatacaggccgatctctctagtgtccggccggtggcatatatatatcggatcacaatcgcgtcggtgccatgcataacgacttcgatctgcctccaaaaccgcaacgcaatgcagctgtcatgtgctcagtcttgcggccgtgtgctgctgactggaaaggcgtcgtcaccccccctcccgcgcgccggattcctgacggaattgcgagagcttgaccggagcttcggctgaacgaacagagacgtgctccaactcgctgattggaacatctctcgtgtgagatgggaatctcgtgctgtatctttctccacaggtttcgcctcggcctctcgggtggtgtagtgctactagtgctctcggcctcttcagcttattggtagccattgggtaggccccggcggcgccc

SEQ ID NO: 1715 - DNA, 1070 bp, Zea mays
  misc_feature (1)..(100): optimal_loci_321647_G1, chr9:141542280..141543349, Cluster 10
cggctcccagctcatgcatcacatcacctgatcaccagcgcgcgcccacatttgtaaaaagaagaagaagacgacggccgctcacgcgccacgggaaggccgccgatcattggcgtcggccggccgagagccgatggcgacgccgcgagtcctcgttcggtagctccgctctgctcgctcccacacgcgcgccacaccatccacgcgctctcgcttccttttccctttggactcagctccggccttctttttagttcgcgtcgcatcagaaaggcgagcggcacacacggcgcatcaaaaaaaaaaaggttgccagctacggacccggttcaccaaccaaaacccccggccccagatcgggtggcggtgtggcacgacaacggcaacgtcacgcacgctttggacgccgaccttttcgtgttgtccaggctgagccagccagacaagcaggcccagacgatgagacgagtagagacagcgctgagccgctgaccgtaaccgcaaagcttctgcagacacaagtgggttcagagtctacccaggccgccgtgccttaggccccacggcccaccggcgtcggccgtcggtcggcgtggttatccgcttcgtgtggccacgtcacaactttctgataatttgcagggaccggcaacaagtaatccagtaaggcagtaaccgcagtacactgtttaagcgtcaaacagaccggttgctggctttctcagttccctctggacaaaaaactctctgcagcataggaatttctgaattcgttaggaaactacactatagtgccgtcgaactcctgctgactttgtgtagaattctgtctttcatctctactatatttctaccatatttaaatgggaatctttcttcgtgcatcacatctctactgtcactgcccgtcaacctctctgcagtataggaatttctgaattcgataggaaactacactacagtgtcgtcagactcgtgctgactgtgtagaattccgtcctttatccctactatgttttaagtgggaatatgttgcatccctactcacgcagtcacgcgtcgcatacttg

SEQ ID NO: 1716 - DNA, 1090 bp, Zea mays
  misc_feature (1)..(100): optimal_loci_323675_G1, chr9:151658119..151659208, Cluster 10
cctaaaagtctctagtctcacgttatggtaccagctggacactaaaccctttgggggccctaagctccgcaaggataagagatcaagtgtgctcatgtcataagatagaaggatgtgactagacccatcaagagcagtacgaccatgagagcaggatctcatacctaaaagcttttagataagtctatagcgttgccattatttaggctgtatgatactcgagaccataatataatagatgcagaagactacatgggctgcaaactatgtatgataatgaacggtatgacatccttcatggttctagcgcgtgtacctggcgggatgatgagaatttttataactagtacgtgctccttagtttttttaagggaaaaaacaagtcggcgaaagaggtcgagtccagaaccgctttttcttgttggtgatggactgtatggtccaggtacatgatgccgctgtcatgtcctctcatcctgaggatatttccctactttttctcttttgatatatcatttgacctggattaggtgctaaccgcgcgcttctcctctgcgaagaaattaaataatcgtaatcattcagcgaggagtgtctttcgagagaaaaagaaagaaaggcatctggtctcttgcactcgcgcagtcgtacgaccgtgcagaggcgaccgcgggaatggcgacggcggctatcctacaaccgcgagaccggctgagatcgtggtgatgcatggatgagatgcactggtgtctggtagtaattgcactggcgacgacgacgacgattacgtggaattgctattgctatcggatctaaagcttccgtctacctctatctcatccgctgagtagtactgtatgtcgcggcatgtacgtagtaccatcaggaggatgtgtgtggtcaatggttaatctctctctggtcagcactcagcagcagccaccaccgatcgcgttcacgtacgtacacacgtggcacgccattcattgtagctaagctagcaatcacccgcccaccggcctgtgtgtggaaattctggaacggatctctgataacgacaagtctagatatgtcgtggccggtgtgtatt

SEQ ID NO: 1717 - DNA, 1125 bp, Zea mays
  misc_feature (1)..(100): optimal_loci_323705_G1, chr9:151756951..151758075, Cluster 10
tcgacccaacagggaggccaggagcagaggactatggccgtagccggacgtggcgggcgcggcaccacgattctcctgcggggagcgcaaccctgaggtggtggcgcgcctcatcggcggccgggatgccgtgcagcaggcgctcgactgcctcgccgacgcctcacgatcgaggccgaggaagccaatcgtaatggcggggcgtagatttggagccatacatttcaaactcaagcgccgactgctagcatttgcttaaacgtgttgtaagcgacgatctctaattatcaatgtttgttatgaaatgattccaaggaggaagctttcgcaagcaatacttacgcatgtttgatttttcatattataaaaacccgagagagaaattttagataattcttgcatgtcctagtttagtcttcacttagttttgtttctctatgttgtgaccctgacgcatgcattcagttcatgcggggagccggggagcgtcagctggcatgcacggcatgcgcgccgtgtgcggcgacagcgccacgatcctcaggttgtgggcgctgatctcagctgttagcctgttagtggccattgttggttgtagatgttaggacttttatattttggcaatgataaaccagataagataagctgcggcgaggaccttcgctggtttcctttctacaagaaatacttagctttctagcatttgatccgtgtatgatgtgtcgtacaatgaatacaatcagctcagcatttttactttgtatatagatgaaaaaaaactttgtacatgtcttactttcaattgctacaaaaagtgatgcttggttcttatccaatgtgtataatcagttgcaggttagaattgcccccaaattgtttggcaacaagaaacagatgtaacttccttcgcggaccatctgctacgactacataggaatgaatatatgcggtatgtgtcctcaacttgaatacatgttgtactagcttgcaatcatgccttgtgtcagttttgtgaaagcccgggtactatcagatcagtctgcatccaggtgtcccgctcttgcacaatctcattcagtcattccatcatcagtcttgactgttcaccagtaatcaccacagcaa

SEQ ID NO: 1718 - DNA, 1264 bp, Zea mays
  misc_feature (1)..(100): optimal_loci_323751_G1, chr9:152058426..152059689, Cluster 10
cacgagctgctggagaggaaccgaatgcccatccatcagtcccggagaaaggccgcgtttcgtttagggcaccgcaccacccctgccatctgctgcaggctgcagaatctgtcagtccccgtcccgtggtgtcgtgtgctgtggctgtgctagctagctactagtactagctagcactggacactggactgcactgcactgcagccgaaggaggggatagatcgcaggaagcctaagcagagctaggccaaatccccgctggggctgtggcggcgccgccggagaacgcaacgcgagctgccgaagtggctggctgctggctggtggctgccctcgccccgcgggccgggcttgcgcggcagcccgatccgcgccgcgctacgggtgtccccgctttggtggtacacggcgcgaccggcgattcccccccgtccagtcctggacccccgcgcctacgcttgctttgaccgtccgggaacgacgtcctactacacctgaggtgacgtggtatatatacctgtacctgtaggggaatgctgctactgctagtgctagcgagcgctctcgtttgggccatcgctgtttctagtgctgcctaaacttatggggccgccgtcggaacttgctgggccgattgtacttggtagggccaacatgtggccaggtttcagccggtaactacagtggcttaccaccggcggatttcagttcatgtccagcgccgcggcatgcgcgcccgtgcgtgcgtgcgtgcctgcccagcccagccctgacgcccatttttccacgtcgttttctccaacgatacaagcgaaacaagtagacggctccggcgcggcagcagcgcacgacggggttgcttcagctcgtggtgtccgtccggtcgctgccacccccggcttgttctgcgcgccagtcgccgtccgtctgtctgcggccacatctaggccctagctagcgcgcggctctcttcacataattccagtcgtctactgtacgcacctcttctccgcaccagacattctttgggatgacgtataccgggacgacaagccggcgtgtacgtacatcggcaaccaagcatacatcagcaatcttgatagtttttaaacatagagaccgatgaaaagtatgaccggttgttgttcaaatcacagcaaatatatctagctattcattattcagatcgtatacatttacaaacacatatataacatcaaatacatcacgtaaattatctataccacatatacatcgtcacata

SEQ ID NO: 1719 - DNA, 1086 bp, Zea mays
  misc_feature (1)..(100): optimal_loci_326029_G1, chr10:7923778..7924863, Cluster 10
tcccaaacagggcctaaatataagtataaaaatagataagctacagatagccgtaggatacatgatatacacctctctcccttggctcccccctctctcttgcccctaaaacgaggtatcgtctcaatagcaagaatctctatgttttattcagtcaactcaacacaaatcctcacaagtgagtgaccccctttttttctatctactgtagacaatcacatcaattgattcctcaaactaaacacgatctccatgctctgctctgcctttgtataggtccatatactatcatccagcaccagcagcacatggattgattatatagcacgtgaaagaaagaaagaaagaaaaacgacacatgatgctaggccatccgtggtccactggcatggcatgggcatggcacacctaatcaaatgatggtcggtcggttcagctccaacgactcaaaaaaaaaaaagggaggcttcctcttgtcgctacaaactcatcagttggctatgggcatgcatgcccatatggataaaaaaaagaacctgcacgacttcccatatatacacatatacatatcgtgcagtgtccagcaaccagcatgctattcacgtgtgcgcattcactcagcggagtggttagttttcgcagaaaagaaaaaggagagtaccgtcgtttgggggggctggccaacccaagagattagaccaacaaacaaatcaagcgttcatattttttttgtgtgtcttcaaatttaaaacatttttttcttttagctttgcagagacggataacgacgactacggataagttaaaatggtcgcaaagtcggtgggaccagcactccactggattgtggaaaacgtaccagcacctgttgctcgaagctttttttacctttaccaatgaaagcgaaaggcttgggacggagaggcgtacatccagcagcttcgcaagtgccttgcggccacggaaagcggcaagccaagccagtgatgtgtggacttcgtgttggttctcttatcattgctcgcaagaccggacccggtcgaacgtagttgctgccacttctcctgcaccttgtggataagggcc

SEQ ID NO: 1720 - DNA, 1142 bp, Zea mays
  misc_feature (1)..(100): optimal_loci_32689_G1, chr1:200489040..200490181, Cluster 10
aaagcacacgacgcgggactgcagcggcacagcaacgtatcggtatccacatcgcgatccgagccaggctttccgaaagctgcgccatcgcgacggcgagccccatccccaatcgtcctcccgtcctctgcagtgcatgggtcgtcggtctgttcccgcgcgcgccgccgagaaccacgctggagcagccgaaagcccgaaacgaacggctgctagcttttgccttttggtttactcctatgttggatggatccatgcttagaggacttgcattctttcatgcattggtgacgcatggaacggattgagatgagacgaaggaataacgaccgtgcagtctgtacgcacgcacggaacggaaggccggaaagtacagcgcgccacggccgacgattcctggcgaagtttcctgctgagcgcgaaggtgtgaagcgcaacctggcatggcagcttgcaaccctgcatgtgttgcttgcaacggcggcttcatgcactcgtcctgtctagccgctgccatgcatttgcatggccggctgtcctgtcaccgtatccgcacaaatatgacgaagagatatggacagtgaaagttcggtcgaaaaaggaatatagttttcgattttagtctttgagataaatcgactagtatttctaattttggttaagcctataggtaaaatatctataaaaaaatatagttcacactgagtttgcatgtttttttctctatacttcagatagtaaaaatacagtgaaaaaaaactataaatctagaaaactagaatattttataatttagaatagaggaagtcttataaattaacgttaattaatcaagcaggataggatattggcatcttacggtaatctgttttagtgcatataaaggatatccccatgttgtaatctgttttaattcataggatatccaaagaggcccttacggtaataatgctgttgtcgctggagaagctaataagtttgccgaagaagacaagagcactaatatacaagtaagatctatggtacgaaatgctgtaaattttttaatgtacccacataagctggcatatatctagagggagccattctactcttaatttattgttatactagttgggtgcccgtgcgttgcaacggagatc

SEQ ID NO: 1721 - DNA, 1097 bp, Zea mays
  misc_feature (1)..(100): optimal_loci_338241_G1, chr10:83309515..83310611, Cluster 10
ttgggtagcaagcattgtggtcttccgcaagtgcattggtgccatcacactcttggcaaaagttgatgtggagcccggtagctaagctgaattgatctaggatgcatcgcaaactgtgtgtgggcggagacagtccctttgaagaggatgggagtatcatctgcgtactgaaggactgctccaagatcccccggaacggtgggacggtcagtttggctgtctgatttaattaaggtccgaaaaacgtcaaccaccaggagggataggcaggccgggtgggagagggtctccttggcaaaggcctcttttgcatcgaaaccaagagccgggggcatccatcaagtgtaccattggcttgaagagcagcccaatcatcaacggcgtcaaaagcttttcgcgaagtctagctccaagactagggtggcaagtcacctttcgtggcagcattgcaccacttcgatcgaggcgtttgctcgaattcttcttccttctacagtctctatacctgtcgtggccggtaaaaaacatgagcttcagaagctcgatcgccatagcgttctagagataaatcaatcggccaaactcctacctttctttgacaagttaggcggcgagacctcagtagtcagtagccaagggaattagctgcacgaaacactctgagcatcaaatcaatcagagagagagagagagagggaaaagacagacgcaggtcgcaatcggaaggaagaagggtgcaatgaacccatggctaaagagccccaaacaaacgggggggccactaggccgtccgatgctccacggcgagtcgacaagtggcgcggggagaagaccgcgagattcccagcgcgaggattgggggcccaaggtacaacaagtagcccaccgtccgtccctctcggcgcaccactactctctctctcttttttttctctcttcctctctgagtctgagatgttctgttctttcttgcctccttgttgttgttggccaaccacccaactagaaccttccgtccactcgctgcttctctcttcctttggttttggccatctgaaagacgcagtggatcccagtaaagtaggcaatggtggata

SEQ ID NO: 1722 - DNA, 1289 bp, Zea mays
  misc_feature (1)..(100): optimal_loci_34329_G1, chr1:208970002..208971290, Cluster 10
aggctagcaaagcactaataatagcagctgccgcgccctggtcagttgcatccccccgatgccagccgatgcagagtggcccatcgcgagtcgcgacttgtttgccacctcgcgcggtggttcggctgatttcttctgctgctacagtaatactagatcatgtacatagtacagtctcgcagggtctcctgttgtatataccgatgatggtgtgactgatgcccaggccgggccgaattttctttgacacgaagaaaccccaccccaccggagccggcgggaaacggacaattccgtcggttagctagcgctagcggtcgattccccgtggttgaaccgaacgaaaccgcatccgcgttaacaaccgcgacgtgcacgtcccactctccggtctactccactccgaccccatcccgcattcgcgcgcgggcggccgacgagtcgctggagctggactctcgctctagtctcactactgtctcagtctctagctacctcagctcaccgtgcccactggccacgcaacgcatggcgaccgcccggccgcccggctctagagatatatggtgcgctgcacggttggtctccgtacgtcactgtccccggctccggccgcgcggaggaagaaaacagtgcacacaccgcgtccagctatagctgtctcttccgcgcgcgcgcgcgcggcgctagcgctttccctttgtcgcctcgccgagacggccgacgtacgtgggagagccctcacctcacctaccggccggccggccggcgtgccggcctctccagcctgtcctcctacccccgcatggcttcttgccttctcaccgcatgcatcatcagtttcgcgctctctatgcgtttgtgccacacatagctgaactgtaattgattgattcgatgtataggggattaactgcaacttgttctaccatgatgcatgatggcctggcctctcagtcgacactctcgacagtcgacaattgagcatatataaagaactcaccggcggacagcgctagagtccagaaagccagccagctagatggacatccatcgcgacagaagcagcggcagcgatcacgtacgggctcgatcgacgagagcgcatgtgcttgttcgccctctgtcgcggtgttctcttgggcatgcacacactcgcatcgtcgctactactactcagtgtcaaccttgtgacgtgtgtaccaacgttgcatgaggacggcggacggtcgtcgtcgcggcctctagggttcctcgatcaccactactttccagccacacgctaatag

SEQ ID NO: 1723 - DNA, 1280 bp, Zea mays
  misc_feature (1)..(100): optimal_loci_34365_G1, chr1:209122138..209123417, Cluster 10
aagaatagagaactgtatgttttgtattgtattgtagtctagggacgctacaggcccccatcctacatgtcttccttcttaatctatctcattcaggattccagaccattcttcgtcggtgaaaagaaaaaaaaaagttcgatacacttggtcctcacctcacatttttctcgccattttcccttgcccggttgccctgaacaatctttaacctctagtagggaccatatgtttgtaacgctatttcatagtttttgcaaacacacaagggtggcgcattttagtactcggagttgacttagtagactatggcatgttagatcagcatgtatttacatacaaacgaggcatgtatgtattcatacacagtcggggtagaaactgaaatcaaggagatctaagatggacaaatatcttactgatctgaaatcatatacacacggggtagtgtatggaaattaaagaccacttttttagtttattacatatatttttgctacatttacatttgtatagtttttttatcatttgtcggtgctaaattgctcctgctgctgtcatctcctttgacagtatcaaatttcataatttctaccaacctcatcggtccgacaagccccggcacctcatcggcccgcttggaagtagcaaagtgagtattcgcgtccctaagtcaaaaaagcatgtttcttttttgctataggatcccatattctgctggttgagctgtcattcaaaaaaacagacatcaaagattcaaaagacggggtgttcaacatgtaggaagcgcacaaattaggcagatcgccacctttgcccaacatgcaggacctaccctggcgtggcgatgagctcacgctgcccgtgctcaagccaaaccaacgccgtctcgcaaggagtgggagcttctttcaggtgctcaaccacagggtgctcaacatgttttgtgctcttttttaaaatatatttttcaaactgatatggaaagctggcatccatcccatagtattgtagtagagcacgcttttcatttgtagaggcgagatgcacagcatagtggtggcatccacttctcatctgctagcatccacttggtcggctgaggaggcggacggcggaccggacctttcccgatgtggctgccccccaactggcgtctggcgccccccaagttgccgaaaaaagtaattcttctttcgccctcccgtgtcccgtcgcctgttagtttctgctttgttttgagtgcaggcgcagatctgctgcccacttgaccgagatcg

SEQ ID NO: 1724 - DNA, 1122 bp, Zea mays
  misc_feature (1)..(100): optimal_loci_345383_G1, chr10:123571300..123572421, Cluster 10
tttctgtgtgacagaccagatagacttttacatgattgctccgagagttacctttctttcatttcatctccgttccgcggcggcagaaacgagtcaggtcccctgcaggctgcagatccgccatggaggcagccagtgtccccccgaagcgaaaacacgggaggacgccgatgagctcatggccccggcccgcgcgcgcggtcacctgtcccaatagcattcattttcatgtgaccggctgagacgacggattgtctcgtgcgtgtcgagcgccatgcatgacgcgcgaggcgctgcaccgacaagggaggaggaggtcgaggtcgaggaggaggaggagctaggagatctcgcagcagggaatgattggttggcatccgatgcagctgctgctcgtgctagcgctggtgatgctagccggccggggggagggcggggcggggagctcccactgccctgctggtcctagcacgttgcatgcatgcacccgtatgggaatctcgcagtgactttgcaggaatgattagcctttgttgtgtactacagtaccatgaaatgcttcggttcccagtccaagtctataccaagcatagcatgtcctatccaagttaaggaatgtaggcccactttgttacgacgactgagacttggtttctgcagctcttctatcactgcagcgctattgtagtgtacacagctgtagaccgtcttgctttcggacatggtacacgaccagtttagatcatggacgcatgacgtgattgaatgctgaacgtacgccgtcgttatacacgcagacgcagtaggggtttgttgtgaggcgcagtgtgagctagggtgaggccggcctcacgtcagaccagagctattcagctaggcccagccgcccaggagcagcatgtgtgcggactgattccctgaaccagagatgcgcggcatgcgccaaacaaagcaagcatgcagcagtacgcccaggcgcagtctttttagaagccctgcctcccttttcgtgagcccggcggtctgcggctctgcatggcaaagcgatttcgatccatgtacaatagtacaaagtacaatacaccaacttgcgcccgcaccagcctgccgctgagagacaaa

SEQ ID NO: 1725 - DNA, 1159 bp, Zea mays
  misc_feature (1)..(100): optimal_loci_346043_G1, chr10:127368080..127369238, Cluster 10
tgtgccgcgccgctgcctgcctacgcagttgttttgcgctctgctagaccagtgaactcgcctacgtacgctacttgcgttggtctcgtgtaattagtatgcgtgtgggagagaaacgaaatcgacacgaccgcccggcgcccgggccgggtatccggcggcggcggcggcggtcagggttgcttctcgagaaacgtagatgaacagaacatgcctcgtcacaagctgaaacatgtgttgattagaaacgatttccgccacggcaccggcataaacaggtcgcggaaccagctgagcagctaacgttgttcaaagaccaacggccatatgtttggttgctctcgtttcttatgtatataccatgtgtttgtgtttggtttcccgcatatgaatactgatataatcatatgtttgattatggctctccatatatatttactatggctggacctatgtttgattcgctgcatctagtcatatttgcacgcacacaccgacataatctaaacttatttgccagcatccatttatacgtagaaattgatattacctagtaaaacaatctcatgggaacttggctacacacgtcaaaacatccaatcacatgaatactgtataccttctctctctctctctcgaaaagattatggaatattacatatctgcaccggctgattcttcttcctgcgtctgctgcgccgcgaatcgtgtcgcggtccgcgcgcggggaagcaatcccgtccggaacttgagggcgcgccgctcgtgcaagtggccgggcgggccgggggtgctcaatgcaagtcgcaaacccaggctacgtgtctacctaccctacccagacgggggtttggtttgtttaactcattttcggtgatcgcatgtgcttatagcttcgtaatcccaattcgaatttgttatggaacgacgtgcatgccgctgggttcatcatgcgttccttcctaaccaagacaccagaaaacgccaagatcacctagggtgctcacttcttccaaaattttcgcgtcccgcatctaggtccttcctccctcatatttcatatttacgtgtcaggatttcctactctctaagaccgtctgcagtagtatacatagtttatccaaaatactattttgtactattctacactagactgtac

SEQ ID NO: 1726 - DNA, 1332 bp, Zea mays
  misc_feature (1)..(100): optimal_loci_347340_G1, chr10:134403683..134405014, Cluster 10
tccccacaagcaagacctataccctgcatatcatgtgatactgtactatttggccaaaaaaaaaaaccaaccatacttctctattttcgcagctgtacctgaacgtgccagtgtttaagcctgctggcatgaacttcgaaggatatagcaatcttcaatttgatggattacattggcaaaaaaaaaaattcaagctctgctttcctgcatagtcacatgcaaaccaggaggtatcatgcgtctggtctggtcatgggctcatgaaactgaaggtgcgcagggggtgcatggaaactgccacttgaagtctggttgcagaattgggcagtgtggaagcatgactgcatatatgagtatgatgactgctaattgggttgttactcaggatggcaggattccaggttcagtgattcgtgtctggtcgtcttgcatgtttcatctcccttctttttccctccctgctcttgtttttgactagtctccgtcggcaatgcgtcagatccagttcaaatcaggtcactggtcaccctagagttagacctctaaaagcagtgcaaactatttacgattctgcaagtggctgcacactcggcgtctggaagcagttctcgttggctatttgcacaggcgtctggaagcagttctcgttggctcactgaccaaaaaaaaaaatctgcaaactggagccgactcttctctctgcaaacaacttgattacggttttttctctctgtcagaagagtgtctcaaatcttatatatatcaaggatccaatcgctttggacttacataaatcaactgaaacaaaaatacaagccatccagtcatcccggaaaacaggaaggctgccggcggcggccagagagtgaatataaagtcttagaggcaataagtggtttcagctgacgagttatcgtgccacttttgatgtactttattaaccgataatcgtctcataatcttggattgaactttcgactctcgtggttgttaattctatcacattgctccgtccactgtctgtccatctcagtcgttatctgctgattctctccctcgaaaatacttttgtgtaatacagcgacacatgcgcagttgcgcacacaggggtggtggatcaaaaggagacctgggcgtaaaacctaattattgtggtcaacagccaaaaacagtcttaaaagcaagacgggcacggtcccatatggggagggtacggaagacaaaaaggagtaggacaggacggcctaggattgtaggatggctaaacgggctactgtgtcgctgacactattaattacggcactattatgcatgatactattagacactatt

SEQ ID NO: 1727 - DNA, 1312 bp, Zea mays
  misc_feature (1)..(100): optimal_loci_347544_G1, chr10:135672879..135674190, Cluster 10
ctcatttccattaaaaaaaactacgtcaccaatccaatcccttcatcagttcctctgttgccaaccagtagaatccctcatcaactacagcaaggattcctgaggcgattattggctagattctccagtacgtgcgtgatgccaccgttcacggcgctcagccgcgtgcatgcaggagctagtactagtacactgccggaacgtacgtgtgcgtgcgcccccagtgcgccggccggccgggccattcgcgcggcgtgcgtacgctgccggcatcccgggtgaggtggggacgtaccggtcgcgcgcgggcagtgccgccgtgccggtgcgccatggcacgcgagcgactgggcgagcaccgaacagtagggtgggtgtaggcctggcctgtagcctgggaagccctgcggctgctacctctgcaactgcaagcgtctccatcggggtcggggcgcctcttttcatgcgcggcaggtcggcccggcccggcccggccggcgggcgcgccgcgacgcgacgcgcgcccctcgcgtcgcgcatgcattattggcggccgggggtgatgtggcggtgcacggccacgggccatcagcctgctgcggtgcgggtgcggggtgcgtacagcgtacatgccatgcgtggcccgtcgcagagctgagcgacttgttggacttggagagaatctgccgctgcccgatcgatcccgtcgggtcggacgtacatcgtcaccgattcatgcgcgcagatgcagatgcaggccttctcggtcgcattatgttacgcgtgcactgctcgcaacttgctgattattactacgtactatgtacgacgagcctaatagtggttgccagtgtgcgtaccaccaccacgccgccatgcgcccatgcccatgctccggcgaggacatccatgcatatgaacgtacgaggtggtgtgtgctcctgacccgtgacgcggtccacaacgttcctcgcgcaggggaggcaggcaccggcgcgttttctgtaccgtaccgctctctgcactgcattgccggaacatccttttggatgcaccgagccacctgggcattcctctgcacagcacatgcatgcacatcgcagacaatttgcacctcctgctcctgcttggcggatctgaaacgcagaggccaggaaatggtgtgtaattaaacacgtttgaagttggttaggtggcatgagtagtagtctttacaggagcgaatttcatgtcgcggttaaagaaatctcctggcgtgttggtagccctgatatgttacatggattttcagaccttcagagccatgatactt

SEQ ID NO: 1728 - DNA, 1139 bp, Zea mays
  misc_feature (1)..(100): optimal_loci_347547_G1, chr10:135683142..135684280, Cluster 10
gcttatggtatgtgccgcaggcccgcagcaggttagctgaattcacgaggtaatgttcatcatttggtatacaccttgagggttccaccaaattctttgagagacagaactgggagctggacattttaaccgatggtcgccggacattccgagcctagtcatccgtatttgttggatcttgtcaggttgatcagtctattcacgagctctgctgtttgagactcagagagatgggtgaatgattcttcctccgacaggtgcgtttactgatcaatgaactgtactagtatctcgatcctacggcaaaggttaggttctcttgaacaaatgcagcatctctgaattatagcattccttgaaaagatgagcgccattcatttctgcactggtaccagctagggctaggctagctctagcagcatctgctctcttctctaccaaggtggccactatttatgtcagttagttctcacactgttttccacgcagtgctttatgcactgctttgtaatagtaagtatcgaattggaggcttatgcaatgtggcaggtttcttcttctttttctatctcttctgaggatcctgtggcaggtttgttgtagtaggatgaaggaacccgatggttagctgggtctccagggcttgagaaagcccaagatccgctgctttcttcagagtaggaaagccagcgcgaacgtcttccaaggcgagctactgagctcgcactgctctactgatggtgtgaagagaactgtgcatgtttgctgatttatttgtgtgtgcgtgttttctttttttttttaaaaaaaaagaaaaaacagcaatatacacgagagactagacattgtgatgattgcccatttgattcaggcctaatttggacagaacccagaaatcatgcaacctttgctgctttcctaagcaacgagcttcttggcttggcaagccctgattcctgggacctagtcaggcctactagaaccctttcaacgtctcctttcgaacgagacgcgcacgcactggacgactggactggacgaagaaaaatctggcaccaccgcttggcctcaccaaagtcacagcctttcaaaattttcctcgttaaaagcggggccggccggggggactgacctgtgcc

SEQ ID NO: 1729 - DNA, 1158 bp, Zea mays
  misc_feature (1)..(100): optimal_loci_347758_G1, chr10:136694232..136695389, Cluster 10
aacctttttcatttcaggtgtttcttcccctgttgttgcgtttggggtggggtggggggaagggggtagacggacgggtacgtagtgtcctctgtcctgcatgcatggccatgggcagggcagtgctgactgctgagggatcaggcgagctgctgctggcagttgggcaacagctcgctcccccatgggcgcaggcgcaggattattctctgcagcacctaccagccctacgtgcctgctcccgggctggaatcatgtcatcataacctatttgtgttggtgctcaattgctcatcgagcaagcctgcctgcctgcctgcgagctactactccacggcagtatggtcccttgccttgagctggatggacacggatccggacgtcgtccgtcccacactgccagcggtgcagtctgctacgctgctgttagtgcctccggattattagatcgaggtgcaagttgttgcaagaacgatatggccggtgcagtgggatcgagttgcgctagctcctgccactttcctgtaaacccgtaacagtcttcctcgctggtggatcccggacccatccaatcggctttacagctcgctaccaaaagaaaagaaaaaaagacagataattgtgcgtgcctgtggcgtacggtgtggactctgatctgcctgcctgtgccggtgtcaatgcctggccctggcctgacctactaccctcgataacgggcgtgcggggaagattaccgagtcgcctcgactgcagacaagctaggaacagactgcacctgcatgccgacaccgcggttgagtcgttccacggtcgtccgcccgccccatgccatggcactggcaccagcggtggagtcgtcgtcgtcgctggagcgtgatcagttgatcaccgcgcgcgcgcgcgcgcgcgtgcgggacacggcgtggcgcggtggaaccggtgcaacttgccgcgcgaatcgagggtacatgaaagcaactccctttgactcttggagagttggagtcagtgacaatatatatggccatcatccggacggacttgcaaaccctgactgcatgcaatcacaggctgtccacgtccggtccaaaaggacgtcacagaaaatcagcgacgccgcccccgagccgagtggatgcgcattggactattctgaat

SEQ ID NO: 1730 - DNA, 1075 bp, Zea mays
  misc_feature (1)..(100): optimal_loci_348625_G1, chr10:141082849..141083923, Cluster 10
cctaagtcactgcttaatacaatatacaataaataagtatgcgacggtatatcatgtgacccatcccaggaaaaatagttatttagtgtttttgtacgttagctcatatgatggtctcaatagtaatatcacaactcattttttgacatgtttggctagttgtctagcttgagcctataaaatatgctggaatggttgaaagcgttattcgtcactctaaacaatgatgactcaccactataacgatttaacatttatataaaaagcagagaatggtttaacaatttgttaagccactctagatcgagtgtatagtgtgtgtatatatcatgagcataatttgagagacaaagcgttatgggcacgtcctggagtgtagcgaacagggtacacagactgacagggagtgcgtgtttgctattcacatgttccacactgcaccatcaaaagcaaggagaaaactgcagcagttttctcgcgattttgcatgttctgcattttttagtatgtcccaggtagcatgtgctgaaactgaaaaggctgaaacagatagatagacaccaccgagatcgaaaccgagagcgtttctcatagacacgtttgcggccggtgcacctcccctggacggcttcacgcaagagcccaggtgctcggcccggtggcaacggcatccccgtcccctctaccgtacacgtcaatggcacgtgggctccacgcaactctacgtggcccttgggcgctacgctatcccatcctccgtcacgtgaccttcacgtctctgacatgcggggccacccatcctgccgccgtttcccagctcgcacgcacattgccaaccgttggattgtccaccagctcgatctctccctctccatccgccgattgcgattcgtttgggcccactcgcagagagttacacatcggcacggcacatgggttagagaatggcgccgtcagcagcaggagtaaaataaggcaatttctaggtatttatttaggcgcaggctcgtgttatcgccccgttaattatttaataataatcggattcgcagctaattaaatctgtaaagtatat

SEQ ID NO: 1731 - DNA, 1370 bp, Zea mays
  misc_feature (1)..(100): optimal_loci_348915_G1, chr10:142818740..142820109, Cluster 10
aaaaaacaccacacggtcacggcgaacaaaaaagcggctaggcagtaggcaacggaaacgagtgagcgtgcatgtgctttcgtgtgcccgagcccggccggccgtatagaaatcgtcgtccaatatggggacgagacgacgaccgcaccgtacgtcgtcgtcgtcgccgtcgcaacacgcgtgggcccccgtttgcgcggcaacgagaccggcaaggcgctgacaggctacgtggcgtagagacgtgacgtggcgagctcgaccgggcgcgcgagaggccaggccccactgccccagcctcggacgcgaacggagggaggatgacgtgcagaaaacgacggcgggcgggaaaaagtccgcggacgggggacggcgagcgcgtgcgtgcgttcctatcgtggaagcaccagcagcacgggccgccggcggcggtacgccaaggatgtacggcaggttggcgtcgcggtaaaagtaaccgcgacagagcctttcgcggtcgtgagtcactcattgactcaacgctcgttttgcaggtagatttctcgaaatttgattttagctgagctggtacaaatccgctttaagttataagttgtggaaaacaaagatatcttggtaacatgcatcatatggatttggaaaaatatggagtcgaggatgtaattctaaattgaacaaaagaaatatgttgattttttttttttttgaaatctactacgacgttgtacccgtctggttgccattattccatatttctcgaactcacgaggatgttgcccgactatggtcgaaggtttaccgctcgacaggagctcaagctagggtttgtcgaacaaaccaatcgcggaaggattacggcgtccgcgtaggacgctcacggaaactacagcggtggcgaaagcgaaggcatggaagagttagagtttgcataaccctaaaagcatcggatggtgtattttataacctatcggaggaatgtgaagcgttccgtgaagcactgaaactggagccggccctggatccacacccgtcgacggttttctgaccgccgtgccggtgccgcagccgttcacgacaggatgagcggctctggctgtacctacggccctggagtcccaaacgctcgtacggcacgggcggcttcgtagtcttcgtcggcgcatcgtcctgacgaggacgatatatgtatggaacggtgaatttctggtggactcggactatccgttcgtaccgtaccagcgtacctatataatatccacaccaagtaatggccatcgaaatagacccagccgtgcgatcaaaaaccccaccgtacggtccaaccgtccaaccatgctgaaactgaaacacgtggccacactcgattgaat

SEQ ID NO: 1732 - DNA, 1348 bp, Zea mays
  misc_feature (1)..(100): optimal_loci_349477_G1, chr10:145610418..145611765, Cluster 10
ttctttggtgcaaattacttgatatatgctgttaaaggccacatgaatgaaaggtgtagaagaataaaggttagcgaaagtgaactttcagggtagttcccctttttcttcttttgtacacagacacaaatttcaggctgccctcagtcctgcaactgggaaaagctagtaaagaacaaagggaaagagacaaaacaacacaaaggtgaaacttgatgccaatactttcttggaggaacaaattaagtggatatgctttcacatgttacttctttctatccatctgtacaagtagtaacgacttggtgaactgatgtgtgtgttgtatacttgtatctattgtttgcttgcttctttgagcgcgtgattgaacgaaaaaaaaaatccatgtgatattgtgattgaatgtaaccgacgagttgatgatgggcaggaggggtttcaacttgggctacgcgttcatcaacttcaccaccacgatggcaccccgcatgctctactacgccctgcagaagtccggctggaccgtgtacggctccaagaaaaaaaaaaacgaccacaaggatgcgtagcagcagctgcagcctgaagccagtagctaggaaaaggagtaaacttgttctgagggaaaggttgggggactttggacggtagctgcgtctgcgtggtggtggtctgatcgggatgtctgtagtctgttccgtagagctagcgtagcggtagtgtctttgtactgtggtgtagtggagagtgtttgtgtgttccatttccatgtcatgtgtatacggtgtacctgttgtgtcttgaactccgatgaggatgagtggtagcagcgcgcggctgggtgtatggtttgtagtactagtaggcaatgtatgtgtgtgtcccactttcactttggtgtgttgttcatggaactggcagaagcttttgtgatgcgatgcatgaatgattccccgagagagcatgaatcccagaggaagagaagggcggcagagaatctcttctctggccgtgtccgaatccgtggcgccatcaatgcgaccgggcgagggttcgcggtcaaacagttgccactccggtgaaaactgggaacggctcgccgatcttggggggcagcggcagccggcgacgacatctcccttccgcgtctggtcgtgctgctgcgttgcgtcgcccggccctgtcctctcggtgcagatgtgtgttttattatcttaatgctttatttaagttgttaacgtaattttattaaacttaagtcagaatttgattgttcttgatttactacattgttcttccgatagatgcctcacattttcctttttgttcaggtaacaggcatgga

SEQ ID NO: 1733 - DNA, 1007 bp, Zea mays
  misc_feature (1)..(100): optimal_loci_350037_G1, chr10:148836066..148837072, Cluster 10
actgtcaggaagaaacgtaataatcactgacttgtagccagaaagagagagatgaggtgaggaattatctagcttgagcagcagcattagcagtaaagtgaagcagactttggcaggtgacggccggtgtggtgtcgccatcacatcagatgagatgaggcacctgtctctgtcgcctcctcccaccatcaccaaaaacacgaactgcttgctatcccaagaaaaaggaaagaaattttttttaaaaaaaatacccaagacacacgagacgagacgtgagagtgacggaaactccagttcgtttcagcatatgtatcatccatccatccatccatgtggctggcctgttagatatcatattaggatctttactgtgtccaacttactgaatccgagatcactagatagataatgaatggatctgtatttgttaactgctaatacgtgttacagagggatagagagacataccttggtcatgcagagctggagatggatctgatccttaccgatgacgatgcctcgattcctgcagtcgccgctgtcctgtagaagagggcgatgagttttgtccgtggattagtatttagagcgagggattagtgttcgctttctcacgaccccttaatcctttatatagcttcatgtaaccgggctctaaccatggttaccgtgagccctctcaatcaaagatctgattaaggagattgacagttagatttaagtctaatctagtcattggtgaccgacgaccgtagaatggaatgatccaaataaaagaccgagacccagggtggacacgacgggatggatggaagcttcgcttcgcctctgctgctcgtccagcctgcacgttgctgctgcttcgagtcacagcaggcactagctgcaatgggccgcactagctacaccgagcatatgcatggttgttggcgcacaactcatcagattcagagctaggttgggaatataggctggtacgtatgagccggtacgagagaagatag

SEQ ID NO: 1734 - DNA, 1399 bp, Zea mays
  misc_feature (1)..(100): optimal_loci_37120_G1, chr1:223767449..223768847, Cluster 10
aagaaaagacctgagtagcctggctggaatgttggctggatcatatgctgattacgcctgcgccatgaccaaagaaacgctcacttcttaccctcccctgcaataatttgcagccacgagcaggcgagctcgtccagtgcgattacgctcctattctaatgccattattatctgcatgatatgatggttttgcaaggaaggtagcagcatcacatgccatcctctagctaggttgtgcttgtgccatgccatgccatgcatgatgtataaaagggagagataataatgtctggattaaattcttttggacagtccgattgattttttttatcagttagcactatcaacctcgtttgattgtgcgcgaagttttgaacacagatttctttctttttttaaaaaaaaaaggaaactcattccaaatccactggaaccatcaacatctttttcatcggagaattattaaatgtggctagcagtgcaagaagtaccttctcttaggacgaagagaatgttactttacaagttgcttacgatcccctccagattttcgacgccctaacgaggagcacgtcacatgcagatgcaggcactgcagtggatagagctgaaccagcgccagtccctttaattgcaagttctggtgactgctggttgtgctgttgcaaggttattattgctaatcgcgattagtacgagatcagaatccagagcagttctatgatgctgcttttgacgacgccaaaaagggtatctgcctttctcgttatgtaaagtaaattagtgagaccctcgtctgcagggaagcgtagaagactaccgtacctgtgcagaatcagatctctctctctgagctgttaactgtcctgtgacgatgcgtgggtagctagctgccgctggagcgagtacacacctcaccagcaagctaagggagatgatgaaactaccaccactgaacatgcatgcaaacaaacacgccgatactagctaccaggcacagagtagcacaggttgttcgtggagaaaaaaggcagccgcagcgggaacaccaaccatgcatctcggcctaatccagatctcgtgtactaccggttcacggattgcaggcatagaagaaaagggggggggggggggggggggcgaggccttttgcatgcacttgtaaagaactaacgattggtttggttaaccaacgaacttatcaacgactgaagtgtcttatttacttaattggaggttgacatctgcagagagagagagagagagagagagaggttagctacttaacccaactgctatgacatcatcagcggcaataacacaagcaaaaggccagaacctcataactataatatcgacgagtaatattccgaaaaaggaattaaaaaaaccaagatgt

SEQ ID NO: 1735 - DNA, 1039 bp, Zea mays
  misc_feature (1)..(100): optimal_loci_37143_G1, chr1:223830251..223831289, Cluster 10
gcaacataagtgtcttaaaaaccaagcaattaagtcgttgcagcaccgatccatcactgacagcgatggccattcgagctctgcaccacattccatgcgcttcacggtggcggccgcccccccctggtggcactggcgcgccaggagtacaacaacatctctctcatgccctgtccctggccgctgcgacgagcaagcatctagcccctacccctgcccctgcccctgcccaggccccggcgcccacgacgagagcacaaattctcacgtccttttcgcttttgtcttccccggccacgggcatcattgtcattggccagcggaagaagaattaatgccgacgaagattgccgcccggacgctatggctgctcccctttgttatcggcgacgttcgggtggctggcatcggcccgccatttcgccgtcgccggcacgctctcgcttttcgtcagccggcctgctagatccgtcgccatcgcccatcggacacacgacgagtggcaatgaagggcaaagcaaactcagctcttttcataatggcctcggttcttattgacctggtacgtacgtaggtgctagctgtgttagtgcaacgaagaaccgaccgcaacacatgtcaaggattgtccgtcctgatctaatgcggcctcgttgtgactgagaaatgagtggaaccagatatgtctcggttgcgtgttatataggcacccaaacagtttccggtgtggctcatacatcaaccaagaattacaacaggtaaacacgagaaaaacccaaactaccttaggaaacaacgacctgctacctatcgtctcttaacttcagccattatggtcgcctaactagattagggtcgatggaataagtcctttgtggcctcttgtggaaaactacagccagcatcttagtaattgctgcagtctttgtgttgagtataatagagtataacatctctttagaggacattatctcagtttggtctctatatgacatcatctttgtggactttgtagaacaacatatttgtatgtcagggc

SEQ ID NO: 1736 - DNA, 1017 bp, Zea mays
  misc_feature (1)..(100): optimal_loci_37226_G1, chr1:224246612..224247628, Cluster 10
aagacgccgaggggagccggtggccggggccttgtcgcccggctggtagctccgctcgagacacggcagagacggttgtagcaggttgtaccggtcggaggagtggttaggtgcccggcttgttcgacggtcagagcgtgagccaggcatcgacgagagagggttgtgtgctgaatgagcctatctagttgtggtcatgttccacagcgcagacaacacaactactcgtgcgcaagagaaaggtgcagcaataacgaaggaataatcgcgctctgtgggactgtgccgctgccctcgaacgccggtagaagcagtgcgtggaatctctacagttctggcgtagcagtagctagctgctatgctagcagcgaccagccaaccagccatgctcttgaagtcttgatcaccatctgtgcgcgttgacaggcccttctccctttccaggctgccacacgtcggaagctctgaaccggttttagtactgccaagttgccaacacacacagtgacaggagaggcacagcacagggcatggcaaagacaaaaggccgcgcgcatcgacgtggcttggaccgtgcgcgagcgacgagcccacgagaggtcgatagccattagccaaggcgctttcttgttcgctctccttcggtccttcgcccgacgcgacaggcagcacacccaccaacccgtcgcgtcctgccccctcctgcggcgcgcgcaggctcggagacgcagcactaccggccaccgcctgcctgccgattcccaggacgcactggcctcggcttgtctccttccgtccttcgcgccctggtgctcgctctcagtcactcagtcaggcaggccaggcctcggctgcccccgccttcttttgcagacccggcccgccgtctcaaaagagcgcgctctaccagatctaacaatcccgagtgcgtttaattttctaccaagatgcatagatatttgttacgatatgaaatttcagaaatcgtaattgtttatactatttttacgaactcag

SEQ ID NO: 1737 - DNA, 1358 bp, Zea mays
  misc_feature (1)..(100): optimal_loci_43087_G1, chr1:253907937..253909294, Cluster 10
ccatgattcaagcgacagagttcacttgagtggcacaaatgatatgagaaaacagagttcactggcgtgcctggcgctgcgacgcgcccgtccccgtcggcttgctggctggctggctgctgcttggccggcgtggtagcggcatgcccggcctcagtcaccgtgggttcgagatgtgctagtaacagaaggtgggagaaaaggcgatccagaaaacaaaaaggctgctaaaagtaggacaacaaacttaattcagttaaacacctggtttagtgacaacaatagagatttcagggattttttttggaggttactcgtccattatgtcatcaatcttgtcccccttagtcctttacgcttgtgaagtttggaggaaagtagctgctttttcgcccgcccgctcaactcaatcccgtgccggccgttcacgggactggacacggttggtcacctctccggtctccattgtgtggtggtgggctaatcgttggccacagctctccttcattcacctgcagtgtgggctaatcgatcatgcatatagcatgcccaatctacacaagacaaacaggttgatattaatttattgctgatcgctttgatagataacaagttgacatggaggcgtagacgctcaggctcagcgtcggcgagctcagcatccgacaaggacgccaccgtcgccatcggatggggtcggcgcctcccgcccggaggccggactactacacatacacatgcacttgtgtacaacaacttgcagtgcagtgcagtactacagagggaatcctcgtcctccacacgcggtttcatgttccacgacggccggcgacgccacctgacaccaaccctctgagatctgtggctgcttgcctcttccttggattggatcattgattaagtagtataccagtggcattaggattttgtggtgcgtgcaagaacacaggtgctaccttccgccgccatgatcgggatggcgagatgcggactgcatgcgtctggtcttgggacggtggtcgcagcaagatctggatggatgcatgtatagctaggaggggaaatggccaaagttgaagtgtctccgtccagggtctcataagcctcgtagtagatgcaaaacgagaaccaacggtgtacttctagctagtaagacctacaaaaatatttccatagtactactcctaacgaaaaacacgatcatttttaacgagtcataagaagcaacggaaggcagcaccacctgtagaaaactgagataagatccattctaaccttttgtttaattttcaacctttgaaaccgagtactaggcgtccaccaattgtccaagcgcagaaattttgacgttcaccaag

SEQ ID NO: 1738 - DNA, 1096 bp, Zea mays
  misc_feature (1)..(100): optimal_loci_4358_G1, chr1:22496537..22497632, Cluster 10
atggtcagcttttacctttcgcgccggagctctctggttagtgcgagaagggagtgctgactaggagtgacagtgcgtccgcacacgtggcccaatgctaactggaggccgagccttgcacgtactagtgccggttggaggagcacaaagtcagcagcgagccatgaaatgaaaaaaaagaaagaaagaaagatggagcctgtgtgagtgtgaggagatggtgattggagctgaacctcatgatagctgcaagacgaagcctggaaccaacaaatcacgcagcagatcttgatagcgccaaggaagaatgagcctgggcgcacgattgggggaagaaaatgtttgacctacagacctgctcttttttttagtgggaaatcatgttacacacaggctgatgcgacttgcctggaaccattgctgttcagtatatataataaataagaaacttgaagcgccccgttttttttttaaccctacgcccacaccgcagcaaacatgaaactgatattacaggccacagatttcaagtacatacagaatgactcttgaacccaggtaaaaaaaagaggtttcaaatgcgaccaccaaagagaaagcaatcggaacctttgaaacgcgaaccaaagtgcatgcaccccgcagcaaatcatgaacgggcaggaccacagttgatggcagaacaatacgaggataaaatgcacgggtctgtgcaatcagataaccttagcaaaagagagaaaaccataacagatgcagagaacagtggggcgcatactacactacacccatgcatgtggatcaggtccaagtgtccagtcatggtgggaatctgattcatcccggtggcctagcaagcctttttttttttatccaatgatagtggctactggctactgtgtgtgcgccagcttttggtcgctctctcgcggctatcttgttgccgcatccacctaattcctccgcaggcccccaccatgtgttactagtacatcacaccttccgtggttcccttatccctgcttcctatcacttcagatattctcttggctcttgagaccatgaattgacaccggccacatcaattccacccaac

SEQ ID NO: 1739 - DNA, 1311 bp, Zea mays
  misc_feature (1)..(100): optimal_loci_44031_G1, chr1:258436126..258437436, Cluster 10
taaactaaaaatacccctcttattccggcggcacccgttgtttgacgagagagaaaaaagcatagacttggccgtgaagacagacgaacttggccgtgaaggcagacgaacaaagcggcgggcgataacattccattccattccatcaacattagcgtcatgcacctgatgcaattaatgagaagcacatgggaggccatcatgtttgttcttcgtttaggtgcagcgcgtgactcctccctcccctcactcatatcatcagctccagcgcgggccgggctccttcatgtcgacgtcgaccgtcgcctgccgagacggggggcggcgacccacctgtacggctgtacgcacgcacgcgcgcgctcgcgagggggcccccccctcgcgacgtgtgtcgacggcgacgcagcatcgccgcggtgaacgatggacgtcgacggggatcggactgcctgtattccattccattgcggtcgccgtccatagatgcctagctgttgatcaatagatagatagatagattcaagattctcattctcccacaggccaggctccgatcgacccgcccccaccgtaccgtggtttttcataatgtgctgctgcccgcaacaacgcgcaaagcaagtctgcaaccacaacataataaagcgtttcaataaacgcatcatgcatgatgccgactttagtgtaccgtacccggcggacacacagcgagcaatgatttgatctcagggcgccacgcgtcactgggcactctcgggcagagacgccatctcggccgttcggtccatatggatcgagtcgacactccacagcagcgtacgtcttgcacggccaaccactccatgtcagtacgtacactccgtataatttgtttcactgctcatttcctcggtgctcacctgttgtacacacagtacgtacacgacggtatacgtaaagtctgttgtgcagcatggttgccctgccccatgtgatatcgacgcaatgtactgcatggttccccaccagggtcaaagcacgttactgtgcgtgacgccagagcatacgcagacgcaggcgcagctagcctggttgaatctgttcgtgtctcaaaggtcaaactatgcatgccactgtgccgggtctgtcaggtcgttttcctaccacggttggccgtataggtgctgtgctcgttgcctgtgagccatggcggtcagagaggggccagctgggctctcgtctcggtcgcgtgatgacgaccggagagggctctccatggacaacttttctcctcccctcggcggagcgtggctggttattgttgtgctg

SEQ ID NO: 1740 - DNA, 1173 bp, Zea mays
  misc_feature (1)..(100): optimal_loci_4544_G1, chr1:23561344..23562516, Cluster 10
atatatagactctatatatccaataaattcatatttactaaaacgttaaatctacgagtcagatttattattttaatagagtttctaaggatgctcgattaactcaagttcgatcaaaaaatgatttatcaatctaagtttaacagagttaaaacgtgacttctttctcttttttcttttttctcttcttccacatatagccatcgctctagccttacctctttgtgcctaaccacgtcccaccacaagctctgatttgtacctcttctcgccttgactaggcctaattggtggtcgcgcccgctcatctcctcgtccccacatgccctctccatgaccagtagtgtcgacaatgccataaacctcacctctctctctctctctatccattttcgattgtttgatcgtatcttagtcgtgcctctctctaaccacctgcgctagccgcaccttttctcggtcagacaccctagtcgtggctctcttcgaccacaaggttatctgtgttctcatatttataacataataatgggtaactaatgacattaaattatgcttgtctaagtatgattgtaatcagtaaaaatcaatatcggtctattcaaattgattaccgcttatattttacggtatatttcgtaaaccaaataacaacatagagacatagagttgttgtgcagtcttccatttacgcggtagatccaaatttattttaatatagctgccccacagtaaaggttagatatatatttatcttttaaacaatcaaaattggcctacccggtcgctgctccctctacagagccgcctggaacggccgagcacgcacgctaggcagggtaaaacccgtacccacccacgcctgaggtctgaccgtctgaacacttcgcgcccgcagtcccgcggctcgctaacgttcgtgtaggcgccgcacggctggttggctggctgggtgtatagagcgggccaaatcgcgctgaaatccggggaaacggtggccgcacccgcacgccacgccgatgggaggacagcgacggtgctcggattctgatgctgtccgtgcctgccgaagtgacagcaaattgttgctctgcagtacgcggctgcttctggtcgacggaaatgccgcagatgcttcatgtgagctccatcggggcaaacggacatgaatgg

SEQ ID NO: 1741 - DNA, 1354 bp, Zea mays
  misc_feature (1)..(100): optimal_loci_4549_G1, chr1:23588008..23589361, Cluster 10
gggcgtgcagccaagcgcacgtactccgtccgtccgtgctgacactgcacaacaactactatctaataaagagctctttcgccatgcgttgggtatttcgtaacgaggtcaggtgtcaaagcgagcggcctggccttttttttttgcttttggtaatggtaacgcgctagctgctgctctttctatctgccatgcctgctattggccgtcagttcgggtggatcgtacctgaaatgaaaggctcggcagagttgtttcccataaatcccatgtttctgttcttggaccccaaagaagaaaaaaaaaggcttcatctggacggcagcaagacagatctgggttgtgtgtaatgtatgacctacatcgatccagcgggcagtgggggactctacggcggcaccaactccaccacacacactgttttgaattggtgacgagtgatagcccctcacctactgcagaagaacttgacccccccccccccccaaaaaaaaaaaacgatccactggccggccggtcgtttccggcgcgctatcgtctaccggcggtcagctttgccggcgaactagccagcggcacgcgcaaaagtcgagatgagctaaaatgcaagcacgctctgaatctgaatggagtccatcacagcgacagcgagtacacacacaagacacatgtctgtggcatggttaaacactgcgcagtcacatgcaggaagctgtggacgtcttgaccgttgaatcaatcagcacaggggcgcggtcgagagggcgtgcgtgagtgtccccgtgtgaaacggggcggtgttctgacttgtgatccctgaacttgtggtgcgcgcacgcgctgtggcttctggggtgcggtgcgggggcacttcaatttcctgcctgcccgggttgtcaccaatcatcactcccttgtgttagtgtggactgggcagtggccaggtctgctctcgtgctcgcatggctgaagccagacagcaaccctgcccccgctgccgtccgcgccggggaacactgttgcctgcgctgcgcccgcccttcggcagctgcgcccgcaatcgcaatgctcccggtctcgtccacggctccacgcacgagcgggcgtcccatcccatcccatgggctcgagcccgactgccgcctgccggcgttgccgcggggaggggtcgggtcgcgcattgaaaactcgtaggcgacgtgattggttggttgcagccgtagctgcttcgacctgctgcctctgcctctgccgccgcgtgcaagactgctggtcccagtggtcctgcacctccgctggcctggcctcgtgcctgacggtgacggacgcggcctgggagaggtacgggtgtgcg

SEQ ID NO: 1742 - DNA, 1083 bp, Zea mays
  misc_feature (1)..(100): optimal_loci_45908_G1, chr1:269040924..269042006, Cluster 10
tatgggttcgacaccttctccaccattagtctaatgctcctgtttaactgccagctaaggtttgcttcaatcatatggtacgatggccctcaaagatggttaggaacataggctagtacttgggccagctactaacatctgagggttgtgttgctggtttgttctcctaagttccacaacggcaaggatgtgctgctagatgttgttatcttgtgtatttgctctctaaggaattgaaagatcagaaaaagggtttgtctttgggtatcaaccttttgacttacagtcttacattcagataaatttagtgatgattcgttctgtgcttaacactttatgcacataactagaaagtgcaaatatatgctagtaaactaagttatggtgtgcaccctttcttgtttttttttttggaaagactagttgacaaaaaaaaaaaaatcctattttaaattttagaactcaaataaaagtcttcttgttagagatcctcttataaattctctttaattatcttgtcacccatatataccctgtgtttaacgttgttgggcgagctagaccatgcaagcatgatgatgtgtctaggataaggctcatatacggcctgtttaattgggccgatccagcccttgtacggtggactctgagctgacggtagcgtgaccggaagcaccatggccgatggccgatgcagcgcagctcccttctaccctcgcgctcgcgcttgtgggctctctcgcagtcgcaggctcgggccgtcgggcgcccccacaccacatggcacttggggggcttcggtccgtttccaccggtgcagcaccggagggcggaggggggtcgtggtccgtacgcgcggcgccgagggagacgcccggccagggtcgtgcgtgcatgtgcgtggcgcgaggaagatctgcccttgcccgtggatcgcgtggccgcgtcgccgtctccgtcgccgccacaacacgtggacgtgggaggtatctccggggcacgccggcgtgagccccatgtgccgccaactcgtgcacggtccgctccagggggtctggatggactggactcggtggaaaaggg

SEQ ID NO: 1743 - DNA, 1165 bp, Zea mays
  misc_feature (1)..(100): optimal_loci_46181_G1, chr1:270671671..270672835, Cluster 10
cggccccgcggcggctgagtgagacaggagcgtgcaaggcgcggaggactgcactgcacgtccgcgcgccggccgcacgagggaatgttccgccccggctcggcagactagtagtgcgtgcgcccttttggagtttttttttgccgcgcccttccttttgacttgaccgcttctcctgcaccgggtggtcgtgcctaggacagcgtgtttcactgtctcttctcttccactccggatgcgtcgtggtttgcgctgtaatctgcgtgggaaactagagagatgcatgaccaacatctgctccgtgcagaattccttacgatgtttttcccctatttgggccctggtataacggttgcttgttgagaaaacaggttatctgagaagttggtaagctatttttagtttattgtgagaaaaagctgaactgataaactgttgtagaagctacaagtttaacgcagtttctgcttaaatatatcaagaagctgaaaataagttatacaaaaaataagcttacatggactgacactatataaaggaacaagaacccagaagcaaagtcagcacaagtttcatgtgcgctaagataatgacaagtagtcagaactccagcgatcctattcctaagtcctaactgctgcgctaagatttggttccactctgcggctgagatctgcgtggacccatgcatgcatacacacgccactggctcgaagaaggcctcgtgttagttgaagtgtccggtgaaaacgcatgtgcttaagggtggatgaacatgaactgcatgctgttccgatcagattccggccttaaacaagccgtatatgttgtttgagaagaacaaaacaatgaacatgtcccagttgtaaagtgagctgcattatatttttttgtagagtaggaagggtttaggtgcacgcattgttcctggggatcgatctgcccacatcgtgccaatacgtacatgcatgatccatctatctgcttgtaatctaccaaccgcggttgcactcgagtacgcagctgcttctgtctgggatgcgtgatttgtcctctacccgcccatccgtcatgatcatgatcggtctctgcattattgatgatgcagttagccttttttttaacctggcaaagaaagagatacaggccaaacactggaacatac

SEQ ID NO: 1744 - DNA, 1125 bp, Zea mays
  misc_feature (1)..(100): optimal_loci_46189_G1, chr1:270702129..270703253, Cluster 10
agcctgataaagagaagagaagcccctaggctgaagctcattggtgacggaggtcgcgcccgcgcaagagctcgcccgcagtgcgggtgcggctgtgctgtgtgtagagtgtagaccaccgaggccgcgggcctgccgtgaaaccgctcgaggcgcggccgacatggatggatttcgcagcgccagtgacagcgccgacgaaggtcctcgtcggagcccaagtcgagggccaccggccggggaaggcgtggcggcagatggacgtgcctctctttcacgcggctgcggctgttcgttgttttccacctattgagtagctttcaacccttgtaaataaaactaaaataaggcttaacagtccaattaaaagcgggctcgggcgcctttttgcctgttcatcaaatcaggagcggggaaacacacacagacggccacacaggcacctgagcagcaggctggtgagatcagaattcggatgatgtccgaagtccaatccgcagcctgtacctttttggtacgagggcttgattgctgatgatcacttcaagttcaagcatctactactactacaatacgtactactctacacatcatgcgcatctcgagacacttgattggctttcggcgatgacaaggagaaggacggagcaacaagcaagcagcacaggaccgagcggaaatctgattgaaaacgccagcgattacgggtggaaaaaatcggacgagcaggccgacggcgagtcggcgtgggaggaaagctgaaagcgacgcgcgccgtccgattccagccaaacccgataggtcgaagaaagaccctgccggtgcggtggtgcggctgtaggatcagacgactgggacagtgaggcagcggttgccagggtccaggaccaactgaggagtgaagagtgacttgactgatgggtgatggctgcggaagggtcgccgtcgctcgtctcgctgttcgtgggcctagctgtccgtgtttccctgccgcggcgggactgcgccgccccgtccagttgcctcgtcgaccttgacgggttagatgtgcgcggcgcgcatcacctcgacacctcacgtcgagttttttttgtttttgtttttgtttttgttttgtgattataa

SEQ ID NO: 1745 - DNA, 1015 bp, Zea mays
  misc_feature (1)..(100): optimal_loci_47449_G1, chr1:278160156..278161170, Cluster 10
aagaagagagccgaagtgcacggttaacgccgtaccggcccgtttccccaccgctgcggaagaatcgcccgcctactgaatccgcacggtggggcgtctgggcgagtgaaccattcggcccgcctgcagcccatgccggtgccgtgcatccgtgtcacactctacttgcagtcgacgacccggcatgtgcgccactactctacgcccttgtgcgccgaagagtgcaagttcgaagaagatacagcttgcttgcttggtctggtcgtgagatactatatcttttatctttatcctactaactagtactgtatcttctatatatacagagagactacaagaagtgaagcaggtcagcaggtcaacaagcgagccaggtggcgcacgaacggcgactggcacttgtgcgcgccggctcgcggccggagacggcaggggtgtggtgtggacggtggagcagctagctgattgcctagctagttgcctgcttgtgcgctttccgcgaactttcccaccgacgcgtagtacgtagttcccgacgccacacggctgtcatccgtcgcctcgtccagtccacccccgtttcacacgacgagacggcgggagccagccggcgagcaccaccaccgaaaaccatcgcgatcgagcaacacgtacgacgggcacatgcacgatccatggagacgcacacgtacaatggcgtagcgctccccaccgttgctgccgcggacgacgaagcgcaaggttccgccagcaagctaagctaagatacggtacgggtggcgacgatggcgaggtctcctcgatcgcaaaaagagagggacgacgaggagatgcggcgaggtcggcgcatgcattcagtgggccggttcgcggacgtcgttttctaatttagggcaggaccaggctagctactaaaggcgcgcgccacccggcccggccggccctctgcgctcatgcatgtggacacctcacgtagcagtcgaagcagatggagatgcgcgtggtcgagcgaaag

SEQ ID NO: 1746 - DNA, 1276 bp, Zea mays
  misc_feature (1)..(100): optimal_loci_49167_G1, chr1:285106666..285107941, Cluster 10
cacagtggtgtactccgatcctactttactattgttcttgttacccattattggatgagtacctcttgtgcactgatgtaggtacgtgaataactgtaattagttggttcgtggcgaatctgcattacgtgtcccatcaaagaaatcgagtaggtcaccatgatgccctccacaatctacaagcccagattaatggccgttgatcatggagtttgaattcgacgagtatatatatagtactgtacgtactaattaaagatagttgatttaagaactatatggtcagtgagtttttagatgcatttcggcgttccctttcctatataaaaaacggtttagccaaaattagctccttgatatatataaaatgtcagtataataaagacttagctttgcctttgtgaaaagcacggtagtccgtagagagagaaaacaaaagcactgagagccacgtacgtacggtacctgttgttgcaacacatgtcacgtcagtgatgaagctggaggtgacaccagtccacgcactacagcacgcgccaatatagtgtggagtacaaaaaactttcaagaaaaaaagtcgtctttggagtaggttcttttccttttccccatacctccgctatggttgagaacgagtcatgcatggctgtctggctgctcgccgcaactccgctgaagcgtgcgtgcatgtctgtccaggaggaaaaacacacaacgacgtgatcgatcactgagagcagtagcccgccaaaactgcatgacctacacggtctctctctctctctctctctctaccttttcttttcgttttgagaaaggaaactacaatactgatttgaccgtttgggaaacgattggtgtgactagctgttcctaagatacagatacggaacccacattcaattcagtttacttgtcacgcatcattcatcagtctaggcaaaagcaaagctccgtcatctcaaaaaaaaaaagggtactaccatacgtggtggttgatgggccatgattcagagtggagctagctgccacgagaggacggagcactagctacatgagtgtgtatatgatgacggtgaggaggtattgtagttgtagctatctgctcctcgataaagctagctagaagcgctagctagtagaagcaacaaacgaacaagaagttgaagtgcgcacgcacgcacgtacgtactccacctgccaatgaagtgggcgacgacgacgcgcaacagcaaggcagccggcaatgaccggggacgtgggcttcaatttgcac

SEQ ID NO: 1747 - DNA, 1150 bp, Zea mays
  misc_feature (1)..(100): optimal_loci_49242_G1, chr1:285524395..285525544, Cluster 10
ccactcaatcactcctacattgacaaaaaaaatccctatcactgccaaaaaaaatgaaactacagatcccattaaagtcaaactatatttaagttcgcttgacctaatgttttatttataattgcatcgtttcaggaacggctggatggattcgaacaggattcacattttttttcttgttttcacggttgcacagttgtcatgtgtcatcttcccactctatgtaaaaataagatacaattacgtacaggtgaggatttaaatctgggttggtggctctaagtccatacggaggctctacgtcacctaaccaatggaatagacattttttttatgttaaaactaagtctatccatataataaaaccgtatgactagtgtacaagtatctgtcagtcagtcacgatgaagccaactgtccggtaaatcctcaagtatcaacccaactgtccggtaaagtccaagtgggaataatgatggttccaaaatagctcctcgagtttatccagaaatggtccagatccagagaggccgcagcgagcaggtgcccagttgcggtcacgcaaccggccaaaaacagcaacaaagacacgtcaactcgatcaactgtttattccttgccttcccgaggagagagaaacaagcgaaaagcacatctcctcatctcctatgctacgcgcctacgcacagctagctagctgtacgaaaagatagaagagcgggcttgaagtcgcgcagcgctacgcgacaggcagcacggagggaggagggagtgcgttgccacttgccgccacagagaatcacgcacgagcggcgagcgacgagaggagacaggcgctctgccctgccctcctgcccgaacagagccgggaccaagcagggcccgtcggaggaggaccaaccactctcgggcgggggcaggcaaggacaaggacaagagcagcagcgtcacgacgtcttccggtgcccttccctgtccgtcgtccccgcggccgagccacagacagccggaacaccaaccgaatgcccctcaatcttggtgtcgttgggtcgctccgggccacccgcaggccagtaggtcgccgtccgtcgcttcgccggctgcagcgcagggcatcggcgcgcgcgggtgtgcggcgcgacgtcaccat

SEQ ID NO: 1748 - DNA, 1379 bp, Zea mays
  misc_feature (1)..(100): optimal_loci_49631_G1, chr1:287986848..287988226, Cluster 10
gccgcgctgctgaaagatagaggacgggggctgagagagagaaaaacaaaagaaggccgggcagcaggcaggcaggcaccacaaggcgtagttggcacttctactactactactacgtgaaaaggagaggagaacgacggcgacctgcccccgccggactcgcgcgagcccaacccgtcccgggccgggggaaaacaaaaggaggaaagggaggttcccctttgaaaaaaaagaaggaaataattagcaaggcaaaaaaaaaaggaggtagtagtactagagctttgttcgtgagggcttttttgtgaacaacgtgtagacgccgacggtagagagtggcaaaaaaaaaaaaaagaagaagaaggagaagcagaagaagaagctgctgctttgctagtgtcgttttgcgcagtagtacgcttgattggtgtctttaacagtttgttggtttttatactactactaataaagtgggggttacgcggttcacgaagaacaccgccgccgatcgtttgcgaactgttccattcagagagaaagagagatcgatcgatctactgtccagtcagagaggtttaggcgtccaatcgtcgtctttgtgacccaccactttttacgcaaaattcttagccaaaatggtgatgccaactagctagaaatgccggatgaaccggcaccctacccttccttttcccgacaacgttgacacgagctagctagctagatggatggatggatggatatttcgaaagagaaggaaggccggagaaaactgggggcgagaatatatgtcaccggcctctccccccacagctgcattctttctttctttctcatgaagctgactcccagctacctgtgggctgtggctcacacgccatcgatcgcaggcagataaaaatatccgcagaaccgtcgggctctagccgcacgacgagtccccatccggcttgcgttcgaaggcccttggttcaacgtccaaaccatcttcggaataagcttctttttcaactgtttactaaagctaagaaaatacgtagcgtgaatgggttacaatggtctacaactaagatagaccaaaaaaacttatgatgtaatcacgcgttgtagacacaagtataacactatagatcttgttcagatattcctatcccttctggattggatagaatttagaaaaaaaaaacttataatttttttttgacttatctgagatttaaaccactcaatcatatctaatctatatgaattattgagagcaaaacgatcaaaccggtagtcctttacaagaaggcaaacactgcgggattagaaacctcgccagcggtttcatggactccacagtagtattgttttctcgccctttatatatagaaaga

SEQ ID NO: 1749 - DNA, 1202 bp, Zea mays
  misc_feature (1)..(100): optimal_loci_50284_G1, chr1:292228526..292229727, Cluster 10
gctcacttagtgggcgtatttgactggcctgtgccgtgtgcctacactggggcgacggaaacagagcggggccgcgacggccacggctccttcctcggttcctccttggacatcactcgcgtcgtgtgccccacgggattccacgtggttttgatccgtccccatccctgcatcccttttttccctgccgcaccactacccgtcctggccacaccaccccactaggccaacgatcgacggagaaccccgttccgttcacgcgtcattcatctgtccatgcttcgctctctttaatttttactaccggccagccaccaccaccgcccccggtccggccgcccggtcccccccttttttgcccgtcgcgctagcgctacgccgcgccgcggaactcgctcgcgggacaggagacgaattcgtcgcggcacgggtccgtgtcctcggctccacgccgtgcgagagcgagacgagaccctggtgcctgccgcctggctgcgtgactccgccgccggcgccattgctggctgccctgccccgcaccctacggcccgtgccgactcgcacgcacgcggacagcgcctgcgaggctacatgcacagtggacatggtcctgccccatgcccgcaagtctactacggctacgggcacgcctcgtcgggtcacctgacgccaggtccacggcgaccccccacctccgtttccgttgtttggcggctagcttccggtcactggaatcgacgacttttttgcccgacgcacggtgtacgcttgatacgacttgggtaccctatactatgctatatggctacactagagacaccactggacatgtatacgccagagccgtcccgtgcgtgcgattttccaaacgattgcgatggcccacctgcgagcgtgccggaattccgtgacagcggaagcccatggacagtgcgcagagtacgtttttttccctaaaatattgcgtccgggctagtaggatggatgacgcgtcaaacgatgagggtgggtgggtgcaggagcgggaccagtgccacgcccaaaaaaaagtctaccatggcttattcaaacactcccgagaagaaacaacttcaaagtagtagtttctaacacaaagaatctttctaaatttcgctcactctaaaatctaactaaagttttgttcgtatcatattaaatattcgaatatcaattattatgat

SEQ ID NO: 1750 - DNA, 1378 bp, Zea mays
  misc_feature (1)..(100): optimal_loci_50552_G1, chr1:293633847..293635224, Cluster 10
cctccacaccatactctagtctctagtggagtggtgtgcgtacgtacagtacatcctccaactagccagtcccgtagccatgtgagctttgtcgtcgtggcgcgaagcaaagcagcacccagcaggcagccgccaaacgagagtcacacgcacagctcgcggcacttaacagtgcgcgagaggacctgccgacgccaaacaagagtcgatctgacagtggcctgtgggtggatgtggacagacagacagaccaaggcggttcggcgtcttggaacccgcgccgcgaacacgtacgttacagacggaagcatgctccggtccggccgtccgggtccgggtccgggtccagcggtgatgttgagacagcgagtgcgaggaagaagaaacggtccggaactgcggctgggctcgtttgttctgcccccccccccacccccaggggtcgccgctctggacggaacagcggcacatggatggcgcccgccaagtttccatgcggttgttgttgttcacacgccgtcgtgatcgactcgtcgcttagtactgtcgtcggtgtcagttgcaatacaacccatgtgcagtgggacgagacggaaaaggtgtgtgcgcagcgcagtgctcaagttcagaactcagcgcttgacgctcgagtcagagagattcgggacgctctctcggtagacgactcggtgtcggtgctcagtacccaggtgatccgtgcatgggagtattcggtcgtctgcctgcttgcaagacgccatccacccacccaccggcggactaggcgtttggcgccacctccttgtagttgttggcttggttaattggacgagccgggtgctcgaaggcctgcctgcctcgtcatctttttgctgcgtcatgggaattgacccgcggtgagaccaatccaatccaatgatgcccgccgtgaccgacctcacgccagataccgcgcgtacggagtcagagctggcacagtcgcatgtgcattgacccgacgagaagaagataatcacagatggagcggacacaaagccacagcccacagcggcacagcacgcggctcaagtcagccgttagccggtggcggtacgtgtgtgtcagtgtgggcgggcggcggcgcggtacggccgggacaagcgtaagcgccgccgccgcctgcctgcctgcctgccgcacacgtcgcggagcatctagctagctagctgtgcgtctctgtcaggcagcgagtcggccccgctcgccgcgtcagatcggtggacgaggacgcgtggtgcgctggcgccgcgccgttcgtcgcctgcagcaaaagctactggtgtgggcagttgggcaccgcattcatctatcacgcaccaggttctcaaatggttcgagt

SEQ ID NO: 1751 - DNA, 1136 bp, Zea mays
  misc_feature (1)..(100): optimal_loci_52706_G1, chr2:5074470..5075605, Cluster 10
tatattaaattaataataacaaatattacattttatcttgaccaaaagacctataaatatataagttgaaaaagagtccacccatttttttaatatctcgttgatcgctcttctccgttagcggggtaacactatgtagaagtgttacgctgcgtgtgactttgtatcgtgttaggcctgaatgatttctttggatgtggcttcttgttttgtcttgtcgtgtttgattagctagggtggtttttatggtccatccataaggttttcaactgaaatttcgtagtcctttcatcactgagcacctggagattcgttttacccctcgttttcaactgctagatactttcagaccaaaagcatcccggacgcaattgcatctctttcgaccaacatcacggggcatacacaggcggcattcgacgacgtcaccccaccagtcaccagccaatcggagttagcccaacacgtgaggcttttcctcaaacccgaagtatatgctgctgtcaggatcgtcggcaagttgcaggcgagaaacgcacacaagctatagctaaagctaagtatcgtgctttgtgttaacaaatcagcagtcgtcttagtccggtgcagctaagcagtagttaccaaaaggaaattgcatgcatgcatccttccatcatgtagcgaacaaaaagaagcaatcaaaaggaactctgtggaagaaaaaaaaaattctgacgtacgagcacaaaaggatcatcggctagagtttttctttctagtcgatgatacaaaacaaaacttggattgcatgggcaatgcaagctgtgtgtagtattattgggacgactaagtgagcaagtgctgcctaaaataggctgacattcacatcaagggttaggcagggcgtcacaagttagtactgtaattggtaccttccagtctcctcctatcgatgtgtcccgtcgtgagcgctccaccagcatggagctagcgaacccgtgcagcgcagggagatgtagagtagagctacatgtttttcggtttcttttccagctgtcaacatgttggcacacgaccaagacccagataagaagcagccatggtccatggaaatcctacatcctgagagctccgcaggccgacacgtcgtggag

SEQ ID NO: 1752 - DNA, 1113 bp, Zea mays
  misc_feature (1)..(100): optimal_loci_52953_G1, chr2:6179270..6180382, Cluster 10
taataggagtaataagctttggccatcgatcagacagagcatcgctctcataatggcagagcacagcatgagcaggcccgcagattaatggcgccgaggtgaccgtcctgcactttgcgtgccagccaaactagggttttggtcgctggcacgtcgggctcctccggccgcagcggcggtcgtagccgtacgctgggtaccagttcccctcctcccttcccgctgtgcagtccacgatatacgtaacacgctcccctgccagtacacctggttcctcccggttggtagcacgtagcctcgcacacgcactgtgcaatgcatgcccaccttccttgtcgcgtgtcgccagtcgtcacacaacacgacgccgcgccgcgccataggccggttggttttggtccgcgcgcggtgtacttgcgggctgcagcggccgtgccgcgcgccccgttgctgccgctgacgggcgtcgtatgcatgcgtgggtgacggagcagagtggcggcattgtttttggtgtttctcgtctcgcatggcccatggttgcggtcgcggcgcgcgtacgagcccggcaggcggggaggttggttggccgcgcgtagctagagcggcgactgtttgctgcgatccgcgcggtatccggcacactattgcgcccccccaggtcggcgacgcctgctggacgtacggggggcaggcggcatggggcagcccccgcttccggcctccccaacagcgcgccggcgcgtgggcgtacgtgctggaccatccgacccaggcgcctacaggggcagaggggctactagagagacgttcgttgacaattaattgagtcgttattagctaggtcgggcgtggtctgatctacgtacgcgcgttgtattatcctcgccctggacaccagcaaaactgagacaaccagattaaaaaccccttttttatatcttgtgcctgacctggcggtacagtgtggcgtataacgactgacctgacaacacagacggacggcttgtaatataagcatcgatcgatgcgtacgtagagcccccaacatgtactgtgcggaatccagtgtatagattgaacagagagcggtgccgtacgcgcgccataaag

SEQ ID NO: 1753 - DNA, 1255 bp, Zea mays
  misc_feature (1)..(100): optimal_loci_52956_G1, chr2:6181414..6182668, Cluster 10
tatacacttggcttattatttaacgtggacagttttgattgatgtgcatctttgatagctaatttcttcttcgtatatttttaaacccttcaaatttaagatattctgcaggtattataagtacaaaactactacgtatataactatacacacacacgtatatactaataaggttagatgacgacacatgaaacgacagcccttacaaaacactccaataatacacttgaatcgtgtgtagcaataatgggaagaaatttggtctgaaattagagataaaggaaaagggcaaagcaggagactactagagaaaatcgacaggtctgcacaaacatcaaaatgtgactcgcatcgcatgcatttggctcattcgtcaggaactagtagagtacgtagtttgcgtcgtcgtgagagcctgtgattgagaatcggcaaccgaaagcaggcgggcgatcgcgatgctctgaggggggcgcggttaaaaattttaaaaccatcggtatctcgttgccatggtaggtacagacggtcgatgacgcacatggtcggcgctctcggatccgtgctgccatgccgcgcgtggccggtgtacgccgagcgctccccccgaggtccactcagaccactactagtccatccgccacggcaccatgcatcacgccaaccggtggcgtggcgacgcacatgggcgttacgttctcggcgcgcgctagatctcggtcggtcggtcggaccggacggagcgcgccagaatgatccatgcgatcatgcgaccgtacgtaccggcctccaatcaggacgccgccgccgagcgcgcgcagcgagagcggccaggcgctccgttcttcgtggcggcccgccatcgaccacgagtccacgaccagagcgagcgtggtcctggtcctgcggcttgtggttcgttggtctttgtctttgaccgagctggggacgggcgggcgggagacggacaaagctagctagctagcgtctcgtctggtgccatgcatgttggtgctgggtgcgccctctgtccggtccggggcctcccgctttgtttgttttcgtcgtttgctcgaagggtggcggatccaacgcgctcgcgcccgcgcccggcctcgtgctgtcgcgaacaaatcatagcgtcatgattggccttctcgactctgactgccaccaatcggtcgcctaacgagagagaatccagggagcatgcatctatatggatgtgtttggttgtctggtccagcctgagcct

SEQ ID NO: 1754 - DNA, 1147 bp, Zea mays
  misc_feature (1)..(100): optimal_loci_53517_G1, chr2:9352624..9353770, Cluster 10
atggccgttcctttcaaattattgagttttctggtcctatgttttgcgggtgcattcttgtgcagtttccacgtttccccccctgctcatgtgtacttgtttaaatgtaattcagagtgtgcagtcacgtacgcacagacccacggttcatgttcatcgctcgatgaatcgcctggccacacctccgcacatgcaagtgcagtccgccaggatgccaatcgaagcacgcacacccaagttgatgcttgcagttgcaggccggtgcgccttctcggcacgccatcccacgtccgaggtactactagcggcagcgccggtctgacacgcacccggtacgagaggacgcgagcagatgaagacgaagacgaagacgaggaagcagacgcctgcggcccgtgaaaagctgccgcggttgcttttaccgcgacccgatcacgcctattgccgtacgtccttggagtaccgcagcagcactctgcacgcccgtcccgccgtccgcttgcacgatgggaacgcacgcgctcgtgctcgctgcgatcgcttcggtcgttccaccggcgaccgcggacttttccgccgccgtacgtccctcctcgatcgaccgcgcgccccgcagacgtggccggtccatttctccacgtcacctccctctctccgccacgtacgtggcctggcagcgcccagcgctagctagccgggtctcgctgtcgcgcaaacgggcccacgcgtgtcacgtgtgtggtgcgtcccatattggaacgaccaagaagccggagattttttgaacgcattgtatatactactactataggcacaagaaagcacatgcatgcttactcgtttccgttgccttcgcccagccccagctgcccagcagctgatgctttttttattcgccgtgaccgtgtgttatttctttctttctcccccctaatacgaccgaagaaaagcacgtgcatgcatatatatatatatactactactactgctactcgcttccgttgcctagctgctttatgtgctggggcctgggggccatgcatgcatcccttttttttaactgaagaaaaaaaagtctaacctgatgctaattgctagctatagctatcaggttgatgggcacgctttggcagagattaaacagagt

SEQ ID NO: 1755 - DNA, 1095 bp, Zea mays
  misc_feature (1)..(100): optimal_loci_53712_G1, chr2:10499926..10501020, Cluster 10
ggtgcatcactagtagactcttctgcctggatagaggactgcaggtgttcatgagccgatcgagatcgttgcgtgttcggccggcgggtgggtgggcgggctttcgttcgacttcttgccgttgcggcgttgcccggcccctctgccgcgtcagatgcatcatggatggatggttcggtgagctacgccggcccgccatatgcatcgctgcagcagcatgggtacacagcttctaacaaccctatagttgttaggatcgggtcagacattgaaccgacgactcacagtctcacagcgctacatcatcaccgtcagttgtcacgcagctagctgatccatccatccatgatatgtggagttttgtttttttataaaaaaaaaaggaaaacgtaaaggcgcgtgcgtacgcagagggagatgaggaaagtgagcggctcacaaatgaatggttcgcatctgcatggtgccgtttaactgcacgcaactgcgcctcacggaagcgtacgtacgccgacgcaagtacgtacgtgctgctttacatatgcgtacacagcttctaacaaccatagttgttaggatcgggtcagacattgaaccgacgactcacagtctcacagctacatcatcaccgtcacttgtcacgcagctagctgatcgatccatgtggagtttttttttcattacaaaaaaggcaaacgtaaaaggtgcgtgcgtgcgtacgcagagggaggaaagtgagcggctcacgaatgaatggttcgcaactgcgcctcacggaagcgtacgtacgccgacgcaagtacgtacgtgacctaacccagctactgagcctacaaccatacgtcacttggacggcatgcctgctcatgttgacatgtcctgccgcctaaacaaatcacacgctccaacggctacgtacgtacggtgcctgagtcggtacgacgcctgcctaccccgacccgcgcgcgtacgttgttggaaaaaggaaaaccgtgctggaattagaatagaaagaaaaaagaaggcatgtgtccgtgcttacggtgccgtcgtcgatacgtctggtcgatatacaggcatgtgtccgtgctttac

SEQ ID NO: 1756 - DNA, 1367 bp, Zea mays
  misc_feature (1)..(100): optimal_loci_54250_G1, chr2:13295310..13296676, Cluster 10
cagttccaatatccagggatcttgacagcacagtaatagctagcactagctagcagcactgctggtctgcagctgcagctgcagcaaccagcagcctgtgattgtggttctgctttgcagctgcaaagtgctgttcttctcacgcgatcgctgccttcaattcggggggtctaacatgtcaccgatgaggttagctacaatgtcactcgaatctagtaggtagaagatcagctgagagagcctagctagctagtagcagcaggtcaataagctttaatcaaagcatcggcttcaacattctttttgatttgcttctacacaacgtactactacgctgtatacacagtgacgcacgatgaacacaattcaagtccagatgcgacaacgtgcgccatccatcgagtgggttccacttcaattccacggtgagagaaatgaagcacgcacgcgccaacaaggttaggtgcagggaaggtaaaacagcaacaaaatggttggttaccctaacttagactcgaggcactggctgccacacacacacacaggcaaggcgagcagaatctgcagtctccggacgatatagatggtggaaagggacgactactgactggttgctgaacgggcgtcagtttagtcttcaccaataaacctttttttttttaaaaaaaagaagatttctctctctctctctctctctctctctctcggctttatttatgtaggtgtcgatctcaggaccgacgaacagcttccttcggtttctttgttaaggtttgtgtctgctcaggagtgttgtcggacaccctacaggaatcaaggttccaaccaaaacctgatcctctctcaattttgttctcggaactatagcatattttgcaccgtggtgtgctgttttttttatagaactgacgaagcaggcggttgatttccaaatccaaacgtgaggtctctgagattccgagttatgcacataatattaaatatagtagtatagtacaagtactgtacttgttgacacaagactgatgaacagctagctagctagcttcggttctttgtcaatggctgtgtcgtcgtcgacagcttaattaggagtgtcgttgtcggacaccctacatacagtaacaatcaggattccaacacggaaaaagaaaagaaaaatccgatcttctaatatatatttgttctcagaggaaatatacttagtatacttcgcatgtgcgctgtatgcgttacttgttttttagacgggcgaagcagctaggctaggcaccttgatttccaaatccaaatgcgtgtggtgcgtgactgcgtgagctatcagtagttcagtactagctagcatatacttgtgtacacacgtacta

SEQ ID NO: 1757 - DNA, 1106 bp, Zea mays
  misc_feature (1)..(100): optimal_loci_54429_G1, chr2:14226400..14227505, Cluster 10
gacatatagcatatgccgaaaattcgctattcaatcaatagtgccgctgattggtcaccgcgggctgggtggccccgcccggcgcgcggtatttggcacgtccgtgggccatctcgaattcttttgatcgtttcagttattcgttccgtgggccatctcgctgccgactgccgagcccgtccagtccctatctacccgcctgtcgagttcgactcaactttctcacaaaacctgccgtccacccgcggcccgcccaccggaagcgcagagcaaccatgggcacttcgatcacctgtgttgtgcgacggcgagccccgatctgcccgcgcgttctctggctctgctccaaaccgctggcctgcggctgtgcgacagcgacatcttcgtgtacagagacagaggggagacgtccttctgcagccaggaccaggagggccgcgcactacgagcagatgcaggcagcacaacgtcattcgctgaggtgttcgtttggttccacggtgatcggcgtgccatgagccactcactctttccggcattggcttcgtggaactaacaccgtcggttcctgaaatctggtgcatgtatcagaatctcgtttccaaattctgatggaaatttttttatgtaaacaatgtctgcactgaaccacgggatcagctccgtcgggaaacaaatggctgcttacattttatttatcgtacaagtgtacttaaaaaattgattgataaggaaagagggcaccggtgagtgcgctaattgcgtgatcagctgctcatcaggtggctaaaacaaaggaccggagtggaggggaatcgtcacatccgcgtcagattggagattcgaggacacacgactacacgagttgcccatcgctgagtcactgcaatgtggagacaggagagagaggccccgcgtcctcgtcatagctttgctggacatcacaagccgttgagacctgaccgtacgagtataactgaacatgtgtcgtccacactactaccagtctaccacgtaggtcatgactgggcagcatatcgacgctgtccaccaccaccatcccagcgccctggtgcctcggcggatgatccataaagactagtagg

SEQ ID NO: 1758 - DNA, 1129 bp, Zea mays
  misc_feature (1)..(100): optimal_loci_54439_G1, chr2:14263442..14264570, Cluster 10
aactcgacgccagatagttgcatctgatttgaactgttacggtccaaagctgtaacggaaaaaaaaaatttggcccgaggcagatgaatctcctcactccagacttccacaggttacaaagcaactctgtccatcatcactagctgttgttgagtacctatcccaggtaatcatgcatgcaccattgcctttctcgcactagctagttgcatggcacgcctaaaaaaggtggccaatcagcgatccgcggcacacacggcacgcttcatcgcacgacaagacacgggggaaaaaggaagcaggcagggggctctccatgcagattgattggccggagtatatatattaaagctctcgattgcgagttggatcgcagagactgagcgttaggtgccttcgccacaaacccacaagcacgcaacgcaccagtcgggcagtggcagtggcagtggcgcccctcatcgatctgtttggttcagcgcagtgcaggtgatgggctgacgcctgacgggagagagtggtagatggaggcagcaccaaaagaccaggagccaaccaccaatcagtggctcgtcgacccggaattgttcgatccatcaaatcggccggggtgtgacgtgctgcgactgcgagggaccaaaaccagcgggccggtgagcggaaaaagcggaagaaatcaaaatgtcaagcgtgggtgggtggtttactttggacccatgaggccatccatgagttttgtagagaattctttcgtggccactccaacacacgacaatttcttcaactccttttactactatcagcaggattagaatataaaaaaaacacgattaaattttggttattaacggtactaatgaagctaggcatgtgtaactaataccttgtgatggtgttttattctctcatataaaaaagcaagaaaataaggcctgtcgatacgaacgacgacaatgtcaatgacaacgagagggttaaatttttttaaatagatgatagtgagacaagtctataagattgaagtagtaataaaaaaaatattgttactgctacgagcactcgtgcagggggcggacgggcgggggcaggcacgcaaccagtaccaggccaggccccggttttgcttgct

SEQ ID NO: 1759 - DNA, 1056 bp, Zea mays
  misc_feature (1)..(100): optimal_loci_54463_G1, chr2:14464556..14465611, Cluster 10
aactgatcctcgccattggttcaaggagttcaacaccccacaccacgcgcactctctaccagacctaattgcgcacatgccagctcgttttggagtttgagttgaaagcgcagcatgccaagtcggcacaaagggcgcaaaaagaaacgcaaaagaactcggtggtgcagggttgcattgcattgcgggggcactcgcactcacacgcagacgcagcacaggtcaacctagcctaatccctgaaacgagacacgctgggcaatgcggaaaaagtccagtggacacagtagtttataacagttcaataatggcatggataagttaaagagtttgtttctgaaggttgtgtatatatgcatcgtccgttgctttatttgcgctataatgccggccggcctttgctgctgttgattggcacacgaacgactactggtagctaaaaagctcagagcctagcttcctcttcaactgtgtcattaaaaaagtttgaacatttgttggattccactagtttatccacgcgtgcactttctggaattcaagcctcaagcatcattggacgatgggtgtttaaaatatgacggacacggttgttcagtgtgcatcggtgggatgggtggtaggcggacaacttcgtttcaggcaatcgatctgcaaataggtagtgcacgatctttttgcatccacaggtcaatggagcacgttgtggaagccggaaagacggaaaggaacagaaggtgcatgtggattaatgaaaaccctaaagtctaaactggcatgccagtttctcattgactcagacactaaggacatgtacaacctatagtctcttgattgattttctatgcacaagagacatctaagaaattgcattatggggagtgtttaaaatatgtcatatcataaatgctatcgagagacattatatatagagagccgtgtagagacgtactcttatttaaaagcccgtcttttatattcttttttacgtttgactctctagagaccctcaagagacaatgtattaagtgggttgtacatgcatctctaacctat

SEQ ID NO: 1760 - DNA, 1352 bp, Zea mays
  misc_feature (1)..(100): optimal_loci_54602_G1, chr2:15117938..15119289, Cluster 10
caaataattgttccgccgtaacagattacgccggcagccaattccattgccattaccggatcacccactgaaccaaacaccaccttagctttcggtcgtcctttaccgcggcttcatcgaatatatagtacagttatatatataagatcaaaacatacctattaaccgaagaacacagaagcataatatgataaaagaaaaatacgtatacaagaacgacatcgtagcagttatatctactaacaagcgcatagaaacagacaaacagttatctattaacaagcattactgcagacagataatattttatccagattagtgtcatttcttgtgtcagtgcaaggtttggtactgttctctctaccactgatgaagaatagaaccatgatgaaatgccaggttggctaatgcgtcagctaaaagagacgatgtccttaattatgcctccctcggtgtggatggcaaaacaacccactcgtgtagattagcttcgacggcggttcacgatcatcatgtccgcgaccctaccctgtctgtgaggtttgtccaggttcgggtgaataatctagctagaaacaccactgcatgtttgcaaagagctagcccaggtgggtggctgtcaatgtaggatatgaccgggtacttgatcttggaaacggatgcggtagctggtggtccagcaaagcaagagctttggcgtccggcttcttctcattgtcgtctggtggaggagctaataaaagtctctaacgaaatcaaacttcttcattagctttgttgagtgtgtgtttatttgtttattaagacctagctggaagagcatgtaataggggctgcccctgcccacgccgatcgacggaggcaaggcagcgtgtgttcctcctagctacaatgaactggttctgaagaagacgacgaagcaataaaacgaaaactgttggcgaatacagctgtgaaagcgacgggtcatgactcatgagaaagacgggcagacacaagcgctcgaagctaagctatagaagatgccatcgatcgatccataccaagcggcacgtacgtccgcctcccttgggcttggggcgtagctggaggagtgggcccgtcatcgaaaggctagcctggacctgacacgtgggggcccggtcgtccgtagcagtcggctgcagtggtggtcctctccgacgatcctcatcctcctcttcctctcgtcagggaaattattggagcacgcaagacggaagaaatgtatctagtgcacaagcacagcctgtctgtctgtgtgtcctaccactcctgcatatataggagtagaacagtggcccgaaattgattacgatgtcatcatcccattg

SEQ ID NO: 1761 - DNA, 1097 bp, Zea mays
  misc_feature (1)..(100): optimal_loci_54859_G1, chr2:16636181..16637277, Cluster 10
taacgttactctgcacgtagcagacatgagaatgatttaataacggagcgtaggtcaacttgttgggtcctttgcgatgatggaacttgtctgttcggcttaaatccttgatttgacatgcatggtgttcatattttttttgaatttattttagggcttgtcaacgtttttctttgagtagtaggcgacataaccgtcgacaatgaaacatctgcatgcgatgactccgttcattttaagacctaataaagtttatacatgagtatttaatttgtgtgtgtaccatggttaaaaaaatggtttaatagagcttgactttctttttaaacaaagaaagccttgaagagtcgaagcacgattaattaagaatcgaccaaacgttgacaatcaccgcaagggtgcaaagagtaatcaaccctagctaggcgtttgacatgtatatgagccgggccaatcggatgatgcggcgtgcatatgtatccagcactgatggcgagctagctaggagccaggcagctagctagctagctgtgatgaatgaacaaggacctggaaagaggaacacgacgcttgctagtttgttggagacgatcagacacctctagggctcgcccgctatcaaggggacatgaatgaatgaatgaatgaacctgacaatccgattggggaacggccattgacttcgtgacagaacgtgaaccgccgccgcttcctctctcagattgatgggccgttgactgatcggaaggaagggagagacgattcgttgttccgcgccagacgtgtccggttgattgggcgggggggactgcagcgatcatgttctcagttacggcacgcacactgggcggcgcacaaccacgcagatgcattgcatcgtgtgcgtctctggagtacaggactcctccaactcatcacgggcagcagttgatatatatttgtcagtctttgtatttatgcattaaaaatgatagttttagacttttagtgggttgtacggcacagagtagtatagcagtagtactattatactccatatatgtacatagtactgtagctaaccgccagtcctggcttttggggcatcgaaacagtgt

SEQ ID NO: 1762 - DNA, 1130 bp, Zea mays
  misc_feature (1)..(100): optimal_loci_55062_G1, chr2:17586035..17587164, Cluster 10
cgttgccacatcttgaagcgtattgacgactgatgattgctggaggagtcaggaacgtgattgcatataattattatatacatgcctcactcaccaacggaatcacggcaccattctgcgtgcactgcggtctctctcctctccgtgtaccaaatcctctgttgccccaaggccgcgcgcgtcagctgcatgctcatcaactcgcattagagacaatgtggcattaggaccaacgaccgaccatgaatggaggagctgctaaccaacgctactgcagtgttgccagcttcttctgacactgtgattgtcttacagcgccaaggtgatgaaatgacgagacggctgcgttcggccaaggggaactcttgttgccatacagtacttactagcttgcgttcatcatgtgtcctaatatatggcgttcttctctcaagcgtgtactgcaaatgatcgtgggtgaatggaggtgttgcataagagcagaggccaggaaaatctgaaaagaaacagtgaaggcacgtagaatgcccacgggaagaaaaaaaaattggcacgggatctacctcttgttcagtggttgcattgcatggatggaagtggcccctgtctctgagacatgcccaaaagtgaagaagacagctgaacaggtgcagcggtgtgattgctgctgctcagacgcgctcgagttaatttttctggcaccagtagttgctttgagattttagcaccatgcaatgcatgcatgcttctctgacgctttttgtgcgtctggtttgagcaacggacgtcaggcggtggtcctggtccagactgaactctgactctgaagtagccataataacacccgtggagagcagcgggttgatggcattgcaatctgcacctgcattagatgataagaaatattcacatttataatatcaaacaaataactataagattaattacaaatatatttacaaacattttgatcatgttaacatgaatcattttaggagtccgtcaccatagaccatggagttttcaatcactacaagcgcagcgatagatcagaatctcttgttcgtttggctttaatccgtacgtgcttctactgcttttatagcgttttctctaaaaattgcagctgt

SEQ ID NO: 1763 - DNA, 1191 bp, Zea mays
  misc_feature (1)..(100): optimal_loci_55290_G1, chr2:18701578..18702768, Cluster 10
tcatctggcaggatgggttgtggaacctgtgggcggagccccctagcgcccctttagatccgcccctgccgaaaaagacattggaacctattggaagatgttttaagtcttatttttatggaacatataattttacggaacccttgtggacttatagttatgcgaatcttgcaaaggatgttgtatgtgcagcaggtttgatgaagatggcgcccacctactgctgaaatgtaaagaaacacggagggtttggcacgaactgaacctagaaccagtcagatgtaagttggccgaggaaagacctgctgtagtgtagacacgatggaaatggtgtttgcgttggagaacaaaacgaagctgatggttgccacactgctatggctgtagtggggtgagagaaacatgcagagggaggaagggcatggatcgatcggcattggaagctgcgtacggcacggcttcaatgtctgtccagattccgacaacagagaagggaactcatgtgcgggccaatgttcagacaaagagacggaggaagatcgaggaagccacctgacggtgttctgaaaccgaatacgggtggcgcctttctcagtcaggagaagtcaggggggcggccggacggggattcgtcgtcagagatggcacagaacaagtggtgaaggcgggaggagggagagaagagtttctccaggatgcttttcacgcagaactgttgcgagtcctatcctatcaggcttgaagaaagctgttaatatgggcatttcacttttcacgcttgtgcttggaaacatgtgccaccatggtccgggatgctttgctaggagaagactatcttctatcagcgatggcgggaatcatcacggaagcgaagcacttgatgtctgcagagtttgttttggtttctatgtcagtttgatgatcgggtgcagaagtcctagtgagtctgtaatcacttgggaggttgccccccatggtgttggggttttggtgtccagtgattttagtttacctactattcataagtaatggaatccctattttttttttaaaaaaaaaaagaagaagaatcagttgcaccccaaatagttattcctcgacaaaactagaacagctaaccacgcataaagctaacagaaccgaattcttctgctggcgttgggcgccacatcagataatctcctcgtctca

SEQ ID NO: 1764 - DNA, 1105 bp, Zea mays
  misc_feature (1)..(100): optimal_loci_55594_G1, chr2:20540802..20541906, Cluster 10
agcttccggcgccgctttgcgtggatggccggccagcggccacattatcggtttggtttattgagcgcgagtaggtcgtcgtggtacggctgcttctgctttcccctgccgggtgagtgtgctccgagtcatagttcggtactagacgataagcgggttgatttgacacccgatctgaaatccgaactgagtttttttccctctctcttatatagaccaatgccgttgatgcattatcgtcacggtgaaacacctgtaggatcagaggaggagtatgattattcaagagatttcccccctgacaaaagatttttttgacggaacgtgtcgctgccgtgccggagcaccggtcttccggaagcaaaagcgaagcgcccgggccttttgttgtgtaattgtgttgcaggaagggcgcacgtgacggatggagacgtgttggtgcctcggatagggcatgccgcacacatgggggcaagtccgtgcgcgtgtgagtcgggcgctgttccgtggaaacaggtggtgtgccctcctgccgcgaggcccgccgcccgcgggccacacgagaggcacggaggcggacacggctctcgaaggcgacggcgcgcgccaacgcggcaacacgtgggatgaacggcccgggctgctccgggaacggaggagctgcctcgtcggttaaacgcaacgcgtcagcgcatggccgtccggcacgccggcgacgtgttcgactgctgccgcgcgaagtgctcccatcagactatcagaggaggatttctggtcggtcagcggcccagcgccacgcagcgagcatcagttgtttaccacagcagatgatatatgttgtgcacatgcttcgtgagctttcgcgacactgttggtcggccgtgagcctgtcacacgaaacgggtcggctgcactggctgcggctctccgcagcagcgagctggttcagccgatcagtattacatggatgttgtctaaggcctaaattaaaggatacggagtagatcggtgggatttgagacaaaactttagctatggaaagagactagtgaagagcgaggtccatgtgtttgatctgagtaagcatatcttgtgtttctgcgtt

SEQ ID NO: 1765 - DNA, 1157 bp, Zea mays
  misc_feature (1)..(100): optimal_loci_55852_G1, chr2:21797636..21798792, Cluster 10
acaccacaagggcaaagtcgtccttgcagggatcggactaaacgcaaactgcatgactccgtcccatgatccgctgtcgtcgggcacgcgcaagcacacgcatatgcgggctggagcgcgagagcgagaggtacatacacactaacacacacgcacagtgcattatcacaacccatgcatcactagtcgctaccccccacaagcggagtaataacacgcatcagtccggtggccatacatccaacgacaattccggcccgtaattaattaacgtaaaccctaaacagtccgcgaccgaacggcgaacggggcgcggcccgattcgctggctgctatcagcagccgcgcggttcggtggggtggcgtggcgtgcgcacgacggagacggagccacggagggtgcagacggcgccttcctctagtagtaggccaggaaggccacagctatactgtacgagattctgcaccgcagttgcacgccactgttcgggccgggcgtcaccggagtgctctctgttgtttgtgcgtgcgaggcgggggcggctggtggtgcagtggtgctgtgttcggccgcctcgatgcgtcggccacatgcgcgtcgccggtttcgctcgcgtcctcggtcatcctcgtcatcctttttttttaataattgtatgcgcatgaaacagctgtgctaactgctagaggatgttagcgctgtactgctattagcgtggcgtaccaacctgacagcagagcggcgttcaaatttcttacagacagacatgcatgcatctcctctgaatagtcgttgctgttgccatcgaataggaggaaagtactgaccattaggtgtaagtatggagctagtatattattatctcgttttcttcagtagtataggccaaacatagggaatcgcctctgtacgtagacgtagcgagtatcttccttgtctggctggcaacaaaaataatggtcccatgcggatgagtgagaacgggcacgggctctggaagatgtaacttgcaagtctcagtttaatgggagtggaccagcatcacccataacaagctaatattcggttgcttaatccgtcaccgcgtcaacttgcttccattgagctttgatgatacatctgtttctacgacacgcaccccagaagcagcatccgg

SEQ ID NO: 1766 - DNA, 1159 bp, Zea mays
  misc_feature (1)..(100): optimal_loci_55913_G1, chr2:22039408..22040566, Cluster 10
cgctaatgattgtgaggcctgcactcgcagtcgcaggggaagtaataagcagctgccgcgctttctgatggcacccatccatcattccaacgcccacatgggcgggacggagacggacggtggtgacagcaagcatgagaggagcgctgtccgccgcactgggcggtggtgcgcgtacggtgctcgctagctttcacgttcctgaccttcctcgctcgacctcgagtgcttggttagctacctccgttgcagctcacctcgcaattaatctccctctgcttggtggcttcagctagcctgctgcaggttgctgcatgggtgagtgagtcagtgccaaccgaaatgaactgcatcgtcgtctgagctagaatttacgtacattctttgctagacatcggaggtagtacggctagacgggcgatggaaatgagccgagagagtgccgttccgacgtcactcacgtcactcgtcgatcgggagtgcatccatcggcggtgttgcagttgctcgcagcacatgggccatgacgttctgttctccagcgtatctttcggcagatgtcatgtcatgtagaactacgagtccagaagaatagcagcggggagccgggagactgtttggcaggctgggttcaatggttggagaatctggaagcgtgcgatgtcgttcccgttttaggaaagagctgctcgtgctgggtgcatagcataattgagagcctcctctctctctctctctctctctcccccccccccccctgcatgtgacggacacggaccacacagtgggcactagctagggcctgcggtgcgacccactacgacgagtcgtcgcagctcagcggccagcgcatgcaggagggctcaataattcagcgcagcggcgtccaccgtgttgcgccgcttctttatttgcacgtctaaatccactcgttcggtgggtggtcgtaacgaaaggcggtccgacaggtgtctcctccagcaacgatagagaggacagtggagtatgcaggaggagaattcacgggcccaacaatacactacaataaaattaagcaagctagtagaaaactagtattacacataatttaaattctatgacaatatataatataagttcaaaaggaaaactatatgagtaatccaaaccgtataccttt

SEQ ID NO: 1767 - DNA, 1150 bp, Zea mays
  misc_feature (1)..(100): optimal_loci_56939_G1, chr2:28045808..28046957, Cluster 10
aaagtttagtcatttttagtatctaaagaagcaaacatggtgactaaactgggatgactaaattttagttttttagtcaccaaggacttaactcctaagtatgggattggacaaggctatgaagaagaccaagtgaacaacatctgaagaaaagggctaggaactgtgttgaagaccacggaagatagataaggaccgagcgagcggatcgaacttggcgcatgaaggttcacgattgctggagacgatgatgaagcgggtaggactagagccgagccgagccgcatttccgttgacaggagagggacatggctctgtccgttttagcccgcttttgggtgcaggattgttatagtaagataagattaacagcgacatggatgccaatatatagttggcagtggtgctaatcccaaatcggtaaacctacagtatacaccaatgtattgcctcaagccaaggggtggtcgtaggtagcacgtagcagtagcacagtggcggggccggtcgtcgaccgacgttacgaaagctgctccggtaccggcagccaggcaaagcatgcaagccggaaaacctgaccgaccgaccggggccgggcacgagcgcacgcaccaacccaaccgcgcgctgaagagtgaagacttcgcccgatcgagactagagcacgcggcacctaccgccggcggctgcatcgcgcgccaaccggcctcggcatcgactccatcgaccatcatcccgcaaccgcatgtgtgtttggtgggagttgtggatgcgcggcgtgccaagcgcccaagccagccatcccaagtaataagtgcccaaccatcccactaccactcactactcaaccagccaaccaaccaagcccccggccggcatacacatcgacgtgacgtacgccgccgccggctgcggtaggtaccgcacacccccgccgcgcgggagaactcatggaccggcggcgatcttgacacatggaccatgcatgcgcttgttgcatggtgatgtagaggcggccgtctccaggacagatttccatgtcgtgtctgctaacgcggtgtacgtggcgctgtcttgcgatggcggtgtacgtggcgtcatttgctgcatgtattgttggattggacatccttgtaaacctggaaggagg

SEQ ID NO: 1768 - DNA, 1111 bp, Zea mays
  misc_feature (1)..(100): optimal_loci_58137_G1, chr2:35322345..35323455, Cluster 10
atcgtcacccagttgccttgtagggaaggcaacggcacaagagaaggcgcgccatccctttttccaagaatatctaaaaaacaaaattacctacatataatagtacagttttcaatcttaataacctacaaatcatgataataaacgccctccccaatcgcgtcacaagcggacaaatctcgtccatgcatgtattggtttcttggtttccaaggtagttttctgtttggtaaaaaaaaaattaaataacacatatactgcttaaaaaatcatgaacaattcattttgaataacaaaaaagagaagcggagcgccgctctatctactcacggcacactccggcgtctgtcggacgcgtaccggcgtacgtgcacgggagtggcgtcaccgttgcctttggacggtagcagggcgcgcggcatccgagtcttcgagttcgaggtacgtcaaggagcggtgtacgcaggcagtagccgagacgaccccatctgacgcccgggggacggccgacggcgacgagacctggagaatgatccagcctagatgctccgttccgagttggctactgctacgttaaaaaagtattggtattgtacatactccgtaggtacgtacacgcatgcatgcatgcctgtcacacttcaacctttctagctagtgctcgatctgttgctaaatggtttgtgcattcctaccagagctggagcattttattgttgaagctcctaatcaagttaacgatccgtttgcgcgtggttatacattgtactactgtcgatatatccatccgtttcggttgtactgaagcaaggacgtagtacgtacctcaagtactgactgggaagaaccgtcaactgaaactattgcaggcgcatgagagatgagagcgacgagagttgagagcaacaggtgacacaggtcccggcgtgcacgcaccagtcccctggcatcgtatagtaggcggcgtccacgcagaggattgccacctttattccacaaatccgtggcaagcaggcaggcaggccggccgtgcgcgcagggacgccgaatcggccggagtggagtcacggcatgggatacggcggagtccgggtaggcgatagaggatata

SEQ ID NO: 1769 - DNA, 1114 bp, Zea mays
  misc_feature (1)..(100): optimal_loci_58378_G1, chr2:36829225..36830338, Cluster 10
ttggcacacgtgcgtatgattctatccactatcacgcttttattccgctatgttaccatcccgtcgtaacgatctatgattctctacttgtattttatctagattgaacgtggtggatatactagtacgtagcataacatgtttttttttgaaaacattattacgaaactctcgagggatggtaaactttcggtggcaagtcccaataatataatgacgcatcaatcagctatagttaggcggcatggatcgatcctttatacatgtagagaaaattggcacccaaccgatcaacatacaatactgtccgtccatggtgtgtgaacagttatgattggcttgttccaacaagttcagcggctctgcatgtggttggtggctactagaggagctcatcatccgtcgtcctggctcctgctgggctgggcagactggtgcacgtacgtacgtacgtgtgcagggcattgttaaaccgggccggggcgctcttttttgtcgtggtgcatgcctcggaatcccgccgctatttgccaaaaggcatctccgtccgtcgcactcccgccgtgcagtgacacgcaggctgctcccggcgcaccgcgcacatgccgcttgcgtgccgacgatcttggctgctggtcctttgcctactagctagctgcatgcccgtgcgtgcgtgcatgccaatggtgttactcgggtgactgttgcgccatgtgatgcatgcccacgcctagtctgcggcgcccaagtgaaaggaaaaaaaagatttcaagtgaaagtacgctttggttttggttaggcgccgcggtcgatcgtccacatgcatgaatgaatgcatgggtttggttggtgaacgtgctacagtacgctgtcctttggctgtggtgccacttgtttcacccatcatctgcgagagcagtaatatgtttttggtaacgaacaagatacaaatgctttggaatttaggtattgtcatgttcaactaaattttaaaaaaataccacatcattgttgagatgatatatatatctgcacaaataaaatattactgtactctcaatgatagcacacatatatcagaaaatatattgaacttaacaaatttaaagaataa

SEQ ID NO: 1770 - DNA, 1202 bp, Zea mays
  misc_feature (1)..(100): optimal_loci_59828_G1, chr2:45198615..45199816, Cluster 10
cgcgtgcgtgcaccgtgcagtgcatgtgttgtttccgcttcttctgcacgcggtgagcgatcgagatacaatgcagtaagtgggcctcgacgctgacgggcggcgcccgctgcccgctagcgcgttgaccacccgtcgtccaccaacctcctgccctgcccagcccagctcccgatcgcttcttctttcggcgcgtggggaggccgggttagcttagccccggtcgcgcgcacggccgtcaaagccgtgtaccggaccgatcgggcgggcctgtcaacctgtctgattacacttgatcaggattcagagttgagataaaaggaggccgcgcgcgcgctaaaagaaacgaaagagagagcggccgagaaagggaagctaaaagaagaaaagcccgagcatctcctccatgcatgcacgagtatacatacaatggcaggatctacacaggatcatcggatcaccggaatggacagcccttttgccaaaagcttctggccctctcgcccaaagctttgcttggccctgctggactggtccccctcccggtcccggtcccggtcacgtagggtcccccccccacccccaccccgcgcccacatgcactgatctgcttcgtctttcctgaccgtggacggcagcattattctcttgttgagcaacctggacgcgcattgcctgctgctacttgtgcatgcgtgcgtgcgtgcgagcgaatccccgtgtcgtgtataaaaagcgaggagtacatatatctgctgttcgttgctacctacacctactacggtgctgtgtgctggagattcgccatgcatgcttgggtttctttacctagctataactaagctactctggaatattcacacgttggtgaatagtgggcgagtaatagaatgttccggggtttcgttcgactgtcgtggtccagattttttttagatgtggactgatggattagcttaggaggctgttgtcttgtctagctatagctatagagcttagtctctgcctctttggtggcgcatcgcctttcctctgttttaagggctcaatggattttgccaaactagccctgacaacatcatttttgtaaggaattttcattcattttttttgggaaaaatgaaatttattagaaaaatggaattaccaaagtagtccagtccctgaggggccgggggaaatactattttccatacaaggat

SEQ ID NO: 1771 - DNA, 1325 bp, Zea mays
  misc_feature (1)..(100): optimal_loci_60387_G1, chr2:48417288..48418612, Cluster 10
gctcgcaaccagaaaaaccgccagctaataataatcgtacgtaggagtacttcccgtttggtttccctcgtgctcgtgcatcacgccgtacaccacacctcctccctgcggctgcgtgtgacccgactctgacgcacgcacgcacgcacggcagaatgattctccggtcgaccggccagtccaatcatcaccacgccaacacatgaatcccgcccggttgccggggtcatcgcttcattctcttgattaataataataatacgagtccgaggatgatggatggattgattgaggccaacagtacatgggttcagcaagagcaactcccttttcagtttagaggaaagggaaaagaaagaagaagaaaaacaagtgcgcgcgtcatcggcctggcctgcggcctcctcacgtccacagctccgtctccccagtccccctcatgccccgtacgtcatccgtgtgtgacgcgcgaggaaacggaaccagcgaccgccgggcgccggtacccgttcgttctgagccgctcttctctacttgccttgtcaatactacttacgtcaaataactgccacataaatagagtgtagagatatatacacgcttcttcttttcttttgagggcattgcacaacggtcaccctccctgcatcgacgagtcattgttggcagttcctcacgctgcacggcatgccaccccccccccccccccccccccccacacacacacacacacacacacacatcggttgcgtctggtgtttttttggctcaaacacatacaaacaagttcgaccctatcctgtgctttctagcgacctaaaaagctccctgccattctttttttcgttccgttcctaaaccagttttttttaagtataggtagcagaatgagtagatggatatttaactggaccactaactatctatgaatgaataaacagacgaaaaaaagataccccaatgcatcatccagctttttttcgcgtcagtgggcggcacctgcgaccttcgcctgcccctgccgaacctaagcgttttgagagtaggctaatgattctggctgccgggagtgccgacgaggtgggaggcaaggcaaggcaaggtcgaccacgaccaccgccctctgcatgcatgacgcagcggcgaaccgcgagcagcctggctgccatgatgagccctcgccgcgcgccgcttcgatctcttcctctttccacggctgcgaacgagctctgggcactgacggcgtgtcgccgccagcgacagcggcagcggccagtagtacaatccatttgctcgacgcaagtttcggcacaacaccaaacaac

SEQ ID NO: 1772 - DNA, 1032 bp, Zea mays
  misc_feature (1)..(100): optimal_loci_62347_G1, chr2:58762231..58763262, Cluster 10
gccggcacacggcaaccacaaggtgcacatggagatggagttgacaatgctaggctgagtgcatcaatggtgttgatggcaggagagggggagggagagggagaaaaggtattatttttctattcttatggtggttagtaaacttgtggatatacgttgttataaactagtattttatagatgaactatacaatgttattcagttaaattatatatagaatatttaaatgactatagactgcttttggagcaagcaatttccactctctgcctcgcctggtggttccgagttccgacgacatcgcccatatccagagttccagacacacgcggctgtcgtactctgctgtatacactgcacgtctgcacggctccgaggactatatattggcacttgctacgattgatgatagaagaccgcaggcacttcgttattactactactacagatacatacaccgacagcgcagagagccggcagtaatagactaatagttgcgctgaaatcacacctctttcttgattggctgtatatgacccggccggcctgctgatttcaacgctgctgaatgctgacactgtgcacatacagatacagctgcacgacgtacgcgcgatagatcctgcacataatgtgcggacactgttccgaattttctcgcctcactgtgcttgcatgaaaatatggttggcagagtacgtaggagaggccggtgctagctagctagctagctagcattgaatcgtcgatgatagccaccttgacaattttctgaagttgcaagtagcagcccatctatctatctatctatgctactatatatgacaacgacagatgatagcgacggtgtgtatacggaccaggagttgttgtttagctagcctgcgtacaagcaaaggtttaaagcaactatatagtccgctgctggtatgttgtaatggcgggtatgcacttagctttgttcgtggtaaactggtttggtcatgattaggaagaactgagaagaggccccatgtcgactgctacgtgta

SEQ ID NO: 1773 - DNA, 1144 bp, Zea mays
  misc_feature (1)..(100): optimal_loci_62707_G1, chr2:60878805..60879948, Cluster 10
cacctccattcttttaccattcgcgatggaccgtagcgtccgggccatatatacttctgcattccacacgcgtgttgtactctcgtagaacaccaagacgagcagtggggtcagccatttaccacagcgctgtccatcgccccggcccggcccccgtcgtccgtccccggagagcccagtcggtgcgcttgtcctcgtgctcttgacggctcgtacaccagccggtccatccgtttggcacgggccttgtcagtcgtcatccttgacaccccggcgcgcggacgcggacgcggacggggccggccggcggggcacgtcggacggcgggaccatccaccacccacatcagacacgccgcggcacagatcgtggatcggcgctagcaacaccaacacggtccacgcaagtaatgccgctgctcagctcatcagtgtcgcgcgcgccaagccaacgtacgtactacacgcggtacgtacgcggtacgccccacctgccctgccacaccgccgtgcaggtgtgtggagccgtgcgctagctactgcgcggtgatcccacacacacgtcacgcgccccccgcgcattaacagcgcgcaacgggaagagcgtgactgtactgaccaccaacaggcggtaatggccggccggtcctccgcctccgatccggcgatccgccagcgcatgtgtcgccatgcaccgccggccgctgctgcgcctgcgcgcgccgtcggccccgcgctgcatgccggacaggcccccctcccatcggatcggacggaatcgagtcagcagggctcgggcgggaccatcgacagtgacaaacatgcattgatgcatggtcgatcgatgggtgaaacgctgaaactaactgctccaacagcaattgcatacagtggacgcgagttaagccgcgtacgggtgtacgtagtaggtctgtttccctgcccccacggccaccggacgggcgcccatgcacgcatgcatgcacgaagagagctgctgttgtgttcattcagcatctcaacgagaccacagatcgaccatctttgtcatgtgtttgtgctcgtacgctgtcgactcaggcgggtccgccggacggccggtcgcgatctcgcccataatgcagcgcgatcgcgctatgcggtgt

SEQ ID NO: 1774 - DNA, 1042 bp, Zea mays
  misc_feature (1)..(100): optimal_loci_6276_G1, chr1:32096951..32097992, Cluster 10
tcgagtgagttggatagtctgcagtagcaccaaatgtgtttgatgcttcgccagatacaacatcagatatgttgtgtattgtgtagttttagccttgaactggcatgtctagtgtgcaccaggtatggtacatcagacagggcacctaaagggcttgcataagtgtttccagatagtttacactcatcgatgtgtttggtgtaccaccaaacgtggcattgaaaggcacacctagatagcatgtaaattgtgcaggttagctaagtacacttgacatatctagtgtgccattggacttagcaccagacatgtactcatacagaatgtaatatatgcatcagaaaacctagtggcaccaggtaacttaacattagagcgccccaaataaattaactacacaaagttttataagaagctaataagagtctcgaggccaatcgagccttggcatgctttaaagatcagggccttagtgccctagggcgtcctaggctatgatagtctaagtactcgaggactcttatgccatggggcactgatgaataattcaagcctttggggccctcgtcccttgggacactattaatggttcaagtgctcgaggccgtttggcccctagagcgctcaatggcacttatatactaggggctctcttttggctccaaggtcccaaaggcccccaacttcatattatgatgacggttgggccttgaaccctttggggcccaaagcctcgtggggacaatgaactttatgccattaagtgtaagcctgtctcaagactaaaggatgtgcctaggcctatcgagggtagtacaactccaaggttggggccccacatctaaacattgatgacaattctattacgttagattattggataagtattaggtacaaaaaactaatgcatggtatgtgacattataggtatgacaagcgtagtattgctacaacttaggccataggacactcgaaaccactatatgctatgtgcatcgattttgtagccatgtgcacacacacgaacatactaggacgtatt

SEQ ID NO: 1775 - DNA, 1363 bp, Zea mays
  misc_feature (1)..(100): optimal_loci_6510_G1, chr1:33427017..33428379, Cluster 10
aacgatagggaagcgttgcctacgtgtggcaaaagaaccggccagcgaagtagatacatacacccacccgcctgcgagacgacgacgcacgtcgtccctcgtgtttgaaaattattccggtatgagccgttctagcatttagcgagcacagactgcgccgcgctgctcgcaacaacaggaaactggttgccggcttgccgcacacatggctcttgctatgttttggctgcaatgatcggcggccacaagggcaaaacaaaagggtggcattgggcattggccggccgtgcaccacctaacgatataattctgccgcctctcgctccttctcataagatttcaaccatttaagtgcaaccgcgaccggacctatatagctaatcgtaggaattgaacgaacttgaccagcagtagtccaaataattgcgcgcgggacctacggacgggagtgcgctgcactcttcttcttcttcctcgctggccccctctcactaccatgtccgtctcgtctccattctccggaggagctagcgtagcatagctgttggattggatcaatcgtatccaggctctgggccgcttcaatgcatgccgggccatgctggctacctgtccaaacgaaacgggataacgggaccgcgagcccgctgtcagcgcgaggcgcggccaaccggagctcgcgggaagcccgacggtgcacgagggcggctttgccgggatgccgaatagtttggctgggtgggggtggggtggggagagcagaggaatggtgcgcccgcggcccggccgccgatgcagtatgcaccgcctggcgaattcaagtgggtacagctgagctactgcgttgtcactgccggtgctgcagctccaaaggacgcggtcagtaatggccactgcgcttcagctgcacttctaggtcttgccgccagcttgatgggacggtgcaggtacggtccatacgcccctgtgccaccctcgtatagtaagtagtactccgttattagggtgatgtactggtgtgtgacatactggcagtactacgaacgattaatatataaaatatatactattaaattttatgatgatctaatgatcccacgtcgaattaaacagtccacatatgatacgacaataaacaataaatatattttttaaaacaaaatagtgatttaattttcacacgaattggaaagcaaaaaaccaaaacaaaggatccaggtaaagcacagctataaacagaaatccaaaatataaataacttatgaaaaaaatggaagttcgatcattgcataataaccctagagtatattaagtatcagaaagatagagttaggagagagcacgtcgtaagttggtgattgtg

SEQ ID NO: 1776 - DNA, 1353 bp, Zea mays
  misc_feature (1)..(100): optimal_loci_7692_G1, chr1:40227717..40229069, Cluster 10
cgttgcccatcgttatcgcgacgatcggggctcgagtacgagtagtgatgcaaacggtaatcggggaccagggtattgttttcgagattttaccatgtttcttgacaaatagaaacggtagccataaaaataaaaaaaaaagttacggataaaatatagttgaacaacccaacagttgaacattaaaaccccataggtcaatcaagttggcaagtcgttaaacctcaagcccaaacgagcacacaaaaccagaaaacccccacctgctgtgttgtcgcctaaaacgaacgtctgtggctggacgatccaatccaacaggcatggacgagcttggcgcctagctattcgcctaacctaacccgaggtagctgtccctctcccgctctagctgtgcctgtggacggccaccgtcgccatccgtccccaacgcagccggaaccacttctccagctcgactgctctcgacagacgatgggccccttccctacctagccttgccttggacttgacagcatcgtacgtgacgctccactctttcccctcgcgccgcatgcacgtttcgtttcctccgctccgcagtaaaaccgtcgccgtcataaaaaaagcgagaggaggagacagaagaagacgctgacgcacggctaaatctagcaaattcggcagtgatcagtcggctgaggcgcctgaaatttaacagattctacttggtgacaggtcgtgacacatcggaaggcaaaacatcagagagcagtgttccagtcgtctacagtacgaacagcatccccgcctgaaacagtcgaaaaacaggaggtcagaacaaaatcagcttgattaacagcatggaccgcccgcgtcgagcacgttgcctgttccgcttggcccatggatggatcacgaggcgaactagccctgaagcgcaacacgggacagcgcggcgcacgagcggacgcggctggcaacgacacatgacgctcatctcatgacgcgaagggcacttggtgtaccaccgacaccgactgcccccccccccccgccccgcccgtctcgttcctaacctacctgggcgtgggcatattcctggcaacgcctaccatccccttttttttgttcactgggttgcgttgggttggcacgtgtgctgcgctggcccggcacgagtccacctcgcgcttcttccgtttggcgaggagatgcatcagggatatgataatagagagagagagagagggagagagagagctcaggccacggcggggaccagcttagccggagcttagtttggaagaaattggagagaaaatttttgaatgccacatgcgtccatgtgtacttggaggcgacaaattattagct

SEQ ID NO: 1777 - DNA, 1087 bp, Zea mays
  misc_feature (1)..(100): optimal_loci_7953_G1, chr1:41279823..41280909, Cluster 10
agcggcgatcgcgatgcttgcttattggcgcggccgctagttgtcgtcccctgtcacacaacgctggctggataattttgtctgcaaaccttttgccgtcgattagaacaagtatactagctagctacctgttcttccatcctgccatatatggtggctttacctaaaatcttttgctttaatctgggcggtcgctttcgtcctccattggttggcttttgtgccctatgctgtacctgtacgggcaagcgtccgggtgctgacgtgttgtcctcccaccccacccccacctccgtcctccgaaggtgaaataagtaatattttgctgacgcgaccggtatactgcttatcaagcgctgcggtgcttgtagcgacgacgacaatcccagcgcctgttgattacaggaagtatagttggaaaatccatccagtagatttggatcttgttttagcgttgtcggcatatccactcaaaaaccattttaaagcaatgtgactagtataaactaataagttcttgggaggataataagcaggagatgatggcctcgacgacagcgattgcgtgatttgcgaagtggcagcttggccccgtcccgccgcagtatctgcgtctcgtcgtttcgataagtggcctctcgcccctcccaaaggccgcccatctgcgagttcgtctgctcccaaaggaagagcagggccctattattgcagctggtccacgaaagagaacggtggctgggactgggagcaggagggagagaggttgggggtttgataagccaggtcgcgggacgttttcacgtcgtgcctgccgtgcttattggccagcgggtgtcgcttatgagataacgctacttttttttggccctggccgggatcttcactgtggataacccgtcctgtgacctcctctatcttgacatctcatggtcttcctcgtgctttagactttgaaagctaaggctcaaggaccaagagaggcgtgctgtgggcgattgattgcttgctgctgctggttacccctgtactgcgtgcgtgccacaacgatttgtgacggagagttttcgctaccgttgaatcatggtac

SEQ ID NO: 1778 - DNA, 1301 bp, Zea mays
  misc_feature (1)..(100): optimal_loci_8113_G1, chr1:42159989..42161289, Cluster 10
gtcgccctagctcctgctgtagctgtttattgcaactaaactaaccgtaggctgccgaaaacttcaacagcacacatatgcttgcaatcagaaattccccgccccgtgcatttctcccaaccgaacacaattcttccgcatgatgaactcatgattcattggcgatgcgtgcagcatgaactcacgattcatgcgtgtactacgtgtgtgtgtttatagcattacagtagtacataatgcatgcgatcacactgatcatataggacatgtgaatgggatacaaattacaatgataataatatataaagccgcaaccgagccttcatcaactaggcttccaataattaattgaaacaacatgtccacaacttactacgcacaaaagatcagagtaaaatatgatgtaagctactatcatctatctattattccggttgttaattaaagcgaaaagggaagtgcttacatcccagcccattgacattagttgtttgcaagaatattaataatactgtacctgctgtgctgctacaccaaaggtcaaacaatacataataatactatctactcgccatgtacatagctaacgcgcgcgcggtgctcttccgcgccacgtatatatatatacgcgtattcgttctctgtacgacgagagggtttgttgataggagttgaagactagagattcggtccttgactgcaacagcaacagcaacagcaacagcatccagatcgagcagccattcaatgtgctttgtagatccagacgacttgttcagaagcagtgctagactgctagatagtagatgtgtggcgtgtgtgtgtggacagcgttgcagagaagagcaagtttgagtacgcacgcgatgacgcgtttctaacagacgtggctaattaattattctgtatatgcaaaggccaagctcaagctgctcatgacgtacctgaccgaattattaggcagttgggatttcccaaaatatgactctagcgtgcgtatttgacaaatttcttttgcatgcatgaccccatgcactgaacccagcgctacgcccgcagccgtgatcgagctcgtcatgcttcaatcataatagcagccggccaaacgacgcactgcggctgcctttcattttcgccgctgctggtcggtaccttgacgcagaggaatagtcgcatttcgcctagcagctgcagcagcctgaaagatgttgaggagtcgcctctatgtgctgtggtggctgcacacagctatctgatgacgacaacagtacgtccttgaactgaataatgatatatctctt

SEQ ID NO: 1779 - DNA, 1046 bp, Zea mays
  misc_feature (1)..(100): optimal_loci_81527_G1, chr2:179460608..179461653, Cluster 10
tgtccctctctttctatctatctattgctctctctctcccgcatgtaccactttggccgtcctctttacaatttggatcacaaaacttaacaggtcctctagtttagctggggtgtgcgtggagatcttgcccaccacaaatacaagtagtgtgatccaaacccaggtccgcatcaccatgaatcaaacctggctatcttggaataatgtgggttgtatttgtatcgtaccgccaatgttttggctgctaaccgatgaggtcgcgctctgcaagttgctagtgtggagcccatgcactggacctggaccccccacacaggcaaacgtacgatcgcaggtggacgctactgtgtcccacgcggttttgggctgtggacactggactgctggaccgcatgcatgggtgggtggaaaggaataggaacggagtcgtcgccgttgctgccagctcatgtgatcgcgatcccctggcgcgcgtgagtgaggcgaatagtcgtcgacggcgacgtctcgacgtgcggaccgattcgtgtgtcgcacgagcacaccgtgcaccgccacgcaccgatcatgccatccgtcacgtggcgtagagtccatatcccgaaacgagcggtccatgcggcgggaccacactctccctagtccgtactacacatctcgtttatcaaaacaaaacaaaacaaaaagttcaaaattataaaaccaaaagtcaaacgcgtgctttgaaacagaagaaaacgacgccaaaaaaaaataccgtgaacatgcatgtatgtcttcaaagttgaaactagtcggttggttcaagtctggatggaggactcgaccagagtgttcgagaccgaaattgctcggtctctgatattgttgcaacgtcgtcgtaagtcgcggtcttttatttctgatgatgatggccagaaatcttgggaaatccagaagcccaaatctagaccttcgttgggacttattagacgtccaccactctcattattgtatacgagtgaggtgtttggtgatatgatgcatcataaatccattatata

SEQ ID NO: 1780 - DNA, 1362 bp, Zea mays
  misc_feature (1)..(100): optimal_loci_82317_G1, chr2:183556440..183557801, Cluster 10
attttaagtcttgttttccaaacatatgagtttttttattacgttttaaaaactagtattatagttttttttaaaaccaagaagctagtcttcacaactaaacttataaactatgtggattcagacaccttttcctagtttcttttttctttctaaaagctggtttctagaaaccagtttttgaaaaatgtaggatggatccaaacacagcaaatctaattgaaactttagtcgctcatcgcaacaggacgagaggattacacatatatatgcccgcaacgacggaatccgcgcaagtgctgcatgcgaaatcttggagctcccaagtcagatgcatgcacgtacgtatattgtttttgtaatcagagtcaattgctcggagtgtaggacccttccaagctttaaaacaaaacacagacggagttgaagagcagactcctcatgcaatgaacttattaggcaaactaaccatgaatgaacgcgtgcgcgtacaataaataatctgcacgcctgcttcgttacacagtccagaagacgacaagcaagcctctgcacatgaacggatgaacctgtcgatggagccttgctttaaattcggaacgcgcacggtgccgactgcatgcccaccactgccagagaaatttttttttcttccattttcctcgtcataggtttctgtattgatttcgccttgctggaccggaactcgggctacaatgaaccagcgggatcgatggacgctacgtacacgtagggattacgagaaaggttggttacacggaagaaacacgcgcggcactcacactcagcagagtccattgcatcggagcagagagagagagagagaatgtcaagtcaagatcgttcgtcccagctgatccatcacccgacggaggacgatctcgccgcggccgctcgatcggctcctgcatgcaggcgggcagtttcttcaccaaaccaaacgcagcacgtcgaccgcgccagccagcggctccaaaaccgcattggagttgggacttgggagacccatcataggtttccagctttcctctgtcagttgccagtttgccacgccatctcggccggacagtttccctctccgtgctctgctcgcagtcgcgcgcgaacgtctctgaccaggaatcccgtcccaaacagagaaaccgagcatgcatgcatcagagaccagggagattaattgcgtgtggctactactgcgtactcgcgtgctacacggcacagactagctacagcctcgccacatgaacagctaccgtttgtgactcatgactaacactaggagcatcctcgtctcttttatcgaaagcgagccttactttgagttttagcacccgttatttc

SEQ ID NO: 1781 - DNA, 1171 bp, Zea mays
  misc_feature (1)..(100): optimal_loci_82430_G1, chr2:184140716..184141886, Cluster 10
caaaatacatcatagtgcaacaaggtatgtccggtggattatacaatggtatggatccaacaattaactacgtcctgtgcaacgtatatacacgggatagatgatcgtaggtagcccaacacgtacgtccggtcgaaaggcgattctctgcctctggttctggctcatcctgcaagttttccatgggctagcttaatcatgggcggaccatgggtcggatccatctgtcaacttcgacttccctgagctgtcgcgggccccggagggctcaagacgtatctgggctcgtttcccaggtcatcaggcacgcgcaccgcgggccgggagaggccggaactgcatgcacatccttgtttttttttatagcacgtcgcggtcgcgcaccagcaacgattgaagaaaaccgcaacgatttgttgctggattccacggcgcttccttctctggatggatcgggtgcgaatgtgccttgtcgtcctcgccgagaaatagaatgcctcgacgaatgggggagctgcctgtcgcggccacgccactccttggtacgtaccggtacctggtagtagcaggcgctagcgtcacgcaaccggaagtcgatactcgtgagagcatccaacgaattcgtctgtgcacgcgtcgcatggcgccaaagtggagcagggccgagcccgagcgcttgcgtttttttgtcggcgggcagcgctctagccgcctagcctctagtacagacaggctacaagtgctgaagtgcagtacaccaggtcatgcgtctgtactgcggcctgctcgcaatgctgtacccgtccaatagggcactagtacgctgccctggctcttgtcgtctgtcacccccaacgctcatgccagatgtcctcctagcttaggttacatttgggtttgacaaattcgctccctgcctggaagttctagatgccgtttccctacggggcgttcgcaacagtcgatatcgacatcgccgccggttgactgcagttcaataaaaaaagaacgcactctctgggttcactaaggctaaattaacacacgcacagtttcctctgcattggtattggttatcagagagaagtggggacttgtaaccatacgtacgctctccctttgaggctctccggctagcgatggtatttctcacccgttttatttcctcaca

SEQ ID NO: 1782 - DNA, 1408 bp, Zea mays
  misc_feature (1)..(100): optimal_loci_83359_G1, chr2:189331715..189333122, Cluster 10
acagacttggtcgacaggtgagtcattttaaaagagaccataggcagatcctttaattgatcggaacacattacataaagatgtagagtaggtgataatataggtacacaaataaacccttttcggcagagatcaacttgggcttcataaaacggttatgcgagagaaactagggggtggagaagctacctttcctttactagacagggtgataatgggcgtcctgtacatggcctaaactattcgtccttgtaatccacgagtaataatcttatcttcggagccgccagcccgccagtttgatggatcctaggaagggccggaacacgctgtacgactgtgtactatgatggaatgagttcctgtcctgtggagagggagagagagcgcttgttttaatgcggcattggccgtccatgcatgacatgctagtgttagcgatctgcagtgcgtctgagtaaaaaaaatcatgatcagacgatttgatgtttcctttggtctgacctgttagagagcacacacatgacacatgggatgggggccatggggcaagcgcaatgtcacagctagagagcacagtgaagcaaaccccgcggtcgcttgtaccaagctttgttgggtcaaaggcaggttcttaaacttgttatcttatcttaggttgttaaacaagaagtaatcaacaagcacgggtcgagatagatgacttcaccaattcaatcatttacagcagcggacataaaatggactctgcctctgtcagcactggaaacacggatacatgcacgaccacctcacgtggtgtcacatgcgcgagcgaagactttgatctttggcgtggtggtggtggtggcatgcatgacggaggtggctttggcttggcctctgaccgctgtgacatggaagtggaaccggatcctcgctaatctgaccgacaatccgaagcccaggccgagtaaacaactgcgagtagtactaagacatacggagtactcctcctaatagatagtatataataatggcttggcctggcctgcactgaattattcagaagcaacctgacgagagggagagccctgcccaaccacaaccactccactcctccccgtgcaaaaagaatccagctcaatgatggaggtttgcccccgcacgagagtgatgatctggacgcaatcaagtgaagattccctcacttaacgcacccctagtaaaatgattagactctctccaaccgatactctaaatatttctctaccttaaaatttagaggatgcggccgtcctatatatctacaacaatatcttctaaacagtcctctaggtatagaggccgtcgttgagtcctctacatgtgtagagcttttctttccccctcttcatccattttaatactacaaacaactgatttaaca

SEQ ID NO: 1783 - DNA, 1017 bp, Zea mays
  misc_feature (1)..(100): optimal_loci_85950_G1, chr2:205776927..205777943, Cluster 10
  modified_base (115)..(115): a, c, g, or t
  misc_feature (115)..(214): n is a, c, g, or t
  modified_base (116)..(116): a, c, g, or t
  modified_base (117)..(117): a, c, g, or t
  modified_base (118)..(118): a, c, g, or t
  modified_base (119)..(119): a, c, g, or t
  modified_base (120)..(120): a, c, g, or t
  modified_base (121)..(121): a, c, g, or t
  modified_base (122)..(122): a, c, g, or t
  modified_base (123)..(123): a, c, g, or t
  modified_base (124)..(124): a, c, g, or t
  modified_base (125)..(125): a, c, g, or t
  modified_base (126)..(126): a, c, g, or t
  modified_base (127)..(127): a, c, g, or t
  modified_base (128)..(128): a, c, g, or t
  modified_base (129)..(129): a, c, g, or t
  modified_base (130)..(130): a, c, g, or t
  modified_base (131)..(131): a, c, g, or t
  modified_base (132)..(132): a, c, g, or t
  modified_base (133)..(133): a, c, g, or t
  modified_base (134)..(134): a, c, g, or t
  modified_base (135)..(135): a, c, g, or t
  modified_base (136)..(136): a, c, g, or t
  modified_base (137)..(137): a, c, g, or t
  modified_base (138)..(138): a, c, g, or t
  modified_base (139)..(139): a, c, g, or t
  modified_base (140)..(140): a, c, g, or t
  modified_base (141)..(141): a, c, g, or t
  modified_base (142)..(142): a, c, g, or t
  modified_base (143)..(143): a, c, g, or t
  modified_base (144)..(144): a, c, g, or t
  modified_base (145)..(145): a, c, g, or t
  modified_base (146)..(146): a, c, g, or t
  modified_base (147)..(147): a, c, g, or t
  modified_base (148)..(148): a, c, g, or t
  modified_base (149)..(149): a, c, g, or t
  modified_base (150)..(150): a, c, g, or t
  modified_base (151)..(151): a, c, g, or t
  modified_base (152)..(152): a, c, g, or t
  modified_base (153)..(153): a, c, g, or t
  modified_base (154)..(154): a, c, g, or t
  modified_base (155)..(155): a, c, g, or t
  modified_base (156)..(156): a, c, g, or t
  modified_base (157)..(157): a, c, g, or t
  modified_base (158)..(158): a, c, g, or t
  modified_base (159)..(159): a, c, g, or t
  modified_base (160)..(160): a, c, g, or t
  modified_base (161)..(161): a, c, g, or t
  modified_base (162)..(162): a, c, g, or t
  modified_base (163)..(163): a, c, g, or t
  modified_base (164)..(164): a, c, g, or t
  modified_base (165)..(165): a, c, g, or t
  modified_base (166)..(166): a, c, g, or t
  modified_base (167)..(167): a, c, g, or t
  modified_base (168)..(168): a, c, g, or t
  modified_base (169)..(169): a, c, g, or t
  modified_base (170)..(170): a, c, g, or t
  modified_base (171)..(171): a, c, g, or t
  modified_base (172)..(172): a, c, g, or t
  modified_base (173)..(173): a, c, g, or t
  modified_base (174)..(174): a, c, g, or t
  modified_base (175)..(175): a, c, g, or t
  modified_base (176)..(176): a, c, g, or t
  modified_base (177)..(177): a, c, g, or t
  modified_base (178)..(178): a, c, g, or t
  modified_base (179)..(179): a, c, g, or t
  modified_base (180)..(180): a, c, g, or t
  modified_base (181)..(181): a, c, g, or t
  modified_base (182)..(182): a, c, g, or t
  modified_base (183)..(183): a, c, g, or t
  modified_base (184)..(184): a, c, g, or t
  modified_base (185)..(185): a, c, g, or t
  modified_base (186)..(186): a, c, g, or t
  modified_base (187)..(187): a, c, g, or t
  modified_base (188)..(188): a, c, g, or t
  modified_base (189)..(189): a, c, g, or t
  modified_base (190)..(190): a, c, g, or t
  modified_base (191)..(191): a, c, g, or t
  modified_base (192)..(192): a, c, g, or t
  modified_base (193)..(193): a, c, g, or t
  modified_base (194)..(194): a, c, g, or t
  modified_base (195)..(195): a, c, g, or t
  modified_base (196)..(196): a, c, g, or t
  modified_base (197)..(197): a, c, g, or t
  modified_base (198)..(198): a, c, g, or t
  modified_base (199)..(199): a, c, g, or t
  modified_base (200)..(200): a, c, g, or t
  modified_base (201)..(201): a, c, g, or t
  modified_base (202)..(202): a, c, g, or t
  modified_base (203)..(203): a, c, g, or t
  modified_base (204)..(204): a, c, g, or t
  modified_base (205)..(205): a, c, g, or t
  modified_base (206)..(206): a, c, g, or t
  modified_base (207)..(207): a, c, g, or t
  modified_base (208)..(208): a, c, g, or t
  modified_base (209)..(209): a, c, g, or t
  modified_base (210)..(210): a, c, g, or t
  modified_base (211)..(211): a, c, g, or t
  modified_base (212)..(212): a, c, g, or t
  modified_base (213)..(213): a, c, g, or t
  modified_base (214)..(214): a, c, g, or t
ttttgttgtactatagaaaatcaaagtaattatacaaatgtaaatacataatgtaaaaataaaaagtaatgtaacaatgtttttcctaaagaacgaatcaagctgatcatcaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttctctgtgtgaacttgtgatcagtgagaccgtgaccgtgaacacgagaatattaacacccccccccctaattaacacatgttaactgtaaaatgaatataagtgaaattttgttcctccgagtaattctaagtattttgaagcgccttcacggtaatcgtgtttttttaggtagctcgacatggaaaaaagatactgtgtctgatatggatccgtgccattcctggcgtctaaagtcgccagcacgacacagcggccggccggacgctgtcggagtcgggcacggcacggcgcgcgcgcgcgagacgcggaccagtcaccagaggcagtggcccgaggagcgcgtcgtggcgtgcgagtgcgcgctgcctgtcgtgtcgccggccgcggactccgctcgtgagaggctccagcagacagctattggaataggcaggcaggtgcgagtggtgctgccgtgctaatgtcttttcagatttgacccttcctcggtgtcttgagcggcggcatcgtttagggaattgaccaatcgtcctgctcacgtacggacacctgcaactctgcacgcgacatttctccgtggttcaaccgtgcaagcaaacaggacagagcatgtcccgaaagattgcggaatatcgctggctgtagatagcactgatgactgctgccgaatcgctggtgagcgacagattggatgggagatccagatcacgcgatgggttgggtacccgtcggtactggtacggtgcctgccgagttgctgtacagcacatttcggccaggtcacatacattccagacta

SEQ ID NO: 1784 - DNA, 1107 bp, Zea mays
  misc_feature (1)..(100): optimal_loci_85987_G1, chr2:206044069..206045175, Cluster 10
taatagattcatgacacaaattagtctgtgcaattagttttgtaataggcagttgctcgtaataattgggaatctgcagctcgctcaggtacgtaccgctcaggtacgtacacgatcggaagagatttgatttgtgtagcactagcaccaacggcccgtcgacaaacgccacaggggggagggatacgagcatctccgaacgcgactggattgggcgacgacccattcgaccaacatcaacatgtcggcaaatacaatgcgtcggacgggtcgcctgagctacacaagaccacaagcggagagcgaccgcacgccaaactgaacgtaaaaagcaagcgccgaaacccagacccagcagcaggtttccgatcgatcagcggcgccgtgatcgatcgagttgtagggttacatgtcctatgcagatgcaggtaatactataacgcaatcccacgtacgacaaacgcatgccacacgtgccgtgtaccgatcggccggtcgccggatcggcaaaagcgagtaagcgacccaatcctgcttcctgcagtgcagagcccgccccaccccacccccggggccgcgaccgcgacagtcaagcgaccgcctgcccgccccggacggcgccaaacgcgcgccatgcggcgggagtggacgacgagcgaagcttcttcggtcgccctccgccgtcccgcgcgcgggcgggcggtgcatgcacctcgccgctggcaggacacacggattcttttcgatcgcccgcaaaggcaaagccccggctggcggggcgtcgcgtcagggggggccagccggcggctcgcgcgcgcgcgccgcggctgcacgtaccgggggcgggccccggccccggccccggccccccaagtctccgctctccagtcgccgaggggcaagccaaccggccgcgcgcgctctgctgtcgcgggttagcacacgtacggtacggacgacgtggtcgcgctcgggccgccaacggcgaaaccgaccgccgtggagaaaaggcgcgcctgcttaatcgcattgggttgggttgcatcaacgcgtgttttggtgggaggataagctggtttacagctgcggatgatggcaactcatgtt

SEQ ID NO: 1785 - DNA, 1244 bp, Zea mays
  misc_feature (1)..(100): optimal_loci_87548_G1, chr2:213811149..213812392, Cluster 10
gataccctgcttcggatcggagcagctcttggtgtccgccccatgcgcccgcgcgcgtgcccgggctgccgccgaccgccgctacttcgccgacatgctgcgtccccgcgcgagagctcgtgtgattgtgcttgtgctgtgccgacgtctcaacgcgtttcaatccccgaactaaccgatccttgcttcgattttaattcttttcgatttgaaccaaagaagaagaaaaaggttcagggattaaaaaaaagagtaccaagtgtccggttgcgtatcgttggtgtcaatcaaagcggagcaagcgaaccccaaaccttgaagcggagaaaatgcgtccgaattgaatagtcggcgactcggcaaagaggaccagaccagcgctggacggcggcagaaaaaaaaggaaagcgtggccgcacgatcgggacgcgctcccccgctgtcccttttgacgcgattttcctctgttctgttctcatatagtcatatcatatccggcgcccactggttcttctttttcgcgatcagtacactcggtggcctgatttcaaatcgccgtcggctatctcaatttgcgggcggtagcgagaagccacagagctcggccacacggttttgttcgccgcagcgcatcccgcggggtgccagtccgctttcaacgcctccgactcggccactccccacggtcccacccacagtttggcagcaagcgtttcgagcttcgaagccaatgtctcccgttccctccatatttaaacgcgcgcctcgggcggggcaccgggccgcgggctgaccggcgggtggggccaggaatcgaagggcgtcgtaggaccccacttggcagtgagagacggtgtccgggcatggatgatcacggccaatgaatgggttcggtccgcttcgggcttgtcaaaccggccgcactgcaagatcctcctgctgcctgctcggaacgaagccgctagccgcaggccacagagcacaagcagactgaccagcgctcgtagaattgcaaaacttactgaatgcagcattgtactagtgaagttttggaggatttttttacgtgaggtctaaccaattggaaatttttctatagaattgaaggtcccatactcccatacaactctattcctattttttttctattactatattttactaatcctatattccaaaggagacctgaatatttttattgttggttatagatgatattgcaaggagttaagctctattattaa

SEQ ID NO: 1786 - DNA, 1006 bp, Zea mays
  misc_feature (1)..(100): optimal_loci_91074_G1, chr2:231206222..231207227, Cluster 10
  modified_base (879)..(879): a, c, g, or t
  misc_feature (879)..(978): n is a, c, g, or t
  modified_base (880)..(880): a, c, g, or t
  modified_base (881)..(881): a, c, g, or t
  modified_base (882)..(882): a, c, g, or t
  modified_base (883)..(883): a, c, g, or t
  modified_base (884)..(884): a, c, g, or t
  modified_base (885)..(885): a, c, g, or t
  modified_base (886)..(886): a, c, g, or t
  modified_base (887)..(887): a, c, g, or t
  modified_base (888)..(888): a, c, g, or t
  modified_base (889)..(889): a, c, g, or t
  modified_base (890)..(890): a, c, g, or t
  modified_base (891)..(891): a, c, g, or t
  modified_base (892)..(892): a, c, g, or t
  modified_base (893)..(893): a, c, g, or t
  modified_base (894)..(894): a, c, g, or t
  modified_base (895)..(895): a, c, g, or t
  modified_base (896)..(896): a, c, g, or t
  modified_base (897)..(897): a, c, g, or t
  modified_base (898)..(898): a, c, g, or t
  modified_base (899)..(899): a, c, g, or t
  modified_base (900)..(900): a, c, g, or t
  modified_base (901)..(901): a, c, g, or t
  modified_base (902)..(902): a, c, g, or t
  modified_base (903)..(903): a, c, g, or t
  modified_base (904)..(904): a, c, g, or t
  modified_base (905)..(905): a, c, g, or t
  modified_base (906)..(906): a, c, g, or t
  modified_base (907)..(907): a, c, g, or t
  modified_base (908)..(908): a, c, g, or t
  modified_base (909)..(909): a, c, g, or t
  modified_base (910)..(910): a, c, g, or t
  modified_base (911)..(911): a, c, g, or t
  modified_base (912)..(912): a, c, g, or t
  modified_base (913)..(913): a, c, g, or t
  modified_base (914)..(914): a, c, g, or t
  modified_base (915)..(915): a, c, g, or t
  modified_base (916)..(916): a, c, g, or t
  modified_base (917)..(917): a, c, g, or t
  modified_base (918)..(918): a, c, g, or t
  modified_base (919)..(919): a, c, g, or t
  modified_base (920)..(920): a, c, g, or t
  modified_base (921)..(921): a, c, g, or t
  modified_base (922)..(922): a, c, g, or t
  modified_base (923)..(923): a, c, g, or t
  modified_base (924)..(924): a, c, g, or t
  modified_base (925)..(925): a, c, g, or t
  modified_base (926)..(926): a, c, g, or t
  modified_base (927)..(927): a, c, g, or t
  modified_base (928)..(928): a, c, g, or t
  modified_base (929)..(929): a, c, g, or t
  modified_base (930)..(930): a, c, g, or t
  modified_base (931)..(931): a, c, g, or t
  modified_base (932)..(932): a, c, g, or t
  modified_base (933)..(933): a, c, g, or t
  modified_base (934)..(934): a, c, g, or t
  modified_base (935)..(935): a, c, g, or t
  modified_base (936)..(936): a, c, g, or t
  modified_base (937)..(937): a, c, g, or t
  modified_base (938)..(938): a, c, g, or t
  modified_base (939)..(939): a, c, g, or t
  modified_base (940)..(940): a, c, g, or t
  modified_base (941)..(941): a, c, g, or t
  modified_base (942)..(942): a, c, g, or t
  modified_base (943)..(943): a, c, g, or t
  modified_base (944)..(944): a, c, g, or t
  modified_base (945)..(945): a, c, g, or t
  modified_base (946)..(946): a, c, g, or t
  modified_base (947)..(947): a, c, g, or t
  modified_base (948)..(948): a, c, g, or t
  modified_base (949)..(949): a, c, g, or t
  modified_base (950)..(950): a, c, g, or t
  modified_base (951)..(951): a, c, g, or t
  modified_base (952)..(952): a, c, g, or t
  modified_base (953)..(953): a, c, g, or t
  modified_base (954)..(954): a, c, g, or t
  modified_base (955)..(955): a, c, g, or t
  modified_base (956)..(956): a, c, g, or t
  modified_base (957)..(957): a, c, g, or t
  modified_base (958)..(958): a, c, g, or t
  modified_base (959)..(959): a, c, g, or t
  modified_base (960)..(960): a, c, g, or t
  modified_base (961)..(961): a, c, g, or t
  modified_base (962)..(962): a, c, g, or t
  modified_base (963)..(963): a, c, g, or t
  modified_base (964)..(964): a, c, g, or t
  modified_base (965)..(965): a, c, g, or t
  modified_base (966)..(966): a, c, g, or t
  modified_base (967)..(967): a, c, g, or t
  modified_base (968)..(968): a, c, g, or t
  modified_base (969)..(969): a, c, g, or t
  modified_base (970)..(970): a, c, g, or t
  modified_base (971)..(971): a, c, g, or t
  modified_base (972)..(972): a, c, g, or t
  modified_base (973)..(973): a, c, g, or t
  modified_base (974)..(974): a, c, g, or t
  modified_base (975)..(975): a, c, g, or t
  modified_base (976)..(976): a, c, g, or t
  modified_base (977)..(977): a, c, g, or t
  modified_base (978)..(978): a, c, g, or t
gcatagaggaacaaaaccatatatatgatgaaattcgattgcttttctagaacaaatacaatatggctaagaacttcttcgaagtaacacagcatattcccgaaaagaaggctcacatagaaagaaagtagctgaccatcttgtctatggcattgtgagaagacccaccaatcttgaagccgtcttccattctgttcttgagctccatggctctttccctcatcgcatcaccctccctctccttcattagcttcctgatagccctaacaatcttgcctctttccagctcgccttccagcgcaaaccctacaccccaggcttcctccacgtacctcgcgttcatcatctgatccgcgaagcagggcctgcatatcatcggaacgccctcgctgatgctctccagcgtcgaattccatccgcagtgagtccaaaacccacccaccgcccggtgcgccagcacctgctgctgcggcgcccatcggaccacctttcctctgccctccactgcagcctcgaagccgtttggaaaatctggaccgtccaaaccctgcactaccactactacgtctggccgaaccacccatagaaaaggaaggccactgttcgccaaacccgaagccacctccaagaactccctggagtccatggatgccaggctcccgaagctgacgtacagcacagatccagacggctgcgtctccagccactcaatgcagccgtagtcctggttcagtaggctactccccgtgctctcggaagaaagcttgtggagagggccgacagcgagtaccagggggatgttgagctgatcacggatcgtctccagctccgttgcctccaatgcgtcacatgcgttgatcactagaccggaggaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatctatgtgaactaaggaggaggttcc

SEQ ID NO: 1787 - DNA, 1198 bp, Zea mays
  misc_feature (1)..(100): optimal_loci_94135_G1, chr3:10284229..10285426, Cluster 10
gcatgcatcaggtcgggtccagcgtacttcctacgcgcggctaggcgtagctacctatataccttcacttcgtccctctctccgatcagtgtgctcaggcaggcgcgaccatgcatgcctgcctgccggcggtgccggcgcccggcaggatatttcgccgtttgggttgggggtaggctggtaagttgatggatggggatcaccggcggcatggaccggattattcctgaaacaacgcgtagctagcctgataaaacccatgcatccacgtccaccatcagatggatccatctccactagctagcagagtagcagtacagtgtacgtatcactaccaccgcagcggcaagtgcaagtgacggttcggttgttggttgcattgcaattgcatgcaccgctgggctactatagctacctgctgcgagagagaagagagaacgtgctgctctgctgctccatgcttccaccagccagccagccagccagctttacacgcacgacgacacgagagcagctggccataaactaatgctagggctaatcatgagccatccaactgggttaggtcgaccgagtaggtggctagctagctagcttctagctagattttttgacgctttgcggacggccgggatgcaggcagcgctggccgctgggtccgttccgtggtgcttgcaggcggcgcgaaagactgctgtgctagctgatctcacaccacccccagtccccacactggtaaaataggatcggatccgggatgccgccaaaacggccaccatcggaaacaacgtatagtatatacgtacttactaggcgacggcgcatgctccaagacaaatcacgacgcccatgcacgatcgacgacgcaaacgccgtcgtgcggatcctctgcgctgccgatctgatagcaccgcgcgcaattaaactaattgaacagccagtgattattaggctatatatagccccaatcgaaacgcaggattattagacaacaaaaaaaaccccgaaggaataaaaaagaagttttggaagtactagtatggtaaggagtatatgcacatgcgatcgaaacggacaagtgaaaatcacatggtactgtattctgtataacgagcgaaccgaccgtcattattaagaagaaaaggctgtgaagctatatattttcttcttcttcttttttgaacaactagtacatgct

SEQ ID NO: 1788 - DNA, 1035 bp, Zea mays
  misc_feature (1)..(100): optimal_loci_94784_G1, chr3:13725710..13726744, Cluster 10
tatagtagccagttagagcaggtgagccagcagtgagcgaggtacacagtgacttcatctcattggaatacaatacatgctacagaaactaggcgggttttgatactgtttgggcacgcatagccccatgtgagagaggcaagggcatccaatccatcaacccttgaacaaggcactactaatcaatgcgccatattgccatgccacctactacttgtagtatttactaatcccacgctggagctactactactggtctagttaaccctaaacgaaccttccattaacgaccactagcagctgcgtgcgtgcgtgcgtgctctgctgtctgctcacagcctcacaggtcaagtccactctctaacgccgttgaaaccactggtggcccatatattgcttagtactaaatttcaccacacacgaattagagcagtgttccgttgctttattccaaagctgaagatctaaacttgctgtctgttggaacgcaacattaattgtgcagcgtgtgccttgagaaccggagcctgtgagaaagctaggacgcgtctccaaattaaacgccgatgcagacggccatccgagcctttgccggccggcgacgcatcggcggcacgatgactccatgcatgcggtcgtcgtcattgatcgaacgcgatcggcgtacgttggtcagtcttggtcctagtcctagcctcccgcgcgcctagtacgttgctgttgcctggttgacctggggatacacaggcacaggcactggcacaggcgcacagcctactgctactgctacgtactactggagaggaggcccgctgcattgcatgcccgtcgatgttgcgtccgccgaaaaggtgcagactactagcttgcagttgcagatcaatcgcgtgcacgcgtattgtatcgtcgatcggtcgatcgatcggggacgcaaacgcgtgacgaatggacgaaccctaataacgactgaaattaaaccaagaatgtctcctgctcctgcaccgcaccgaactggagctgcagagccagctgcgg

SEQ ID NO: 1789 - DNA, 1025 bp, Zea mays
  misc_feature (1)..(100): optimal_loci_95244_G1, chr3:16577870..16578894, Cluster 10
agaaggagagaatagtgagcaccactagcaagaaggccacagagatcaagtaaaggtgatgaccataagaagttggggattgaagaggaaggaggcctctcttcccaacggtttggagttaggaagctgtcattatagaagccattattacggttggtacatctacgagatagcatacagtacaaattaatatcttaataaaatggaactcaaaatactatagctcattaaagtcgtccatgacattggggtcactattggtctcctctttctcccgctcatcttgttgctgttacttctccttcctcagttcctctccacatcatatccttgtcatcctacaattttgcataaaggagcacacgaaaagaagagcacgaacacgaaaagaaagagcgaaagaccagtacatgcacactataattgctctaacaacaataacaaaacaacaatactaagtttcaaaaacacataattgaaccaaacatcttagaacatgaagaaaaaaaaacatgttgaaggtatttataggggtggagtacatcctcgactacacaacatggaccgttgtttccttttcttacccttttacgctcaatacatatatttaattttttctcgagggcgattctgccatcacgcggcctttattttgggtatagctagctgtttgaattccaccggattctagaagagacagacgctggactggatggtagccagagaatggatcaactggtctcacgtctcaaaactcgaacaattcacgtgcggctataggattggtagccgcccggcatgcgcggcactgtcattgtgcgtttgaccgtttgtgctacggcatcccgaaatagatcgctatacacagtacgtaacacgctgccagccctggaattccttgaaaaacaaacagcacctccaactccaagtttaggctccctcgactcgcgcacgcatgcatggtgcccgcgccgtcgtctccgtgtcgttttaatccccgttccaccgctggttggccctcgatc

SEQ ID NO: 1790 - DNA, 1042 bp, Zea mays
  misc_feature (1)..(100): optimal_loci_96381_G1, chr3:22733784..22734825, Cluster 10
  modified_base (29)..(29): a, c, g, or t
  modified_base (30)..(30): a, c, g, or t
  modified_base (31)..(31): a, c, g, or t
  modified_base (32)..(32): a, c, g, or t
  modified_base (33)..(33): a, c, g, or t
  modified_base (34)..(34): a, c, g, or t
  modified_base (35)..(35): a, c, g, or t
  modified_base (36)..(36): a, c, g, or t
  modified_base (37)..(37): a, c, g, or t
  modified_base (38)..(38): a, c, g, or t
  modified_base (39)..(39): a, c, g, or t
  modified_base (40)..(40): a, c, g, or t
  modified_base (41)..(41): a, c, g, or t
  modified_base (42)..(42): a, c, g, or t
  modified_base (43)..(43): a, c, g, or t
  modified_base (44)..(44): a, c, g, or t
  modified_base (45)..(45): a, c, g, or t
  modified_base (46)..(46): a, c, g, or t
  modified_base (47)..(47): a, c, g, or t
  modified_base (48)..(48): a, c, g, or t
  modified_base (49)..(49): a, c, g, or t
  modified_base (50)..(50): a, c, g, or t
  modified_base (51)..(51): a, c, g, or t
  modified_base (52)..(52): a, c, g, or t
  modified_base (53)..(53): a, c, g, or t
  modified_base (54)..(54): a, c, g, or t
  modified_base (55)..(55): a, c, g, or t
  modified_base (56)..(56): a, c, g, or t
  modified_base (57)..(57): a, c, g, or t
  modified_base (58)..(58): a, c, g, or t
  modified_base (59)..(59): a, c, g, or t
  modified_base (60)..(60): a, c, g, or t
  modified_base (61)..(61): a, c, g, or t
  modified_base (62)..(62): a, c, g, or t
  modified_base (63)..(63): a, c, g, or t
  modified_base (64)..(64): a, c, g, or t
  modified_base (65)..(65): a, c, g, or t
  modified_base (66)..(66): a, c, g, or t
  modified_base (67)..(67): a, c, g, or t
  modified_base (68)..(68): a, c, g, or t
  modified_base (69)..(69): a, c, g, or t
  modified_base (70)..(70): a, c, g, or t
  modified_base (71)..(71): a, c, g, or t
  modified_base (72)..(72): a, c, g, or t
  modified_base (73)..(73): a, c, g, or t
  modified_base (74)..(74): a, c, g, or t
  modified_base (75)..(75): a, c, g, or t
  modified_base (76)..(76): a, c, g, or t
  modified_base (77)..(77): a, c, g, or t
  modified_base (78)..(78): a, c, g, or t
  modified_base (79)..(79): a, c, g, or t
  modified_base (80)..(80): a, c, g, or t
  modified_base (81)..(81): a, c, g, or t
  modified_base (82)..(82): a, c, g, or t
  modified_base (83)..(83): a, c, g, or t
  modified_base (84)..(84): a, c, g, or t
  modified_base (85)..(85): a, c, g, or t
  modified_base (86)..(86): a, c, g, or t
  modified_base (87)..(87): a, c, g, or t
  modified_base (88)..(88): a, c, g, or t
  modified_base (89)..(89): a, c, g, or t
  modified_base (90)..(90): a, c, g, or t
  modified_base (91)..(91): a, c, g, or t
  modified_base (92)..(92): a, c, g, or t
  modified_base (93)..(93): a, c, g, or t
  modified_base (94)..(94): a, c, g, or t
  modified_base (95)..(95): a, c, g, or t
  modified_base (96)..(96): a, c, g, or t
  modified_base (97)..(97): a, c, g, or t
  modified_base (98)..(98): a, c, g, or t
  modified_base (99)..(99): a, c, g, or t
  modified_base (100)..(100): a, c, g, or t
  modified_base (101)..(101): a, c, g, or t
  misc_feature (101)..(128): n is a, c, g, or t
  modified_base (102)..(102): a, c, g, or t
  modified_base (103)..(103): a, c, g, or t
  modified_base (104)..(104): a, c, g, or t
  modified_base (105)..(105): a, c, g, or t
  modified_base (106)..(106): a, c, g, or t
  modified_base (107)..(107): a, c, g, or t
  modified_base (108)..(108): a, c, g, or t
  modified_base (109)..(109): a, c, g, or t
  modified_base (110)..(110): a, c, g, or t
  modified_base (111)..(111): a, c, g, or t
  modified_base (112)..(112): a, c, g, or t
  modified_base (113)..(113): a, c, g, or t
  modified_base (114)..(114): a, c, g, or t
  modified_base (115)..(115): a, c, g, or t
  modified_base (116)..(116): a, c, g, or t
  modified_base (117)..(117): a, c, g, or t
  modified_base (118)..(118): a, c, g, or t
  modified_base (119)..(119): a, c, g, or t
  modified_base (120)..(120): a, c, g, or t
  modified_base (121)..(121): a, c, g, or t
  modified_base (122)..(122): a, c, g, or t
  modified_base (123)..(123): a, c, g, or t
  modified_base (124)..(124): a, c, g, or t
  modified_base (125)..(125): a, c, g, or t
  modified_base (126)..(126): a, c, g, or t
  modified_base (127)..(127): a, c, g, or t
  modified_base (128)..(128): a, c, g, or t
cgaatcaagctgaatataagaatgccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctccggaataatcggcaggagcagagcaggtaaaccaacccgtcctactccacacccaccgtgctccgccctctgtccgcgcgtgtgtacaaacaaccagtgcgttgctcggtcacactgtgatattgataacacgcctgcaacgaagggggtaggttttagcagcatcgtgtacttgtttatgctcctctaccgatgagaggaagacaagtctctgtcgtccgctcgtacgcccccccacacgatgctaattcgatctggacaacaagttgcgacgaaagaaaaaaaaaaccggagagcgggaatcgtcgtcgccgtcggcggcacaggcacgggacaggaggcatgccgaataaaacacctccccatgtacgacacgaccggagacgaatgtcgcgggcacccaaatcacatggcgtgacagggacactgcactgcaggcgcctctggacaacccaaacgtggcgcagcctgctgcagatgatgcaacgcaaccgctctgctgcttgtatttgaattttgaaaccaagacgcctttgcctttgccttcggcgtccacgtccatcattgcctgtgcgtgcgtgcgtgttttacatggatcatgcaatttacatttgcaggcatccatgctcgtcgatgggactcggtatcgtgcccgggtattccggcacgagagaaaggcaggcgtgacggatagaataagacggcacgagaaaaggccgaagatctgcatgcccgctttcttgttcgcacactgcgtcggcctaacggatgacttcgattctggcttgctaaaacaattaccatgggccatgttcttgttttatcaggtgggcttcaaatcgtaatgcgagcgcggcctggcccagatccagaactccccgggcctccggtgttggtctggtggtcggc

SEQ ID NO: 1791 - DNA, 1158 bp, Zea mays
  misc_feature (1)..(100): optimal_loci_96419_G1, chr3:22958390..22959547, Cluster 10
gaccgcgcatgccatgcactgcactgcacagcgccagctgcgtcgtctgtgcgctgtgctgtgcctgcgtgcacgcgtcgcacggttcgcccccgcacggcaccaccgcaccatgtgctacctactggtagcagagcagaaggcactaggcagatattgtagacttggatagcagtagacgcagcaaaaaggtcgtcgggcacgcacatggtggcccggcgccggtacctgtctgtctgctctagtgcttgctagtacgtactgtatgtggacagctgccatggccgacgccagcaggcacacgtcgccgcgtgacgccaggtgcgtgcgtgcgtgcgtgcgcgatggacatatgtggtggactggtggtggtggacacacttggtttggtgccaagcggggccgagaccgtgatgcatgcctgaggtgactctcaggtgaggtgtacgtgtggggtgcgggccgtgctctgcgccccgccccgtgtcccgtctgctgggtcgggtggctgttgggtcgccggccgccggatattttaatgcgaccgagtggaccgcgtcgccgactcgccgtagccgcctagaggacagcagacagatactcgtcgagttctcgaatcgttttctgtgacttggacgcaggaaacacgagggagagcggtctcgctagacagacaccatggggatcgcacacgtgacacgacacggtacggtacggtggataataataaaataaaatgcgcttcggacccatcgcgtcacagtccggtgaccgggtcgttgctaatctctttcgctgtcatgtcccccctcccgactcctccaattcggccattcccggccggcctgcctgtcagcagtagtataatggaggagcgtgagaacgaagaccatgcacagcaagtaactgaggttcatgaagcaatgccacagaaataggagcgcaccaagagaagtcgccatcctatatatgtccgtataagtgggctagagtgacccatgtaaacaataggccgtagtgggccgcgcgacgtcatgtgttgcagtataaaaagagacataggctttatcaaaagtataccgaaaatcagaacaaaagaatacaaaggctgagacaacgtctcgcggccaaaacattatgaaatacagtttcatataa

SEQ ID NO: 1792 - DNA, 1134 bp, Zea mays
  misc_feature (1)..(100): optimal_loci_97417_G1, chr3:28346683..28347816, Cluster 10
tatgtgttcggagtgttccggctctaggctgcacagagcacgtgcccccggaaacaaaacgcttgtttgttccgtgtaggagtaggtgggcgtgggtgcatgctgcagctgtagacctggtagctactaggctaggtacgccgaacacgaacgccagcgcgggcgcggcactcatgcgaaacgccgcgccgaccgcctgacggctgattgctcagcattcagcaggtagcacaaacatccaaagctgcgtccatgaaaatcgaatccataatatatatactcctcctacatcgcactacgggccagcacatacaaaaaaaatacgtgcaaatgttggggtaacgtaatcggaggagcaagatgccccacgcaactccacccgccagggccagggccaggccagcaagaatgcaaagcaaaactaggcgacaagaggacaggggcctgcactgccgggctgctcacggtctcacccagttggggctgttgctgtggcagtgcctggcacaagaatgagaagcttccacgcaatcagcagccattcggtgcccgtccttgcttgccgggccgctcccaaacgcgccacgaaccgacctgctaccttcgtttttttattccttttttaattaatatatttagtggcacaacaggtaaggttccattttattgctagccgttactagagataaacctttaatatcgatttttggcaagaactgtcacgtgtcactaaagatgggcctttaatatcagttctatagcaaagaaactgtacgtaccaacgaatttttattttccgcacatacaaattgttgttgatggatagtacattaattaatatgtgcacgtataaacggtcaagttctttccattacgacatgtgacacgaaagttccttgttttttttttatcttagttccttctttgaccctacttttgtttgtctcggttctacttttttctgcgcagttccttcttcgtctctagcaaggataaatatgctcttagcgtcaactaacctttaacgcaccaaataaaaaaatgttttaaactaatggtttgttgatagttgaatgtattttcttatttcctgtctaagggccagttcatgattaagttcttcaccgttctaaa

SEQ ID NO: 1793 - DNA, 1106 bp, Zea mays
  misc_feature (1)..(100): optimal_loci_984_G1, chr1:5005906..5007011, Cluster 10
ttagctgatcaccatttgtttgtttgttcagaattctgatgaccaatatgttcgttcgtttgtttattcagaagtctgttggccacttgttctgtgtgtttgtgttcgaagccatgcatatatggctcgccgcggaggcgtcatatatgatgtatacacacgtggagcgccggcgcaggtcaatcatctgccggccagctgcccagggggatcaccggggagggaaggctggcagtgcagggagggcgagggccgcgccgctatgggtgtacagcagggtccgtccgcccgcccgcgcccgccgtggcgtgcgtgcggcggcaccgacaggccgcggtcgcgacagctgtgggctgtgggcgtggcgggggctggcgcgcaccgcctcgctgtcgcggaactccaacggcggccaaccccacccccaacgcgtggcgggggctcaagctgaaccaccgcgcgggctgccgactgcgcgtgtggaccagccagccagccagccaaaccaaaccaaagcaaggcatggcaaccaccggacccggctgctctactcggtgccgcccgccgaccgcgcgtgccccgcctggggcctcttctcgcctccacagcgtttgtactttgcggattcggtcggtcgctcgctcgcttctggttccggtacacgtcaggactacctggattgctctgctcatcagcctcggctccggccgtccgtgctcctcccatcccttgctgctgctgctgctgcgttgcattgcattgcagctgtacatacaggaccacacatgcgacgtgtcttgtcgtgtcgcggatgttctctctgcgtctgtacagtagcaggcagcccacacccacagtgcggggctagctttccagctccgcaaggacacgtccccctactgctgtacaatgtacagtgcctcctcacgctgctacaagctaccgtctccgtccgtgcggtagcagtagcagctccgatccgtccagcacagcaaccacacgtacgctcgctcggtttgcatgtgtttgccgtgaccgtgaaggacagccggttagttctggccgcctccggccgccgccgcgggcgcccattctgctgcaccgtc

SEQ ID NO: 1794 - DNA, 1024 bp, Zea mays
  misc_feature (1)..(100): optimal_loci_99593_G1, chr3:41747027..41748050, Cluster 10
gaacataagtgctagagtttagctaaaagtatagttttaaattttagcactatagatacaaaggattcatgtggtagacagtttgccggctaattttagtatattgtgcttcaaacaaactgactaataaattagctaattgttaatcgcacggctgacaaatttgtccattgctgatttaaccttgcttgctaataggtggtaaggaatcataaaaacagagaaaaaacatcttgttgctaagactctaaatatactctgatctaattgtttactggctaattatcaaccaacaattaaacataccttacttttagctctgataaaatagtgtagtgggtgccactctctgcaggcgagtaggcgaccgaggtaacgcgcgcgctaggcggtgtgcgcggcagtgcgcctgcggctgcgggccggtcgtttgacccctgtccggccctgcccctggcggcctcgcctcgcctgccgagcaaggccagccagctcccgcgtttgcccaatgcccagggcggcaggagccctcttccattattttaccgcggtgaccgacattcctgcgcgcggtcgccacgtgggtccgttgctccccgtgatgtgggcactgttcaatgtgtttctttttgggcgtgaatcgcgcatcagcgtgggcgtggccgtgaagccgcaggaaaccgcgggccgcgagcgcgtccatctcgggggcggtggtcccgctggaccacggacgacgatggccgccgtcgcctcgccgtcgtcgtcgtcgcgtaatccgcccggcatgcccgtgtcggagggaaacatggcctgttcttcctcccagcgcagacgtaatcatgccatggccacgggtggcgcatgctattaagcctgaaaggctgacagcccgcagcggttttggcgtgctgcgcggctgtggctgattagcggcgtgtggggcaggtgctcgtaccgcgcagctactttgctttttttgcttccgggttgcgtgaccaaattccaatagaaaatggcgtca

SEQ ID NO: 1795 - DNA, 1709 bp, Zea mays
  misc_feature (1)..(100): optimal_loci_343678_G1, chr10:113837795..113839503, Cluster 11
aagatccctttatttttgaagtggtcttaatttttcttagaaaaaaaacatatccatggctaatttgattcgtgcatcgttagcgccccctctaatccatctttgggtccccccagctgatgcgaccagggattagaattttattaattccacccatcgagacgcccccccgccgtggaagtaccggtgcccaccagcatcagacgagacgactgcaaatgccaaatgggtcacgctcggctcaacacaggtgtgtgcgtgtccccctagtaaaccccatatggtcactggtcagtgatcgcgctcttgcgtgccgttgcttctgctgctgctggcggcctcgaggcatgcacctgccgccggtgcgatctcgtcgtgctctcctgctgttctggttcgacggctcgacgccacacgagtacacgacacggcggcggcaaagagcgagtgggcatggcggggggtacggtgcgagccagcggcggtggatgatggatcgggattcgggaaggtggcggtggcggtggatgcggacaagacgcacccacccgatcggcctcctgctgttccctgtctccgatggagatgtcgcgtacgtgtcgacttcgtctccatccacaccgtacgtcacgtgccgttaccagaggtatccgaagcccagctcgataggctctccctccgtccgttggtcgccatcggggtggacggacgcgaggccatgaatagtgtgcggtgggacgggtgacgtggagcccgctgctctctctctcacacacacacatgtgcgcggcgcgggggtcgatctcgtcctaatcctatcactccggcggggacatcccacggcacgaaggaacgaacaggaggtccggccattcacccttcagcgcgagatgaacaccatgccgggcacacacaagataaatgcatccgctccccgtcaacgtgacggttcaactgtcgcgctacagtctctctctctctctctctatgtagcagcatgcacggaggagtagttagcgggcaggaccacaggctcctggtgccgggcgaagcaggtcaacacaaacacggacacgtcgcgtcgtcgtcgcccacccaacctgccctaggagtgtagtacgaagacacggctcagccaatttctctccaaactttttttctccatctactcctacccgtaaaaccgagggctgctactaccggtcatagcggcattcatcgcgcctaaccaccgccgccggttcacgccgacatggtcggcggcggcacggcaacgggtttatgacttctatatatgtggctcagctgctcaaataacgactgcgatctaacgccgctgccggtgccaaatgtccaattgatgatggcggcggccgtaagccgtcagcgaaggaccgtccgtccgcgcctgttccgtagtatgtgtggaccgtggtatcccatccaacgaggctggagatacgtaaacgccagaatccaagggaggcatggggtgacaccacccacccaccaccccacccggcctacatgtcgactcccatgatgtagtacttgccaggcagacaggaatcagcgtaggagagcactgagcctgcttcgatggagaagcgcagcatgttgcatgtttgcttgtggaatcctaccgtgtcgaggaccactccacggatattgttgtccatatttacaactcataacatactgcggctata

SEQ ID NO: 1796 - DNA, 2501 bp, Zea mays
  misc_feature (1)..(100): optimal_loci_10030_G1, chr1:53412522..53415022, Cluster 11
cttgtaggggaggggcgtcaatgacacgagcacttactttgtgcggtgccatagtccgttcgagtggtccgattggtttggacatgtaaacgtgctggtgtcttgacgtgagtaattggcacgcttgttggaggcccgccttagaggccaggtttgatacaaccaaggtccaacccaatgcacgaaccttgcttcggcgggaagccctcctggttgtgcaaaacggcccagtgagcgctggaagctaggccgagtggcgctacaagctgggcccaagtggtatgcgcttaattttccgccgacaagaggatactgagcgatctgcaaccggtcactgttagtaacttattagtacatccatctttatatgtgacatgacgcgaccacaacgcgtagcgtagcgatcatgaatccaccgtacagtaacgaaaaccgtgtgctgtgcgtgccctcctggccgtccggtccattttgattataaatgtctgaaaaggaaaacgccttcttttttttttctttagaagatacgccgggcggcggtgagcatcaactaaaagtgcgctcactagtactaatagcaaacaaataaatggacgcgtggagtacacgatcggccgccggggcgaattaaatgggcagcgccgcgtcagtgcccgccaatttgacaaaccgcatggagcccgcccgccccagctagacctaagcttgaagtacaaacgaaaaccgatgcccgtctctgtcgcagctcccggctagctcgtgtcgccgtcgtccgccccagaacgatcgagcgctcgcggatcggaggtcaacggtttcgctccgcggcaccaatccggcacgcactgtggtttcagcttgctgcgtgcgtttgtcaagctggccaccatggccggacggcaggcaaaggcaactcatgcctgtgcctcggctccgcgttgcgggcactcgcccatgctgccatgcactatttaccttggattggatgggacggcggacgcgagggtcgtcgcgtccggtgtcgcgcaccgatccagtaggaagaacgcaagctgcgagcagccgcagcgtgggtgagaggggtgagctggttcggtggttccgcttgcttggattgggatcgcaccgccggccggccgggccctctcgtgcctctctgtacaggcatcaatttcttccagcctgttccgtttccggctagtccctgggtacaaaaaaaactgaagctcggagtagatcagtagacccggcgcgctaccggtattatggaccttctttagtttattcggttcataactgcaggaaggaaggaggagctcattcgtgaattgtcttcgctccacgaacggatcaggcagccggcccatttctgcgagtaactaactgcatagaagagaagtcgctgacggcgcatcgtgcaccttccaagtttgtttttttttctccttggcgaaaaccttctaagatttgtccatctgcacaagtgcatggctggtgtccaatgctaaactataatcaaacgttaacctgatcagacactcgtgcacatactgcaaaggaatatgtatataaacatactctgttaacgaactttgtggaggagcatatcatgtcataccggatttatgttgtaaactccatcgggcctaaacccacacgaacgctgtcttggaaaaaaacatcatctagcaatctgttgcttgtaaaactctcagaaccgccgcaacgcgcaactacgatcgaaacgtgttctaatagccgccatcctgctgctgggcacacttggcacttggcagcgacgacgacgggggggaacgtcgccgtcggagttcccaggtggcgcgccgcgcgcgtactcaacgggggggcacacttggcagcttccgccgtccgcgacgcgactacacgcacgctggagaggacccggagcccgagattcttggaccagacgaagaaaaagggcagacacaatcaaaccaaacctagttacagtatgtacacacaagagaaatcgtggatccggtttcgttgtgtctggcacagctgcgtccgaatggctggagaggacaaaacgtgtagccctactactagactagacaccccctcgcaataattgtagccgcgtcgagatgccacagctagcagttttgttaccgaccgagatgacacggttggagtcctgactgacgtctcactttttttcgtggagcatatatacacgcatatacatgggtgatggacatgccacgagaactaccaggactataaacgggtgtgcggcctgtttgtttctggtgtggcacgagtaaaagcaccgcttgaccgaggtttcagtcacttgagtgaacgcgcgacagggacgacaagagggcgtaccaaccacgggaaagagagagagcgagaaatagagaagacgctctactagaacgcgggtaggtatggtctatggaagcctctggtcactacaccttagagcatctcgagagattagcaaaacaaac

SEQ ID NO: 1797 - DNA, 1571 bp, Zea mays
  misc_feature (1)..(100): optimal_loci_100860_G1, chr3:48504880..48506450, Cluster 11
tgataagaatgaatggaaaccatagtatagtaacgtaagaacccttagcttgtgagtatgtatgattggctctgacccaaccagtaagggcagccgtaattatcaccatgcatgcgtcccttggcactaaaaaaagacctccatattttcgtcacaacatgaatcctggtgcaaatcgattaaattgagttcccaacatttgtaacgacgacctcgcattcggttacttaattagccactgccatagtccgatgccgaagtctgccggtctatctatagaatatgcgagcatttgaacactaatcgtgtggctgtgtttggcgtgattgctgattgggtcatctccaagccaagttgacaggtgacacgcaagagcctcggcagagacagagacaacaaagtgtacctaacggccaacggacgacaagggaggcggccgggctcgggaccgggctaggaattaggacaccacgaccgcgccgccggcccccctccactccactccacgcggccggccggaccgaacgagggggataggggagacccgccccccgctttcgtcgggcgctgagcgtccgtccctcgcgcggggcgggcagcagcagcgacgcctgccgtcgtcgtcgtcgttggctcctgctgctgctactactacagtactagtacgtgcggtgggacgtcgctgggcagccgaagcgcgcgccgggcccaggcccgggcccgggccgtcgtgctcggactcgatcggagccatgcattattatatttcgcgcgccgtttcgccgtctcgctcgacgacgacgacgacgtcgcggggcgcaggccgggacgcgcgacgtacaagccctggtcttggcgcgctgggccgcgccggagccccaccgctgccggccttttccgcgctcatcactttcctctcctgttgtgctatacacacgatagctgctgctccgaccgacggacggacggacggacggacgggtacgacgagcgaggctgctgcgtggaacgttttcgatgacatgcatggcccccacgtacgcatatatatatgtgcgtgcaccacgcgcactgtcggtgcacaggcacgtcctcgtcaccttcgctctccgtctagctagctctgcgcggagattgattaatttaatttaaaatataattggaacggaaacaacgacgacgcatgagtgacgctagatatgacgtggtcggccttctcgttcttctccactgacccgctgtgatgattgacagaatgaccaagagcgggaaaattttgtttctatatattctgggaagatatatacgtacgtacgtacatacatacgtacatgacatgtcggacggaagcacagaacgtacgacgccgtcgacggagacctagctagctagctagccacactatatagcagatactgtgggtttggtcgactgtaacaatcgcgacgtaccgcgcgcgtgtcgtgtatctgggcacgtacgtacgtgtttccgaacgggcaaacatcagtgacagtgaaaggcgcaacagtcgggcgtgtacgttgcccacacatgctagctagttagct

SEQ ID NO: 1798 - DNA, 2052 bp, Zea mays
  misc_feature (1)..(100): optimal_loci_101177_G1, chr3:50114579..50116630, Cluster 11
attacgttaccaatatgtgaaccaaacggcaccttatttgcttccttgatcggggatgcaattgatggttgccggtgaatgcaacaacatgggccttacggtttctgcgcacaatgacaatacacagcaacaaccttttctccgatcctgttttttagacgcatcaaacatcaccgagtagaaatcagtgactgaagtcaactctgcctcttggcaggcacttttgcaaatgaatcggtgccaccaccgaccgacgatggcatgcaaatagtctcggtctcaaagacaccaaatagtagatccaaacagtaacgatggcgcgtcgaacttgcaggccgattaaaacgatagattttttttgaatcttatgtttggctctgatacaacttgctatcaaataatacgaatataaatcaaacatgaggcacataattaagtgaaaaattgcagcggtaaaaaaccatgtgcgtgcatcggtgaggagagtttatagaacaaagaataaaatgaattatctcttcccgcgtgacctacaaaatgtctatatatatacaattgatagactacaggtcaatacaaaaataaatccgctaataatgatatgatacaagttgaaccgcgggcgcttcaaacgtccctacgagactcacgtcagtcctgaactcgcctgacttttaagtccaactgcggacacacatgctcattttttgaatctgtgtgcctctagtttagcactgtttgttcagttttgaggtcggctccaattctctccgtctctcttggatttcttcagtcttgttttcggacgtgcaggtgctgcaataaccaaagagcggggcgggcgaccagccccgtgcgcagacgatacccacctcggtatttttttaaaggcggtggcgcagaagatatatttgtagtgtaatgttaacgatgttgatgccgacgccaattaaaccaatcatcacctacttgataccccagtttggtcaatgacgttctgctcgtgcagtccacacacgaaatctctctatatacattttcttcagagattgacgagaccccaggagcagtggactaaattaaagctgacgcgatcggcgatcattaggtacgtgacgacgcgcgtcgtatgagcggcggcaactcaggggtgcagggacggccagcgggcggcgtcgtggcttgtgcgccgccgcgcacatacaacgtgacgtgaccgaccgtcgacgagcagtctcatgcaccgatcaagagtccaacaacacgcatccagtcgtccaccgataacaattccaagttgaatcgaacgtgcgcgcgcggcaacacagaaagggaggccgccttttgattaatttggagcaggagcaaaacggcgaaatcgtgcgtgtgtgcgattttaaatagagaccctcgcgtcgcgtcggcttcgtacagtggggatgcaccggaaaccgctcttttccgaagcgaaccaccgtccggaccggaactgacctaaccctgcaacctgcatcgcatcgcatcatcccttgcgcaccatggcaattgcacgcgttcttctttatagatagactatactatatattatatagtatagcacaggccaggacggcagcacacgcggttcggtgccgatgacaatgggtccggaaaagcatggtgggcccgcgtgccatggtgggcgggatccatgtgagtggcgccccctttttcgctttcatcaaagggatggaaacaaggacgccggagcgcaaaagtggtccgtcagtgcgtgcgtgcgtgcatgcgagagaggccactggcgaagcagcagccgccgcacatgctgatgctgaacgtggaaatgcttcgcggcgtcagggcttgcaacagatgaccagtcacgcacacgcacccaagccaaacccaacaatcaggataagctgcttatctttacctgctcttccactagccgccccatagtgtgtagccgttttcccaacttcccccaaaggatgtcccgcccttgttcggttggttgcattgcacctagattagtggggattgaaggga

SEQ ID NO: 1799 - DNA, 3135 bp, Zea mays
  misc_feature (1)..(100): optimal_loci_10878_G1, chr1:58450084..58453218, Cluster 11
aaaatcgggcagacatgttggtcgtcgttggtccaggtcctggagcacgtacgcacaagagatgcaccgggtaccacacacagacacacttgtgtactacctccacttatgtactgcatgcccgtgacctgcagacggtgcacaagtttcacatgcaactccgaaccacggcgcatgtaccagacacagcacgtacggtacatgcaccatcgtctcctcttctgaaattttcattttttttttctcccaacagggtccactaaaatcgtaactagtccggaaacaaaacgaaatcaaatcctccccaccccacccgcccacgtccacgacctttccatgtccgaaaccgcgagacggcttcctgcacgcacgaactcctactgaaacattttttccgccccttcaaacatgccccaactgaaatattgggccattcaatccaaaatattccgaaaataacacggtctactcctaacctggccgctgcaagcgtgcgcatgacaccgatgccaggcttagcaaaatgcagaggctgttcgttctggaccaagaaacctgaccccattggtgaactcggcttaactaacattatctcctcctccgatccagtaaacaaccgcacacagaaccgcgcgctcgtacgtcgggcccgcccaccagaggccggcgtttgacgcctgcggctggaaaggtcgccgccggccctctcgccatcccggaagaagcttcgccacccccacccccacccccgggcctgctcccggtcgtcccagctgccagccggtcactgacgttaacctgagcgcgcgtgagctgagagccgtgcacgcaaccatgtccatgtcaccacaccagcaaccggggtcgcgcgcgcgcggagacctgtagctgtagggccatctatatgtttttttttttttttttgcttttcattgcatcatcagaatgcaggtgcgccgagtgatcatcgttttcactccgcaaaccgggaccggccgggctctagtttactcgtgataaaccgccaccttttccggcccttgcttccgggctaagcctccccggcccggccgggacaggcgagaggggacagcttgatcgggctcagaaaccgatggcgagaaggcctcctgtcgctgcatccatggcctggcctggcctggccaccccccgttcattccccgtccacggccggcaagatctctctttttcgcgaaataataaacaataaagcaccactttatttcgtgaagtgtcaaggtagctagctagccacggatgatcgatggagaccaaccatggcggttggcgggcatgtcctgcctgcttgctttcacagcctacgcagctccatgtcagcgccgtggatctttgcagcgcaaagtcgccacctacctgccaccccttctcgctctggaatgtgcgtgcccatccgtctgtctgaatcagcgctgaaaggatcctcccgcgccgaccaattcccatcacgaacctagatttttattttttgttcctaataacccatggccatgggttaggaggtgcattattaggcaaagttcagcgattagtttactgttgcctttattcagaaaagctgtccctggagactggagtgatggagacagcgttgttcccggcaaggactgtgcatctccagttaaataatataaaactcaggtgggaagagttaggtgacagacagaccgaaatgtgtccgtcaaaatgcacgatggttcagcggaggctggcgacaaaataaagggtgagagataatatttctctctctctctctctctatgatcttggtttgctttttaaaatttcagccaaacgattcagatatcgaaaatggcaaacaagtacctcacgagcataaacaatgtgtgtatattttcgatagtgatcgatggatatagcggagcattcgaactagcaagggaaccgaacatgatactaaaaatctccaaaatcgaaaaattgtgctctctcaagttcaaccgaggtaaaataagcatgtctctaacagatcgtatatatgatcgtgtaaaacactgatttatactatatggtgcattgttcacatagtgtaatttagaatagaagatctgataggaaattcgcatgccattgccaagctggtctagccagaatacaaggacgaggttttgcgccgcaagccccaaaacatccctacaaaatcttgaaatcctctattttaggttagatcgagataaaacttggcacactacttcaggatatctagagggttttgactcgtcctatctattgagtctgcatgaattgaccaaaccgcacttcagattaatttgggttttctccacaaccagcaaaaaggaaaaactatatacttgtgtgagatctgctcgaaccaccttgcatatatgatctcgagtactcataacacatagacaaggccaagaaacaaacccaaaacacacacacacacactaattggagtactaaaacatacaaaaaaaagtgaagatagggctccaaaagataaggtgcaattaagactcggcaatacaacccacaagattgggctatgaaaactggacacgaggaaaaaagagcaagaagaactcaacaaacaactcacaagaggtaaggtcttccattcccataacgtttatcagttacagagtcgaattacaaagataaataattagtgcagtgtctaaatcatctgtgaatctcaatagaaacaagaggaagggaaaacctacaatgacaaaataaaacgatgtgctagagagaagaggctcgttggatcttcacatatgacacctcaagtttctaaaccaccaaactactctggagtagtatactctctatgctctctccataacatatgtcgcctcttaattctgaatcgccaagtcttctaatgccttcgcttgacttgatcaacctctcgctttgattttgtcagcacgctgtactcctacatttactattacacttggcaatgaccccaggtatcagtcaccaatggtttgtctttcagtttctccaatcacctcgtttaagctcgacattcatccttcaccaatcctagtccatcgacataaacttgcatgacttttatcttcgatgtcggccaccgtttgt

SEQ ID NO: 1800 - DNA, 1532 bp, Zea mays
  misc_feature (1)..(100): optimal_loci_111669_G1, chr3:122494753..122496284, Cluster 11
catgatgtacaaagacgacgtaccatgcgtcaacgtatatatgtatcgacatcgtgcacgcgtactagctacaccgttcacgtacgatggagcagcccgccggtgggtcgacgacacgacgtctcgtcgtccctgtgctgttggctgaattgaacgtacgtacgtaggactccgtacgtactagttagctagaccaccggccggacacaacagtgtatgtatggtgcgtcggtcgacgtcgtcgtcagtgtgggcgccagcatacatcttcttgcattgtgtactgcatcagttgcagcagctagttagcgacgcgtacgtacgcgtacgacgcacgatatgatgtggtggcagggccacgcactgccagtgatgatcgccattccctaaccaccgggcccctctcgacctcgatctctagctacctgcttgctaagctagctatatatacttacgtacatacacgacgaaagagacggtacagctaccgtatagacacgtacatgctagctagctccttggatcgacacgacgaccaccgcccggcgcatattcagcttgccttcctttgatttctacgcggggctaggctacgaaggagacgatactactacgacagtgccgaaggaagaaccagcagtccgtgcgtgcgtgacgacggatcgttttccgtacggacacgatcgacgaaggtccgtgcaccgtacactacgagacgacgtcggcgttcgttggtggtggtagctaggtacgtggtgcatcgtgcatgtatgcaggtatcatcgatcgcaacacctagccagctctctgcatgcagctcacctgccggtgctaccgatccaagtacattagacagcacacgtacacacgtaacgtaacgtggattgaccagcagccagtaggagtggagtggcactggcatcacacacctacgtatctagctaactggctaaccgaaacggcgtacccggatgacgccacatgacataaactaagcacagctactacctctaatatgtgtatcacgtactactacttgttagtgacaccgtttatgactcttaattgtatgcatgctgaataatggacgagagaaagatagtgtgaatgacctctttgaagggtagcgagctaagctggtccttagcttttgggccagtgctggtgcaattaagcaaacatacagtagatcgagctcttaagaactagccacactccaacagtccaactgacaaaacggaacaaatatgcatggctctatgcatctgttaaatcatgttgtgtgtgcatgtttgtgatagatgtgcacacgggcgtggcgagttagacgacgttagtcaacttaaacacacggccggggcatggcatggcagctccgttctatactagcttcattgatagcagcgcagtgcagctatgtcgacgcagagctatatagctgagcaattgagcgtcgatcgatgacctctccctctctctctcccttcacatcacgtgccgcgtcgcaggtctccatgaacagcggtcacctg

SEQ ID NO: 1801 - DNA, 2807 bp, Zea mays
  misc_feature (1)..(100): optimal_loci_118163_G1, chr3:161969894..161972700, Cluster 11
cgatgacgatcttactactgcaattcggcggcacgcaaatcttttaccaatatcagagatcagcagtacgacgtgacgtaatggctggcgccgaagaggaccggggcgataatgggcggatcaacgcgccgtacgtgcctcacttttgcgccggtgtcggcactgggagactgactgactgagagataaatctacgcgcgccctagggctcatcgcggttatgacttttacaaagcgagcgccgcacggcagcaggcagcgccgatgcttatgcatgcatgcatgctgcaacagagctctctctctctctctttctctgtacgtacgtggcgtccttttggcgctccaatcagaggcgggtggtggtgtaggctatataagagcctgctaaaaaggcgacggcagtacgtgaggtgagtagaaaagggagtaggttaacgtaagacctggaaagaggactagaggaggggctgagaaagccggttagcgcgtcgtcctgtggtgtcgtgtgtgcaggacgagtagatatatatagagagacgagggacctcttgtaatcttgttgttctctgtcctctcttcgcttgctcccttgatctctttcccttttcttctatctttttatatatataaaacgaagcccttttttccggaggggggttgcctttattataactatatgtacttgtggccgtagcggccttttttcttctgtgctcgtctcgccagcagccgaggcgcaggcatgtgactgtcagcgccgatcccgatgcgccgattagaataatacgtactcccactactactgctgatgctgcgcgcgcaggctgtccgtagagaaaacgcttacgtataggtgcccaccaactgtctggagtctggactggcggcgctccaataccccgcggctagttgctaatcccttctccgttacttcttctccatcccctcctccttacatttgttcttctgtgcaccgttgcaacataagggtataaatatatatataaaattaactgtccattttttacacaaataaactcttcctatcaaatctgtctgccgcacgcagatcgtaggtgtggcctggccgtgtggacgacgggacgggcacaggctcgggccttttgctctgccccccacctttccctccggctcgtactcgtaccgcctgccccgctgtccctctcgtctcgtcttgtcagcgccaccgccaccgccaccgccagcagagggatcggagcgagcgagcgcgcgcgcccgcggtttggtttctcattggatccgtttcgtttctttgtactagatgatgagcctagcccttaggagagacgggaatttcgtttccgccggccaatgcaagtcagagctcgatcgaaaaggcatgcgccatgcatggcaatggcgtggtcaaggtcaaccaccgtaggcgaagccgtctagctgccggtttcctactacgtgcagtgcacaagagggaggagggggcgttcgccactcactgcccatggccgtggcgccgaaacattcccaacgctgtttcagtttgactcggttctgggatctcgtcttgtccactacttgtctaggataaagcatcgtgagagcgagcgagtgctatacgaagcgtagggatgaccacgtccggtcaatgtgcgtttcgtagttgagtttctgcatggcgtagtttctcttcatcgacaatttctagaatatttctttgaatcttttaggctagctcgggggcattttgtaatgattttcaaacaatacaaagtaatggacacgtattacaaaaatacaagtgtgttggaaagtcggaaggtcaagcatttttggccaaatttaaaccctataagcaatactagctcgtacaaactctggccgcaatacatattttagggcgaaaaaagtaaaaaaaaactatcatccatcagtttagttgccaaaagtatcataactatcttcacgcgggtgaatagtgacctatccgcgacgcagtcattcgcaggcgcctgagctcccaatctggctagttttctccgttcccgcgcacggcgcaccagaggttttccttcgcgcctccactgttcctccccaccactccatttcgcgcacgagggagcacgacacacggttcatccggctgctggatctctcaaccaagagctcactctcatcgacgtcgtctcgaagtagcaagtctccgccggaatcttcttgggcgatgccgatgcaaaatccatccgcctcggcggatgattttgaggtaagcatcaacctcctcttgcttctttgttgtatgaaaaaaattgtgtctttgcgacgtgtgttgaatgatgctaagtcttgttgcacttatacccaacagtagtttagttcttatttcccgataattcacacgtaaatatcacaagttgaacttgagttgttgtgaaattaatatgtttcattttgcatatggtgtctgtttgcaatgattatatgttccattacattttattgccaattctgcaaatattagttatgtgaaagaaattcaacgatagtagctatgaatactcgacaaaactagtattggaaatgaagtttagattcctctcattcatttttttttgccatagtaactactaacaatggaagccagctatatattacattaacctaatgagcgaggaaaaaataacatttcattggatgactttagtgatgtttttgctgtcatctcgagttgttcctttatgaaagaccaaactagaaaaggtatgctaatttcagctagcaggtggatttattggtcgtgtagg

SEQ ID NO: 1802 - DNA, 1969 bp, Zea mays
  misc_feature (1)..(100): optimal_loci_118872_G1, chr3:166424125..166426093, Cluster 11
  modified_base (1342)..(1342): a, c, g, or t
  misc_feature (1342)..(1441): n is a, c, g, or t
  modified_base (1343)..(1343): a, c, g, or t
  modified_base (1344)..(1344): a, c, g, or t
  modified_base (1345)..(1345): a, c, g, or t
  modified_base (1346)..(1346): a, c, g, or t
  modified_base (1347)..(1347): a, c, g, or t
  modified_base (1348)..(1348): a, c, g, or t
  modified_base (1349)..(1349): a, c, g, or t
  modified_base (1350)..(1350): a, c, g, or t
  modified_base (1351)..(1351): a, c, g, or t
  modified_base (1352)..(1352): a, c, g, or t
  modified_base (1353)..(1353): a, c, g, or t
  modified_base (1354)..(1354): a, c, g, or t
  modified_base (1355)..(1355): a, c, g, or t
  modified_base (1356)..(1356): a, c, g, or t
  modified_base (1357)..(1357): a, c, g, or t
  modified_base (1358)..(1358): a, c, g, or t
  modified_base (1359)..(1359): a, c, g, or t
  modified_base (1360)..(1360): a, c, g, or t
  modified_base (1361)..(1361): a, c, g, or t
  modified_base (1362)..(1362): a, c, g, or t
  modified_base (1363)..(1363): a, c, g, or t
  modified_base (1364)..(1364): a, c, g, or t
  modified_base (1365)..(1365): a, c, g, or t
  modified_base (1366)..(1366): a, c, g, or t
  modified_base (1367)..(1367): a, c, g, or t
  modified_base (1368)..(1368): a, c, g, or t
  modified_base (1369)..(1369): a, c, g, or t
  modified_base (1370)..(1370): a, c, g, or t
  modified_base (1371)..(1371): a, c, g, or t
  modified_base (1372)..(1372): a, c, g, or t
  modified_base (1373)..(1373): a, c, g, or t
  modified_base (1374)..(1374): a, c, g, or t
  modified_base (1375)..(1375): a, c, g, or t
  modified_base (1376)..(1376): a, c, g, or t
  modified_base (1377)..(1377): a, c, g, or t
  modified_base (1378)..(1378): a, c, g, or t
  modified_base (1379)..(1379): a, c, g, or t
  modified_base (1380)..(1380): a, c, g, or t
  modified_base (1381)..(1381): a, c, g, or t
  modified_base (1382)..(1382): a, c, g, or t
  modified_base (1383)..(1383): a, c, g, or t
  modified_base (1384)..(1384): a, c, g, or t
  modified_base (1385)..(1385): a, c, g, or t
  modified_base (1386)..(1386): a, c, g, or t
  modified_base (1387)..(1387): a, c, g, or t
  modified_base (1388)..(1388): a, c, g, or t
  modified_base (1389)..(1389): a, c, g, or t
  modified_base (1390)..(1390): a, c, g, or t
  modified_base (1391)..(1391): a, c, g, or t
  modified_base (1392)..(1392): a, c, g, or t
  modified_base (1393)..(1393): a, c, g, or t
  modified_base (1394)..(1394): a, c, g, or t
  modified_base (1395)..(1395): a, c, g, or t
  modified_base (1396)..(1396): a, c, g, or t
  modified_base (1397)..(1397): a, c, g, or t
  modified_base (1398)..(1398): a, c, g, or t
  modified_base (1399)..(1399): a, c, g, or t
  modified_base (1400)..(1400): a, c, g, or t
  modified_base (1401)..(1401): a, c, g, or t
  modified_base (1402)..(1402): a, c, g, or t
  modified_base (1403)..(1403): a, c, g, or t
  modified_base (1404)..(1404): a, c, g, or t
  modified_base (1405)..(1405): a, c, g, or t
  modified_base (1406)..(1406): a, c, g, or t
  modified_base (1407)..(1407): a, c, g, or t
  modified_base (1408)..(1408): a, c, g, or t
  modified_base (1409)..(1409): a, c, g, or t
  modified_base (1410)..(1410): a, c, g, or t
  modified_base (1411)..(1411): a, c, g, or t
  modified_base (1412)..(1412): a, c, g, or t
  modified_base (1413)..(1413): a, c, g, or t
  modified_base (1414)..(1414): a, c, g, or t
  modified_base (1415)..(1415): a, c, g, or t
  modified_base (1416)..(1416): a, c, g, or t
  modified_base (1417)..(1417): a, c, g, or t
  modified_base (1418)..(1418): a, c, g, or t
  modified_base (1419)..(1419): a, c, g, or t
  modified_base (1420)..(1420): a, c, g, or t
  modified_base (1421)..(1421): a, c, g, or t
  modified_base (1422)..(1422): a, c, g, or t
  modified_base (1423)..(1423): a, c, g, or t
  modified_base (1424)..(1424): a, c, g, or t
  modified_base (1425)..(1425): a, c, g, or t
  modified_base (1426)..(1426): a, c, g, or t
  modified_base (1427)..(1427): a, c, g, or t
  modified_base (1428)..(1428): a, c, g, or t
  modified_base (1429)..(1429): a, c, g, or t
  modified_base (1430)..(1430): a, c, g, or t
  modified_base (1431)..(1431): a, c, g, or t
  modified_base (1432)..(1432): a, c, g, or t
  modified_base (1433)..(1433): a, c, g, or t
  modified_base (1434)..(1434): a, c, g, or t
  modified_base (1435)..(1435): a, c, g, or t
  modified_base (1436)..(1436): a, c, g, or t
  modified_base (1437)..(1437): a, c, g, or t
  modified_base (1438)..(1438): a, c, g, or t
  modified_base (1439)..(1439): a, c, g, or t
  modified_base (1440)..(1440): a, c, g, or t
  modified_base (1441)..(1441): a, c, g, or t
cctagttcacctttatcttcacattcgagcatcgtctatatgtttcaccacacttgtagatcacaagttaaaaaaaaaatctgttgtataatattatatcacggcaataataaactgaagccggttatcatttttggcaaataataccgtggacatatatatacacatgtacgctttgcgctatgttcactgtgacgaaagccggccggcgggagagtggagaggaactgaggccaggccatgcagcaggaatctcgcatgtgttgtcgatgccgaccacgcacagatcaaaatcaaagcaaccttttttgttttctttattccattctatctagggacagaggcacagagcacgtactcgtagttagtaaacctttatataagaaaccactcatgcagcatgatctgccaataaacagaggagcttagagcgagcgaggatgagcacgaagaatcgcatgcatgcgtatgcgtgcacagacacagacacacgcgagagcgtccagtccagccccccgtcaggttttcaagtaagcagagcagagcaccaagaaaaatggtgcaaaaaagacgaaggcgcgcacgcacatgtccatacacgaagagaagagaggagtgcgcgggaagggaacggtcgcgctcgcgccgcagccgacatgtagcaatgcacgcacgagccagcacgacggtggcgctgggctgctgcctgcgtggatgtgggtcgatgcgagtatctgcgaccacaagaattacatttcatgggttttcattgatatttatacacagagacacaagatgaattatgggtctatgattatcacctgaaccgaaagacccaactgtactagccaatcaggagttagaacgagctcgcgtgtgcttatatgtggaggggggggggggggggaaagagcgtcggccgtatcccccccctgtccctgaccataaaactggatttggggttttaacatcttagagagaaaagcccacccactatttttgcgccggtctgctatttatacgcaggtcggggaggataaacaatatttagtttttacaagatttatcgcttattctcgtcttaatcaggagatcgtgcacacttagatgctaactcggtatagagacctatattcgcagagcaacacgtcgctgttcgatggtgggctgtacgatttagagctctgcccaatccagattctataatcccgacaatcctcagctcagacaggggggctagggacggtgacctccaccgctttgcgtcgtctagagggagcactcaactggagtcacctcctcccaacttgcagacgagagggtggatcccggcgtcagtctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatactggccggaaaacgagggttggaacggagccttcaatcccaacccaggccttgcaattagccggcctggaaccattttgtgtccccgccagggccccgctcggggggaaaccccccggggggggtccccgggggataccccaacacccccgggggttttggggtttttttttttttgccaagcaaaaaaccccccccctttttccccccctaaaaatttaaaaacacccccctcttgcattttttggggttattgaaaaacgaggtttcgacccgtcggtccgttaaccgaacggacctgtaggttgggtgttttaaaacctttattaaggaaataaacaaatcaaacaaattttagtgcggttcattattttaccgggggtccggcaggaataaaccaattaagtattttaaaaagaaacattcaagtaattcaacgtttaccggagtatagcggtaaatcataaaaatcgttcaacgattagaagactaaattgctaacgagaaaaaagatcgatgagtcaaa

SEQ ID NO: 1803 - DNA, 1653 bp, Zea mays
  misc_feature (1)..(100): optimal_loci_119988_G1, chr3:173513503..173515155, Cluster 11
aaagctggtgtgcagacatgcatggtaaaacagccgcgatcgatcaatcagatcaggaaagaaaacacttgctgcattgtgctctctaacgaaacctgcacagcacagagcccgaacttcgctcaaatgcgtcctcacgcgggtttacggcaacctgaccgcgacaacggcgaccgagctggtgagtgccggcgactttccgcgacagtttccatcagcatcagcagcagccgccgtgtatgttcactgcctgccgcgcgaacaataaccgcgaggcggcggaacaactgcacgatacgagagcgacgaggcccgtcgctgtgccgtgaattcgtgggacggcgctcgccgcacgggcgggcctgccggccggccgttaggatccagtggaagcgagccgcgcgctctgtgtggagtaaagccgacgtcgacgtgaacaaggttgcttgtttccccggacctgaaaacatcgtcagagaagaaggtgatgcatcggccaatcagacgcagggagaagacgcgaagcatggcagttggcacagcagtacgtacgagttcctcttctcgttacggttctactacaaggcaccagcggtcgtcgttccacgagtcgtcgagaaggccaggcactgtagctcttccaaaaggcactgccgttgggactggtctgggccgccggtcgccgactatcgatctggcagtctcctccgggacgctctacccacatgtctgacgttccggcaagtgctagaatgaatgtcacatgaccgaccacccatgaattgcagaccgattttagcctggacccaacctctgcgactattaaagcacagtgcctaacatcctaacctagccatccgaacagtagaggcaccaaagttgaacacgtaggccgtcgccagtactctgtctcttcctgtacgccattcgcacaccagtggtacagcatcctgcagcttctgggtctgggagaaggtattggcaagtcacatgcccagctggtataggtaggctggtagagactagagagtggtagacggagagacagtaccaccgcaccaggggtccagggcatggagcggtactgcaaaatcggacagttggctttccaactccccaagcgcacgatggctgctacctcgccgttgttgcggtaccgttccggaagcaacgtcactcgcgccagctttcattcttggccgaaccagcagcaaccgcaacaggttggctgcgccaatcattaagatccctcatgttagttttcggggcgggcgttaacacatcacctcaggctgacggatggaacagtgccaccggcgccggcgcctcatccatgacacatccgcggcaaagagctctacggaagcgcacacagtctccatgattagcctgaacgtacgcctcgtgttttcatccctgtttttttcttctttctaagctccccatggaaaacgccgtgattttggaagcccactgcccacggtcagtggcccatgtgatgatgagctttgcgtgttgtactgttgtaactgggaggcaaaggcaaacgcgacccggaaatctcgcgcggggcgcacgacggcgggcggaaatgagctcgctctccgcgcgcctgtgactgtgactgtgactgtgagcggccgacggcgaggt

SEQ ID NO: 1804 - DNA, 2445 bp, Zea mays
  misc_feature (1)..(100): optimal_loci_120290_G1, chr3:175539793..175542237, Cluster 11
gatagtatataccttgtttgataaaggaagaaaattaatgtgtgcactaatctttcttaagaaatgagtctcaaaattaaaggtgttaactagttagatgctagtacgttgctacaatagtgtagagtataaaacctggacatgtatgttctagtggtttggtgccaacaaacactgtttgaatatctacttatatattatttttagtttttcttactatttaaacgtggaggagaggtgtagggaaactatgtagtagtagtagagaagtcagtgggatatggaaggatcgatgggcacagttataggtggcgggaggagattgaggcgatccaccgttggagggcggggcccattccaagactgatcgcgcacatgagaaacgccaagaaacggtccaaaagtagctaaaactaaggcgcacaaagctgccggcccctcgctccatttgctatactatctttatccaacccaggccaaatcttgaaatctaggcagggagagtagtgacgcgcacactcaacacccgtcgtgttcgtgtacgctctcattctcgtggtcgtggtcgtggggcagggcaggtacccggtgtgagtgatccgcgtcatgtgagggcgcatcggctcaccacaccagctgcgatcttccgttccgtcttcggataagcaagcgctgtccttggggggcgcgatgattggggagatcagatcggtcatccgatccagccccctgatatatatgcgtatggatggttggctggcgtaaaccaaagctgcatgcgcgctctgattcctcgatctgcccccgtccccgtccccgtccccgtccgtccttggcctgtgtgtcacgtccgtgtcacctcgcgggggcagcgcagcgcagatgcatccacaccaaatcttccatgggatcgtcgccctttatggccccgtttgtcgtgtttctcctcctccaacgcaccatatcgcatcagtgcctgcgctgcgcctgcgcgtcgcccagcataggccagtagcccgcagccgctgggcccccgtgtacgtattgaacaggggaggaaggaagaagagcggttgccatgccacgcgcggaactcatggaacacgtaaggagacgccaccctgcgtacgttacatctgtcagcgctcagtgtcctcgatcggctcctgttgcacagttgcaggatgggacgagggcagtggccctcgcgccgccgccgccgccgcacggatcgagcgcgcgcgtgcgagacacacgtaccccgccccgcatccccccctaggcctacccctggtttatagtggccgtgtcaagggccgcgcacggaaaaagcgttcggttcgtgatgaaagctggccgtcgccaaactttgccaatcacaagtcgccatcacatcccaataatactgacacaacacaacacaacacagacccggtcctcagctcctgaccgctgagcacgccaactgatgagcatctggttttctgccagaactggtggtacagagaatgcaatacgcgtcaaccaccggcgctgattgatgtgacgaggggcactacactaccaccggcgctcacccccccccccccaccccaaccccgtcggaatcagtaatcacgggctcgcccacctcgtggtcgcctcccagactcagtcccagcgagggagtgggaaaaacacggcggccagtcgggcaccgcacgaacgcaaaagcgcgtgccgccgacttcctcgcatcgcctgtcgccggtgggggaccaacggccacggtggctccacgtcatcaccagcgaccaaacggtggctccacaggggcacgcgacgagatcgatcaggcccagcaccaagttgccctgaccggaacccgcgcaactccggcgccaaaggacggcgagggcgaccggaatcacgaagcgtccgcggatctctgccgctagatagattctctttctctgcgtgtatcccggtcactgccacgggccaccagtcgtacgacgtacgtgctctgaagtagcatgtcctatatatgagctgtgtggtccatgtggtaccaacaacgctttgttttagcaaaccgcacgctgaagctcaagaaccaacttgcaatggcatcagatcagtgtggcgtgtgtggaaagtgaaaagagaaacgagcgtactgcatgcttcgatccagtgctagagcaacaccgaatccaaactctacgagctcccattcccaacggcaaaactcgtcttagctacgtacggttttcacatcgaaaactagctctaagtcttttatcaaagcttggctacacaaagattacaaacaggtataccttataactatgaaatgttcatccgccgaaacttatatataccatgtttagattaactagaataagggccagtttaaattcgttattagtactaaaattagctagcttttctctcaaaagatag

SEQ ID NO: 1805 - DNA, 2151 bp, Zea mays
  misc_feature (1)..(100): optimal_loci_120729_G1, chr3:178151264..178153414, Cluster 11
atgactcgatgtaattgactaagattaatatagcttccttttcaaaaaatataaattgcgtgaattgagtactcatcttcggataacattttattatcagtggccaaagcaactgaagcgaccacgagacgcgagaaatatcgtgtgcaatccgtgcctgtgagactggccgctgattttcctgacgcataaccccgcaacgtcgatggcgtatatccctcgagaatttcctcccgcgaaagttatcgctgcaagcaaaagttgcccgcgtcggcgacaccatggtcccgttccgggcctctccgcccctcgcgcgccaccgtgtccgacaggaaatatcccgcgcaacggacggcccccgacgggcttcacgttcctatcccgccggcgtcctccggtccggcccctcccgaagatctcccggaccgaatcagctgctagctagctagcattccgctccgcctgcgaattggacggtcgaaacggtctctagggtctaggctgtggaaagagggagagaggaccagtccgtccttgcaacgctcgaccgatagtgcacccggggggggggggggggggggggggggtggcgcccgcctgggccaccccaggccgccgccagcgacaggtgaagcgtctgccggggggcgctggccatggctgccggggcaatgcaagctgccaaagctaggtgcgtgcaaaagttggatcgccatgccatcactggcgcgcgcgacacagagcggcagcgtgtgcgtgccgcttagattttgttctctccacttgtcgacgacgacgacgctggtttggttcctccctcctcctatgattctatacgaagtgtttcttggtttcgctttttttttcttttttgagacgttggtgcgctgacagtgccatgtagggtcgtgccccggctagtgcctgcctagcgtggagaattctgagaatgaccttagatggcggcaacctcacagcgccagggtacgcgttagaaaatgacggagatgagagagcgtcagtggcggaacggaaccagagaaaattagagggcggtgcgtttgtcttgtaggcgttgaaaatataggcagcaactatggtgaaactatgattttttttttagtggtggtctttcgatatttttgtgggcgtgcatgcgtagcttcgacgctgatgagcgctatgtctttttaagtttttactttccgaatgtagcgaaaaggagagaaagaagcagaatgggagcagtatgccttgtgtaacaagtcagatttcagccggttctctcgaagcaactcccctgcaacaaattgatatgtccgaatcaattgtttgggctaagaagatctgagtataccgattaatcgagcataccgctaatgctactgctataatgtctgaactctgaagcgtaacgctgtgtgtatgtgacttgtatactatggaagtacagagttgcattcgcgtctactagatgcgtcgatgttcacttctgtacagacttttgggcagcctgttcaagccagcaaggcgttcaaccgtgttacagcaggcaaacggttggtagcaaagatgactgttccaccattgtgtggtcatccttcagcttaaaaaaccctttttttttccagttcagcgtgtagatctcaacatctgtgggtgtaaagattttgatgtccctgcgcctcctgctgtttttggcagcaagtccagacagtgaagcagcatcgactcggtagatagataccataccaatgaaatctccaacgatcaccaccaccacatgtccagacgaatcaagttggttctgctcaatggtcccgaaccacaaagcagatctgaacggtgtccacctcccgatctagcctagctacgccgtcaaaattctgaaattaccgagacatacggagcactggaaaatcgtctcgactcggcactgtacctgctgctagttttccacaccggttagttgaattctgcatgcgctgttcctgttcccctccaagagctcgtgtcgtgaccgtctctcctactaaaagcaccccccctctcaaactcaaaaaaaagggggagtgacagtgtttgcctgaaagaagtgagcactaaggaaggttgatggaatcagacgatcttttctctggatggaggcag

SEQ ID NO: 1806 - DNA, 3003 bp, Zea mays
  misc_feature (1)..(100): optimal_loci_120998_G1, chr3:179435768..179438770, Cluster 11
cgcaggtgtagatatatgatcgagcagcaacccccggggcggaagggatcaggcatttagtgcgggaactagcagataaaaagatagagattcccatcgcaggcataacgcatcacactcgtgcacactctgactctgcactggcgcgaagaatccacatgccactgggcctaagctggggcacggcatatacccacccagcctatgaacccaaccgcctgcttgcttgcatcgcagtcccaccctctctctctccccttctttgacttcaccgattccatcgtcaccactcgccatggccaccgatggcggccgcgaatatccaccccggcccctccgcagtcgtccccgactccactccttccttcccacgcctttggcccgcggcccggcctcctctctttccgtgccggattccgcgagcgtttccgtgtgttcgatcgattccgtccatcgcgacgcgagtcagcaacaagtgtcgcaccgcacgagagcgagccccaggaccaggatcctggcagtttcttcgatccaggctttcccggccgtgagagggtgtctcgttgtcgcctcgtgcgtgcgttgccttttggagatgtgggcatgcacgtactacgttggagtgtccgcgacgaaacgaactgcgggctaccacgtacgcatgcgaatatttgcccggccggcggcgagcgaccacgacgacgagcgcacgcacgcacggcacctgtagccctggcataggccggagcatggctccgtcggtcttgcatgcgcgtcgtgtcgatcgaccagcgtacgtgtgcatgcgtttggaccgtggaggggtggagctggagtggagcgatctggtgggggcggagactggagatcgaccgccgcttgcctgcatgcggctgtgccgaactccatatggggctggggtttgttgggatggtccaaaagccgcagcaagctagtagatcggatcgcaacatttcaacgccgggatctttgaatgcgagagggcaggaagaagaacctttgccaactggatcgcgcgcgcctgttccgaggagttggccaacctgatctgctcacctgttgcctctgcgttgcattggccacctagtactagtagccaagctagcggcacgagtcgatcgcggcacgcaagccgtgcgtggcattccgattcgtatcgtacgtcgtccacacatctgtcgcgccgccataggctccagaccgaggcatgcatgttgcaatcaggcgcttgctttggtgtacactgtacacagacacagacagggtcctggcacatcaacacacgtctcgtgtgccgtcatcatgcaattaagcgatgcatgtcatcctcccctgactggataatccatctatccatctatctgtttatctgtctatcctcagaaggagcatgacagacggacacattgacactgtccgagtgcctgatccggccggcagtggggactaccgtaccgccggaggctagatattatctgaacatgagaacatgcacggcgcacgtacgcacacatcgcggcgcggcccggcccggcccggcgatcatccttatctcgatatccttttgccaagattccgcccccgagatcgagcaagatctgtccaggtccgtcgataccactggcaccgtaccgtctcgcgcggcggccggcggggcgctggggtggccgtggtcgtggtccctcctccgttggatggaatcggcgtgaaaccggcagctagcctccgccgtcccgtccacacgatccgattcgctctcgcgatttttccatacctgcaggctgcagcgcaggaggcgatccggaacgcgaggccaatgcttgcgctcacggctcacggcacgtacgtgctagtcacccaataatcgctgcgtatatctttcggattcggagcctacacgtgcacccccgcgcggcagctcgcatcggccggtaggcccgcgccgacgtgtcgcggatgccgcgcggtcctgccctgccgcccgccgccctccgttccctttctatcctgttcgccgccgacggcgacgcgcgggggcgcggtgacgggaacgacagcgaccgatgctgccggctgccggccgcgcgcggccggggctggctgatcgcgcaccggaaaaccgtctatgtccgggccatggcgcagcggggcggggcggggggttaaagcagaggttgatggaaaagcagccggatgcggggaatcatttgcgggcgggccgggtggaacgacgatccaagcgagccgcccgcgccccccgtcgacacgccgggcagcaggtgggtacggcatggacgggataagcagggaagagaattcggcgccaagcatgttaagtgaatgaaggcggggagctttttgggagccgtctaatccacggcctgggaccggaggatggataaccaatggactcgatcgtcaggttccggctggcccaggaatatagcaggatgttgttcgctcagttcgggctagccaggaaggcagcaagctgcgctgcgcagcgcatagatttgtcgggggcaatggaccattggagtgctgtcgggagaagggtggtttgcaggaattgccacattcgtggttgtttttttgccactaccaccaccatatcgagtcgcctgagagtttctgaggccagcattcaatgttccttgtaatctaaaatcccaatttaccggtcattttatttttttatagaatcaaaacatcttaaatttaaataaattattcaaaaaagatagatctattatgatattaaacatgtatactgtaaataaagaatctaattatacatggacgatatcataaataaagcatataccatttctaaatttccagattgaccaaagaatagctccagcaccaatgattaataagttcctaagattcttattcaaacccactagccatctgccaaagaggtcatccaaatttgagagattctgataattgccatcagcaagaaacatgtttgtaaaa

SEQ ID NO: 1807 - DNA, 1550 bp, Zea mays
  misc_feature (1)..(100): optimal_loci_121905_G1, chr3:184074381..184075930, Cluster 11
tgaccatccttttagaccgcacgcacgacacgaatgtacattagcccctagggcctaggcatctactttagaacatgtctatgtattgcaaagcgatcgaagagcgcgcgggacggagccggccggcgctgcgtgcgcttttatgttacgaccgggcatgccagaaaaaaacagacccgggaaaactagggagaaagtcgagctcgtctccggtgacgtcggtgtagtggtgcaatccgttcatggaaatgccgggccctttcggatcgcgtgcgaccgtgcgtgcgcgaggaaaaaaaaaaggtcgtgctgtcgtgcatgagtacaagcaacggaaaaggccgtctgaacccggttcactggatcgggccgcgtaaataaaggagcgaaaacgaaaggaaaggcgcgcagcagaaaccggcgagaggggtagaccgcactatagtactcaacttcaactcacctgacccgacccggggcgcggcgcgcgcgacaggccgtaatgcgcgagcgggggaaacgaaagcaactgccggcggcgcgagggcacaccgcccggctcgacacggccagagcgcagcgttattgctcgcgggtgttccttgagccgatcgagtcggctggcttgcgcaccgacccggccggccaacagctagccctttgctcgtccgagaggtcagggctttccgcccgtgccgtccatggcaaagcgcctgccggcccggtggaggcggtgccgtacgtcgcgcgtggcgtggcgggtcacggcgggcgcaccaccgccacgatccagggtggggtccgttcatttggttgggagacccaacccaacggtggttgcgtacgttgctctggtagtttgttcagttgccggaagacatattggtgactgagagagagaagcaaaatccagccgagctgactctttttttttcccttcagtcagtctcagtcgcggactctgctaccaaaacctgtaggccgcgggcggggccgtgtgagtgagtgataccgcttgtccgcttgtcctctttactgctgctgctggtaccgggtctggcatttaagccggtgagctagctgaggcggaccggccggaaagcggaacaataatgaattcgaacgaggcgaggcgaggcgctgccagccgacgtgccccgacagcgctcgtgggggcgcggcgcggcgcggcgcgccaggtgacgccaccgtgacgccttggcgacgtcggaggccaccaccgtgggttggcgaccgtgcgtgcgagcgcgatgacaagaggggaaattgtttctactctactagctgagaatagaaaccaggaaggagcccaagtggggggtagtggtcggcatccacacgacccagaagaattgagggcacacagcacgacgccggctgtgttgcacgtcacgtgtgcgtgtcgcggccacttcggtctcgtcttccgccttgcagtaccctacacctacacggaccgaggcatccaacaaacaggtcgatgggtcacctcaaacaccgccacgaatctgctggagctacacgcgcgc

SEQ ID NO: 1808 - DNA, 1595 bp, Zea mays
  misc_feature (1)..(100): optimal_loci_122291_G1, chr3:185939930..185941524, Cluster 11
aattagagggattatttgaatttataaccctgccatttggaaagctcgtgtcttccttgtaaattttcaagtgatcgttgacaaaatgtaagcttgttactattagcaacttagctaaaaagagatttgattatatgacttgtatatttttgcatgaaagcagttttgttaatcaaattttttatcgttatgtgtatcaacgtctgaggaagcccatatcaccagatggtaccaatacatctttcaaagatcccaacagaaaaattcaaagaggatccaactaatgttagtcatgcgaccccagggtcctaagccctaggggagatggatcatcctcaaataaggttgggtccctcacacttggggatcggtcccggggcccctagacttacaagattctctcggtcttcgggtcttgtctggataaaagacgaatctcgaggcctagggccacgaggctctcttggtgctctttcgatctctcggaacccttagtcacacgacctttcgagctagtggttgggtctcaaagccctcttgggaccctaagacctccacatgggaatccaagtgctccgttcaatcaactacgatggcctctatagactaaggcatataaccaagcctcatctttaggtaggagggctttagggggtgcgaacatagagccatggccacctctaatcaagagggcgatgcaatattaataatttggataaggctctcatgcatcatattaaatgtgatggataatatcgcgataacggggtgcactatagtcatgccaagggcagtagacatgtcgagacactatgcggtgcacgcaccacccctatagccatgcctaaacgtgctaagttgcctataagcatcataaggtataagaaactacactatttaccaactacgccatacacaacaacatagactcgagtacctcctttacgagagtgcatatctgccactatagaaagatgtagtcaacaatatggaatattcatgacataccatcatgtatggttccacattcgggatgagatagagcagttaagcctttgctattaatagggtccactttcccaataggtatgtgtccttctctcctcacttatattataatcattattttaatcatcaagatttgcgtataaaagtgttctccaaaagaaccatagagtctctctcagaattaaaaacctaaattaatcctgtaatatatctaatcagtgcctattttttccctcaaatcctcgtctacttaaaaggaaaaacatcctgctcgtccggactattccataggcccctctagccggctggatcatgcgcgccgagcccaagccaccactttgcctccgcgggccaacctgctctaaaatcgcctgttggaccagttgggccgcccagcgcctttacggggccgtctgcgcgctactgcccagacgtggctggaccgccccggctaatgggccaacgccgtccacacggctgggctggcaagcgcagctccctgtccgctggagcacgctgcttgatcttgagccagcgccgtttacacaggtcgcaggcaagcacgcacgcaggatgctcttgagaac

SEQ ID NO: 1809 - DNA, 1784 bp, Zea mays
  misc_feature (1)..(100): optimal_loci_123394_G1, chr3:191780323..191782106, Cluster 11
tgcagcacacgatgcgccatgcgtggcggttgacgaaagcagcagcacgggtgctgggagctccttggcaccgtggccgcgcgcctgcatgccttatcggcatcgtcgtggagcccgccgctgctgctgggcgcggtggcaaggctaatcgatcggatcccgctgcctgcgctgctctccccgtccccgatcaacctgaaccggccgagcgcgatgccggcgggacgtcacatgatatgcatgcatgcactacttgagccgggccacggcggcacgagctccaacaacagaacactttgaccaccttttttatctacaaccggagggacctaggaagagactactgtaataaataaaacaaaactgttttttacatcatgggccaattcagcaatcttgtctcggcccattaggcattaaccatcggtatcacgtttacattaccgatcaacagcactacagccgcaccagcacacgccctaaaccccgcgggtgcagtggtagtggtacgacacgtgtccgatggctcggtgggttttaggatctagtaggggtttagggtgtcgtgtactcgtgtcgaccttgtgctgcggcggcaacggcaagtgaagcctcgctttcgcctttcggtctctagtctgtgtctctactaggggcgctgactgccggtcagcgagccgccacgtaggcaggtaacgcgtggactctttgacccgggagaaagggctacggaaacgcgagtggacccggcgacgactcggtcgtgacagcgactcggtagtagtaactcgctcaggtagctagctagcacattttttgcgtgcatgatgacgactatttaactgctttaattattcactgggacgacagtctcagccgcagcccgcaggggtcttatcagagttttatttatatttaacaagctatatcacataaattcgataattatcataggatataaaaagaagtgtcttttatagtggtcaaactatctcgacagggttaccagctatctataagttataagattaaatatctataaaattatagaatgcaatttttttatactaaaaatatgttgtattcatgcatgattttatgctttattttattccatatgatatgacagtcttgaaaataacgccactaaaactgatcttgcccattacaaaaatgctgtgtgcgctttccaacttcccgtggaggcgggtagtttggtcgtgtcaaattgggcctttttgaccataatatattcgttggggtgatgcgtgcatgtacaaagctgttaagctgataataaagcttgtttataggctgtgcttgtctgcttcttagcggtcgaactcaccagggaatgtttgaaattagtactgaccatgtgtgaacacacacactacatgaccgaattgctttgctgaccaatcgccttgacttgttgggccagcgagttgcacgcagtgccgttataaggtaagggatacataaatcaagtgttcgttgagaaaacgtaacagtaaaaaaaactgaagcgccccttctagaaagcgggacactttctctggatccttggtgttttatatggaattataaactatgttctgtgattttctgtatatcttttataaaattcctaaagttctaaagagagaaccaaagtatatgtgtatacataagggttatcaatattttgagggttcataccccaaacatgagaacacactagtgcacgtgtttaaaatacagtacgtggtggatctagaatttaatagaaaagagagttaaag

SEQ ID NO: 1810 - DNA, 2284 bp, Zea mays
  misc_feature (1)..(100): optimal_loci_123992_G1, chr3:194873122..194875405, Cluster 11
caaatgtccctagaaaatcatgggataactcaataggcccttactgcatgctcaacaatgacccattaccagagtcagttctaatgtgggaaggtcctaagtggccttaatgcattgtcatgtaatgatgcaatattcaagaatgtgctctagctggcgaagggtagaagtctaccagtgaaagtctaccatagatccatgtattgcggccctttctcaattcgtacgcgacttgttcgatcgtcgcatctcggcgccggcggccggcatggatctatccatgatggggttgggggggctttgcattggaagctagcgctagcccatccgccccagtcctactcctgcctgccgcctgcgcatctcctagcgcatgcatgcacgcatttctgttgcagctgctggcctgctgcggcacgcagatgcagatgcagatgcaggcagcagcacagctcagcccgctgccgcacaggaactaatggccatctggctctctctcccacctttcacctattcaatgtccctgttcgtctgcttgcttgctagacgctagtggccagtgtctgttctgtccccagccagagctaccaattaagtttgcctcgccttcgcctcctccatccacgatccatccatcctccctcctccctctaaataaacaccggaccaccaccagccttctctcctttttcccagctcgcagacttgcagtgctgtggtgaccatgcatgcatacggcattatattgcagggcgcggtcaaggcgtgaagcacgcacgcagacgcagcctcatatatcagcctcaaaaggaaagggccgtccggccgggccgggccagcgtgaaatcatgaaactgcatgcgagcggggactaccatgcactaccggctggatctgactgcagcgcgtttgcatgcaagtccacatgcaagcgcgcgcgcggccggcggcggcagggcagctgctctgcctctgttctcgtgtctcttaattctggccggccggtggtggtggtcttgtgggagagggggggtgcagtgcagtgggccggccgggtaacgttgttcataagagaaatgaaacgacctacaaatggatggaaccagagaacgtgcatccacgaccgaccaccagctccaagtctctccaacatgtctggaccagactaccgcaaccacacatccagagtcatccatgcatgcaggaaagcttgtgtcgtcgctgtcgtgtgtacatgcatgcatgctgatgcccggccagttgatgcgtatggtctccgatcatgcatgcaggcaaaagtgtttccgaccgtttactgcaggtgaatccacgcgcgcccaatcgatgttttccccccggcctccgatccatttacaacaggtgtacatgcattactacgtctgctcctcctgttcctgctgctgctggtggtggtaggggacctctcgatcgatctgatgagttgtccccaaggaaaccaaccaaccaacctatatatcatgcatgctgctctgatggacaaaatgagagttacatatgcgcgcgtcacttgttgcgtcctgctaactctaagcagacagcgcctcctcaagctagtaggctaataggagtatatatgagtactactccgtatagtatatatgtataagatactcgcacgcatgtaaagctttataaatgcgacgccgcggccagaaagcgacatcgatgcatcgcttcgatctgggtattactccgtatgttgcagtgaggcagtgatgcagcctgagctagagtgcagccgcagtgggaaaaaaaaaataaaagataaagattgcttgcagagtgtagtactcatgcatgcctgcccgtctagctagctccttgtttggaagttggagccgccaaatcacaacgcgctgtgcttccattaatcctcttgggcagaacgcgcgcgcgcgcgtcgtggcgagagacactgctcaactgaaacgtaacggtgcgtgtcctgaattggtgatgcatgcatggtgaatggaagaactagtactagtatatgattagtcgtcatctttgatttgtgtgctgattcaagtgatctgagcaggtatatcagtgggtgctagtagctgactgtatagtgtatagaccagtccacgtcaggccatatgaaccagcagtggcatcatattctgatctgatgcatgcatgccacactagctagacccaacataggttgatccccatgcgtaccttgcacttcatagtataaccttcgttctcatcacacatcggtaaaaaatac

SEQ ID NO: 1811 - DNA, 2171 bp, Zea mays
  misc_feature (1)..(100): optimal_loci_124131_G1, chr3:195732164..195734334, Cluster 11
ctgtatgtctttgtctcagacctggtttggatactctaatattaactccaatccacatgcgttgaagtcgattggagtgtaatttagtttaagttacactccaatccacctcaacacatgcccaaataaatcctcacggtcacgaactgaagccctgccaaaacaaatcctcacagtcaccaactggcggcagtcccagcaccagcaaggagacgcggcgccgtttcgtttgagcaatgtgccctagtgactgtccggtagtccctctcagattactataggtttagttttgggtctttatggactgtaggattatatgctagctagtggtagcatttgaccaccgcagaaatagtgccttagtgctgaggttgagattccgcatgccttcctcaaggagaggctaatctgcgtagattatatgctagtggtagcatttgacgaatcgtgagaggcgtccatggctttgcttgcatactcgacaatttgacgaatccgtagaactgacgctgcggcctgtggcagtacatgtactgaatacggtagacgttattccacgcatcaccgacaggcgtgcacgcacaggatggagcgtctggacagtggacagcaaccatcctaacaacgacacgtggcagtaacttaaataaacaaaacgaaacggctacctacgtacacgtagcactacaagcacggcaattaatccttgcattgcactgttgtatagtgtatgctgctgagcagatcacgtcgactgttgatggccggcgtcactaacacgtacggtcgtcgatccactagctctagctccggtagatatatagggcagggcacaggcacaatcgcagagatcgtcagtccggttgcggcagacagggcaagaggggaggcacggccgcatcactagccctgccggtgccgggaggtgcccagcgcgcatcagatgcacgggctgcaaaaaggatcgtatgcacagcacgacaccaggtgtggccgtgtgaacgaattcaggagtcaggaccggccggcgcggggcatgcacgaggtggcggcgtgtgaaaagtgaacgcgcggttctgactccgactccgatcccgatcactaccgctcgttactcctgtcggccggccgcgatggcggtcccgttcccgtggcctctctcggcaggacggggtcacgccatgtgcgcccgtgagcgctgccgtggccgcgtccgccgcgcccaccgtacctggaggctggaggcttccattccattccgccggattccgacgatctccgaaccgaccgtttcttctacggctgtactagtactcctacgcgacacgcccatctgctatagcccgtacctggcgtacggtagagtggcaactggcaaggcagtgttcggttgttgacaccaccaaccactctcagctacggtaggttgccttgcctgccctttgtgtctagatagctctcactgtgcccactgggctgataaatgtactggcacaccgcggaccagcaagtgcctactctacttctgctctgtttcgtggtactgcaccgttcatcaagtagctaagtagcttaaccggagtggtaaagagagcacggacgctaggcgcttcgttgtcacggagacggaggaaatccagagccagcagtccggccggtccgagagaaacaaaattccaggcgtcatgcgtgccgacataacataacataacataacatgtggccatgctcaaatattaattccagcaaaccatctcgaaccacgtcgatactttctcgatcgtcttcttaattcacctcgttacctctttgctcagacagaacgagtgatggtgaggtgtgttgattgaagatacggtacggtgtgcttcttcagttttctgtcagtctcggcctcgggcgcacgacactccatctctctcaccggccctccgttgcagagcccggccgggcccctggagttcatcatactgcattgataccacatctccgtcgcgtgaggcgtatcgtcgaagcaaagcggagaggcccctgtattaatactggccttccagcctgtgagtgagctgcattattaatttattattgtcattaaagggtctttggactcttccttctcacgtaatgagcctacaaggttccctgaattggaatctctcttccaattttta

SEQ ID NO: 1812 - DNA, 1923 bp, Zea mays
  misc_feature (1)..(100): optimal_loci_124791_G1, chr3:199608891..199610813, Cluster 11
cgtgtctaaacttaaacttttaaaaaaaataggactaaaataagaaattatggacgagtccgctactagtagctcaattcgttgttatgtacatgtacaattgcatgcatgcgccaccgataacggtgaatttaaccgaaaatattgacgggtcataaaaaagaacagatttgctatataacatagattttcatgaacctttaacggtgcttcgctaaagaatttataatttttttatgggggtgggctcaccctgataaacacccctatagattcggccgttgccaatgccaccggacgtgataggtgctcgcataaatgtgcgtttgctggcggttcgatcgccttccgtcgatcggctggctcgatctgcttcaacttaaattctgattgtgtgcgctgcaggaggagctagctagccagactggaacaactggtattcgtactgtatataaagatgtagcatgagtacgtgtctttctggatttttggttggcgaggtaatcaatatttctggatatatctaaattgcaggaggagctagctgggtatatacacctgaaattagtgtgtatcggtacggtgtatatgtatatataggtgtttaagctaagataatcaagagctagcccgcaacttggttgcatacatgctccaataccaacctgtcgtgggtccctccaataataatctaaatctatgtgtccagtgctaattcaacatacttcctcgaaaagaaaagaatgaagacggcatgcacagtaaaccaagcgaccatgcagttgtaattgtatactacagttctaacttctaaacccagccatgaactgaataatagataatataatcgtacgtacgcttgatatgcagcgtcgttgcacggttcaattggtctcacttcaccttcgtcccgtgcatctcaccagcagcacgctttatttggtcccgtccggtccaacagtgagtggcgcgcgcgcgcgcggcgccccacgccagtctcggtggtgccgagtgccgacggggtcggggtatactgatcaggcaccatccatggccccggccggcaccccgagcagaccaggaccttttttttcgtgtgtggagacgcatgcatgtgacgcaacgtctcacctatcggtggcgcacggacgaccgacgatatgcatggatcggcatttacgcgatcgtgctgggaccgcgtgcgtgtgctcaatcagtgtgttgccgctgtgactgtgaggcttcgcattcggttatgcaacaagaggatcatcgagagctcgatcgtttcggtctcgccggcggcccgggttcgtgatgagacgtagcactagctagctagcttcagacctcatcacgagttcgttacacatgtgcatatggccatatatgcatgtcgtgaaccgtcctgggctcgcttgacgtttctgtacggcgatggcggatggccgccgagcgaggagcgctagaaccggcagagcgacagtgtgcatgccatggccatggcatgccatgctcgatggagtgacaggggggggggggggggggcgagatggtgctcgctcacatggcagtatcgcgatggagaacctaatccgatctctgtccttgtccggtcttcaaagcagagggggccgggccctccttggatgcggacatagcctatctggcaggtgatgtgacacccgaatacagtctacagctacaggagcagtaggagtttcgtcgagcaataagtaaatttcgctgcggctttggcttctactttttttttctactttattatagctgcactataatagttgagctgcctagtatatgcaatccggactatttatgcgatggtagccaattgtaaaagctggtttgggaaattacgcttgtgcctatatataaaactaccgacggcgcacactactgttt

SEQ ID NO: 1813 - DNA, 2075 bp, Zea mays
  misc_feature (1)..(100): optimal_loci_125238_G1, chr3:201999656..202001730, Cluster 11
ggttaagtcagatcgagtgatccatgattagatatagaacttacacgcaagtacgatgagcttgtgcttcgcatcgcatcgcatctggtatatgtgttccggttcgataccgcaacaacacataaactcttttagttctcataaaacaatattgaaattcaacttcaagcgcgtgaataaccctttgacattcctcctatttaagaataattcttgatgtgtcattattttttttcaagcctctcgatattacaatcatgtcttagaattcaactgtacacggatgtttctttgaacatgtacggtaccgatgtctctagtggtctccattaaatatgtccaaatctttagttaagatgttgtcgggttcatcacaatccacatcattaaaataaattgagataaaatgcaaactaaacttcactctaatccaccttaacacatatgaaataatgtgaattcgactacatacaaataaggcatcaagtgttatctaaatgttattagccccacttgtccgtgcattatcacggtttctattatgtgtgatttattggttaggtggctgtgaatgtggagctaacaactgaggttcaaatcttagtttatgcacaatgttactttatttttgtttaagtggaaagattacatagccgatcaggctgataccgttcctgcgggctgcggtaaataatctttgcaggagctccgcgtgagtggctgaatcttggactggcaaacgaaaacgacgtccatttttcaacaattacatatggctctgtttggaacgagaggacgttccttacggagagccaggttgtttcccatccggcctgcactgctccaaccataaacaatggctttctgtgataccagaagccagtgtgtattcagattcaggacttgaggtgacgaagaggtgccatgcatgagtcagcatcatactacactacacacgtttacgttgccaacttttagatagtgcaagagcactgcagatgatcgggtagtgcatgggtcataagactactactactacaagagagtgttgaaggaggaagatgcatcaatcctagatccgttccagttgtgtggatacgtatgcgtttacatataggaacagaacagaacagcacaaggcacctaactcccacccgctcgtgtgcttacgccgtcaaattctttgctgaaagcgtcatcatcgagtcaagattaaaaagaaaccaaccagcagctgatggcaattgtctggcggtcgcggtcgcggcacggtaaaaaagcgacgaatgactgggccgcgtcgtgctgttgggccccctaccggcctcgcggcgttggttctgcacggcctcgatccgcctgcctccgaaaaccacttccccagaagcggacgccagcccgcgcgcgctgtggcagcacagcagaggcagaggcagagccagccaggtgttcgtcggtcgtgttggattgagcagagtccacgcttccacaggacagccagcccctgtctgtggcgcgcccactgaccgtccgcaccagcggcgtcgctctcactcgcgcgtcgggctatctccaacagacttcttatctcactgcaaaccatcccatggccttctggagtacgtactacgagcagccattaatgttgaacacgttggcaagctgtgtgaccgatcctctacttctcgaagtatcagtgggcgtgggcgtgggcgtgggcgtgggccggtgggcgtgtggtttccctctgctcgcgattgagagggatggatcatggatatatctatcatatatggaatgcatcgaacggggtgccatgattgatacaggacttcctggttgatgccgaggttttcgctctacgctaaaactgtgtatctgtgcatgtcacgccgaggacggaagaagacccgattcatgcaacggtgcaggccactcgtttcatgcgcagcagcgaataaaccacacgtaataagcaacggtgcaggtcataagcattgactagcggtctcgtaagtgactgttagatagtgttcggttccgcagccagttaagatgaaactgttccatacctg

SEQ ID NO: 1814 - DNA, 1998 bp, Zea mays
  misc_feature (1)..(100): optimal_loci_12600_G1, chr1:69093901..69095898, Cluster 11
aggttatcattatcgattcatagccacaaaccgacaatgataaatggactatatcactattagttagagccatacaactctagcgatagttcacctgtcactgcaagtgtactaaccatgaacactgtcggctccgccataatcaataacgacggttcaatagtgactgaatgttttgacagtgcgtgacatgccacaacgctacgggcctacgacatgtatggaattagggctaagactcagctagtatgacccgtggtacaaggtagttcagtagttgtcgccatgcttcttcctagagaagagggcgatgatggagagacgaggatgacatgggatgatgggaggcgaattgaagcagcgtggatccaactatgacctccaatagcgatgtgttgcacaaaatgacggctgcgatttggaaagttctttcttgtgtcgatgacaatgtggatgaagtgtgcttacatatatcaaaaacctaaagtgctagctagttcttttttgaatggaaaatgctatgcgcacgaccagaatagtcgactgttgtacaaccagtaaatatccaccattggttgaatgtgatcttgaataaaaatacggttttaaatgatgttttttgaagtcttggttggttcttcaacgttgatgtcccgtattctctggttccgtattttcaacgttgaccttcacaaagttgaagtttgagcatagaagaccttcgcaaagtttgggacatgttgaaagagtttgattattcaaaagcatagctcaatagtgccaaagcaggagttttggactcagtccgtgaactcagtgtttccactgacactataatcttccgtatcatttatctccgaatttatgatgtttatgactttggtaccttaaaaaaaaagataaagagtaatctgcggtgcggggaacattttcgctatagtgttcaaagactgtgtccgcttagaatttgcattttcagtgctcactcatatgccggccctgctctggcgctggcgcctgctgcctcgtcgcggccgccgcgacgacgacgtccctgccgctgccacccttgaccgcgcgcacgtgccagcgccgctcgtgccctcgcgcacccttcctgagcagaggtccgagtccgaagccgccctcattgcccctttggccttttaagccatggcggtcgtatctctccccttctcaggaatccccgcaaaagttcgctctgggttcgccctcgcctctcccacgtgcgccagagacggtgagcctacctcaccctcgctctcggtccgctgtcgccgcagtgcagccgcccgccggacacgcagctagccgggcggggcccctcgcacgcaccggtcgttgttgcctgcattgggtgcggccggacgcggggaggccctccacgcccccggcgtggttgccgtggccggcctgctcctcgtccctgctcgtgtgtgtttggcaggggctcgcgtagggacgaagagatcttttgaggagacttttgtaaagtcgcgtacgaggagaagtttctcattttggacaaaatagtttgctagtttcgcggggtcctttatgcatttttgcgtggggcagcgtgatgggccttgccagccgccttgtgggattctgccctggccgcacgggccttttgcacgtctcgttctgggccggctgcgcagcgtgcatgggccatggcctgcaccaggtccggacccgttctggttggaggagtttactttccttttcctttttaagttgaagaacttctaaaattcagcaaaggtcgctgaaaatatttaaaaatggaaaacattttttgagtttctcatgaatgtatttatgcagtatgtttacaatatcctgttttttaatatgaaagttttgttgtaaatgtaaataaatggttttaggttctcaattcgtagatatagctagggtaattcaaaagcagtgtaatttttatggtagaatagtataaagatgtatgggcta

SEQ ID NO: 1815 - DNA, 1506 bp, Zea mays
  misc_feature (1)..(100): optimal_loci_126660_G1, chr3:208767485..208768990, Cluster 11
caatatattgtctagtttctttattaaatccaaaagggaatttgcgaggtttgaattcagcatatatatgagcagtatatgagtcacgatcccacagatacctgtgtcccctagcttgttcttgttggttcccaactgcatgcatgcatgctcttattacgtgacgtacgtggtaaattaaccgcgccatgaatgaaccccatgatccctgcactgcatgcgcaaacggtcgcggcaaaagcgcatctgcggatggggaaaggaagacgaggagcagcgccaggagccaggaggcagcgagcgcgcgcgtggcgcggacgtaaacgacacagcggagctatcagctgacacgatcgagctcgacgacgacgagcagagcagctggcgtgttctttgtgccaaggtcgcgtcagcagcccacggtgtattttcctaccggcggcaactgaaataatggctcaaaagaaacacaggtgacaggtaggggggcgctgggcgtcgtcgtcatccatcgtctctccctgcatgctgcgctagctagctgctactcgacgtccgtctccgggactgaaactgagagccactgtctgtggtcacatgtttgtttaaatctaatcgtaatgagatactaaactataaactaatattggcttgttcaaatttactaatattcgagtataaatcattactattactatttacgttatatttcgtgaaccagaccctgaggttctcaaactcgacgcagcgggtttctcgagacgactacaactccggtacggtgtaccggtagctcacatggctgcatgacgctgatgcctctggtccggtcaaccctgggaaaccgttggctcttggtacgggagtggaagactggaagttgcggttgcggttcgcagcttcgtgcgcccctgccgaaacaggaacctggctgcaggaatggtggtcatgccgcgcgccgtacgactagggaattagctaggggcatgtttccatcgatcactgtgttgtagtacgccgagcgtcttcgcctttgacaccagacacggaggtactgaggtagtacgctcctcgctgctccagagctcgcgtctgtacgtgaaatgctcgcggccgcaggtttgattgctcttgccggtcgcggacggcgccacggttttctggcccgtttgattgctcttggctcttgctctgctccgctgcgctcatctgagagcgttgctccttccacttccactgtctgtagtaattgtgagttgcagtctctagtgtgtgtgtgacctgctgaacctgcggcaaatttaaattgccctaattacctggctagctagatcgtgcaggtgagtgttgtgttcgaccgatttgagcgttaggttcattcaacaagtaaaacaagccgtttatctcctaagcgcaaactactgtcacaggcctcgcgagcacacctcacgtcgttagagttatagggcttgtttggtgggctggctcgagcgccacaccacgcca

SEQ ID NO: 1816 - DNA, 3043 bp, Zea mays
  misc_feature (1)..(100): optimal_loci_126685_G1, chr3:208873857..208876899, Cluster 11
aaaatattcttcgcaagtgtttgtagtgattaccgcggataatttttttcgtcgtggggttggagtagttctccgttgccatccctaacaaggcacaatgataaaaaaatgtagccatcgagccaaaaagtccttggtttgacatggaccctctgcaaaatacagattgcccgcactagatttgtccttgtgctttattaattgtattatgcacaagaccgaaatgcatgatccaagcttccaagtaagctcaatcaagagacggagaaaaagccaaaaacagaacaccacgccacgatcacgtctacactcaacagcatgcgtcgtctctgtcctcgatcgcttctccctttttgcttgtatttaagttctaggttgccctgcccgtgtcaggattgcgttgccgccacgcaactgatggagaccatatgtataggtggttgttattgtaattttcatgattctgacacatgctatcagtatttatctatttagaaattttctactattgttatgaattcttcaacttaaatagtacctccgtatcatttttttatataaacatttactgataaagctgactagacaggggtgcgctgccgtgcaggctcatgtcatagcgataacgtgtgcttagacaactgctgcttggcttatcgctttattagctgttgccaacataaatataaattatactaaatataataaaaaaactacattgaatttaagaaattcggatagtaaattgtacacctcgatcttatagcatgtgtcagaatcatgattagatttagtatatatatactcctactatatctttaccaacaatgtagtagccatttaactgcccccattaaatctaacagggacagttaggaaaacgctgctcgctcgattagtacgtgttgccctttgtccaattgatcgggttcgggtactttgtttttcatgtttcacagaaccttatagactttcctgcatggctgctgtgtatctgcatagagctgtatgcacgacgacgagcggacacctgtacttaaactagtgtccctagctaggtagatgagtagatctgatatagccctcaacaagtacacccacaccggccggcttggaattttggcccatgtgttccgggagaggcacgtggtcgtccgtcgcgatacgcgggcagcggcgacggcgcggggtaaatgtgacgcctgtgcgctgtacagcagccgcgacggattattggttggattgaaacaataaatgtggttgattggtgtggtgccgcgccgccggcccccgcccctaatgcccggcgctgaacgcggccgatcgatttcaaatctccggctgccggccccaatgatcacgggcaaaaagtctgtcgccgcgtgcccgcgtgagagtcgtctctgcttcgcggaggatctctccgagagcgcatgatgcatgatcgggggatggataatcagttcaattcgtcgtcgtggtcatggaggaacaaccgacgatgcatggcatgcatgacctgctgctgctgcgagcgtttcgtcgttcggggggcgcatgcagtgcagttgtagtagactagtagtagtatacgaatacgaagagcaggcggcggacggacatggcatggctagcatgtctctcgatcgggcccggccgttagttctttggacgctaatcattaatgttagcatgcaccgttgaccggcctctatctctatctcgatcgtacacgtataccgcagccgatatcgatcatcatatcatatataaataaaggaagccagctgccatagtaaggactactgtaagtctgtaataaggaacaaccgtactacgttgagatctagagcttccatggccacattaataccttattatatatatatatataaatatgtacgtataatactatagagcattacttactctcgaatggtcgatcgaatacgtgagaggagattatcatgtcgtattatcgttaaattggcagtaatggctttgtttgggtacttttgtattgacctcaattcacgtgtgttgagttggattgtggtgtaaattgtgtaagttacattacaaatacatgtggattgagcacaaactaggcctgaggggttatcataaatgcacttagaatataatgtgtcattagcctgattactataccctttgaggcttgatgagcgatgtcgagaggaaacgaaaaggaaacgatccagcctggcgtacgaccgaatcccatttcaattccacgcaggccgctgccggggtctggtcatcaggcatgatatataaaagcgagcgacgtctcaggcaggcaggacaggaggcagggcccggcggatggaaatttgtccgcgactccgactactagctggcggtgctttagcagcagggaggattggaggaagcaagcccgcccacatgcctcaggcaagagggctgctctggttgtggccattgcttgtgcctgtggcttccagctcatcatccgttgaccgtggtacgtacgtacgtcgtcagacggtcagcagggtaggtgaacacgccaccgcgtgtacgtcgtcagacagtcggtgcactgcacggtgctactccatccaggggctttctactgcttttgttcaagtgaaagtgcagggggcacaggtagtatggatcatgatggcatcatcacatttttggtgaatctatccgctggctgacattgctttacctttttttttctcatccggtgtgccagacgtatttatgcatggattgcttctactgcaacgtatgtactgtacctgtactgtactacagcaagctgtcgcagctagcagccggcaacaaccaaggcagaagctggctcgtcactcaccgcactggccagcaatggagaagtcgagttcccttcaagagacagacatccaacttttaccaaccaccgcaggttaggaatcatatattatatataagctggatcaatcatatataggcaggcatgcatagctgcaagtacgtacatgcatacatcaagcgtacatgggtgggttag

SEQ ID NO: 1817 - DNA, 2612 bp, Zea mays
  misc_feature (1)..(100): optimal_loci_127133_G1, chr3:211140002..211142613, Cluster 11
cactggcaaagagcacgtacaaccgagcaggtcaaagcaccaggggcctcaggctctaaggtaaagacacgaagaagcaactgaatgctactacttagaacaagtttaataatataagtcaacatcgggttttataaaaaaaatgtcatattacatgtagccaactaaaagtatacatatataataactctccaatagtataattttggtccacctctttggttcacaaaatgtcttggagtgtctaaacaacaagctttaatttccttgttgctccatttctctttttttttcatgtcattataatttgatgtggcacctcttacatacaccttgttatatttgctctacacagacatgatgtggacagggcgtagcgacactccatctaataattgaggatggaattaattaatcgaatggttgcccccacgcatgcctcgatctgtcggtcacagttttatgattggccgatagtggtgacacaaacgcaagagacgctgcaccactgaagtgcgcgatcgagcccctttatttcatccaccataacaatgcgcgccttgtcagtggacatgatcgagaacatgcgaagaataatatagtagtagtaataatatggtagcagagccctgcaaccgctctggtccactgtgtttcgaagtttgaacggtataagtgcttcttgttgctgaatagtgtatagccgtatgcccatatatatagttactcacaccagatgagctatttcttaattacaaaaaaaatgatatagggactcgctgtttaattttattgtctattttaaactttactttataaataaaaatgtagaataatattttgtacgacatatgtaacgatattttacgttactctcgtggtctatatatggcatttgtaaaccagccggcgccaaaggaaatgctgccaagtagatgattggtctcctcggtcgatcgatcgatcgatcgctcacgtacgctagctgccagctagtgggtcgcgcgcggcatggaataatccggcacgtggtccgcacgtacgcccttggcacggaattatatatccagttgttgacaggcacacggtgggggccgcgtgcatgcatgattgactcggaagcttcaatcacgcagcgcgctggcatggcacgtacggtggaatttcccgtaccgtcgttcgagacattagaggcagcaaaagagcttgtgtgcagagatttgtagctagtgcatgcagctgtagcagacgacgacgagtcgacgacaagtggcccgtgccgcgtgggcgtggactccatttccggaaaccggaagctctagaaatcatcgcaaccggcgactcgaggcaggcagcagggtcactgtacgtgtgtcttattaattgatcgatcgatcgattggatccaataatgaatggatgcgtcgacgtactcccaacaacaattatactctgatccccaccacacacaccttcaaagctactgctacaaaagcatcgtcgatcgagcacatattttatctccccctttctcagcgagaagacagaaaaaataaaataaaaaggaccttagcttgttgtatatgctttcggtgatatgtatgcatgattccgtaaagttcataaattaaagcagcagcagtcttgtgctaagcctacctagctaaccgaaatgggtgcagaccagcgtggcatgcatgcagcgctccacccttttttcttctgggctaaggaataccctactactataccggccccgtatgagttgaagtaaccggagtcgatctctactacggcagcaactcacatggtatttcccagagttgctgccgtagccgtaggtttggaggtgccatggcggcaagtgcaaacaacagctccactaatcaatgcatgcagtggatggatggagtacagttcaatgccagtagtagtgaccgatggtgtagttctgttgctctacagcacagagcaccgtgcaccatgcatcttcctataaactgtactactactagtatctgatgaggttattattgttatttatgtttcgatttaatgtgaaagctgtcctctctctcactctcgacgagagacggacctcaaagagctactactactaccattggtagagctaaacagtactccggccgacagcaacagcagcagcagcagcttgttgttttccgtttccgggctgcccgcacgcacgggcatgcacggcagccgcgacagcaacggggtccatatctacgtcggcgccggccggcaagcctatccacaaaccacgcacaagctggctgcacgtatggacagccttgcatttggcttgcgcgcctgccgggcggccatccctgaccctgaggcagacaggaccactgggctgggcttgtaggtactgtatgtaatgctcttggaaaggtaagagactgaggcactgtgctttgccctcctgcatgcttgcccgcccccttcctcccttttccagggcactgttgcctctactaggagctagagccagcagatctcggttttcatcccgtggcacttgcgggtgtgccacttgcccacttgactcgctgttcctgagctattgtttcattctcttgcttagc

SEQ ID NO: 1818 - DNA, 1827 bp, Zea mays
  misc_feature (1)..(100): optimal_loci_127583_G1, chr3:213411264..213413090, Cluster 11
ggcaatagtttgttcgtttattaaacaactagtggttttttagctaccacttagctacttactcgttattatcattttgctagtagtaaaggcaatagtttgctcatagtgtgtagtactactagcatgtagcaatagtttgctcgtttattaataaacactagtgctagtagtacatattcatctcgctagcttccctgcgcgtgaggaagcaactaggcagcgcgcttttggatggtcggcacgccgtcgcatttggattaggctatccagagtcccgacagtggagctagctagcggcacgtacgccatgcagatggcacgcctcaagataataaaaaaaggaacctcctagctcttgtactaaaacgggcatcttacgaggcgcgacgatgcttcacttctagtaagtactcctactccacacgatgtaatgttgcgacgcgggacgagctgcgaaaccgacaggtgaaaccgacggaggagcgagcgccgatgggcagaccgtggaggcgtggattgtcatcaatccacgcaaacgcaacacgcccggcccgtcgcgctcgtcggggtccagaagccagacggacggtccaaccagacgcgcccgcatgtcgccggagccggaacacacacactgcaccccacccaagacccgaaccggccggccgcacggcatggcgacaggccatgcatacgtacgaaggaagcaactcgacgtctgtactctgtacccgtggccggattcatgccgagatctggacgtgagtactagtttcagaagatcccggcggtcaagtcaccgacctggacgtgacttggtacctcgctcgtgttcatgttcgtcaaaacccacgcccacacgggcagtaggtgcaccgtgcacgtactagtactaccgaatactagtataccaccaaccaccgctcagcccgcccgctctctctggcgcgaccagatcgtccctgtcgggatccgcccgccgctcgcggtctctcctccagtccagcgcatcccgacgtgtcggccggctcacaggtacccatccgcgtccgatccgcgccagcaggccgatccccaagtcccatcctctgacgcggcccgaccaggtctccaccgacgggatggagaaatcatccagtcctcatatagataggagtactagtacgtggtttccaattaatgatcttcttaataaataataatcgtaatatatgcagtagtagcaggctagcagcaccacatttcgtgattttgtttactccgcctgaacacgcccgcgcggatccggtcgatcggggcctgcctacccggcgacctggggtccaagacgcagccgcactatcgctttcccctccgtcaacgacccaacggccggccgactcatcgccaacgcgacggtgcgtgccgctgccgccctcgctctcccgaacggccgaacgtgccacgaccacgaccgacgctgacgctacgagcgacgtctgacgaaatgcccggcacgggcgcggactcccccgacccgcggcaagccaacctcgccacgcaaccgccggtggttggtacgcccgcacgtcggatgctcggacgaggacgacatccccccctgcgcgcgtcggcacctggttgccgtttttacgctggcgtggctaggcagatcagtaacggcaaaaattgctgccgggactgtctgactgtctcctcatacctgctccatttctatacttctagtacagtactgagtaccagtgcatttgttatggcttttctttgttattatgtagagattcaattcgagagaccatgcagctgtatatgatgactattata

SEQ ID NO: 1819 - DNA, 1837 bp, Zea mays
  misc_feature (1)..(100): optimal_loci_129241_G1, chr3:221559568..221561404, Cluster 11
gcctggcccagtggccggtggacgtgacgtcgcttgatcgggggcgcgcgcacgtgtcgggccgcggggtgcacggacgtgagcaagacgcttcctgcctcgcccccgggccgcattccttttgtaacgccttctcttttacacgggaccgtgacaggcgacgccgacctctccaccgcggcggcgtggggtgcgcggggccgccgcgccgaggactctttgggtgggtgacgattgacgaagcagccgggatcggacgacgaaggcgcgccgcgcgggtgtgtatggatggatggaacccacggagccggggccgggaccgcggcgcgacgcgcgtcggcgggccaaaagtactagccgagttccctcccacctggctcaccgctcacggctgcacctgcaccagcacgcccggtccccggcctccgtgcacccacccgcacccaacctcaccaccactgttttgcttcgtgcgctgtgtcggggaggtctgtccccgtcgctcttcgttttctcgcagaggatcgctgttgagatccgtagcctgcagggcgtcgactcctgcctgcgtttctctaatctggcgattgatctgctggaacttatctagccccggatgtacatttttctgatgggccaaaaagcaacaagcctaattacgcttccactccggtctccttcctcttgctaattaggaagtagtcctcgtgtgtcaaataagattagtataaataaacctagaacgatttttcgttgcatcctgtcacagtatctccaaaagcctcttttaaacatgatcttttaaactttttttttttgggtttggggggggggggggtctcacgctagtatggaaggtatagctagtttgtgcgtcacgattttgttgtttttatctccgtttctagaggggcaggctaagatctgaaattttgtattgacacaaaactgtggacaaaagaaaacttcttcaacctcttcataggtcaccacgggtgacgaatttcacatgtgtgtgtggggggccctaacgtgctactattttatttttttgtcgcttcatttctcagtcacttgtgagttgtgaccaagtggctaatgcgattctttttatatagataaatattatagcagtatagttaagattcgaacgggatcgaatcaattgcaacttcagcttagataacccaatagactgctactgcatgacctcctgaacatgaatgagattgcagaacgttgtagtctggcagctactgccacgtacatgcccagatctcagacggacgtcctgtcgcgttggagtaacagatcgaacagagagcagtagtcatgcttatgttgaaaggcgtccacctgcagaggagaggagaggagaggagaggagagcaacatggtagtagcagtagtatagagctatagctgggcagtgccagcagcacgtgggcatcctccctggcgtcgcacgtcccggggccgtcgggctcgggcgctcctccacgaaagaacggacgctgatgctccggcagctagctaccccactgactactactactacacgacaggactcaggagcgagtagtagtagtgtgcactgtagtactgtactaactagtgtgtacagtacgagacggagcgagcatgatggttgcatgcatgatcttgtcgctgtgccgtggtgcttgcgtcgcgtgttgccactcagtctccaggcgcagccaggacaagagtgcaggatcatgcatgcgcaggacagagaggtgtagtagtactagtaatcattagatttcctttgggaaccgccgaagctgtgtagaggtgcctgccacttgccagt

SEQ ID NO: 1820 - DNA, 1860 bp, Zea mays
  misc_feature (1)..(100): optimal_loci_129849_G1, chr3:224667329..224669188, Cluster 11
ggatgcaacggcgacttacgtcttggagtgtgcatgcttcgcgtgcaagagcaggtggcggtgcatgcattcatgtaggggaaccgaaccggaacagaacaagaaactaaagaaaggaccatgtcaaggtttttcttcttcttcttctttggcacaatggcattgccctttgtgcaacggagatatcgtatcgtactaccacaccgatcttgtacgcgtggtggtgcgataggccggtcaaggtcacatgtccatgtgcacagttcgcacgaaccagcagcagctggtaacagggaccaggctatctctgctgcatgcatgcatgcatgcatggcgcctcgttttcacggtgggccgggcctgacgccctgaagtgaaacgaacctttagctgttcacgtgtagtagtagtagtagtacgtagactagacaaaacttggatcggaggagtccggattctaacaaacacatatgcagttcgcgatgccgtatccatccaaaaaggcttcagccagatgcaaacccaaagcggctagaacacaaacaaacgaacggacgagaagtgcagttgatgctgggtatggacgtatggtggtggagaggggaggggaggggcgaggcgacctgtgctctgtctcggaacatgtgcttatcttttggccccgtcgatggaacaagcgctggtaactggtaagtattatatgtatgacggtggcaactcgccgtgcaggcgtttacaaggctatctctgatatactcatcctccacacttggaacaactggtaagctctcgatcatttacgtggtcgcaccgtcactattagaacataaaaaaaaaaaatgcgcatctgcatccgatcgactcgcagcagcaggaatggtttgtaagaggagaaacgagctagtaaaagatacccaggtgtggtttgtggttccggatgtcaaggggggcaaagaaagcaagccgtcggtccatagagatcacacagaatccgctgttttgacgtcggtcggatcggtgatcgaagaaacacgacggttgttgcgttcactttcatctcaagaaacggcggcagcagcagctaccagcacattcagatgaactagagctgcaggatgctgtggccccctccccctgcatcctccgagcttccacgcatcagataaactatagagcagcggcaggctggatcacatgggcgagctccaaagataagatccgccccggccccggcccctgcccctgcctacacccatattaactgatggcagtggcagtcgcagcgcagcggcggcactgaccacgccacgccccactgggcgcgtgcatgcatccgcgcgcgcggcgcggctcgatcgatcgttccgggacagatcagagagcccgccatcgcacatggaaggagccatcacttgttttatggggcaggcagcggcagcgccggcagctagcgtgggcgctgatttgatttaattataagaagaagatgcggcggtgacccgtgtcgtcgtcgctcctggatctggactggactgtggacctcaatcgccggatcgtgcatgtagcactagtgttatagttcgtcgccgtagagtctctgtccgttccgtcgccacgcccggcatcagctttcggacgcgaaagggagaggtgtggggaaatacaagcccaggaccagtatcggtggtagtagtataatgatgcgcgctgagatcgatatggcatgtcgaccagctccaccagcatggatgactctctaacccttcctgtcggcggtgaatctgctttgggcggctgagcttgtttcttttcccgtctcgttaattaataagtgactaacggtgtgtttgattgcaggta

SEQ ID NO: 1821 - DNA, 1707 bp, Zea mays
  misc_feature (1)..(100): optimal_loci_134273_G1, chr4:13417323..13419029, Cluster 11
tttgagacagtgcccagttcctcgctcagaaattctcttatctggctcccaaaattacgcgcctctgctgcgttcacgatttgccctatgacacagatacctgagcccgagaattgctgtgcccgacagcaacacagccaactgacgcgccgcgtcgtgccacctgatacgatacctgtccggctatccccgtcttgactgactatccgtggcggccggcgagtggcgctggaaatcaacgagaggcctcaatctcaggcgcaggcctgcccggagcggaggagagatacttttccaggtgaccaagtgggcgaatggcgtgagcaccaaacgctagcgcagtgttgggcagcgtcgtcgttgtggtctgctctgccttgcccctttcgacgccgcacagacgggtggatccattgatgccaagaacaccttcacccttgaccacaagatttatgttttttaaccaaaaagaaaaaagaaacaagatgtaagccacaaaactacttataatttggaacggatgcagcatacattttttcttttcttttttgctactaagaactagacgattctaatttcttcgatagttatgtcagctgggaagcgcatatggactagcaacagaaaccaagacgacgaagtctggccacgagccatgaccgggctagctgcagcgatcgatcaagacgaggcatggccgccggtggatctaccttttccctgttcgccaaaagggacacacgggccattccgttcatgacgagacctagatgatatggattgtgcgcctggactgtaataagggacaaagtgccatttgcgaagaaaaaaaaagaacagctagacagagagaggcagcgaatcctatcccctgcacatgcatggtggacgcgttcttccggcaagctgcgctagactagacagcaaccccactgcaggattaaggccagggtctgattagttgggtggtgctggtgcatgcatctgccgcgtaaagaatctccaccattttttctcgctccatcacttgaggctgtccatcgctttttctttttagccaaggttgcagtagcagtacaggatataacaacttggtgcaacaagggcaatcctttgtaattctgttagcatcggcaggcagacgaagggaaaccgccgcgcgcacctggagccggagccggacagctaccagcaccgccacttgtcgtcgcccgcaccgcaccgcaccgcaccgggctgtgtgccttgtgctgcagttgcaattgcaactcgcagtaaactagctactgataaaacaaacaaagatcccatccatccaaccatggttttggccgcgaacagcagcaaggacgacgagggaagtcagacccggctggcctccgcgtcatcgccacgggcgttgacctgccgccatcccgtcaggtccgggcccggtgccggcctctggcctccacacgccgaaagacaacggcgcctccagtaaaacgtttggcggcgtggccgtggaaggtttcaaggtcgccgacgacgcgagatcgagattcatgtgcagcgttcggaattcgaggcatgctctcctgctcgcactaaggctaatcacagtgctgatttcatgtctctatttccaaaaatgttaatactctctctcaatagagagtttcatctcactatttcatatatcaacatacttcttaaatgctgcatata

SEQ ID NO: 1822 - DNA, 1521 bp, Zea mays
  misc_feature (1)..(100): optimal_loci_139485_G1, chr4:42804231..42805751, Cluster 11
gctacctttatcgttagggccatctctagccctaggcgggcccaagcatcgaggtggcacaaaaaaattatatgtttcttataagtttttgaataatcatgatatgcataagtgttacataacttttacatatatatattttttgctattacaactcatctgatgttgatatcaataattttatcagtgttttaactcttgcaaccaactttgtcggatgctttgatgttagtaaactgagattttttggttcattaaatgcattgttatccacacaaatgtgttgcatatcggattttattgaccaatatatcatgtgatgatagcttcagttgaaacaagtttctcaaagctaaagttatcagaaaattatttaaggtcaattatgtcgcaaaatggcttagttacatgttctatcaagaaggatacatggaaaaatgctgatatgaacattttcctcatagatttcgcgtggttgaactgttgaatttaagggacaggcgcgcgccgaacttgtcctctcctccagaagccaccgagctaggacgaagcttgggaatttgttgctactatatactagctatttcgacccattctcacattcaggttggcggatcttgcttcagtcagtcagcaaacttgtgctgcaacgcaacggcaacgcaacagaagttgacgctgtcccggccgtccactccttcattttgcgtgaactagctttacccgcctgcaaaatctgtgtcttcttcgcgcgccggctgatgtgaaaccgagactagcagctaggaaaaggcccagttggtttgttacatacgtagttgaaatccgtctgccgtactgcctgcatgcgtcagatttggctggctggctggtttgaccactggctagctagctcattgtgcgtgtacggggtcagattttcaacactatcgtaccgccgtgcactcggggagtcggggtcctcctccctcaggaatctgcttgttggcctgagacttggcccgagaggctggtttcagaacggaaaactgatgaggtagcacaggatatcagcggaaaaaccaacacacgtatgaagcgccccggagccaccggcggcggcggcgtgagcgcccggcagccaccgccggcccacatcggtcggtcacgcagcattgcaacgctgaccttaattcctggccggacgcggacgttctgcgaccttgtttacgcacgacgcaagaagatcgagccacgcatcgcttaccgaagatcgtggaattcatggctgcagagtttcccgcgcaggacagtttcagcagccgggacgtacgtacgcctccgatcctcgtgctgtgaggtgagcttttcttcttctttttgtttataatcgaaatacatgaaccatgagtgaacatggttttttgcatgcatgattccggcctctacgtacagcgcacagagccaatgaaatgaaatgagaacaaaaggcagccatttggtgatcagaaaattagagtagattctcacgaggagaaatcc

SEQ ID NO: 1823 - DNA, 2094 bp, Zea mays
  misc_feature (1)..(100): optimal_loci_145842_G1, chr4:82662841..82664934, Cluster 11
tcttaacccgcatgctgcgattcagtgcgtcaagcgacaattgacaaactcttggtgcatggaagtcataatgataatggcatggtgtatctggaaataatgcagaaatggttagatcttttttttttgaaataaaaactgtaggattcaattcagataaaagaaaaatggacagcgtatttgtttacatgtcatagtggcctacgtatccatcaagggctggtacggttcataacaccttttaccctaatacttattgagcttaatgtaaacttcaaggatagatggcgcaatggatcctcttggagatatttttttaaaaaaaaagtccgaagcacctagcgccatgcagtgcatgaatccatatatgctgcggccatacagagaggggttggagtccaccggcgttggcgacgatcgatcactgccgacgcaagcagcatgcaagcaggcagggcagggggtcggatgagccgaccatcgttgcggaaatggtcgtgagggaaacgaagagagagtacaagcagcagtgtaggtgtagaggagacataatttgatcaagaaccagctagcgcagcagctaggcggtcgagcctatagctagctagagccgatggccggatggagagggcagccaccgtgtctttgtctcgcattccacatatacccggcctccctcctccatccatatcgcgctgctgggtagtttctcccagctctctctctctctctcccgattcgtcccgttccgttcaagaacgaccgaatgattgtgccctgcttgtgcagtcgcgcactctcctcgatcagtgtccgtcttcgtcggtcgacgactcgactcgacttgcgcgtcatctcgagaacgaagcacgctctggctgtggctctggacgcctggaccagagaccatcatcatgagcctcggagagtccactccacatccacacgcggcggccggccggcgggcgacgtgtgacgaccgacctccacgaccctaccggctgcgctagctagctctcggcatggatcatgggcgcggagggaaacgacccctagctcgaaggccgaagcgcgattagttaatttacgggggtgtttggtagtaggttttttactgtaaagctagctagctaaacgtcacgagtaggactagtggtagggggagatgatgagtgcgccaatggccaatggctgtgcatgcgaaccgccgcgatggatgatgggtcggtcgcgaaaggatcggccggccggatgtgacgatgacgacgacgacgccaccacatgcaccatggcacgcatgatatgctcggcatggcggggcccgcgtgtgctcttgatatcatcaccacgacattatgacgttcgcgggcatagctatagcgcgcggccggcgcactcgatcgctggtttccgtgggtgtggtgtgggccttgctgttgcttcactcctccggaagaaagtgagcttttctgtccctttttatacaactccggcccagtatttttgcgtacgtaaacgtactcctacttagcactacttccacatattaattagttttcgattccgcgcgtctatggtaggtcaatttaacttctagctagactcgtcttgatcttatctaattcatatatagaaaagaacataaatatttgtgacaccaaaagataaatgagaatctattttatggtatatctgatgatattaattaatgtcataaatcttatcgctcgtttctataaattcaacgccacatataaaaatgtttgatttaacactactacagaaaaaaatgattttaggagccttcttatttgatttatggacatactaggtagtaggtacgaagtgtacttgtctcctaaaacacacacgggcaaagacatgcaaatcctttttttaagacatccaataactaccaggctaccggctctatatatatagatcaatcaactgggacaaacgtcttaaaaggctcgccagttactagtgtgtgcagctcctctcagcctcatattacactactgcataataccgtcccttaatttcagtactggttcctttagaatggatactaacaatagttctataagcttt

SEQ ID NO: 1824 - DNA, 1532 bp, Zea mays
  misc_feature (1)..(100): optimal_loci_154285_G1, chr4:142657322..142658853, Cluster 11
ctttactaaggttaacacgctcttacacgcttctcaatgttcttaggtgtaagccatcaacccatgatagcgaatcttttatcttctctagttcctcggtaccaatctcgacgtccgttcttcaccattcttagtccatcaccatgaaaccgtgtgacctttaccttaatcatctaccacatatctgagctccgcacttgtgcaccactaaatcaaatccgagtatcttcttaacaataactcatcacacttaaacatcacggccgcatcttatctatgtattcgcactagttgcaaacatgaaattttacttcaatttgcaaggcttcacctctagctacgaagtctcgaaggtggtgaggaatcgctcagccatttaattattcctatgttaattcggtggtggcggcgaacggtaaccagaccgatagatgatgttgatggcaacttttaaatcacttgaaaaaaaatcgattgatttattttttgacatgcatgggctgaagaggccattattatttctatgatgatgctcacgctgtcagattgcaatgcaagaactttagaccgtttccctggctatcatcgttgttatttatccagaggaatataataaccaacaaaggcaaattctatcgctgacaaaaaatcatccagattagctagtggagcggttggaacgagagccgcaactttttacgcagtctgtatatccatgtactccgtcgtagtgcttgctccaacgctgtagatgataaaaaaaaggcctttcgatcggttcgggaaagaaaacgggagccagattttcgatcctttctgatccctttgcgcagacctgttcagaagacgacgatgtcgtaaataacaacccgttttttccaatcagattgagagagagatagaggaagatgtcatgcatgcaaccactcgtcgttatcctgctctttgacaattgagacacacacacacacatgtatgcatgcactttaattatgcctctgaagcaggcagcgaaactggccgctgtgatttgatgcgtcgtaaacgacttttcccgtcagctcggtcgctactgggatacttgtacgaccatcaagtgtggtggaagctttggacgacgacggggtcggaccatcgatcagttgttcagctgctttactgttcaatgcatgtgtagcgggcgttttggtccccgggaagtcgcgccggggacgaatcatgtgccccgccgtcgccgtcgagaaaggagagcgacttggtggatgatactatagaataatacaccgtcagttgtggacgatgtcagcggcaaaacagcgtagctaaagtatttggctaattgtaccgtcgaccatgcaacgcgatacgtaccgtacggtcgctatgacgaacgggcacgagctagtacgcgcgcgaacgaaaatacaagcaagtttgtattattgctagctgatgtagtcttctccgtgacgaagtggcgttccaggattgccgtgtgtgaccaggccagcagctatcttgcgacatttttt

SEQ ID NO: 1825 - DNA, 1513 bp, Zea mays
  misc_feature (1)..(100): optimal_loci_158474_G1, chr4:165628959..165630471, Cluster 11
atccagaatgtaattttatatcgcgcgcatggcgcgctacatacactagtatataaatcatcggaagccaaaccgggactcgcacaaagagggtgatgaacgcagtaggcccaaatgcaaatgtgtccaataatattcaaggtgggttttcaggcccaactaaaccaacatgtgcgtgctactgggctaaactttacaaaggcgctggtgcaacaatctcatagcgggtatttatttggcttcaccgtttgcttcttctagcgaacacataacacgtttttttttctaactttgtgaccctatccagctctcgggggtccggtagacaagtggagttcgtgccgtgcgagtttctgaagaggtcgtgacggtagaaggagaaacttcccgtccacatgatacaatagcaaaagtcactacgtggccaacgacaaaagtttaaaacatttaacaatccccacatgccacgcatagtgctcttccttttcttttctctttttttctgtaaaaagaaaataggaggaggacgtgacgagagattcacagcgcttccaactatttgtgcccacatatctgcacatatggacgaagcaagaaggagaaatctagactactaagaccacgcgcggacacacagcttcattagagcactagttcggcgtctatacgtgcttgcttactgacaggtgggtcctgatgagttaggttcgcggaaaaaggtgccacacccacacgcgcgcggcgcggcgcggcgtggcccgaacccgaacggatagggacgttcaccagggcggcaacggcaacgagctgagccccaacgacgatggaggggatgggagtcgcgcgcggctgcacggtgccgtgcgacccctggacgtgcaagcaaattaaaaagagagcgcaaacaaaagaatggatagaccaagaaccgacaaatcccagtggtcgatcgatcccggaaagcgacgcgggggggcgtgtgggagagtcgacaccgccgccggcgggcacgggaaggccggcgcgcgcgcgcgacgccgggcaacacgatcgccgatcgcggaccgacattgcccgatcgacgggcgcgcccactcccgcccgcggtcgggaagaaagaagtaaccgagacccacggctttctccaaccggcgggctgtccgcgtcacggcgcagacgtaagcgcgcgggcgcggctgtccgcgtcgcctttcgagtcggccagcattagcgtcatgattaactaatgataatagtgcaatggcctcgctgctctccctggctcgacccagtcgctttaatagtttaatgtatgtacccaagcaaagcgacgctgccttgcatccaaccaagcttgctacgcctctgtcgctcgtgccacgtacgaaaagccgaaaagggtttgggcgcagggcgctctgctctgatggcttgttgcccagcagaggcgattaataaagcggtaaatgatgcatcatgcatgcgactatgcgagcaggcgtaggattaattt

SEQ ID NO: 1826 - DNA, 1741 bp, Zea mays
  misc_feature (1)..(100): optimal_loci_159603_G1, chr4:172771600..172773340, Cluster 11
ggtattgtactaccatagagttcaggcgacagtgtgtgagctcggagagtgggaaataataatcgaagaattattaatacaaataaaccctaaaccaataaactaggggtggcagaacgtgagagaggtaatataagtgatgaggcctacagcagctgctgattcgttatcaggatagatgagggggaaaaaaatatggctgggatagcctcctgggttttgaacgtttggggttgaagggcaggcagacaggcaagcaggggttgtgtcgacggaagtgacgatccactcccctccttttacatttgacccgctcgtcctctctctcgatccaccgggtctatcaggaggaggacgacgacgggaaagaagacgacgacgggggctagctgcagctggcctaacgtaaggacggacgaagggggacgaggtgcacgcatggtgcaatgcaaccggccaagtcgttggctgggagagtactaatctagcagtagtacgtgctcacactgcggcggttaaatgttaacggatgcagctagccctgccggatctttcactgcatcatcgtacgcgcgaggagcaatcaattagtgccggtcattgtattagcaccagcaaagcacgcaacagcaagttggtcgctgcaccgcaccgcaccgcaccactagtgagagcttgaggactagtaacatgggacggggcggagagagaaaacaatcaggctagagagagagagagagagagactgtgtgtgttgtgttctcatgttgtgtgtgaggacagacagacacacggtaggtacgccagcctccctcaccgccagctgtcgtctcgtccccccgcctttcctgtcgtgacgttgaagtttcctcccgatcccccctcccccgatttttttccccggctgtgtgggagggagggagggattttaaagaagaaaaaaaaacagaggagagagaaggtgctgctgggtttccctttcccctctacacatggcacgtgagggaggaactaaccgacggccaccgctccagctctggatcctctgcggccgggagccgcagccgcgaccatccgtcgcggttaccgcgaccgagagcctccctctcctcatcctccagtagtccagtccacggaacggaagcatccacccggccgcgtgcaaacgtccccattggccgccgcggctcggctcggctcgtccgcgtccgctgacccgtatcctgtacacgcacgcccaagtcgcgcggcaggacagcgagcgggcaggccgcaccgcacgcgctgcgggggggcgggattggctgtgtgattgagagggacgcggaccggcctggcaggccttgcgttgcgtccgtccaacgacgcgcggcgcggactcgccggcggaatctggcgggggtgtggccgcctgcctaacctcaccttggttcgttcgttcgttctggcctctgacccaacccatgcacgtcggtacgagtacaacaagcatgtttaccgaacctgttaggctaggctgttactgtctctaggcgtaatgcgtttggtcgaattaaacccgatccatagatctgatacagaccttcgcttgtacgtaatttttttatatatatacgtataccatatgctgcggccattggcagtgccaccgactgccggtggtggatcgcatccgaaactaagccgggggggggggggggggcgtctgtctgaatggcagagtattcattcattcggtata

SEQ ID NO: 1827 - DNA, 2972 bp, Zea mays
  misc_feature (1)..(100): optimal_loci_159605_G1, chr4:172774108..172777079, Cluster 11
cctgaaaaaggagccgctcgcctttgtactaccctcctcctctgctcctggtaccatggagcagcagcagtagtgtccggtcccggtgcagaagctactagatggcccctgcctgccgcgtcactggcggcagggctccatcggccggacacgggcgccacgtacggcgctttatgagcggcggttggtcgatcgatcgcgttgcgttgcgttgcgacgaacccagccagccccgtccagtccccgtccccggtcacgggaccagctagcccgtccgtcggtcggtcggtcggtccggccgcacggcgggaccaacgagccgttaactgccctgggcagcccgatccagcgtctggtgcgcgccgttggcagcagccacgagcgagcgcacgctgtcacgggaggaagcaggcggagagcacacaggccggcctttctgtttatcccgccaggtagatcgggtttagcgagatgattgcggcggtaacagcctcgtgatccattgcccaccagtaacaggggccggccgatccatctctgacgacaacgctggcatatagaactcgccgcgccgatcccgaggccgcgaggcgaccaatgatcgctcaacatgcggcctgcatgtccccatatatatatatatatagtactatatccgatattttttatttcaaaaaaaaaaacaatcaataggattccattaattcaatagctagaccatgtgtgccgtacgcgtgatacggtggcggtgcgtgcagtggtgaactgcatgaagtggcggtggccgatcgatccaccacccatcatcacacatgaccgtgatccggtccgggcacgtccggccagccggcgacgaccgcaacggcagcgcccttggacacggcgggagctgaacgtgccccggtaacatgtccgcgtcgtgttcctgttgccgctgcgattgcgcgcgttgctggctagcgcgtggggtagtagtggtgagtgtgcgagcacaggacaaaacgcaaataaaggcacccgcatcatgcatgcatgcgtgctgtgcatctcatgcgtctttgttccatgtaagtgcctggtgctgtgataacaggcgcgaatcacgggattagtttacgatgacagcgtcaaaaggagagaaaaaaatgtcagaggacacgtatatatatgggcatctgtgatccactgtctcgcaattcaaacaggttgatccaaaccgcaggctacgccagtgttcctagctggctgttttttttttgtaatgaatatggtttttatatcgatggttcgattataattattaatcaagctaattgatcgattataaagtaggtgtagcacactgtaacatgcatgctaatggcagcagcgatgggtcagcggtagtacagagtgaggcgagtcatgtgcgtttgtgtgatccaccggtgcgacgacgtacggtgcccccaccggacgacgccgcgcatgtggctgcaagctcacccggggctgggccgggcctcgccgtcggttgcgcggtcgctacctgctgctgccgccgctcatcatgcgcctgcaccggcgtgcgtgggcgtgggcgtgggcgtaggcgtccgcgtggatgtggatccatgcatgatccatctcacctatctatcttcgtcaacttattcattttcatattcataatcaaattttgctatacgaatagcgtaatctataatataaaatcgtgttttaagtggccatataggtaaactgctttaaatgtatgtattgtccgcgcgtgtatatatttgcgctgtaaattcggatttggtactgctttttaataaacttttaactttggctcaaatacagaatcctaaatttttaggactgggctggggcgggggtggagtaggtacagacgtacagtgcgattcaaaggaagctggaatcgtctcgtgtgcatcctatcgatggatcgcctgtatttatgctagtatcctactaccactactacgcacagtgcgtaccagtgacagttggtggctgtccgatggacgacgatgaggccattgaccagagactggccttgtggtttatttgctgatagctagctagcctgagtggctgatgacgatgccatgccagcctgcagagatcctcgattgctagctgcttgccctgggggctaacgtacgacgaccgagtctgaatttgacgacgcgtagtatgcgtgcaatggggttcgtttctttcccggacagcgtcagcgtgtgattcacagtggggttaacgttactactttactagccatctagccctcttgttcgttgacaagcgagacagtgatgctgaccgtgccaggtaaactgcatgcagcctgcaggcgactggtcaatccttttcgctttcaccctgccccacagccacaggtcgttgtagcactccgtcaaaaaatggtttgtttttgcctcggcagacggtgtcacgttgaagcggtattgtaattgtactagcattcggggactgcccacgactacgaacctgtcaggttgctggattgatcggttcttgcgcactgcatacttgcagcttcctttctgtgtgccatgtccaaatgggcatggggttcggacttcggagccaggtaacacatgcatgcaggtcatcagattcagaggctccttcgtgtgatgtgttgtgagttgtaaccatgcacgcacgtcatgggcaccacttttttctgtctcctttttctttttttttccaaggatgatgcgcgtcgtgctgtgcattcctcgcatagtcgcttgtgtttcttgccttttaagatactgttttcttgaggggcgagtacgtatttttcaatggcatatccttgaccggacagatttctaacgatacagctcacgtacagacctttttcatgtttgggtctctagattgctgcggtgcgcgcgcggttgcttcagcctatagacaaacagacagtcaaacagttt

SEQ ID NO: 1828 - DNA, 1434 bp, Zea mays
  misc_feature (1)..(100): optimal_loci_160623_G1, chr4:178750783..178752216, Cluster 11
cgccaatgttgggttgcaagttggcatatatatttgctttccttgagcggtgtggcatcatcaaaatcagcctatcttatccctgaaaacgggtggttctcgtgccattcctaccggagggaaaaaagagagagagacgagacgagacgacgacgtcggcagcggagtggactggaccagcaggcgagggagacggcggtcagtgtcaggcaataatgcgcgggagacacctgcatgcatatagcaatagcatagccgatcgaatctgccagcaccggcgcgtgctgcggcccagcgcgaccgcgcgcggccatgggaatcaacggcagcctttccaaggggtacttgccgcgccgcagccgctgttgcgttgctttctactacctgccaatccgcgtgacgtgcggttgtctcgccgcgctcgcggctgccactgacagtgctgctgctgctcgctcccagtcccatctgtccaatcttcgtccccgcgattccacttttccagatctgactggacttcactaggccaagggcgcgcgcgcgcgcaaccgtaccgccagcatccatagctctcggaagaacgatccaatgaatttactgacaccgatctgatctcaacggcccggccggctccagatctaccgcgcacagtgcagtgcccgcggctccatcgatgaggacaacacagccacgaactgtgctgccgtgtgccgtgcgccgtgcaggggatcggaatcggatgcgacagcccaggtccctggaccatgcacgcgcgcgtgcgttgttactcccccgctagtggctgtggctaggccggtcacacgtggtaactaacaatgctgggaccagcgcgtaggagtatactacgcctgtcctgtatgtgtatccccggcctactggtgtcctacggcaccggcgcaccgccatgaatttgcgcgtgggacggaacggaaggcgtgatccggcgatcccgttgccgcgagcacgggctgggcccccacccccacctcgtgatctgtttacggcggccatttatgcgaccggggttgcaagccgccatgtatgccactcgatcccatccgtccggcattcatggccgtcatgcgcacgagcgcttggccggtggacgacgcggcgttggcggatccaaagcgtaaatggcctcacgacccgtccaatcgtcggaccgggccgtgcgcacctactgtatggtctcaccttagagcctttgacgggctcaattcgcgtcgtcaccattaacaatactatacttttgttactctctctttaaccgaccatcacgttcttcgtttgtttcccttttataaaaaaatttcggtgcggcgtaggctacaaaggtttgcaaatttgtgcagacttttctattaactgcgctgacgtatagaccctgtttgaatacactagatttaatat

SEQ ID NO: 1829 - DNA, 1516 bp, Zea mays
  misc_feature (1)..(100): optimal_loci_160711_G1, chr4:179615212..179616727, Cluster 11
gtgtgaaggaatgatagccgtcgtcggtcccttgtacccgtcgtcgctgatctttttatttttatttttcgtgaggagaagaaaaaggaaggaaaccagggagggagtgatgatcaggaccatcttccacgcacgctgctagctagcctttgagctgctgctgctgctgccgtccatgaccatgagccttgctttgattctactcctccaggggagtgtgccaacactgtctgacaggcagctagcgagtgggatcggagtcggagcagggtgaaagaggcctccctcgatctccttttctttttaatttacgcggctccatgaccgtacggaacgggtggtcgatgcgaggaggacacccacccaagggctgatccgatcggagccttccccccgggatagacggcgaccgacggaggacgtttcgcctctggtggtcatctataatcgagccggccggccggttctctatccatgtacccacgtcacatgatatatatatatatataacacgccggggccggcggtcgacgtggccgctgggcgggaagatgagatcgatcgatgcttccggaccaacagtacaggtgcaaaggcgatggatggttacttttttttcgggggggcaccaactccgcgcatgcttgcttgctaggtgtccatcgatccggcgcactgctatgctctcccccctcccgatcgccaccgaggccagatcggggcatgggaattattggacatgataaaggatgacataactcgactccatccatcgattgagagaccgagcggtgcgcggacagggacaatttacactccaacatgggagtgtgggacacacaccggtgcctgcctggctagggctagtcaaccgatcggatggaagctatacgtcgtcgtcctccgatccgtcccgcgtggagtacgtacgaacgcagtgcgcgatccgcggggaatgggcacgatcgcacgagaattccatgtccatgagcggtggaatccgagggcgggcggctatatacacggaattcttccctagtactctctccatatatcgctttctctcggtgctagctcatcactctcgcacgagacaaccttagcttattcggtgggggttccagataagccacgaaaggtgccatcaacaaagtaaaataaacgagagagagagagagaaaaaaggccatggaaaaactagatctttcggagtggaggcgcgcgcgagattttgttcctctctggatggagttttgcgagattgacaggcgttacagccaactgattaaccgagacaggagcggggcagatatagagagagagagagacgcccaccaccaaaccatgcacgatgatgacaagtgttgtgtgaccgaacgaacgcccagggcccagggagcagcgccagcaagcacccgtcgcgttcaatgatggctagctagctaccgctaccgctgctctggtggtccgcgcgctgccatggctgctggtggtgttatcgtcgtgctagtgctac

SEQ ID NO: 1830 - DNA, 1594 bp, Zea mays
  misc_feature (1)..(100): optimal_loci_160712_G1, chr4:179616859..179618452, Cluster 11
cttggcatcgcggtgtgcacccgtgggagagcgacggcgaccccgaccgactttcccgaggccgtacgtggctggtccaagactccaaccaagtccaaaggatgatgcccctgccatgccgctacctcgagtggaaggaagggaagtgtggaacgaccgatgcatccatccaccaaagctctcgcacccacccacacccacccatcgacgacctcctgtcggggttccgaactgaacacaggcgggcgggtccatgcagggcgccgatccagcggatagcgacgctgcctcgagccgatccaacggccccaagaccgccagcgagtagtcctcatctccgcaccgcagtggcgtgcccatcccgaattgcgcgggccggcagagctgcaactgcaactccccccctcgtctgcctgtcccgacgccgacgccgacgccattttctccgcttcgcctgctcagcggcgccagccacccgtcgcacgcgagagcttcggaagcgcgtgcgctgctggatcggctgcgacacggctgccactggcattggcgttgcgctgctgcttttatttatatacacaaaggggaatttaagcgcagcgcagcgcggttggtcaatactatacgatcaagggaagcgtaccgacgatcagacgactaattgctgcaaataaattactgactaatcgtggcctgagcaggagatgatggccactcgcgctgcacgatttcgtcaataaacaacagcggaagtactgccaaatggaaaagctagtggaaacaccgaaagctctacctttgccgcctacgcatttcctactgtcgccgggaggaagaagaaaaaaaaaaacctgcgcagaatcaatcgtcgagaattcggaattcacaagggccaagaagaagaatctgcgtacgccctagcaagtgctacgtgcaaaaccattcatgcatcttcttaactggccaaaaaaaaaagccatgtgctgcaactcccaactccaagcaaacatggcaccgtggaggacaaataatgcgagtggaggtggaaatggtctcacctttttttttttttgccctccactttgaagccactgttcttctcatcgcctgcgcgcgagaaacttcgtctcccacctacctttcccgggcacctgattcccccactgagatgcacctttcttttatgtcctttcctgagaaatgcacctggtaatttctcacaagacacaccacacataaggcctagtggctcctttttttgtgtgttgtttatcgcacttaggctgctgtcgagcattgagaaatttattaggtattgtccgggatgacttttttgtttcgtcctggcctcgttttatagccctttattgttatagccttttatttgcaacaattcctggagccaacatagaaataatgtgatgccttgtttttaacaggagcatcaaattctaaaaattgttgtaacttttaaattgttatttgctaatgcttcaccaggctgtattaggttcaccaactgtagttaaaaattaagttttagaatggtactgcatggtgtcatctttgtacatcctaggtaatataatgccatgac

SEQ ID NO: 1831 - DNA, 2248 bp, Zea mays
  misc_feature (1)..(100): optimal_loci_162326_G1, chr4:189130194..189132441, Cluster 11
ttggcccatctactgagacgacgaccggctgacttggctaaggaatacgcgggaacaacacagcaaccggccggctttgcattagatgcactcctccaccaacaggcagcgcagcgttgctagctgttgcagcatatgcatcagatgctgctactgctttgcattacttgcgtaacgacgacgacgaggaggaggaggacgcagcagcgcgttcattctcattccgcgcgcaaacgttgggaaacatgagcggcgcacagacgactcgatctgataggtgctttgtgtgtgttgtggtctctgcatgcacagtcaacgatgattgcgtgcgtcgactgtgtggtgctgtgcgtgtgctcttgattacatgaccaccaagaacgatgcatatgcaccaggccaggcatgcagctagcactagcagtcgcagtgcaaaggaaaatgtggtgaagctttcggatgtgcgtgtgccgccaaattgtcatagaaccggcctgtcgtcgtcgatcgtacgtgtatgtccggccaggaaagtacgtaggactcgctggactgactgattgactgactgactgactgaggtcgtcacacgaccaggtcgagtccagcagccgatgcaacaacgcgcttcggtctgaaaccgtgcgttgcgactggactcccatcatcggcatgcagtgaagtgcagtctcgatcgccatagatatagagaccaatgcatcctaaaatatggaagaaaaatctagagaaaacccctattgaaaaggttggcagcgacaaggaacgaaaacgagctagaaggcactcccggccggccattaatttccaggcaagtgtacggtatgctggcagtcagtcgtcaggtcaagcttcggctgggttcgtttgatgtggcttgctaacgaactcaacgctagctatatagctggccctggccggccggccggccggctggcttgggagctttatcacttggagatttcagagtccactcgacgatgtcaagacgttcgtcgtcgtcgtcgtcggttacagataaaggcgcgtaatgctggagttagactgagtgacgacgcacggacgccagccacaaagaatagtagtagtagagagagagtatagtcaggaacagaaagaattcaagacagagaagcttcccgtgtcccttcttcctcgaggagtcagaggcacgataacgcgagtttggtttggctagtgacctccttttggtcggccgtgagcgtacgtgttgcagtcactttttacagagtggagtttgaaattaatgaaagatgagatatgagttagtgttgccttgtactagctataggagtacgcagtcttctttactcctgaaaataaaagtagccgactaacctggtcagacggacccaagaatcctgcacattttggagtacaaaccgttggattgatcgcatcagactcgatcagggaatcaagtcggacaataggctcgcgctttggttgagctagggcatataacaataatatgttggttgtagacttcttttataccacaagaaccagtttatgggtaaccctttcgtcatacactcgcacaaaatccaatgtaatccttatgcagctgctagtgaagggaagactactacagtcgtcttctttgactctgatcatcaaacctctaccagctgtatggcatctcatcccaatcctaaaggtataatcccaaattctgctgtttgtaatggctaatgttacaaggttaagatcttagaagtatatagtagtgatatcagagccatgtttttaggcttcaaccctaactctagatgctagaacccttctgttttagatcaaaatccaaacaaatcccttcaaattcttgaatttgtggtcctacctagttagaacaacaaatggaagaaaggaaccctaactcggcatcccaattttcctaaaccctagccctatgaaactccataggaagagaaagaggcccttagagcttatgtggccattgctgatgtcggtaggccatggaagaaggcggcactaccgtcgatcttaagcgtgaaggcagacatagggccttatgacactgtcgcgaggcctttcaatagcgggacactcaccctcgggtgtgcgcgcgcaccagcgagaggtcgcatagacggcgtcgacactctgtcgtgcctctctgtcacagactagatagtattgtatcttcgttggagtcgataatgtaatgtatacattactagtttca

SEQ ID NO: 1832 - DNA, 1705 bp, Zea mays
  misc_feature (1)..(100): optimal_loci_173220_G1, chr5:4909246..4910950, Cluster 11
acgggccccacgagcacgtgacgtaccggatccccccccacccgatcccaccggcgcactgccagactgcggagtggtgtcactgtggcagtggcggcctgcgccgtttgtctcttccgatccgatcccctagcaggctcaagctgtgtagctgtagccccgcctggtccatcatccacccgccgtttgtctgtgccagtcgcggaggatgcatgcacaagcacgactcgtaagccgcgcgtcctagctctctgccaccgcatccaaatccaaggaccacctgaacagaactcgaccggggagaaacggccatggatcgcagcggacgtgggggccacctggccgctgcgcctagcgacgccggtgggcggtgggctctcctccacctctccgtcgtcgtcgtcgtcgtcgtccgcactcgcctcaacaactatctatccctaccctaccaagaaagatgggtccgcggccttcccaatccccccgccgacgtgtctgtcgctcattggccgtgcgtgggcgcacagaacagaagtagtgcctgtgccgccgcgcgtttggcctgccctcacatccaccacctgttttgggcgtgcctgcctgcctcagtgagtgaaacggtcagttcagttcgacggcagcagccgggtttctttcttttcttttctttttctctttctctctcaagtgagcgcggcggccgcacacagtgctgcgaattgcgatgcatcttctctgctgtctggcctttacttggcgtcgcacagttgcactgttgcaccacgtagtggtcggggcatccactgtgtgcgccccccacccgtgcggccttgcctgtgtggcgctggcaccaccccaccgccgcgattcgacgacggcgacgatgattagagtaatacatatagcaaattctactttatcagtgcctatatatataactataagtgctagattattataggtgcgcgaggctggggagcagctttccatcttgtcacgccaaattaggttagccacactaattactccccggaccgaatctcttgtatccaaaccttttctgccgattcgtctgtaggtcacgtcgctgctcccccctgtgggctgtggctctcctcagtcccaacttgcttgatgattctttatcacttggcctttcccatccgcgttactgtgctttattatacagcctcctcatccacatatgattggtgcacatggattcccccctattttctggacgggccgggtccaaataaacaatattatactagctaagctaatcgggggttttttttcctaacataaaaaatggaaaggaagcttggcttttataaaaccaacagccggatgtgatcagttcgcgtatgtattcgtatcatcacccgctttgacgaggggaactggactggacggggtgtggtgtggtgtggtgtgggcgcgtcgtctccaagcgcgacggcgacatatccatccatgtccgccgcaccgcacggccacggcccacgggacaagagatggcagcagaaaagccacccggccgctgccggttggacttcggagatgcagctccggcatccgggtcaaaagtttcctttgttattaccgctctttctctgcttctttcctccgctgctggttgacgaagcagagtatccaatcagtgaagacgacgacgacgacgtgtttacgcctaatcccggga

SEQ ID NO: 1833 - DNA, 1659 bp, Zea mays
  misc_feature (1)..(100): optimal_loci_173224_G1, chr5:4924455..4926113, Cluster 11
gaagttcaaacgaaattgaaattcttgaagtgaagctctcccaaacaggccttgggtatttatttggttcacatatttgtattgtaatgtactcgaaccgttgaatctttgactggaacatgtgtagatttggtatacattatgccgccagtcagactttcaaatataattctcgagaagtcaaataatgactaaataaacttgtatagaaatactaatacgttgttattaattacaattgaaatacgtggactgatacaagctccatatttggctgcattctttttacggaccgagggagaagggagggatatgtgcttgaacttgaagtttggtttcggactttcggttccatgtttctctgctctgtcctcgggaaggcaatgaacaaacagttgttcgagttgatgtgtccttgtctctgtttgttttggccggttgcgtgagtgcaactgggcatctgctgctgcctccctcgcctggaccattgcagggtaccaactaccaagagcttctcttctgcgctgtctagagcggaggtttcggtctggatttccaagtaaaatccagcgagcacaacgaaccagctcaactgggctggccgttcacgcttctttgagacctaccctaattcacccaactcaacgttatatagaatagcttaacttcagtcaaacctaggattttattgtttttgacagagatagcgcttttttttaatttgtcattttgagagtggtgcaacgaaattaaaggcctcagatgttgctccctccattctgaacatcgctacaaatttgtcgattagctggtggtgcgttgttgaaacaattccatcgccatcgaaagccaaaacaaaaattctcaagttaacgtacgtgctgactacggtaagcacttttgaaaccacaaacaaaacgaaggaaaagaaaaagagggttcaggaggaaggaaggccgaatgggtacaacaaaaggtgccaaatgggatgcagtttcctttattttcgaaagcaatcggataggacagctactgattatattaaaaaaaaggaaataaacgataaaccctaagtattatttttccggctgtcaggtggggcagctccggattcccagctagatttccttggatcgctcgtcaccaaactttcgatttgggaatcggatcccagtcctttttattgctactagtcctatcgtcattttttgttgttgttgttgtgcggtgaagcagacattggctgcgactgcgaaagctgcagttcgtctttccatctaataaaatctcaccgacagatggcagcggcgaatttgacagccaatttttcaattccatgccctcgaatatcaacatctaaatcaagcaaaatagaagaaaaaaaagtgagatgggctgggaacgtgtggctcgggtgccagccgcccctccaaagctcgccatcgcgtgcaggtgcagcgtgcttcgcgtcgtgagttttgaggagggtgttttgtcatgccgttcatgtgtgcagaccgcgataataaactaataattgcggcgggccgaattgttccacgcggctctgagcgaggtactgatgagcaggctttttgggtcgcagatcactagaccggcccggcccgccccgtctctcacagtccggccacccaactt

SEQ ID NO: 1834 - DNA, 1526 bp, Zea mays
  misc_feature (1)..(100): optimal_loci_174019_G1, chr5:9822725..9824250, Cluster 11
ggcgggcccccacctccctgccgcacttgtgccactggcctggcgctctgcgtgttgctcggagcctgcctgggagggcgggacggagggacacggcggcagcagcacctcgcggctcgtccgtactagtacggtacgtacagagctttgactgtcctgccgcgtccgatcggctcggctggcacgcctactcgctactcgtactggtctaagtggcgcggggcccggggtcataaacccaaagctgcagtggaacgaacaagtgatgcgcacagtgcggtgcggcccctttctgcttctgccccctgaattcgggactagccgcacccgcgagctggtgataggctagctcgtttgtccgaagtgagcgacgcggggtggaagcgtggtagtaggctgctcgtctcgtgttcgtattgcacacagcggtggctcccgccagtccgctggtgatctgcccgcgctgctgccttgcttgccgctggtcgcagtgacgacgacgtctagtacgcgcgagaggccgccaagccgggtcagggcagggcaggttccccggccggccccggtgtgggagtgggacgcacgaaatgcacggtgccccaaactccgtagcgagcgccgctggcgcccgtggaacggcgctcgaagcggcccctgccagcgacgtcagcctcggggccgacgggtataacttctcgtttttcttgtctcgagacctgtcgggcccccctttttccagtttcttctattcgggcacgcgaatcgatgcccgccctgcccctgacgatttgcctgcaacgattgcacgcacgaggacgaaggacgggcgatgtctccgtgcacgctctggcctgcgacgtgtgcatgcatggagctgatgataattggtgcccaagttcccttttttcttattaattttttttttgcgggtaaattggtgcacaagtacggcactgtttatacattgtttcgtgcatatggtaaagagcaaggaaaatgatttgtggcaaggcagtccatcgtgcctaaccttatcggaactaggactgacgtacgtacccttatccaaccacgcattatggactgcctatataagatctcgctttatcgtaatctaatcgtttttacacgtgcagcggtcgcgcggatgacgtgtctatgggggtgctgaaaatgattgtgccgcgactgtgagggccaaattacgtgcgctgaacaccaaccaatcccggtcaaccgtatagaatttttttaagcaatggcgctgtcgggacgtgaatctcgagcccaccgttggccaagcgtgcgctccagccgtctatgagcgcgggaaagccaaggagcaccgtgatctggtctctgccgacctcacagccacgaccaccactacatgctaaattctaagaatcccttgatttgatctgctaaattataggaaccgttccatgtaatatctctatatgcaaccaactggagatctcgtacgtagcgtgcgtgttcattacacctgattgacgtggccgttt

SEQ ID NO: 1835 - DNA, 2896 bp, Zea mays
  misc_feature (1)..(100): optimal_loci_174338_G1, chr5:11797178..11800073, Cluster 11
tttaggttgctagagtgggttgcagcctcgcttgattctgggtcgtaggaccatttttttccccgcaatccacctatatgactgccacatttaggcccttttataatacaagaataattttagagaaatcatagtaatcaatttattttcgtagagaaaacacagacaccaggaaaaatctcagccttaggctctaatcttgtcaacactctatataagctggcacgaacattgtttgaaaagaaaataaaaaatcggtgagcgttgccgatcttaaacgtatcagtcagatcgctccgtgacatggacacagaacaacgctggtgtgaggctgactccagcggactctttagatggatgtgcaaaacaatattttatattgcagacgttactatttacataatactccgtagaattctaaatcgatacctaagatatgtagtgtgtaggctgagagtgggcggcagcggcacaggttcgaggcacctgtcattctgtctgtcaagctcacgcgccgaaattcttcacccacccaccagtccccgcgggtagcgtcgcgtccccggcgcgcgcacgaatttctctccgccggccagggcccccccgtgcgcacatcgttgtcgtcgatcgccgtccgcccgtcgcggcaagagaagaaggcgtcgccgtcgagggccaggccaggcaggacgctctccgggcgcgcgatgacgcggcggaaacaaaaatctcgcgcctgcacggaacggaatcgaggacagccacatgacgcggacgggggcggccaggtgggggcgggagaacgtgtccatggggccggccggccaaccgcccgggatgggaagggaaacgaacccggacgaacggaacggtggccgctgccgttgcggagggccccaccggccggcctaacggccaattgaaaaagcggcgcgtcgctctctgctgcgcctgcgcactatgcccccacacgctcgctgccctgagctcgcccgcaccagagaagaaaatcgtcgtcgcgccgggtccagtccaggacctcgttcgcggcataatcagaccggccgatgttgacggccgatgttcgctgcccagagttcttttttccttcactggtcgcctagatgatggcctaatctcttgtttaacgatctgttactatattttatgcagtttgggaggtcgatgaacgagtagtttatgcatggactatcctgggggtgatctcagctgcggaaacgacccgatccgagcccgacgcccgtatgcatacgtggtgtggtgtggctgcatgcttgcgtttgcttccatttgtttcgcccagatcgtggctgatctcttgcgtttgcacgcagccacagggcacgagctgggttatcgtctgatgacttgtgccatgatagtagggattactatctcacacacaacctaattaaccaagagaccccgcggccacggagcaagcagtataaaaacaaagccgtcacatgcgcgccttggagttggcgccctggaagaaatctctggcatttccggcgagcaacttgccccgccccccgaatcgcctctccgtgagaacaggtgtgggaaggaccaccggcccggcgttcgaatgcggcgtgttttgcttaaaaaaaacagcatgttccaagtgccagtagattagccattactaaacgagagctgcatacgcaagttgcagccagccagatagctagcctagctactagctaggaggtctcttgccgagattcggacctaaatttgtagcgtgccacttgtgtgcgatcaaataagcaacgctagtactctacgttacggcgcctaatcgcacatgtgcatggtcgcgacttgttaaagttgaggcaattatacaaacgtttcacccgggcaaagatcgaagaccacacatgataagtgggttcggcatttctaaagacctccagtccagcccggtcaaggaagatacggcagtcttgtataggtcggcccagttagaggaataggcttcgatcggaccactctatgaccaggcaggaaattgtggcccaacctgatatcaagataaaagcatcgtcggcccagttggagaaataggcctcacccgaaccgctcggtgaccaggcaggaaaatgtggcccggccttgatatcaagataagcctcgtcggctcagggttaacctccacgtacatgtgttcatttgtgtcgagcttaatggactagcacgaagaacgaaaaaagcacaagctacgacacaaaataattttagaccgggctgggcttgagctgaggtcccggcccaaggacgggaacgagcccgacccgtttatagcaagcacgaaaaagctcattttaggcatgaaaaggcttgcatgcggaaaaaagacccagtcccaagccacctaggcacagacaataagcctctatccgagagaaaaggcccagttcgatccagcgataccaggaccccagttcccaacctaaacggctaaacctaaacaagccatctcggtgatgtgaactcaaccacctaggcgcgagccctccactgcccccacccccgctgctgccatcgtgaagacgtcctgagacacgaggcccgagtagcgcccagctcgactgcctccatgcgggcaccgacgaggcgacatcccgaccaactaggagtaccgacgacgcagcgtaggtcctcgctgaggttcgagtcggcgacgccctctaggctccagttgagagtccaaaaccaagctccaccaggcccacttcctgcagctgtcaaccatggcgccaccgtcgcgaccacccgacccacagaccgtcgtcccgacggtccaagcaactccggctgcgcctttttgacttgctactgctccacgacctctagaaccagaaga

SEQ ID NO: 1836 - DNA, 1667 bp, Zea mays
  misc_feature (1)..(100): optimal_loci_174374_G1, chr5:11894443..11896109, Cluster 11
ttcatgcgttcttcttttcttttctttttttgattttggtccaggtgctctttgcgtccattggacttggatgccacgggacactggacgcctcttcggtggaacggcgcaacttgcatcgagtttctcctttggtgcgtggcgtgagcgcgagcgtgttgttggcgcccgtcaaaattatgcacgtctttcttcctttcttccttcctttctttttgggaaataatgcgtgtcttttcaaatgatgctacagcgctactgaatctctctgttaagcgggccgattcagcgtccgatgatggttgagatccggattcacgtcccagctggtcagacgtacgggctcggaatcgggtggcccaaaatcgaaaccatgctccaggaacggtcagcaacagttggacgaccgcaaaggcacgtggccgctatggaatggaatggaatggaatggaacaaatatggaattcgggcatctagccgttgcttggggggctcggccctcttccacgcatcagcgtatgggccggccaccgtggcccgttactcgtagacgatccaaggaccattaggccccgcggtagaggtacagaaggcagatccagccaggccgaaaggacggttttccgggaaagccactttgacccatctcttgcgtaccccatctcttgggcccatggcaggtagtcttattgatggcagaaacaacttaggacttcaggtgactgaatatatgacgctattttttaattattttcggtttgtttctaaaggccaaacagctgtgttgctgtggtcgtttgtgttgtttcgccgagcatgatgggccgccggattgcagttcgatatcggctttggtgaaactttgcatattcctgatccaaactttacacttaaaaattcagatactttggacaactacgttataaattctatactcaggtattcaatattcgtactctacattcaggaacttggtgttgtcatattgtaaagggctttgtactgcaagcacgcgcgcgctaaattaaaggatcgatcgggcagctcgtgctcacgccgcagcagctgggcggccgctcgcagacacgcgccgccccgctctgtaccgtaccgtggcgtgctgctgctgcgtgcctaccgacgcgaacccatatggccaggccatatctgggggaagagacactcggggcaatcgccgaaggacgcagacgcagtaggtaggtggtcgtggagacgcacgcaggtggccatcaggtaggtggtgggagtgaagctcgaaacagatcgggtccttagccgtgaatccatgtatgatcttgtagtacctagttctcatgacaatcactgatgaacacaacacaaagagtatttgctgggcgtgatgtagttagtagtacttgcgtatctgcctttttgtgatggcggtgtgtgcccacatttccgaggcagatctttggccgagatagatagaaccgtctcgatagggcatttattcaggattcgtgaaagcggccgggccggccatcatgttactactaaccgccagctagcgctttttaacaacacaggtctggtcttagcttgctctcattagcaagacctgtgagcacggggatccataaagaactgctgagaactggagtgtactggtagtgtagtagagaata

SEQ ID NO: 1837 - DNA, 1518 bp, Zea mays
  misc_feature (1)..(100): optimal_loci_175543_G1, chr5:18555078..18556595, Cluster 11
ttatctatataaaggaggggtctggacagtttggaccgtggatagtccgcaaggactttttctgtgctcaacagttacgtttcagatgcagtagtcgcatggagtgcaggaatagtacattgggaactcgatcgatcgaattctggacacactacttgtctactttgctgacaaacaaacaagcttgtgtgctctccgatcgggcacgtctcttcttgtgtttctctgtcctcacctcatggttgttcctgttcccccaatcacgctgcgacaaaagactgtctcgatctcccaagtctcaacagcaactgcatgcatagcagctaagctagcagtggtagttagttacttgtgagctgcgacttcgttaaagcatcgtcctagctatagatagtctggcaagtggtgacaagctaggtttgatggagcctgctgcctgactgacggaacgagggcacgcacatggcggaaactaaccaatgcagcaggtgcttgtttcgtggacgggagggagttgtgcatgcatgcatggagacgtaggagattcgtcccgtggattactaccgctagctagcttcatcgattatagccgccggccatgagaagaagagttcgctgctggaactgcagctgagcttgcttggcaagttggcatctccccgactttttatcctgttttgctttagcgaacacgctaccttttcctttacgtcagtcagatgctgagtactcattcagtatcgcgtatggttcatgaatttcagcttcgctacccttggccaacatatatatgttcaggggttgaccctgcgccttccacagttcctcgcaaaaactgcagcttatttcgtcacagcttctaatttttatacagtattttatctctataaattgcagctacagcagttcaaatagctgacccatatcaaatgttgtccaacacgtgtgactgtgtgcagtgtgcaggagttcagaaaaattgatcccagagcctacgaaagtgcgttaagaaagtgaaacagaaactttttttttaaaaaaaagccctcaacgagaagcaacaaaaggtatgcaaaaatcactgaactctgatctgcactggcattgaaactaaggacatgcggtgtgctagagaaagcagtgcaacaattactgttcgatcgaaagggctatgcaatgtgcgtctttatctcataatggaccatatgtaggtactgcctaaataaacatgccgacactatccaacgtctgcaaggaatatatagaagttttgaattattccttatagtagcactaactagtatcagatcgtattccttatagcagtactaattcattattagattgtgcgatacgtacgttaacttatctgcttattccacaaactaaatgaaaatgtgagaaataagcagcccatacatacagactatataaagagtgttcgtcaaaccaaacattggtgtcataaagatctaccgactcctaaaatgcacgttgaggtcctaaaataccatgtca

SEQ ID NO: 1838 - DNA, 2482 bp, Zea mays
  misc_feature (1)..(100): optimal_loci_177465_G1, chr5:28124618..28127099, Cluster 11
ttcaaacctacccgggaaaagaaacgtgcgcgccaacataaaccgcatcaagacgacacgatcagttgggggtgcgcacggtgaaaaagctaaagcggcgacgggcgacggcgacgcgagaacggaaagagacatgaacacgagtcgcggtggaagtggaacgcaagcgtgtgaggagagagagaattggggaccgaggagtgcacacggacgcctaccgcgcgctgcgctgatccttatcccgctccggccggggccagtgcgccgacgacggagcgagacacgggcacgtaggacagcgagacatggtccagtcccgtcgccctcagcgtttcagtagagcgggatcggagtcaaacagcgacgtcgccttggccttgtccccagggcccaggcacggcacggcactccccccctcccccccaacccaacccaggctgaagtgggggagggcggctgcgcggctcacccaaccgcgcgcgtggatcacacgacacgacgacgccgtgcagcgctggcctagcttgccccgatcgccgccggccgggcactggccgcccgcccgcgcgcgcggcgcgcgcgcgttcgtcgttcgcctgtggtctccacgcacgcacgagtcgcccactcatataaaacgtgatcgtccaggaaaagaaaggaattctgagcgcccggcccgtccctttgtccactccacactgctacatactgctagcagcaagaacgtaacaactccgatccgtagtatctatctatctatcacccagctgctagcggtaccgatcttctcgcacggcattgatgaatcatgcagcgatcgacagcaggcagtggccgcctggctggctggctggccacactcgagcgcgtgcgtgcgtacaggtacaggccagccacaggggtgcgagacagagctgataagggcggcaccgggggcaggtcgcaggcctagccgggaacatcccgcgacggggccaggcacggcaggccgtccgactccgacaccgcccggcagcccggcgacaggaacgccagtcgtccagcgctgccggccggccggcgcggcatcatttcggacacggacccgtcgggcgatcgagtagcgagtaggcagccgaagggccacctagcttagcgcttagctagccactcactcaaccggcggtccaactcagctcccaccgcgccggggaatggtgggggagcgctcggttggagtgggaaggaagattggcaggcaaagccttggtttttataccatttgcgcgcaaacctaaggccttgtttggtttagggctcgcaaaagtacagttagaacttagaacagtgcctgcagcactgaactttctcgctcgcgcccagcagctgctgtcattgctgtccactgcctgcttgttcttgtctggctgggtggatggagtcatggagccccctccaaacagctcccggtgtccagcgcttgttcagttgatctcagtcttaaaaccgaatgcccagggcccgtccaagcatgcatgtgccagacgacacttctgtctgggctgaaactgcagttataaacactgatcattcagcctgggccaagatgagccagcacctcgcgtgtctcctttgccctggggcgttccacgttcgctcaaagcggtcgggccggacaccgttcatgccggcgcggccgccacccgccacctggcgcgtcattctgctcgagccctgccaagacggacgccaaaaatctaccactcatccaatctgccgcgcacagagtcgatctgctgctgctgctgctcctttgtccggaaagctttggcgtcgtcgtatggatcacgaattgcgcgagctagctgagggaaggagattgcctacccccctcacacgatagacagatagatagataacgaggaaaacacgagaatctcgcactggaaacgaaagagaaaggaggggcgagattgttcagagctagtcgacaagcagagtgcttgtcaagcaccggccttcccaggccctgatgttttggctttcggccacgcgccagatgctcgcgcagatctccggacgcgatggtagcccggtgacgagatctctgggacttgacatcgatcgggggccaccctgcccatatgccccctccgcggggaaggcctagggcgcctagccatggcctttgtcctcctcgagtcctcgtccgcatccaacaagtagtacgtgatctgctccatggattcccccagatcaacttggctttttgtcattgtggtctgtctgtactcgttacgagatttaattctgcatcatccagttacaagggggctgtagcctctaggcatctagcagctccacgggtcagcctgttttccattgatcatggtgtgggtttgggcttcagcttatcatgtgtgggtgttcggcgagtggcgttggaggctggagcggtgatcacgtggctctagagggcgcctggcttcaccaccgatat

SEQ ID NO: 1839 - DNA, 1451 bp, Zea mays
  misc_feature (1)..(100): optimal_loci_17930_G1, chr1:99974789..99976239, Cluster 11
acagccaactagctaataagttggcgcggggaactcaggcccagaccgtgcatttgcagccgcgccgaatacacaggcagcaggtcaggaagaggtcgtcgcccagtcccgggtgaggagacgagcctgttccggtggctgttttgcagccctatatataactgttgaactgcagctacagagtatttgtatcactggttggcagcagcagcagctttaagaccatccacatccatcaccctcctcccgagtcccgacccccgactgaggtcgtggtcaacgacccggggctcatgtgatcttgacacccagcagatcagagtcctgtcccagtgtcccgtgtctgtgctgcgcttctctgcacctgcccggagacggccgacggccgacggccttgcaggctgttgcagctcccgtcgtctagcgcttgacgtgccgtgtcattatccatgacatgtcccaaccaaaaagacgctgtgtgcgtagcaggtacgagcgggcagctgcgagtacaaaaacaaatcccatccggatcaaagagatacgaaactttggggtttggagcggcaagtcctctgtcctttgcgtctgcactggagctggagcgggtggagcctccgagcctggactggagcacgaggccgcgatcatctttggggcgaaagcaaatgcaaatccgaggagcttcgatccatcaatcaattccctccgccggcctggcgggatgtggacgaaccccactcgcccgccctacagactcggaaacagcgccggcagcgggacccacacatgttcctcgcctcggcaagctccccgcccacgtgacgtgacacagcccatggcgtcgtggcatccttcactggcctcgggcggcatcggggcccacatgccagtcatgcagccgcggcggcaccgctctccctctgcgtgtgctcctgctccctctgaccggcctgccctctgactgtcaccagccactgatatgcacgcgctcccgcctccctgccatgcgggcccagatgaggcggacctcggccgcgctggtacgtgtccctccgaagtacgccaccctcttttttattttctctgcgtgcgacgagagagaaaacaggtgagacggcgccatggctgcagtgggaatgagaaagaaagatgagaaccaaagtaaagcaaaagaaaacgcaaataaataattaattatttggtccgggcctccctccgattgattccttcacccgcccgtagcacgccaaaaaaggcaaacctttttttttctaatcgcccgttgataatactaaccgctgtgtcagcggtacacaactagcctcgctaaatcgcgcctaccgtgacatctttcggtgccgcgacttgtaccaatactttcagaacaaaacaaaagaggggcttcttagcaaccattaattaattatggcttcgtggcaaataatgag

SEQ ID NO: 1840 - DNA, 3100 bp, Zea mays
  misc_feature (1)..(100): optimal_loci_180179_G1, chr5:42844362..42847461, Cluster 11
cgcgcagatgacgcgcactaataagtgcttcaagaccgacgaccgagctcgatggctcgctcgctctccaactaactccaactgctgagtaagtacgggagctgcactagtgcacacgaatgcacgtaccggccggcccatcggtttggacacagtgcatgcgtcgtcgtcgtcgacggcggttgcgcggtcgcgcgagtcgaggtgctgcactgtatgcacggacgtacgtacatgcgtgccggggccggggccgggggccggccgtcgcgtcttggtactgcgcgctcgcgccgcgcgtaccgtacgtaacgtaactccccggcccgtcccggccgcgtgcattcattcttccgatggagaagtgcacgtcgttactgccggatcggtgtagatctcgcccggacccagccggacgtgtccaccattatctctcgcctccgggaccgtacctcgacgaggcgtgtaccccgcacgtacatcggccggctatgcatggtagtacgtcgtcgagcacgcagcgcgaggccggcggcgccgatatctacgtacatgcatgcgcatcatcatatcgtacgcacgctggagcaaagtcgtgcgcgtcgtcgtcgcactcgcacgcacggcaagtgtgtgggtgtgggtgccacctgacccctgtagactgtgtggatgtggtgcctctccatccgcgtgtgtgtatgtacctgcagccaggagatggatgcatggagccccgatcgtacagacgatggagaggacgcgacacagctagcccatgtcgtgaaggcatctagctggatcggatcgatcgtgtcgcgagtcgtgacataactgatgatagcctgggaagcgcagacacaccgggccagaagaggatgaggccacgggttactgcagctgcacacacgcgcgcgcatgggtcgtcggtgcgcggcggatctttccagctattagctaccacctgagcccaccacagcactgcccgcccgcccaccgtaccggcgtttttagctgacggcaacggcgccgcggatcgcgcgccgacacgggcagaggacctgccgccacgcccccacaccccccccccccccccacgcatgcatgcatgcatgcatggcgccggatccggtccgtacgcgtaccggtccgccacaccaggtgcgaaagcgaggcgcgtcgatcggcccatgcattcatgcgcctgctgctgctgcagcagctacctgaacggccggtctgcaggtgcggtgcaagtgggcagccaaaaagttgaataatttgccagtgcaaatcgcagtgcgtggatgatggttgatgggtgcgaggaggacgtcgcaacggtgtagtggccctgactggctgctgaccgcgacgactgtgagcgagcgggtggtgccatgcatggcactgccaactgcacccactggcgcgcgggcgcggcactgcagggacggacgacgaagcttttttccgcgccacctagcttcctcccaatcacaataacccatcacgcctccatgcatgcatgcatccatcggtcgcacggcctcttcgctccacttgtccggttgtccctgacgaccctgatgagatcctcgctcgtcgacaggcttctagtaggtcgccgccccccccccccccccccctgcccacgcatcgtcccagcggcggcggcaggaaacggaattaatggagtcagtgacgaacttgctgccccagcgaacgcgtgcagtagtgctccgagagtctgaggatttttacttggcgagctccgcgcagccgaccacctcgctttacagttttacgccggcacgcgcggcacgactggcggcgacgccgatgccgatgccgccgccgcgttatcgcagccgtacgcggcgtcgcgtactccggccggatgcttccgtccggctcgatcggacggatcgtggaaataagtggccaagatccgcgatttttaatttgtttgtcggagcgctgtccgtgtccaggtacgtgccgtgccggcgtccgtgcgtgcgtgcgtgggtgtgcaggtgggtaggtcaggccgtcagcggtgtagtgtgtcattgtgtggcgacgcggcatgcagtggcatcgcaggcgcagccgggtggatcccgatcggcggcagcagcagagtgaaatggggggccagtacagtacacctccgtacagatgcctgcatgggcggtttattaattcagaccatgtaattaatgtccatcactcatgcaagcagagggggtaactagtagtatggcagtgaaagagggatgaaatgcatggactttatctactgtgttggtcaacctgaaggtgtggcaagattacgatggcatctttgcagtaaccaaatgacgatgtgaggaggtcgtgagggtaaatccgatctcgtaatctatcgggtatgcatggtatatggaggaaatgagggatgatctgtgtttgtttttcccttggtgtgtgcgcgcgtgtgtgtgtgtttttcccctctgggagatgagctctgacgaacaccaccgcaccaccgttctctgctgccagtgttactagctgtgatgagaaacctgtcgggatttatttcggctctcgtacgcgtgcaattgattccgcgaccagacagtgtttatatatggtgcacgttgtgcatgtgatccggggattatgaaattatgcggcagccgcacagccccccctcctctgcacttgcaggacggcagggacgagtgtttattgtttttctatgcactctgacccggcctctttttactcgatctgcgagcgataactttgtggttttagcgatcaataaatatatgtgtgtttggagtgagagcattattagtttattactccactcattaatttctgatgagtaaccttgtatatatatgcgccatccgatccattctgtaattgggattgtaattcggttactttagctttgtaccaataagtcaaattcctcaaattggctgggggtacgtatctggcacaactcgtagccaaatctcttggaagagctgctggtaattagtagtactgcttcatgctcagcactcagccggtggtaactctccagatataataa

SEQ ID NO: 1841 - DNA, 1521 bp, Zea mays
  misc_feature (1)..(100): optimal_loci_181916_G1, chr5:54185964..54187484, Cluster 11
agtgtatccgtgggccaaaatattttcactcgtctccatacggttgagtatcccttgagttttgggtttgcacgttaaattgctaaccctgacagtaggcactggtgggcggcagcagcagagcagctagcgcggcacacacattgacactggtggtagcgcacaccccgtacgattgcatgctggatgacgatgccacggaggggcccggccataacacggacggggccagcagagcacagcaatgatcgcgtgccagctcgatcggtcgctgggtcactcaatcggcagggacgggatgggtgactcgtatggcagtggcagccataccgacggatggattattcatggatgggggagagacaggaaaaatcacgcatggggactggggggcatcgcgatacattacaagctgacgctgcccgtgcctgccgggccctagctggcgtcggcgaggcatattgaagtgtatactaccagactaccaccagtagcagcagcagctagctagccattcacccacacgcatagcggttgcgtgttcgtcgtccgttccccccctgccctgccctgctgcgcactgccactgtgactgtgtgctgggggtccggtacggtggcgtggagtcgtcgcagcgcggggttatgagcgctgccgcctgccgggacgggagcatcgggtgcgctcgctccgccgcgcgcttttaagcgccggagaccactgcctgcctgcgtgctgggtgacgacggacgcagcaggcacgcccccctctctcggtcgccggtagcatgcacggcaccaatgtcacgatttgcagtacagttaatagccactagatcggcggcgagatcgtcaatgccacattattcatgggctcgcgtcgtggccgctagctggccgtgttttaactccacagttactggctggcctaggtactgctggcagtaccacaccgtacgtctacttgctccttcctaaatttctaatttttttagtagagtcagaatataataatctggaagctacgcggttgaatggatctacgaacgccccgcggagtctcccgttcgagaccacggaatctagcgaccccggcccatgcaatgcaccgacatgctcgacggcgatggagcgagcgacgagcatgcgttcccgccgcgtggtcgcgaggacgcacgtacggcctcgctcgggctatcacgtgctgccgtccttgctctcgcgacgtcacgtcgcctcctctaccccgcgcacgcgaggcgtgtcgcgctgccgtcgtcggccccgggccctcatccatccagtttccttttcgctctcacggaccacgggccacacggcgccacgcggcggtgccggagcccggagccggggccctcctcttgcaccatgcatgagcgtgatgcatgtgacgagcagccagcgccgacgatgatcgtgtttagaaaagtatctgagaatgaatctccgatgtctgtattccattaacgtaaaacagtaaatacatagtgaacggacggt

SEQ ID NO: 1842 - DNA, 2591 bp, Zea mays
  misc_feature (1)..(100): optimal_loci_182884_G1, chr5:60243679..60246269, Cluster 11
caggccgacgggtgcgtaaacggccatgcaaagtaatgtttcgtgctgcagattttattgtttacataatagagtttaaattagggactgagacagtgagtggtataggaactcagcagctagagatattctagtcctccgacactgtacgtgtatgcatcatcttgatttagacggcctcccaaggacactgttgttcctttttcttgtcctgtggaagtacgtagtggagcgacagtagcaatgagaatacagtggactagctagcttgtccggcttcaaggttgacaaaaggtcgttttctcgtgatcaatacatgctttatagtatatatatacgtacatacatacaatacagtatctccgatccctctagacgttagcttcatgctactcattagggcgtatatattaccctcttcgcaaagatgaggtgcatgggccacaagaatttggcaacggatcgatcatgtgcaaaccagctggcacttgaggtgaaagtagtcatgattttttttcttcttcttcaaaataaccctctcccaccatatgctagctgtcaaaataaccctcccacctctcctgatatatagtgatatatattattaaatatccccctctcctacctcccaactacgaacacgcgttggtttgcatgcatggttttcatcaagtgattggtttgcatttgatatgttgtcccccaaggatatttagaagaaaacgaaaacaaattaaatctgttgatatgtgcattggtgcaagccccttccgtacatgcatgatgacgatcgagttaggcggccctcgctagattttgtggaccactttgaccctcgctctcactctcagctggccagccaacagcaaaatttgacctgcagcacagcttctgtttcacgagcaatgcactgcaatgcaagcaagagatgtagctagctggtgctgcatgctagctaggcgctatatacctcgactctcccctgccctccactccatgcatctcgatcttccgccacgtacgtctttcagaatcctgctgcgcgctagctagctgtgcacagcaaagaaggaatcagacctaataataagaacagaaatcaaattattgggccaataatgcatatgctatcgatccatgcacgcacagctcatcatatcaagcctgtctcctcgatctgtggttgcttagctagctgcaagggattttcactgcgcgacgatgatgggccgatgacgaaagtgtagtgtagctgagctgagctgaggtacactagctagacgtactacgcgtacgtcccaccgtactagctctagctagctaacagccatgcattatatggacggacgcgtgacggtcattattagaggtagctagcacgtattagcactagctatagctagtgtggggatatatatatatatatgatggaagaaacggaagcagcagcaaattaaagctatatatatattaggcagctatgcatgaatggagatggtcccaaatgtacgtatatactcgtatattgttagctccgtcctctacgtacagatagataagcgttgttgttgtgtatatagataggtatcgtcctatacaaagacagagagagagagcagacgcagcggcatggcatggcatggcatgtgcccgcgccgctcgctcgaataaataaaggggaaaaaacctaattaagccgcgccatcatctcaactaataacctactagctactaccactactaataataataatatacatagccgtcgtgcgtcgccgtgtacatgtaggaaaaggatgccggccggctaataggcttgcttgcattgcattggctggtggatcttgggcagtgcgcgcgcgcggctgcactactgccacttgcatggcctagtacccagtgctctctagtgcttgccgatgggaggcagcaggcagcccggccagttgcaaacagacagacccacctttcgttattactaacagcgagaacgcaaaaggattacacaggggcagccaatcaggtacaattaaggggctggcaagtggatgttgtgctgtgcctgaataacggctctgcggtggagagcctgtccatggtgaagagccaatagaaaatcttcacttcattagggaccttaagcatccatacaaatgccccatcctccacatgcatgttgcagcgagctagcagcaagatagcctcccgagaagaggatggtggatgcatgcagtgagccagtctgctgcactgcatgcttctctctggcctctggcctgctgggacagacagacagactacctctgccgccgccgtatctgcctctgcccttgtgatccaccttcttctcaactcctccgatgacaccagagttttcccttgtctgaaacgacatgaattccgacttgtttgctgctgaaacattcattttaacagcctgtaattaaaatgaatggatggacgcgtccttcgttctgtggttcggtgtcagtagtagctagtagtatttttaatggtcacttttgcgctttccttttcttttaatgaaaacattcattttttttgtcgttgataggaaacatataaatagc

SEQ ID NO: 1843 - DNA, 3559 bp, Zea mays
  misc_feature (1)..(100): optimal_loci_199583_G1, chr5:171183943..171187501, Cluster 11
cgtgagaaccaaacacatcttggttgtttacttgtgtaccaatctatactccttaatgtttgcaattggtttccctcagatattttttttgtcctcccgttttgtaattgtggctgagcatggtggtacagtagtaatcttcgtctgtaccgcgtgctgagttgcgccaaagcgacagcgttaaacacagctggcgtctatgcgttcctcacgtttttaaaaagggggtcctgttcgtgtctgaccaagctacatcgcaggttcaacgcaccgctcgagagcaagcacgcagcgagtgaatgtctatcgcaggcatctctgagcactcactcgtagtaggacaggacagtataaaaataacggttgtcagagccgcctgttactcgtacggctgtccttgcggtggccaagactaccaaaaaaaaagaaatccgtccccgcccgtccgcggatttcgacgcgctgtgctgctctgctcgtcagctctgcgcggacaggacagccgcacgggcgtggatttccgcgcgccccgcccgcccgtgtgtcggcacccgcgcccaatccgggccgcccatccgtccgccgggcgccacagggaccacggccagtcaaaccggtcaatccccgcttgcgtgcccccccccccgcttgcgtccccccgtgccccggcgacggaggtggggaagacgagaaggaaaccggattggcggaagcctcgcgtagtcgcgtgccgcttttcttctccgttctcgctcgctcgagtcgagaacggaccgatggatggggtcgctactggccctccgccctcgggcgcaaatattcctgcggggcccacccaccgaacccaagcaggacagccatccgacgtcgttcggcccgggcctcgccgaccgatgcatgccatgactgcaactgcaacgtacctctctctcatccgcagccgtcggggggcaagggcaacgtgtcgacaggagatcgcgcgctggggcgtgcgggacgggagcgagcccctggcgtgtgggggctaccgggcagggatgggccccagggcgcctatgagtggggctgggtttgtccccggtcaaccgggcagcacgcgggggcggggctcgtggggtgcggtgccggtgccggtgcggaggagatcaggagagggctggggcgcacgtgcgggacagctggcgcgggtgcttccagttttgaccgcatcgtgctcggcgtgtggggggcctggagcctggagggtcgcccgcagtacggcagtagtagtagtaatgacacgcgcgttccgtactactaacattaacggagagcctcagctgacctgctccatccctgtctttctcggtcctcatcatctaggccatcgacgattcagtctcggcaacttgtacctactactatcctcatcgatcgaattcgtcttttcctaatcctgatcaaagagttcatcagcgcgcgattcctcgtctcatccgtcgacatcgctcgtcgggttgtctctctctatctccggccgcccttgggctcctcctaaagcttccggtcatggacggtggcaaaaactgaaacgctgtcgctggcatcggcagtcattttgaccaccgcctcagccttcatttcagacacggcgagcgtactcatcctttcgttgccaaaaaaatatttaacaggtgtcttctttcaaaaaaaagtacaacatcattatatttaataaaaggaaaaaaatgttcaaattacttccctcgcctgtaggtaatgaccatataatctcctaaaatattttcctccacttaaccccttcctctattcgagttagttcaatctacctcttaccagaatctgtcttttctatgtataaactgatttttttagttcaaatttaattggttagtacataatgtcataacttaggctaaaaatatattatgactgtcctagtggcaatgaagaaatgactatttttttagtggcgaagaagaggaacgagtgtagctggcttgatgtgtccgtccgtgcatgtaaccatgtatgccgaccacggctgcgtaccccatgcaccagtcgtgcgccacatgtttagccgtgccaggcagtagcatcggcagactacgtacgtacgtactggtgcaggtgacggagcaatccaatcccaagctgcatcgtggactggtagtggtggtggcgagactgctctgctcagcgtcagctggacctggacctggaggctggagctttcacgtcacatgcatgcatggcactggcgcaacgcatgcatggatatatgcatggcccggaaaacgttgggccttccgctgatgcagataaaataacctctggggattactccatagtactccccctccccctctgccagtccggtccacgtccactctactgtacctgtactgctatactgggagattttaaaggcgcctgggcctggcaaggctggcgtgggataaatggaccggcggggctttctggatgagcgagaaaatggttttctgacccatactactactactactacagtcgtagcggcctgtgaaccttgactgcggtgcatgcagatgcagtgctgctagctcattgcacacaaaacgctcagggccgcgctgtggctctcacatcatcacggtcacgacgacgacaccaagttggctatcagatcgccgatcacgtcaggccgctgtaccgcacgcgtacgtctgcgcgatcaggaaccaccagcgccctgccccctgcgcgctccaggtcgtccaggcgacccgggtggggccgggagcgaggcagcggagacccgcgacgtggtggaccgaggcgcggcgaggagcatcgcctcgcccgcccctcgcgcgcccggaaaaaaaaagccgcgggcacggctgagttgaacaggcagcgccgcgggcgtgccggccgcctcctccgttttgggccggcagaggcgtcgcctgtcacttggccggccgtcgtcgcggaaagaacggaagaaagaaagcgcccccggtcccggccccggccccgcctttcaccagtctttgacggtcgtcgcctcgcctgcgcccgccgcgcccgcgcgcggtactttgcctgccgggctctgaaccgcatgcttggtgtggtggcccccctgaccctccgcgtcctgttcgatgcgctgccgctgccgctgctgcctgctgcctttcaggtggttctgagcgctgctccggggtctcatcgtgtctctctcgtcgttctgatcgctgatcggggctgctgcgttcacgagctagctagctaccaccgcatgcatgttcaactaaaacataacaactgttgtccaagagctcgtccttagaagccccttattagttctaccaagtggattcatttggctaagctaggtctctcatgtgagatatgaatgtgagcatgcatgcatgtctcttgttctatttcttgctattctgaattatgctgtatttgttctggattgtgggatgaggtcccattcaaataatgcaataaccttttggaccgcctaaggtagtgtctatgctcctgtataact

SEQ ID NO: 1844 - DNA, 2254 bp, Zea mays
  misc_feature (1)..(100): optimal_loci_200759_G1, chr5:177853281..177855534, Cluster 11
ccaaccacgggatccgtcatcagccagcacgctgcacgccccaaatttgtgtggcgtggagcagcaggctcttccgtcgcgagttcgcgacgtgtaacgtgttgctgctgcaaaccattgcgtctttaatcttacctgcctagctcatctttcgccttgcgttctcgatcgatctcccccttttttgctacttttgcgttgtgatcgaggatggattgctgcctcgagtagaaagggacaaagggtgccgtcgagagcacaaaaattcgaggcagcaaaaccgtaacgctctcatgcatgtctctcggtccgtgaaaactactacacggcggtggttgtgagtttggaaagcatggtccctgcagggctggggatcagctgccgcagagtgggtgctgcattgctggagagcctctactttagttctctgatatatgtgtgtgtgtgctcctacagaaaaaaaaagaatctaagaagaaattcctactacgaaaaacaaaaaaaaagagtgtgtgctcctacagacctctcgatctgtctgtctgtctgtcttatgtgaaactcttttaggtctgatgaaatttatagtgccggggctcggcagcgaaacgattgtccctgtttctgcgcgtgatttcccgaagagtgacccctcgtacgcggactttcacgcgccgacgcgctggcggcgagtgctgactgataaggacacgtgtgtgtgcaaggcgacgcaggcagctcacggttgcaacctagtcgctgctgcctgctgcctgcgtttttttggtagaggtaggccgccaggccgggtagtcttcttgtggtagcaggcagcagacatgataaagaactgacatttaatatctacagaaaatcaggcttcgattccctgatgatctctttcggtggtactaaaagacatacagcgcagcggcagaaacggagctaggtgcgtgcggcgtgacacacacacggtgtagttggctcttgcacacctgtgaggctgctgaatgctgattgaccccggcctagctgaccccgtgtgttggaatggaactgtttgctgacaagaccggggcggggcggggcacacacgaccacgaccacgatcccgccgtacgtaccttccaacatctcctcctggctgcctgcctgcctgtctgtctcgcgcggtgaccctttgtgcgtgtcctcgcacagccgctgcattattctccctgaagcgagctggaacggaaatggcgctaattaacgatgatctgtgcctagcttgattgaatattcccagaatgcatggcggcgctgctgcgtgcccgcccccccgtccatccagagaatcccctccgcgatgatcaggtcggcatatgcagcatgccgataagagccggcctgccccttttggaataggatacgtgtgtgtgggtgtggcaggcaactggcatgcaaagctattggcttccttgtcacttatctatctattgactcggagtcagaggcaaagtcgagatgctagagggagggagggagggttgagtcaagcatgcgtggttgagccaagtcttccagtgacttttgcataatcgttcgattcggtcctgcatgtacacacgatcttgtaagaaccatatgctattcgacgtgttcatgcattttggggcatcatatgatatttagggaattaagataaaagcaaagccttttttttatacgggccgagagagagagtgtgccacacttggttcacgtttagaactatctatacatatggaaccgtcgcatgcttacatatttaggtcggtcgtcgtcgatctaggacatcgacttttttcccactcctttttctacaagaatcacatactattctagtggccacatatttttccgtgctaactagcaattgatgtacattctttaatgagagccacaaaattctttgatgagaatgtggcatgtattctcaaatcaacccctcaaagactccaaggaataagcagtgaaacaacacggaagcaacaagtgcagcggaaaacacaaatcgaaacgaagaaaacacaataggaacacaatctctctataattaagcaaaactagtttgactgagagaaccggcttggctggctggtaggagaatcggtctggtcagcctagccgattttttctacacaacacctcgagtcaagatgccaaaacatgttcttgactcaaaatcaactccactccggtttgcatatttagttttacaaagcagccgctt

SEQ ID NO: 1845 - DNA, 1425 bp, Zea mays
  misc_feature (1)..(100): optimal_loci_2014_G1, chr1:10666111..10667535, Cluster 11
caacgccgtccggctccggccacagttcaccagccatgtagctgtagtagcccaccatgcatccaccgcgcgcgcggtgtttcactgtttcctggtgaaaacgcgtgagccaaatccgaaatcccgagtcccaaccggcaatcgcggtcgtcgtcgtcgccagacgccagggtcaccgtgcggtggcgcgcggtttctgctgctcagctcgggcacggggcgactgcgctgcgctgccgcgaccgaggaatcccggggtcgggcctcccggcgatctggactgaatcccctttgtagtctgtcgtgctagctcgtgggactggaatggaatggaacttgccgacctgctgttgaccgaccactcacttccctccccgcctccccggtcgctggcctgctagctagatagagctgagcagcgctgaaatgtctcgattctccgcccacaccggtccggtccggtcccgtcccgtctcgcctgcacctgacagggaacggccatgcaatatcatgcatgcactggtcactggagtccggcccactcgccagtgagcgggatgctctcaaccaggcagtcgctacaaccaaatgatttgattttgggatgaccctagttggtcaacatccaccgaaattagttttgaatcttacttttcagtttttttctatttaataataaatctggacctccagatctaactatctagatacataaataaattttctgagacatcagtgagacgaggcaggaagaggagtttccactgatgggctcatggtgggccacagtttgtcagctgttgggttggctctctaaatttatcgtggggctatcttaaatgtttttttaaaataagatcatcatatacctaaatttaagctgctcaaataaaagttttatattttagatctagcttttttagactcggctgtctcaaacagtttctctgactccatccattccactatggcgtttccaagttccacacggttacgcacgcgcatagtccggactccggacccacagctctgacggtgacgccgcgcggtgcaggtgcggcagtgcggcactacacctgtcccatcgtctcctttgatgcattgctcactcacactcaagtcacagaataaatccaacgacctacgaattgcgcggtactaatcggtcatccactttactttaaagataaacgaaaaccgtaaaaaaaagtcggaaatacttcaggtacacgtcgtacgtcggatatcaatccttgaggggccccttttggttcggtttccaaagaaaaaaaaatagaaatgggcaaatcttgtgggatgagtactgtacatatcttcggttcatacgagacgatacaacgaaaacacaggaaatttttcaatcattcaacttttaaggttagtttggacactacatttttctaa

SEQ ID NO: 1846 - DNA, 1436 bp, Zea mays
  misc_feature (1)..(100): optimal_loci_202514_G1, chr5:188478202..188479637, Cluster 11
ggagggaatacacaaagagcggtaactggtggagcacgaaaggcacggagacggtgcgcgtccatccgtaacaggaaaaactaaactctagtggccaacaaggactgtgaattaattcatcagtgtcaatgcatctagctagaacaccggtcctggtcactgccattctgctggttggttcgatcaataggcttaatttgcatctggcggcttcagagtcagtcaaaaaaagtaactattatatgctcgccgtatataccttaacgtgcagtggtattactagatgatatttgctgattctgttacagttaccggcttataaaggcgagataaagtggccagcagcttatgaagcagcgaccggtaggagggagggaagcaaagcagtttggcgtgtttgctgcccccatgggatcccctaggaacactggccgttccgttgcggctgccgcccccactgttctttccttaacgaggtggtgcaagtgcaaccgcgggagcgagaaagccagccaagccaagcccatggggcatgggcccctgcctcctttcccctgccctgaccctgatccaaacgccttttgacattgacctccaccgggtccggttgcagacttgcagctgctgtccgacggcaaaaggcggccgtgcctgttgtaaaggcggccagagcacgacggaaaggcatgcggccgacgcgatcgcggattagttactgttgtactcgttcgtccgtgcgtgcgtgcgtgcgcgggggctccacctccgatccccatccgattccacagtccaccccgggccccgccggcagataaggatggcttctttaatggatgcgctagatgaacacaggctacattaccggcagcttttctgcttggtttgtgcgttccagtggaaaaagcacatgctgacaggaaaggctcgttacgtagcagcggtccgacgtgccgaccgggcgtggtggcctcagggtcccccccggcccggcttacgtcgcacacgcttgctgctgcggcagcaacatgcccttcccagtcactgctgattcggctctcgactagaactagcgctgggactccgcacggcaccttttgctcgtgcgccgcacgccgtggcactcgttggagggtcagcaagccgttatatatgttggggaccggcacctcctgcaggtctgggcagctttccgtcgggttttgagtcgctgtccggtgctattggagaccttgcttgcagctgtagtgtagccttgtaggtatgaacaagtaactgttctttacactgcccgtgccctggctttcacttggcttgccggtaggtagcaaccagcacgagcattgcagcccggagattagtggaacttgtctgccgaggcattcgggtgacaaactaattaggtgtttggtttgatgaatcactctatccaaaattaa

SEQ ID NO: 1847 - DNA, 2455 bp, Zea mays
  misc_feature (1)..(100): optimal_loci_202715_G1, chr5:189297040..189299494, Cluster 11
attcgagatggaatttgtgcacttggacaccatcggtaccttgtgcacccgataatacgctgcaaaaaactaacctctcctttggtgcctctaatataattaagatcaaagctgaggacttctatatataagtgattgtcggtaaaggcattcttgctttcacccaccacacagtggtaaaagctagaaatcgttgcttgtagaaataataatcatcatatctctagatatacacacacacaaaaaatcgttcgttatcatttgaattgctataactatggaaacaacgtactcatggactgatggtgggtcgttttgcttgctcgagacgattcactttgctcatagtcctatgataacgaaggagtgctgagtagtgagtacacagtacataccttgaagtgtttggcactggtagtgccggaatcagtgaacagtttctctgaagaaatttgcaatcagtgaacagtgcagcattaaaactgcataatggaacacccaaaaagtttcacagagacgaccacctaacaaacgacgataaatctaatttgacgaagaccacgcatgcatgtactgaggtaataagggcactcattccacaaaggaaattttatgagaaaaactgacgtagagtatcagatcgaacaagttacccaccgtggtgaaaatcagagcacgcggtgaccgcctgaaaaaaatgcgtagtagtatgcatgctcatagctcgctggcgctgctagctgttggatgatggatcccagtcccagcagtattccatcgttattcccgagaggcgcggccggcaggagcaggagcagttcactgagcactgcactgcacagcaggcgcggccggggcaggcggcatggcgcggcagaggtccccggacggagaggaggatgaggacgacgacgacgatcgagcaggcgaccagcaggagccacgcgccgggacgagaaccaaggaaaaaaacgcgaaagggacgtgtgcgttaattggtttcagacttttggcctttcacgcgttaataatcagtcaccccattttagtttgtcttcacagttcacacacaggaatcgccccggcagtttgtctatgaaattagcagatcagccgatctatgtgaaggcatgcagtagagaacagctcgtcattgcatgcgtatacgtgtatactcctacgtactacatgccatgcgtgcctgtattttttttactctctgcaattgcatgtgacgcttgcagcctttttgcaggttgtcgttggttcgatatcgatcagctagctagctagctataggtcctctcgctccgctcctcccctctccgatccggttcgccattgaggcgctacagcgcgcgggtcgagtaagtggccgcaacagttgccctagctacatgtccggtaccggtagctagctagctaggcagctatggctacaacgtatcactcacatctccaactggtgcaacgaacccgctcctgcttgtagacggacgcgatagatacctttgccgcgatgaaaagctcatgggacgggccgggtgcattgaagaaggtgaatgtactacacgtcagaaacgctaaggcatggagatggagccatggaggagggcatgcaatgcaatgcaatgaaggaagggaaggcttttccagtactttttggtgatttgacctcacactatcccatcagcagccccgcgctcggcaacaaaagagtcagcagcagcagcaggagagagatcctctacgcattcaattgcacactacacagtacacactgctgcatgccactttctcttttccccctccacatcgccgtgctacacatgcacttttgattcctcaaattcctcccgcgcgccctatccccctatgctttcccctgccgactgcccagttggtctcccggggcatgtacggggacacaggggattttttagtataccgcgccggccttatcaaagccgtgcatgggattctggcaaagctacagctcttgctgcttgccgtggctgtcgcagatgcgtgatcgccggtgatatgatcaatcgcaagccgattttacttgcccatatggatcagcatggattatttcatcttctcctgtgcgtgaatcgtgacgacaaaataatggcaatatatacatatataggtgcaccgtacccctgtatagatgaaaaagaattttcttcaacatatatacaaaaaaaagataggcgaaaagcatacaataccaaaacattatcatcttaataagactccatattattttatgtgcaatgttgaacgttttacaataccgaaatatttcttgttaatgaaacatatataaataaaaccatgaatgccagatgttatggtttctaaacatatataaaaaccaggaataccaaaacaaggggattctagccactctaatccactccagatttgtggtttccaaactcgccct

SEQ ID NO: 1848 - DNA, 1612 bp, Zea mays
  misc_feature (1)..(100): optimal_loci_203867_G1, chr5:195686024..195687635, Cluster 11
tactgatgatggctgatggatcgatgggcaaccgggccgagcaatgacgagggaacagtgtgacctactgtacgcttgccagcagcgggcagccatggagaaggaccacagcacacttgggtcgcctagcccctagctagctagtgtctgtgcccgtctgcctgactgctgccacgacggatcggagccgccgatcccaggatctagtgtcccagaaaacgtacgctggcgatgggagtggcgtacgtgcgcgcacagtagtgcagcgagacacaggcaccgtgtgcactgcatgtacaagccccggtaggccggtacagttatcatgctgtcggagggcatctgactttcagtacgggccaagctattcttctggttcctaaataaaatagttttcaaggttgcgtcatgcaagattagccatctcggctttcccaaattatctttccgtgctgtgagtggctaagctactaatggttcattaacactccgtacgtacttgcgccgctggacagttactctactgtatactcaaaattaaagagacgaatggagcgagggagttgatgaagcaagagagatgcatggaccactacactacactactggggttggttgaaacgtaacagtgggaaccggcgcacgtgcggatgtcgataggcaagcagcagacaagaagtcgttagcacgatcttaggttagatatcccggtcccaccgtcacgtaagcgtaaggtggtgggccgggcatgcttgcattgcatcgcccccaggcccagcctacgaccgtccggcaggctcgacccgagaggctagcatagcaagtacgtccaacatgtccggtctgcgtgctactccgatccctcgatccatgctaagttattggttattctaattttgtgctacactaaataaagtataatttaaaaagtgatttggatttcggaggagtgatggggctgatcgataatttccttttgggagccgccggacgcctcaaaccgctgtctgtgcaagcgtgtcggtcaggtggctctatcattttggcgcctctcgagtctcgactctttggtcttccacgcacgcaaacgcaacgcatagggtaatttccctcgacgaatttcctgggcctggcccatgcatggcgataaccttacttttgctgcctgctgtgcctgtgagtaccctatgatatgatatgataacgataatctggctgatgcgtctgtttaagctgcactgcagacctgtagagagacgcctgcgctagggcggcccagacgagcggagcgcgatggcaacgtccgatacctgtgcctgcggaaccggcggcagcgtcgctctcggggatccccggacgcggaaaaaccagatatgcggccgcagcagcattgtaacagtgtacaggacgatgccgcgcctgcagtgcaactacaactactacgtcgtagtacgtgtgaggatcgcgcgccaccacaccacgccacgcccgagccgcgccgcgccgcgctggttttttttttatccacgcgaacgtgcacggatctgctgcctgccgaaaggcgcgcgtagcaggtcgccgtctccggcggagaaaagagatggcgcgcgcg

SEQ ID NO: 1849 - DNA, 2373 bp, Zea mays
  misc_feature (1)..(100): optimal_loci_204854_G1, chr5:201391775..201394147, Cluster 11
ccttgcgcccacgagctggacgtccaatcacgctcaatatatatgtccctctccctcctgggtggactctcgccttgtcgtatgcgagcgctgtctatgtcaaagtgaaaggaggcatgtcgagcgagcgagtggagagcagagagctcgaatgcgatgcacgatgggagtgtggcacgttgcacatcgaactcggaaacgagctgatttggtcgtgccgtgcgaaactgcactgtgtgtacatgtacatcacgatctcgcgcagatatcttcgacgatggtgttagcagacggcaggtgagtaggtgacagacaggtaactaggtaagaaactgttgacatcgaagggtgagagtgatgtaaggcccggaaagactttaaaagggccgagacttggaccacttgattgcgcgcacccatacccatgatgaggccagactattttcctcgctcgagagggccggattaaaatggtgcacgcccggcccatgagggctttcgattatcttcaccccctcccgtaccgtactcctccttttctcccgccactcatcatctggaaaacaagtactacggggcaggactccaaacccacacttccaaagccgaagcatgctgttcgtgcagcgaacatgacaataccgttgctgattcgtaccaagcgtcgcacaaaaaggaggcaaggactggagtctgaactctgaagggcacgcagcgcaggccctaggttccaacttacaagccagtcgtctgcctggaactctggacgctacagacctgatgagaacaaagcgtcgctgctaccgaagcgaagaacgagtaccgagtaagtactgtactgtactgtactgtcggtccgctaccgtttcagacagcgacgccttcgatgcgtagacgacccatggaccggagccgagaggcagcgaatgtacagggacaacatcgctgcgaccgttcgtcacgatgccatcctagatcctcgtagtctgtctggggacccggcaatgcagcccccacgcagcaggaataggacagacagttttcgtgcgttgtgcccgccacacgcactgctccattttgtacaacacatacatacatctggaattccggagcgcttgtgtgtgctggactgctggtgttttttaatctctgaatgaagcaatggtgctaggctttgtcgtttccgttttctaaggaaaaccgagacgggacatcaggcaggagccgtgaccacaggagctacgtacgcactgccgctactcggtaggccgccgtagctttgccgggcgtcaaaacctgaggtgacaacacgggcatagacaggcagccagccagccagccaggaatctctcgagtgcggggtggccggctggccgcgagcgccgagcggagcagctcggcggccgaagccggcaactcggcgtgacgcgaccagccgaccacattgtgccctacagaacgcgggcatcatgccactgcgttccggtcgccgaaatggaggcactttcgcagccgcactccgcaatcccccacgggcccacaacacacacaacagtaacacgacagagccttcgcaatttcaattccatgtctaatcctcaggcaacgactgaactcgtcgctgccgccgctgtccacataattttgctctgggcctcaccgcagtgcccaagcgaaacggatctgatcgacggccttcaaattctgttgagtgacggcagctgttaccatttgttcaagcaacgcttgcttgcaaagcctactactagtctcttctctcttgtcgtcggttcagtcgatagggtcgtggtggcggtacttgcatcacgtctcaataggatgtatcatgacctgttccacgtccctatgtagtgtaggcctaatgatcgtgcccgggttcatgtgggcgtgaacatatgatgcaaagagcaatgcccttgggcgtttgatggacagggcctaaaaaaagctgttctccctcggtccacaaactagccatatatcaaagataaaaaaaatgaccttaacttctcttgaaaatcaatcatttatatgtcttcaaatacactgtatcaatttaaaatctatgtcttaaattatacggtatgtcacatccctcaaaaccatcaactccatctcagtgtgtctgtcttttaaaccccatccacgtatacgtttatactaatctttgaaacactatcttactgaaaacaactcgtacggttgtcacccaagaaaaaaaaacaatgtcatgactatctaactctttttaaactttgtctcacttagaagactaaacaaggtaacaattagaataattagttattgaggatcctctctcagattcctaaatttgttaagctcgagtcgagt

SEQ ID NO: 1850 - DNA, 1618 bp, Zea mays
  misc_feature (1)..(100): optimal_loci_205692_G1, chr5:206159180..206160797, Cluster 11
caagagtacctgtacttggttagagatatgctaatatttcaattgaacaaaggaaaaaatatttcctctcaatgaggagaagaggtttgcaagcatgacacaatgcgattatagagagaagctcgaaacccatgacaggctgctgaatgtagtttgttacttgtgcgagccggtacccatttcaccaaatggagagcgaacgtatctcgaaaaagatagtggagtgacgggagctgacactaacatttgcagcagtccctcctcttccaactgccacccgatatccacatagaaaaaagctccaacgactaataatccactagaagcagaagctcgttggcagaaaggctgcaggatctctactccgcttggtgatgtttctctaccatttcctcttcggctcttcttttcttgaagaaaaatgagagcgcgtaaagtagatttggtatgctcaagatgctatgttttgcgaatcaagtaaagaaacacacccttgtacaacacatgaagaaaaataaaagggaggggaaaaggactcgtacacccaaaaataaaaaataacggactattgcagctttagtttttcattgctttggcatcaacagttcacaacattttctgatgaaccaaaccaaccaaccaaccaattttttttccatatataccagtctctacatgttgggttatcgtgttctacttgtacatgctagtgttaaaaaatcggtgcagtggacttgtattaaaaaaaaagacggccgcatatatctagtctccggtgcagcaacgcattagcaattacaagcgaggttccttgcccagaattttctcgggtggttgtgccatttcccatcttttattattattattactctcctttccccttgcctgccgccacccccgccgcacttttgcaaaccgtggccatatatccttgtggtgacgagacgaccaaccaaatcatctgtaaacgagacccttaatcgtcacaacagctgaaatcgtactacaggaaaaggcgtcgatagagaccatgacgttttgttctgttgtgcctcagttttccaactcacctctctccttcacaaagagaacaacgatgggtagggcattcgttccacaaagcaccaaccttcaaagcctgctgtgtcgtaatgtcagatcacattactgccaggtcaagtaatgacaagtgaggaccttggatcaagttacagtggctgcttcggcacgaggcgatcgcgtgtccagcatcagatcgatttgacagtatcgtcaacgataatcgggtgcgggcaagccacaagcgcgaccacgtcggtacggcaaaggagtttccgtagtgtatactcaagtgagtgtgtagtacgtgggcaaagcatctttttcaggctcgcaaaaggataaaaacctgctcgtgtgttggtggtgcacggagacaaaagcaccaaaaacaacacagtgcctcagatggtggcatggtgggcaacgtgcagcggtacgtgtgccctgtccacggtgcacgccttttcttttccggttctccggccgaccgacctgattggttgttgaaggaacggaaaggcttggctttacatgatccatctcgtctccctcctgg

SEQ ID NO: 1851 - DNA, 1731 bp, Zea mays
  misc_feature (1)..(100): optimal_loci_205869_G1, chr5:207126273..207128003, Cluster 11
tggagtggaggagggaagaggtcgacgacggtgatgatagcagcgtgagtgagggaagaggttgatagcgaagatagagagagtgagagagaggaaggggaggggatacagtggagtagagaaggggatggtaggagaggggtcgacggtggtgcgaaaggagtacagtgtttggtgggtgcaacaaaatttcactgtggatgtgcatcatcatgcattgagcacgacgcctgaaatggagaggaatctttttgggcttttctttctatatagcaaagcctctgttatttacatttagaagtaacaaaagcacgcacacgcgcggcaggaaccacacattcatgacacgggaaaataggctcggtgcgacattgcttgaagaacgaaacatgcatagatcagaaagccgccgcgcgcccaacctagtgctgcgcaggcgcgtacgacaccgtccacgcgagcgcagaagaacgggaggaggtcactgctggccctggccgggtgcggtggggcaacaaagacccgtgcgcctgcctgcggtctgcctgcctgcatgggttgtcagaggcacgccctgcgctgcgtccgtcatgggtgagtggtgcactgtgtggggatcattaccggccggtgtgggtcgatccagttgactcagcggcgccaaccacctacctgcgcgcgcgcgggggcgcccgtgggactgggagcgagccccggcccacccgggcggcccgctggatcgtggggctcgggggcggcggacgccacctgggcaacacgtacggattcttctgtggcgcgcgcgcgagcgagatcagatgacgaggcgagaggcggtttgtgcatggcgacgcgccgggcggggctgctgtcgtgtcgtgacgtccctttcgctgtctccgtggcggccccacccgcgcgcggatcgaccctggggtttggctggcccgtgacgcccggtcacttgccaaacggataacgattgacaactcccaggcagccacctgaccgtgcagtactgtgctagtgatctctgaacctcatcagccagccgccgcgtgggtcgggccggacagacggcggactggtactcgtacacggtctactagcaccggcaggctctctctaggttctgcggcggcgggccggccgcggataacgaaccgcttggcgatcggcatggcggcgcccagtgatgcatgagctcgtcagctggatgttgtcgatggatcgctacgtgcagggtgtacgtgcaagttgtagggcagattccagaaaccgctttgtggacagtgacttgatggcctggttgggtacggccggttaggccagccccctgcccctggccggatctattttcgctgctggttccgttcatctggccggcgccctccttgcaagaccacacacaaacacaccctttactaccaggtgtacgtggcagcgtgtcccggacaggaccccgcacctaacaaacatttcggacctcctcgctctggaccatctctcaaatgaatgaggtggcagcggacggacggcctgcattttggtaaggaaaaaggcaataatccacacgaacgaaaaggaaaggaacgcccccccattgttcgtgctcgtgcaacgtggtgaccacagcatggccagctggtcaactgccgcgcctgcttaccctatccccttcatttctgtctctgaaagttggctttagattagcgcgtctttagtgtcaac

SEQ ID NO: 1852 - DNA, 1779 bp, Zea mays
  misc_feature (1)..(100): optimal_loci_206477_G1, chr5:210286639..210288417, Cluster 11
gtaattggttggtcaaagtaggatgcatagggacatggcctctttcacgatatgatgtttaaaaaacaataaagacaccggttataaatggtgaataaaatcgtcctgtggctaagattaaaggaagcgattatagattgtggtatgatgagattgcgcgccttctcagaacaatcccaaccgttaaactagttttgttgtaccatcattcacggtaataccgtgcaccgccaggcacaacctgctgctgccgacgacggatatatatatagaaaagccctttggttgcatatcagattccgtgctaccgctttcaaccatcaaggaaaagatgcagcgaccacgctgcttacgacgatgtgccatgcacgatccaggctgagcgtgaccattccgtagtctagagccggtagtgttggacttcctgtatgccacgctactacacttatatatacttctagattaactccgatggatggacaaacctgaaatccaggagggtcaaaaagaaaaaggacaaggaaggcaagctggcgaccaaaacccgccacaatttttcaaacggaaattaacatcgccatcgcgatcacatactgctggatcgtcggaatcgccacattgaattccgacgacattgctttcagatctcgtactccagatgcagcagacgtccacctcagacagacagacagagacaggtgtccgttcccgcgcagatcgccccgagaggtcaacagacagactgctcataatcataaataagcgcgcgcaagagccaacggatcagctgccgtcccgtcactcacaggcccaccacgtacggcgtcgacgcggtttaacagcctagcccgcagaccaaaaatgcgcccgacgatatgatgcgatctctttttttttgggggggttcgtcggaatggattgtcaaagaggaggaggagtggggaaatggacagcgacctggagtggttaaccccctcgcaggcgtattgtatctttcaggcctcggccgcaagcagctggactgcattaggagcagtggcgggcagagggaagcttccggtccggttacttgcgagatgattcgcgtcttgccctctgggcgatcggttttttctattagccgaagggcagggagaattctgccggctgtaggacttgcagggtattttctgtagcttagtttaggtttcagatctcctgcccaactttgtcaagttccagagatacgcatgcatgtgttgctagttcctgcctgctgttactgctaggacgtcgtgaacagatcttctttctattttacttgttcagaaaaaaagggttgtgccaggaaaaaaaaggttgcagctcctcttgctccagatatatgtatgtatggttgtgttgttacagatcctagccgctgttagtactgcacagatatcatccgtttgtctggagcagacatttttctggagtcaagattcaatcgatcatcatcagctacgacacccatctagtgatctagatgcagaatctctctgggacgctcgcttcggtttcctttgtacttttgagcgagcctgatatgtccacatcaaccgacaacagcatccgagaccgtttcaaaggtgctgtagacaattaaatagggctatggttaaagaagaatttgtaatgaaacaatgaatgggctggcgaagttttaggaattggcgacacagctgtcctgcaaaaaactttttttctacataaagcgattccaatttcttgcttcagataatagtgcttgcaattagggat

SEQ ID NO: 1853 - DNA, 1541 bp, Zea mays
  misc_feature (1)..(100): optimal_loci_206488_G1, chr5:210416620..210418160, Cluster 11
cttctcgatctcatctgccatccagcaagctccgtacgtacgtcgcaggtatttgagcaacttattgcatgcatatcggcatgcatatgtatggctctctggccggcacaagccaagacggacttggccacccacaccccgttatattattacataaataatgtgccctgcagatataaaaggaaggccgtggtgcctgccatgtatatgtgcggtggtgtacatgcacgcattggagactacagctagctcagtgtctccttttttttgtcttcccggtattaggggcaaccacttgtattggcttggctacgtattatacgtatgtatgcctagagcacttgcctgaaaagaagataaggtgcagccgtgcagcgtggctaccacgtatcatcacgtatgtacgccgaacttgaaagggattacgacgctgctcgttaatctcctgagactgtgacacatgcctcaccagatcagaggtgacctaatttgaagccccctgctggaccccggtccttcactggctacgggagtgagccacatcacgtcggacagtgcgcgcgcgcgtgttcggttgaaccgatcgatcatgggccggggtttgtcttcgatcggcgccacgcccccctaccctcccttttggctgctgtcgccgtcgcggcgccccgcagaaaggggaaaaaaaatgcatgcatccgcgcgccctgctgcgcgcgcacaccgggcagagaggcactgggcggcaacgatccggccggtcggcggtgttgttggtgcgggcgaccatgaggaattgagaggctccataacgccctgcgtgctgatctggccctgaatcacacgcaccgcagcagctctccttttcctcaggtcaatgtctgtgacagcggaaagctaaattgcgtgcgccatggtgcgctgcgcatccgtccatgcagcgccatccagccgatgggctgaacggcgaaacaatgggttaattcgtttagagatcagagagctgagctaggccatgtttgttaccccggtttacgtattcagcttatttaaaatcccctctcttgctcaaccgatccctcttcatcctctccctcccttcacctccaagctcctctgtcgccattccctgaatccggcgccatgctatagagatccttctccccgcgtccaatggacggagctcgtagcggatcaccgcctatcaccgcctcctgtcagtagcgcgctgccacaaatctgtcatggtccctttcaacctcacctcgagcatgatgcttctgttttcgaaacatgctcgtgctgtcctaaaaagctcgacccatgtactttttgttacctcgacttatatatccagcttatagaagacactgaaactgatagtcataatcattcactataagtttttttattttaaaatctaaaaatgatagttgatggctccaattacaacgaaagaaagcagaggtgctatgcagagaagtactgatgcttagacttaggctactcaatggatacttgttgattgcatggtcatgtatagg

SEQ ID NO: 1854 - DNA, 1712 bp, Zea mays
  misc_feature (1)..(100): optimal_loci_206608_G1, chr5:211045717..211047428, Cluster 11
ttttgcaggatcaactattgatctcctatatgtgctctcaagatgacccagatgaagacgtctgtggtcgtagagtggaagacgtgtatgtgtgacgtacgatggcgtatgaccattgaccgttgaaagttatgctttataatagtattaaagatagagatatataatatgtttgcttgactttaatctgtatcattttctaataattttatagtattttgtctatataaattactggtgcaccagtccgaacaatcttatactagtctttcgttaaattattacttggtctgagtgctacgtctctcacggtagtgggccgtcctgggccacaagcgactctgctgcggctttgctttcatgtagtataaatagagggcctggccttagtgccgtcaattaaaagcgtacgtcgcccaccttgctttcccctaggccctagctggtggaggccgcacaacacgctactgaaatcctcctacctaaaccctaatttgatctgcggcctctcggtcatcgattctcaaagcaattccaattcatggaggaaatcctcgatccatcgattctctctaggcaattcatggaggaaatcaggtgtgctctggaggaagcacgggaggagcctgatcggaagttgaagacattacagctcccggaggaggaggaggagggttcccgaggcgacaccgtggatgaggaggaggaggaggaggaggaggaggaggagggttcccgaggcgacaccgtggatgaggaggacagcgacgatgagtttaagggtttcgacgagaatggcgacctgtgtctgccattcgtcgtctcctgggatccgccaccagtactagtttgcacggcaggcaatgataacctcgtcgctacccaaattgttttctctatcaaaattcgttatgtttggaaactccacaagcaacatccttagaccaaagagaacgccgctaagaattgtgtaacatttaagatctacgatagttatgaatgacagtttcaaaatcgtgtgatatcaaaatatttgggttttgcaaatcagcaatattcaggcagttactaaaaaaagagtttatacagaccgtataaccagctgaatacaactgttttttcttcaggagcaagttttacgatggaggaagcagaagaaatagttgactctgtcaatgaaaggaacgatgacctgctctcagcatggtgtgaaatggttaacaacaaagtgactcctttgcctgcaacgcctctacatattcttccagccataaccacattctgtgtttctggatatgagtgctaccacctgcgatattggactgaaattacttctgaaagtaggtgaactaattattaacgacacactactctatcttctctcttgtggctcattttctttctatatacttgcagctgatccagatcatccatatttcaaaccctgtgagatgatgcaagtgttctccttgggattatcaagccctctcactcatcctgttaatatttatgggtatttttctgttcgtgataactgggaaccactccgcaattatctatttaagcgctcaagagctgatccagccatgatttctcaggcaagtgatgcttgttcttgttctgaatagagaatctttgtactgtcatttataactattgatatgttatacaacagtgtaaatagataatgttacaactcaagtattacatgc

SEQ ID NO: 1855 - DNA, 2020 bp, Zea mays
  misc_feature (1)..(100): optimal_loci_207085_G1, chr5:213063717..213065736, Cluster 11
tgcctgcagccgtgtgtacaggctccagcattgttgtgcagccaatcaatcaaagacacaagcacagttaacgcatgcgggaacattgagcgccaggagctgggtaaccaatcacgaggatagagatcaggtcaacagatcgtattactaaccctatcatttctccacctcgcatgatacgggaggaagggctctatcctagcccgaccagaccccatggtcctcgaaatctgagccgattgtagaccgactatagagcttaagaccctagtatggagaatagaggaggacccgtgaggtgggtcacaatttacaggaggatgggggtacgaacgaaaccactatgaactcaagcattccaacgacgttgaggtagcaagtgtcactatgccaccaactgtagtctgcagggcgttcccggtctaacggaagtacctgtagatatatagaatagtttatcctcgtaagaagaataggacgcctcacctcgtcccgaagtacaccggcaagcacaagacaaatcgcaaaagacctttttcttacctattatgtactcctccatgaggagacccttgtaagaggctcattcattgaacaataaaaggaagggccagcctcaacaaaacggacagaggaacaaaagcattgtgctagcacaaagaaagagatctcgagattcacagcactcggactctcactctcactcggactctcactgtgctacaccaaatcaacactcacacacgcactctagagacttgataactctttcctctctcacatgtatgtcgcccatactacgaccaatccgatatcgatagcgcaagtcatttaaggctagagtagaaacattcagaccgaaccagtatagctcttgtgttcaccctgtatacacaaatttactcgtcggtgctcacacaaaacacctacacatggccacttcactaaaaaccgtacacatattccacgtgttcttacacgttgagaattgaacaatttagtactcataaaaccttttttttgtggacatttggagtgttcttactatattagatattgcatcatcatcggtgggaacttagcttctttacgactaattaatgtagactgccgtatcagttggcttttcatacatatggtttgtacgtcatgaaaacctgccgaacccttggtagacgcaaagaaactctggaccgaaccgagtttgcaaacgcgtatgatgcatatgcatatatccgtacgtttatccggaccggccgaacgaagctagaagggggcaaggcacatgtggccgatgcaggctcctcgaataatggggccgatacggcgatgaagcaaagaatatcctgcctgccttccttgcttgcttctcgctcgttcatatgcatgtacaacggcatcattgggatcacatgcgcgctcggcttggacgatgcgccgggatggaccgagcaagggcgaggcagacagaggtgagctctctcgttcaagaaatccggcgagatccacggtgagattttttttctttttggaaaacaaaagcatatccgcggcgtgcaggctttgctgttggtctgaagcgctaaacaatggtggtgatccgcaagctagcatgcatctcgtcaaagccttgacaggaacgaggacgacgaccgactgccgttccgcagccacgccacgccgcgccgagaaggcgcatgctcttggcgcgtgttttttttttatttgcggtgtggcccacattctcggcgtcctagtcgaacgaagcgagcatggacggcaagtgaaacatgacgtcgcggctgatccctctcttcttctagcggacgaccggatccccaagggcatattcgtcgacctgtgcgtgccttgcttccatatgcttgctgttgctgtgcgcactttttatcgagagaaagatgacgtctgtggttcacagatgacatgcgtgtgtgagacaattgctgagtaacgagcgaaagattttttttaaaaaaatagcacaacaacctttaaaaaa

SEQ ID NO: 1856 - DNA, 1765 bp, Zea mays
  misc_feature (1)..(100): optimal_loci_207335_G1, chr5:214342638..214344402, Cluster 11
tttgtgctccatattggcgaagtcaagagacatgttgcatacgtatactaacttatgctaaagttagtgagtataattggtggcttatctgaaaatttgaattatactccgaactgcaaatgatgtactcacatatccagatttgctgaaccgttaaaaggtggccgtcacgattaacataacattaacaaataattctaacaaccaacggtttttttattaaaaaaaaacgggtacccaaagaccacactgtcgtggcaggcaggcagagacacgcacattctgaaaagctgagataccatctgctgtcaagttggcgttggctttggctttaccccacaggcagtgacagggaaggcgcagcttttcccttcccttggcttcccttgcccacggtctcatgatgtggcgtttggatcccaaaaagattttaagaaagccgataaaaggaattctacaagtttgattacatttgaagacttcaaaatatttgggttaagtttccgataaattgtccagcctgttttggaacaaaatctagacgaccggattctcaaaatccggagccgaatggggcaagtcactacacgccaccactcaggaatcaggattcagaaagctaaatgctcatccatcatccatcattccatcgcgcatcaaggtcggcacaaggcaccaagggagggccactgacaggcaggccgcgcccgcgcgtcggcaccgggcccacgtacgtgtagccccagcagctcgtgcagtgagccagtcgtagggccaggccagacgccatctggtctcctctctgcagatcgatctggtcctctgtcgtcgtctgatctcacttgccttctcgctcatgtcatgcatggccggccagcggccatggtcatggccatggcgccctgcttgaatcttgatgaccagataggagttctcctacggtctacggagctgccactgccaggaataataatggaatatggatttcactgcaagcaagcaagcaagcaagcaaagggccaatggcagtggcaggtaggcatgccttctacggcccgaaactgcatcccaccgctttctggttctttccctagctagctatagccgctgctagcgatacgctatttccttcggcaaaaaaaaaaacatttcactttgtaaggtatgtattcatacaaagtattaccaatatctgtacattatgtaacgatactaaaaactatgtgtattctttttggacgaagccttcgagaaatggtgtaggattaaaaggccaacgtcgtcgtctacaattttctacgggccatgattagcgatatagcgtatattgtacatactcaatgatggtaaaagtatttaacatatatatggcatgattcataagtctcatgcatcggttcaaggtattatttattttaattcgacaggactaaagtatatatgttacctttatattagcttttatacgcacaaactcttcctttaatttgtagctagattattgcatcctgtcgtacttccggccgggtgacaagatgcagcatcgtccttccatatccgctgtctctcgcactggcggcatcgtccttccaagaacttttggggctagctagctgttgagtggcaaacgttgcctagcggacgtatcacgtacgtaccaccgcacacaagcaatggcaaataaacgcaagcacgtcacgtacgcggagaggcacataaggccctatttgggaataaagtttttgaaaatcacagtttttgaaat

SEQ ID NO: 1857 - DNA, 2761 bp, Zea mays
  misc_feature (1)..(100): optimal_loci_228992_G1, chr6:129868303..129871063, Cluster 11
  modified_base (208)..(208): a, c, g, or t
  misc_feature (208)..(208): n is a, c, g, or t
  modified_base (262)..(262): a, c, g, or t
  misc_feature (262)..(262): n is a, c, g, or t
  modified_base (312)..(312): a, c, g, or t
  misc_feature (312)..(312): n is a, c, g, or t
  modified_base (320)..(320): a, c, g, or t
  misc_feature (320)..(320): n is a, c, g, or t
  modified_base (441)..(441): a, c, g, or t
  misc_feature (441)..(441): n is a, c, g, or t
  modified_base (471)..(471): a, c, g, or t
  misc_feature (471)..(471): n is a, c, g, or t
  modified_base (621)..(621): a, c, g, or t
  misc_feature (621)..(621): n is a, c, g, or t
  modified_base (690)..(690): a, c, g, or t
  misc_feature (690)..(690): n is a, c, g, or t
  modified_base (739)..(739): a, c, g, or t
  misc_feature (739)..(739): n is a, c, g, or t
  modified_base (746)..(746): a, c, g, or t
  misc_feature (746)..(746): n is a, c, g, or t
  modified_base (786)..(786): a, c, g, or t
  misc_feature (786)..(786): n is a, c, g, or t
  modified_base (883)..(883): a, c, g, or t
  misc_feature (883)..(883): n is a, c, g, or t
  modified_base (890)..(890): a, c, g, or t
  misc_feature (890)..(890): n is a, c, g, or t
  modified_base (927)..(927): a, c, g, or t
  misc_feature (927)..(927): n is a, c, g, or t
  modified_base (939)..(939): a, c, g, or t
  misc_feature (939)..(939): n is a, c, g, or t
  modified_base (952)..(952): a, c, g, or t
  misc_feature (952)..(952): n is a, c, g, or t
  modified_base (954)..(954): a, c, g, or t
  misc_feature (954)..(954): n is a, c, g, or t
  modified_base (1030)..(1030): a, c, g, or t
  misc_feature (1030)..(1030): n is a, c, g, or t
  modified_base (1038)..(1038): a, c, g, or t
  misc_feature (1038)..(1038): n is a, c, g, or t
  modified_base (1058)..(1058): a, c, g, or t
  misc_feature (1058)..(1058): n is a, c, g, or t
  modified_base (1096)..(1096): a, c, g, or t
  misc_feature (1096)..(1096): n is a, c, g, or t
  modified_base (1101)..(1101): a, c, g, or t
  misc_feature (1101)..(1101): n is a, c, g, or t
  modified_base (1108)..(1108): a, c, g, or t
  misc_feature (1108)..(1108): n is a, c, g, or t
  modified_base (1114)..(1114): a, c, g, or t
  misc_feature (1114)..(1114): n is a, c, g, or t
  modified_base (1138)..(1138): a, c, g, or t
  misc_feature (1138)..(1138): n is a, c, g, or t
  modified_base (1181)..(1181): a, c, g, or t
  misc_feature (1181)..(1181): n is a, c, g, or t
  modified_base (1203)..(1203): a, c, g, or t
  misc_feature (1203)..(1203): n is a, c, g, or t
  modified_base (1219)..(1219): a, c, g, or t
  misc_feature (1219)..(1219): n is a, c, g, or t
  modified_base (1222)..(1222): a, c, g, or t
  misc_feature (1222)..(1222): n is a, c, g, or t
  modified_base (1256)..(1256): a, c, g, or t
  misc_feature (1256)..(1256): n is a, c, g, or t
  modified_base (1273)..(1273): a, c, g, or t
  misc_feature (1273)..(1273): n is a, c, g, or t
  modified_base (1278)..(1278): a, c, g, or t
  misc_feature (1278)..(1278): n is a, c, g, or t
  modified_base (1287)..(1287): a, c, g, or t
  misc_feature (1287)..(1287): n is a, c, g, or t
  modified_base (1289)..(1289): a, c, g, or t
  misc_feature (1289)..(1289): n is a, c, g, or t
  modified_base (1292)..(1292): a, c, g, or t
  misc_feature (1292)..(1292): n is a, c, g, or t
  modified_base (1299)..(1299): a, c, g, or t
  misc_feature (1299)..(1299): n is a, c, g, or t
  modified_base (1306)..(1306): a, c, g, or t
  misc_feature (1306)..(1306): n is a, c, g, or t
  modified_base (1337)..(1337): a, c, g, or t
  misc_feature (1337)..(1337): n is a, c, g, or t
  modified_base (1347)..(1347): a, c, g, or t
  misc_feature (1347)..(1347): n is a, c, g, or t
  modified_base (1383)..(1383): a, c, g, or t
  misc_feature (1383)..(1383): n is a, c, g, or t
  modified_base (1432)..(1432): a, c, g, or t
  misc_feature (1432)..(1432): n is a, c, g, or t
  modified_base (1523)..(1523): a, c, g, or t
  misc_feature (1523)..(1523): n is a, c, g, or t
  modified_base (1558)..(1558): a, c, g, or t
  misc_feature (1558)..(1558): n is a, c, g, or t
  modified_base (1572)..(1572): a, c, g, or t
  misc_feature (1572)..(1572): n is a, c, g, or t
  modified_base (1574)..(1574): a, c, g, or t
  misc_feature (1574)..(1574): n is a, c, g, or t
  modified_base (1578)..(1578): a, c, g, or t
  misc_feature (1578)..(1578): n is a, c, g, or t
  modified_base (1620)..(1620): a, c, g, or t
  misc_feature (1620)..(1620): n is a, c, g, or t
  modified_base (1622)..(1622): a, c, g, or t
  misc_feature (1622)..(1622): n is a, c, g, or t
  modified_base (1638)..(1638): a, c, g, or t
  misc_feature (1638)..(1638): n is a, c, g, or t
  modified_base (1774)..(1774): a, c, g, or t
  misc_feature (1774)..(1774): n is a, c, g, or t
  modified_base (1789)..(1789): a, c, g, or t
  misc_feature (1789)..(1789): n is a, c, g, or t
  modified_base (1798)..(1798): a, c, g, or t
  misc_feature (1798)..(1798): n is a, c, g, or t
  modified_base (1812)..(1812): a, c, g, or t
  misc_feature (1812)..(1812): n is a, c, g, or t
  modified_base (1815)..(1815): a, c, g, or t
  misc_feature (1815)..(1815): n is a, c, g, or t
  modified_base (1819)..(1819): a, c, g, or t
  misc_feature (1819)..(1819): n is a, c, g, or t
  modified_base (1826)..(1826): a, c, g, or t
  misc_feature (1826)..(1826): n is a, c, g, or t
  modified_base (1896)..(1896): a, c, g, or t
  misc_feature (1896)..(1896): n is a, c, g, or t
  modified_base (1919)..(1919): a, c, g, or t
  misc_feature (1919)..(1919): n is a, c, g, or t
  modified_base (1940)..(1940): a, c, g, or t
  misc_feature (1940)..(1940): n is a, c, g, or t
  modified_base (1972)..(1972): a, c, g, or t
  misc_feature (1972)..(1972): n is a, c, g, or t
  modified_base (1974)..(1974): a, c, g, or t
  misc_feature (1974)..(1974): n is a, c, g, or t
  modified_base (2027)..(2027): a, c, g, or t
  misc_feature (2027)..(2027): n is a, c, g, or t
  modified_base (2072)..(2072): a, c, g, or t
  misc_feature (2072)..(2072): n is a, c, g, or t
  modified_base (2130)..(2130): a, c, g, or t
  misc_feature (2130)..(2130): n is a, c, g, or t
  modified_base (2133)..(2133): a, c, g, or t
  misc_feature (2133)..(2133): n is a, c, g, or t
  modified_base (2173)..(2173): a, c, g, or t
  misc_feature (2173)..(2173): n is a, c, g, or t
  modified_base (2187)..(2187): a, c, g, or t
  misc_feature (2187)..(2187): n is a, c, g, or t
  modified_base (2198)..(2198): a, c, g, or t
  misc_feature (2198)..(2198): n is a, c, g, or t
  modified_base (2214)..(2214): a, c, g, or t
  misc_feature (2214)..(2214): n is a, c, g, or t
  modified_base (2281)..(2281): a, c, g, or t
  misc_feature (2281)..(2281): n is a, c, g, or t
  modified_base (2320)..(2320): a, c, g, or t
  misc_feature (2320)..(2320): n is a, c, g, or t
  modified_base (2367)..(2367): a, c, g, or t
  misc_feature (2367)..(2367): n is a, c, g, or t
  modified_base (2381)..(2381): a, c, g, or t
  misc_feature (2381)..(2381): n is a, c, g, or t
  modified_base (2402)..(2402): a, c, g, or t
  misc_feature (2402)..(2402): n is a, c, g, or t
  modified_base (2433)..(2433): a, c, g, or t
  misc_feature (2433)..(2433): n is a, c, g, or t
  modified_base (2443)..(2443): a, c, g, or t
  misc_feature (2443)..(2443): n is a, c, g, or t
  modified_base (2452)..(2452): a, c, g, or t
  misc_feature (2452)..(2452): n is a, c, g, or t
  modified_base (2455)..(2455): a, c, g, or t
  misc_feature (2455)..(2455): n is a, c, g, or t
  modified_base (2522)..(2522): a, c, g, or t
  misc_feature (2522)..(2522): n is a, c, g, or t
  modified_base (2546)..(2546): a, c, g, or t
  misc_feature (2546)..(2546): n is a, c, g, or t
  modified_base (2581)..(2581): a, c, g, or t
  misc_feature (2581)..(2581): n is a, c, g, or t
  modified_base (2599)..(2599): a, c, g, or t
  misc_feature (2599)..(2599): n is a, c, g, or t
  modified_base (2655)..(2655): a, c, g, or t
  misc_feature (2655)..(2655): n is a, c, g, or t
  modified_base (2689)..(2689): a, c, g, or t
  misc_feature (2689)..(2689): n is a, c, g, or t
cagaaacacaataatgatgatccatacttatcttcccctcggctcttcttatggggtaagagagtagaataaagatatatgtcacctagccctctcgtgcgtggccgtcgcgcgtgcgcggcacatcactccaaggtgaggcctccccgccctgtgcactgcgctctgctgaggaggggagctgcagtggtatgagcatggccaatgngctggtcatcagcgcgccgcacgcgcagatcttgtcctctgagtgttaccgacnttgctgaggccttagtggatggacaaggagacaaacatgctctagaggangagcgcanaagattagtatatagcagtcgcatatcagtgtgagtggcgcatctgtgtacgtgtctattgaatgtccatgtgcttgtgcgcatactccagtatcaagttcatataatgactgtatggacncagtcgtggataacactgttacgcgtacgntgatatgttgtgtaatgtattcatctgacttcgcgccaggatacatgccaggctcctacatatgctttatctgctcctcgacatgtatcgctacacacgtgatgcgctgtgtgtcccatgcattctgtgtaatatgtgagaatgcctgtnggcatacagacatctcgagacgcacgctcaccgcgcctgagctaaaagcaggtaattacagaatattgnaatggtacgaggatcgataacagcaatttgcgtgtcatgcatcgcatantgcatangaaatacttatggcgactcttcgtcgactcacttactgtnataccgcgttactattaggctagagctctctgagctgttgtgacttctagccttgtgcttctctcctccgtgtgctctgatattgtgcggtgtacgntgctcanctctgatctatacttgtattatgtatacgtttcgcangtactcatttcnctacatgaacagntnatgtatagacgacttatctgttgtctttcagtgtctactgcgcgaatacttcacttacttctgcaacacagcacantagaaggnatatctatctacgctgcagngtgtgttgatcatataggaactcctatgcgtgagcagnctganatatganctactncatgttgtgtacttctgtgctgtnctctcgtctatatctacactactgcgttgtgtacgtgcccagntatgctactctcctcctcattngtatgttactgtacanttnattttgtgcatcagtctctctctgtatatacctnctgtgtaacactcattntactnctccttgcntnctngtgcttntgactcnctgctcatatctattgatgatctatcttgtncgtagttgtnctatatgcgtgtggtcacgtacactccgctgtgacnctatactagacacgcatcgcacctacactgtctctacgcctgatatcgncctgatgcacttgtacgctgataatgtaggcttctgatgcactctgctactctcgttctctccttacttctcaaatctgcttacttatatntgcatctgtgacttatgttgagtgaatagctctantcgcgtgtctcgtnantganctctgactacactcgattgatgtctcgctcgcctatcggttngncgcctgcgcgacatangtgttgacgtcatgtgcacgctagtgcgctctgcgtgctgcgtcgttctcctcttctgcactgccctgtccgtgatactgacttgctgtaacattatctactcacggtgcttcgtgagtcgcacgtactactgtantctcttctgtgagcnagacgcttntacttggacaatgnacntgtnatgactnctcagtatataggcgcataatagtgagtgatgtgctgttatgctataatagctgtaaatcgagtcgatantctgttatgttcactgaccctgncgccttctctactccacgcgngcgtgcctcgtcgctgctctacacgtgctcgntnatctacgcgatgccgagcctctcgcttgtgtgactacgactctttgtctatanactacctacctcacgccacgctcgcccttcgctctcattcgctanttgattatgcgttgtagctcatgactttgctctattattctgtaacatgtgacgtttnctncttgacttattctgacacacttatgtggtatatgtctttntcgtggtatttaantttttctgctntgctctttttttactntctcttgtgttctcacttcatcttcgtgtcgtcgcgtctgctgtcgtctgctagctcgcctatactnctgtgatgatactacatgcattctcatcttcgacatatnatttggctgacttgtgacagtgacactatcatctctatctatgtcanactctgctctctcnctgacctacgtacgtgtctcnactgctgccgccactccagtcttctacatcntgacacgcantctctactngtntgtactactgttaggtttatgatactcagcgtcacttcacgcactgtgttacgcatctctctcactnctgactatccctgctgcggactgncttgtcacctttttcttcgtcgcctgctcgttgtngtgagctttgtgtcattncatctgtctgctctgctgttgtctgatgcttgtacgccgcccattatgctgccttngatgtgctgtgcagtgcatgttgattgactgctncgcacgtttgcgtactgatcattgacattgatccgagatactatgggtctgtgtgcgtacgtgtagctgatg

SEQ ID NO: 1858 - DNA, 2241 bp, Zea mays
  misc_feature (1)..(100): optimal_loci_231814_G1, chr6:142321458..142323698, Cluster 11
actttatagcagtgtgttatctgattacggttgcacctaaataaatatgatctagcattattagctacccgtcacgtacgttacaaatgtgtgaactaaatcacaccttacctttcttcgagacccctttcatccatgtaaacgacgcgattaaacaatatatataatgctatatacctccaagatataaacaaaagtatttttttttcctcggcaaaatttaatcttatcccgatgaactatatagctagctagcgcttagtcttgcgagatgcttcacctagtcatcgtctctcatgcatctctcttggtcgccgctatgtggaaaaatgactagaatacaattagttatgggtttgcacccaattttgatcatgccagtggtggtcagagcagtgtgtatgcatggcggggttcaggagacgatgttacttgatgtgcatttcaactaggttgaatctatcactcatcaactttttatatacatgcaatcgctttaattaggtcgtgcttggtttcggacgagctaggtgagggttgagaagaaaacggtttcattaggttttcttttagcgaggtttaatttagtgtcatctctcaacggacacgtacatataccttcatcttggtcgtatatatatatatataccccggccggccctaagaatgctctgaaaattgtatgcagacagtaaggcttcaatttcacgtgaagtgaaatgcatgtaaaccgcataattaaatgggtgtgtctgtattgtagtgtagcgacatgtaagtattatttgggtcgatcaaccatcatttcgggcgtttcatcgatctgaataaatcgagctgtagtaggccacatatcaatggttgcttggagatgcatgcatgcatatgtatccgggcctccggtagagtatatatggacaaattcacgtgtcacgggggagaaggatgggaagccagcctttcggcttgctcacgttacgtaacttttttttgtccaagtgcatgccttggaatcgatcagtcactgatatatggttgtgaaagctagctagcctagccagacagccctacgtcgtgctcgtttagttattagtgcttggagttggactcgatcagtcatcagcctgagactcatcaagtatatatatatatacgatggcgatgttaattcatatatatatatatgatagtagctagtgtatatgcaaagcgtcctcctaatctaatctaatctaatccgcgcgcttgcttcgctttgcttgtcccttacgccgcccacgtgtccaagctagccccaactgccccggccgggcgcccatcgacggtccgccattagtctcgtcgccgcccaccacctgcgccccagtcacatatggatgtacgttgacgagacgggcaggcatgatgatgctgtagcttggacacacacacgggcgggcggccggcgtgcgcgcgcgtgcatgtacttgcttggcgtactatcattgcaactagctagttggacagccacagctcgttatttttttccggccggtacggtttggtctcgatcagacgctgcaatacgacattgctaccggtaacgacgggtgcgtaagcaagccgacccgacgacacccctgaccgacccctttctgaaaacgcaagcagcagctcagcagcgcggccaggtcgtagaaacgcccatggctgacgatgttggtgtatatggcgtttgcttgtgcgtgtccggcgcgcgcacgccactctctcggcctggcgtgccgtccgggtgcctagctagctacctagtcatggattattattatctcgtcacatcaatgccggcggccgggagtttgcttctgggtgtctttgcgcgcggcggcgaccggccggtccgtcgcctgtgtgccggcgttatatgtgcgcgcggctgacctgggcgggacggccgcgtgctgccggcgcaccgagttgccgtccggcgtgattcgtgtgtttttgtcgcacggcccgcccacatcgtcagcaacatctccgattcggccacgaatccgccgtcgtcacacctcatgcatgcgtggtacacaggacgacccaagttctgcgcatgcctgcgtatgagtatgtaccaagtaccaacctcttctcggatcagaaactaattaagcgcaattgcgccaagtctatttcgacagttctatcgttaatatagatctggaatttaatattgagctagggtgacgtgctcatgaataa

SEQ ID NO: 1859 - DNA, 1940 bp, Zea mays
  misc_feature (1)..(100): optimal_loci_232310_G1, chr6:145310547..145312486, Cluster 11
gatcccttgacagtgcagccgtctccatgttccccccccccccccttcattccaacgtcactctaggtccacaggcacggcatggtgttccagacggaaaacggtggttggtatggtagtactcgtatgcgtcgttgctcacgtcacccgaacgactcgtcggcacgacttgtcccgtcccgtcaagactgcccgagaactacgtgctgctgtgtcacagtgtgcgctgcatttcctagtttcctaccgtgtcattgcgtcccgtgcgaagacgttgcagccggctgcaccagctggtcccgagttcaacccgtggtcgtttcgtacgatgtgactaggaaggaccgaaggaacgccctttccttgtgcggttcagccgatgcccggtggcccgggctagcaaaacctaccgaacattctgcggcgatgcgggcagcagctctagcgttctactcacttgtggtggctggtgagggaccggccaccgcacttggcctcgctcgtgcaggtggtctactctgcctcgatcggccgggatgcagatgcccgcgcccgtacgcgaaagatctgcaaaggcaagccactgcacaaaagaggtgggatagctagcagagataaggcgcgtcgctgtagcacgcagtgcctgcctctagcttagcttagcttagctaccatccatccgattccaatgcagcagtggacagtggtcacctacctatcaaagatctctcgctagctcatctcggcagattcccccctgcgcggacggcgtgcggcgcgtctcagctgtgaaccccacgcgcaccaggccgaaagatggcgccgcgacagtgccgccggtcggcttccgcgtttcaggctcgcagacccaggcccagggatagatcgcccggcaagttgcgccgacatgcgcctgctgcactgatcctgtttgcagtgcagggactgttgccaaaatgcctaactgccgttcgtgctcgtcagctagctcgtggctccgtgcttgtacatggtcactgcactccatatggaccatatcatggaggcacaaagtaggaggagctgattatatatccctttcgtcttcctttttcatcgtcttcctcaagtgcagatgaaaggaactccgaaacggacgtgtaacgcacacggacacgggcgggcggcgtagcgtagcgcctttttttattagacagtttaaataaatagctactactgtggcagcaccagcccaatcatatttacctgcgttcaacccttgctcctgcttttcgaaaacaaacatggtggaagcatcactatccgagctaaggatcgcaccgagatactcccaaataagaacgcaacgaccctcacctcagctccaccgcttttggccggtaaatgtacctcgactcctcgactcactcacctctctcgctccgcttttgatcgagttttgagttgactttgcaaggcgaggggacgatgacgatgaaagaacttttggctgcgtcaaccatgtaataatttagggatatcctctcctgtatagtatatagagtatttttacgcgatatctcagagaaccattagacgataatatggacctggtccggcgagccaagctccgaggtcctaaaaacattctctctacgtgacgagtctgacgacagtttctgtgcgcacaaaccactgtatatatatccagtgccccctgtggtcagcatgactttttttttcctaacttggcaccactttgctcggcttcttttggctagtgccttgagcacctctatatcctgagtccatcaaaacactcttaagtcatagatctcgcttcaattgatatttgattttttttttccaactgttccaataggttctaaaatgttgctagggcattttaaatggtccaaattaaagaccatttcctactcaatagttttcacgagaagcta

SEQ ID NO: 1860 - DNA, 1423 bp, Zea mays
  misc_feature (1)..(100): optimal_loci_232885_G1, chr6:147895455..147896877, Cluster 11
gttgcataagcaaccgtcggtgccgtccccctgagcgtgactggacgagtcgtcgccaatccatcggaaagagaaagaggaggcttgaacggaagggggaggccacagatgcacaaggacagtggacagcactggcgtgtgacagcaagcagctagcagacacagccgttccttgcttctagacgcctccgtctctcttctctgcacattcttttcaagagcaggtacgtacgtgcgtgcgttgcacattccattccatcgctcatgcatccgtgcaacagaatcacgagtacgctcacgcctgcctgacgatggagggaggcactggctcctcgtaccggacgattggaagaacgtgatccatgctcgatcacaccacctgcggtgtcggcacacacacacagtacgtgctgtgcgtggatacctgcaccggtcaaaaaccaagcatggatacgtcgtcgtcggacgaaccggcgagcgcgggcgggcctctcgtttatctatttgctgaaacttgtttcttgtcttctactatcagcacacatggcgtgggtcctgtcccgacggcttcaacgaggagcgacgagcgagtcgatcctcccctcccgacggctcagccgtaacaaagcgtcattttcttcctccctcttctcccccttgtcttgtgttgtgtcctcgtcatcgtcatcccccgttctaccttcctttcttcgccggataaagccgtgaggcatgtcgctttcgaggttgtctcagccccagtacaggcaacggagcgcccgcgtcatccggacatgccccagagccgcttttcaccacgacgcaacgcaacacaaaccgagagctctccacctcttgcggccgccatgggtcagtacgacagtacagcacctcatgccacgagggaaataacgtcgacatcggtgtagacgtccccaaccaggaccttcacacacatattatatagtggagtgggctagccaggaccttcacacacatattatatagtggagtgggctagattgagtggatttaaatctttagcgactaagaattcttcctaacttttgtaatctcatccaatacatattgaacggaaataacctgcttcgtgttgtgtttgctctctttgttctctcttttgctgctaaagttcttttgttgtgttgtgatgtttgcagctatttatttaagaggttgtcttgtttcctacaaaacgaggcagttgttagttacaccagaatcaaagaaattcaggtggggttttctcccccttgacagtcagaaaaaaggatcatgttcaaaacctctaaaacgaaaatttagagctaaaattaggtaagacgtaatggaccaactaattgctagctataaccaaaataaccattagttgttagttgtcccgacccagctacaactagct

SEQ ID NO: 1861 - DNA, 1526 bp, Zea mays
  misc_feature (1)..(100): optimal_loci_233629_G1, chr6:150836004..150837529, Cluster 11
tggactaaactgttgtagtcctaacaacgtgaaaatcgcgaaccttgtttggcccaaggagctattttgcatcccgccggaccggctcaggccgttgtgttttgtgtagacaacaaaatagctggaaactgtgtcccgtgaacttggcttggtcttatacaaccatccaacacagactagtatcagagagccgtgagcgtcggccggcgcaggaggaggctgacggaggacgccatctgaaaacaggccggcttctcttcaaatttgtcgtgcctgcactcctgtagtcctgtgcccccgcgcgcctgtgcgtgcctgccactgatacccagctgccttcgagcagcatcgttggtgatgaaggggcgataatgatagggagagactgagagaaggagcgcagatttggagtccggctatgcatgcgctgcgctcccacccaggtccacggtggccggctcgtgacgcgccggttgttgttttttttaggccagcaagagggacgttcgctgtcgcctgtcgtacttatcagtagtagtacaggttttgtgcgatagaagcgccgcgatttcgtcacacaaaaagaatctcgatgcattggataccctcctgggcttcggcatgcaacgaacgagaccgagagcgcggtctttttgaaaaggcaggcaggcctcgcctgtgggttttcgagtggcaaggacaggcttgtatttgtagtaggctgtaggccccgggaccgggaggcgggagcgttcgacacgtcgagcggtttgagcgaccacagttcgcaaaaggagacggcaacacgctccatgcccgtcgtccatccggtgtagcagtagtattatgagattggctgcggttaggaaaagaccccaaaatgtgcaaacaaagaccccgtaagttttgaaaacaaaatactaggagggttttgggcgtctgtctgtctgtctgtctccagacggcacgccggctgctctttcggggtgtcgagcgaaccgaactctcgccttgtttatcgccgctggccgccgcagcgacgacgcactgctgcgtccgtcccccgccccgccgccccccgtgacctcgctgccgtgtgcatgcagcaatgcgcaggtcaggaaacgcagcgccaccagaggcgagtatatttatccatttcgtcgaaccagataaattgatcgcaaccccatcgtcggatcgtcccaacagaatgctacgattaaaccaaccagatttatctacatctgcctaccattaaaatgtcctgctcttttacatcctacagtaaaatgtattttcagaaatggactctttgccagtacccaaaatggaatagccttcaaattccttcgcggcggctgcggcggcgatggtcgaggtgacctatttttttttttgcgtttgtctcttccgttttttttatttctggattgtcggttccaaacaccgaatgacctggcaaaaaaaaaaaaagacaaccatggccagccatgcaccgagttcgtctcggtctctgcagaggt

SEQ ID NO: 1862 - DNA, 3596 bp, Zea mays
  misc_feature (1)..(100): optimal_loci_235216_G1, chr6:158290523..158294118, Cluster 11
gcgaaggcaagattcatatgatgcaaaaataaaataaatgagagtatgcgctttaagataattattgccaatgtaagattcatacaatataaaaagataccaaaatctctaaattgatatactactaacacggtgtaccaacagtattaaattaatgatttattgacaaacataaaatgctatataatttatttggtatattcatacatctactagtaccaataaacattatcaaatacgatatttttataatatcaattttttgagttacacgtactgtgactttcccaggatttgtagatgcctctaaatacgtgaattaattaaccatagtgaactttgtttaacattttcaattgagtattaaggttaaaatgttcattttaacgcaagtaaatatttttaatgtgaatatatacttgttacaagttttttataaatttaatttataattagagctttattttgttttatatctattttgcaagtttcctgttttaaatagaataggcaacgtgaaaaccaaaaaagggaaagctggacctcagttcggcccatagcgcacgtgcacggcccataacctacgcgcgacggtccagccgaaacaggtcggcggttcagcacgagtgaaggccggcccaaacaaggaggcagtaacaggccacgcagttgcgcatgtgaagcaattccagcccaagcgcggaggcaataacgcggacgtgtcgaaaacgttacagtatgagtgttttgcgcgagactgtatttcaaactccaatgtataagtaatgttgtaatagtatatagaattgtttttttcacgaccatgtacacaatttcctagacacatctaagattccatttatattataaatttaaatagtttaaaaatatttttaatctatatagtaaataaaatgacttatttgaatatcttttaaattcacaattttggcttcacgatttattagatattagtgacttgctctagcaacttcatcatttttttctggtgatgaaactaatcagggtttagatccacaattctagagcactatttgccactatttaactatggttatattttgttctctacttctccttgacagtgtataaagtccaatacaaattacattatcacatcaggaagaatttgtgtgattctagtacggctaataatgagattttaaaaatacgccataaacggtcatagactttacgtgtagcccttcctctattctctcctctcttcccccaaatcgatgagcagaaagggatagcacgacttcggtcgattcagccggcggtgaccgtctccggcgcgaacggtggtgggctagcgaaatgggaggccgcacccgtgggtgcaagcgcccaggcccgaatgggcctgtcaaagcggagccacgcggccacgcgggcgcagatgaacctgtattgcggcaagcgtacgttcgcggttcgccggtggcgagggggagcactacggtttcctaggcctagcgtgcaccggtgaattcttatggcctcgtcagggtctcagggatatctcgtagtacgttgaccgcgtgcggcagcgggtggagcagaggtgcgccggcaatggcactccaacaccgcataagggctagagccagcacgaacaacagcttgggtttcaggacaacggtggcgatggttctcgagtgccaccactgctggccgtataggttggagcaagaagcgtggatgggggtggctggctcaccgtgattctgtttcggcggccgtggtggcgacaacacgggcggcagggggctgtggctgaagatgagcctgccgaacgcgcgcgtggtgcatgcaggaaagacgacggcggagtcgtcactggctcacctggcaagggcgggggcgagagtggtgactagaacgacggtgaataccagtgtgtgacgtgtctggtgctccagaacacgcccatggccatgtcaatggcgacggcgttcacgcaggggggcagagatgagcagacgggcatcttcggcttttgcagggacgcaggacgagggagtggtcacgggcatagcacggcgaggcacacgacgcacgggcgcacggtgtgcatcgaggtcgagggacgcacgcagcaacgcgtggagcgtggcatttcactgagcacctggcgtgcaagtaactgggcacgtggtgattgcgctcagcgatgtcgggagacgagaccgacagctaccgagcacattgggactgtcgttcgtatagtaaagataaacccgtgacgcctaaactaaaaggttgttggatgtgactcccaattatctacagtacgtttcttatttagggatctaacctaattaatttcatcagtgctctagtgttgtaggcatatactatttaaacttgtaattttggagaaaaaaaagtcttttagtatacaaacttaacagagcatggcatgtcaatatagcaatatcaatcaaattatcggacaaattttcgaagctccgattcaaaccaactccagactccatctgtggaattccaaataaattattgagtaaagctaatgaattatttcagtcatttctgtaggctgattcatatatagcggactggtggatcggtccacaagcacacacaattagatctgatattttcgattgttgaattttgaggagagctttctcttattgccactaaacctctagtttaaatctcatattttgtagactgtgtagcataggattttcccgtttcagacgtttgctagcccatgtggccatggctggtaggccctcatcagtctgatcggatgaacagcctgatggcctggtgcagcaaagcggtttggtactaaaaccttgtgtgtttgtgactaataaaccgtgttgacgtgactactcgttaatcctgacgatttaacctgacctagaaagttgtcgggccgctttgcagatttgcttccatcgtctcgtgcaggccgtaggttaggttaggtacgagtaggcacggtctgctccgggccctttggcacagtaggcaggcatggtcttgtcactgacacggacgcttggtggcttgtgcttggcatgtgaacgtgaatgccaagatgggaggccacaggccacaacaggtggccaggccctttgtaacggcttcgctgtcgcccttcgctcgacgctcttgtcccgttgctaaagcgtacgtgctggtgctgcgacgacgaagtggccgtccctgtcgcctccgctgccggctctgtggccgctgccggcgacgtacgcgcgcgcgcggcgggccacggccgcggccacggccacgtacgtacgtacgacccccggcgggcgctgatcggtgggccctcactcgatcatgcatgcctcgatgggcgatgtctgttagcgtgtgttcgtactggcagctggcccgttacggtgtgggccagggtcgtccggcaagccatgagatgacacatgaatggatgtcgtgtcgtgtcccgtctcccatgccgtggaggtagagctgagctgatcccagtcccagagtcccccaccgccggcttctctgcttgcgctacaatagttggtggtgggtcgcggacgcac

SEQ ID NO: 1863 - DNA, 1565 bp, Zea mays
  misc_feature (1)..(100): optimal_loci_235220_G1, chr6:158295947..158297511, Cluster 11
gacaagaatggcccaccaatttgcatcggagatgcctacttagtttctgcccagccataatagcttggtctattgcagacattcctaactgaagctagctccaaatctgatgcaggctcagttgataaacgaaaccaatcacaccctacggctacgggaacgggagcgtgtgactgtccgaggcagacagcgaccaaagaaaggctgctgagcctggccacctgcatcgtcagtcaccgtcgcaccggctactgctcaggcaattcatgggcgagggccgggacaaaaaaaaaaactgaaaaaaaacggcggcagccgggccgcggatgaggtgaaaatgaaatctgctgaccatgcacactgcaaccgaggtagtaaaaacctgacgagcccggcgtggccatctggtgaatttctggtgcagacgagcagagcgcgcagtgcctctcctcttggatttccgtgcccggagctagcctgcagcatgcagggcacaccggcctaccggcattggcaccaccatcaagactcatcaaccgtgcagccagcagcagcgcgcggcagtacattctacgcacactcctgggcgggcgagcgagacgaatcccagcgcccgttttactgtagcggcgcccgcagtaacttgcggccgcagccccgccccggcggcgtacaggtactgtacacagacagccgccaagcgtacgtcgtcgttgccgccagtttgggcggcacctgtgtggctgtgtgtgcgcctgcgcctgcgcgcaaccctcgctgctgtagatgatggccggccgagccgcatatgcagtccagtccagttcagtcggcagcggcgcgcgttaattaattcgcgtcagggcgcgcgcgctcggtacgatcctgtcattcctgtgtgcgtgaacgtgatggcgccgggcagtccggtgatctcatctactagcactagcagtaagtagctcggtgaaaacggaacgtcgtcctgtcctgcaggcgtgcgttgtggcctgtgggatcgtggagaggccggggtccggcaggccggcaggcggcagcatgaagagggggtgcatttggcgtggtcgcgcgtgtgggcttcggaggagctagggagggaggacagacacggcatgcgctgctgcgactgcgcgtattaaagaggcatgcagtgcagctttgggttgttggttgacgcgattcgttggcgtacctaccgcgcgcgcgcctcgcttcgtggctgctgctacccgccgctagtgcttgagtttgaggtttcggcagcggcagctccatcatccgcgcggccgccgctcccgccaccccagtatttaggccagtggcccagcgcacagcgcacagtgtacaggaccaccgcctgccctgcttttgcagctatggctgcctgcctgcctgcctctctctctctctctccccacctccccgcgtctctctccttgtctctggacgagagagacagccagccagcctgcgtgtcttttagtgcagtcactggcctgctggccatgatttccagccagccctgccagtgtgctgcaggcacc

SEQ ID NO: 1864 - DNA, 3137 bp, Zea mays
  misc_feature (1)..(100): optimal_loci_235932_G1, chr6:162101610..162104746, Cluster 11
agcatgtgtatctatccgtctgtgttttgcctggttgggccagacgggccatcgtgccattcgggccatcatataccagacgagccaaataaacgtaccatcgtgtcatacgggctggcacgacacgtctatgtcttagccttttcgtatcagtgtgtctctgtggttggtacgatggacaacacatatatatggtacctctaactaatcgggcctgtcgggctcgagtgtctagcgtgccgtgttccgatcgtgctcttgctcctgtatagagctagcaaagccatagaggaggtcaggagatatatagcagaaagctgccgacacttcaccccttggtcaaaacagtgggggcgagcgagacgcagaagcttccggccggcctgggcctggcgtatctattgggcgagccatggatcgatggagccgatcgtcctcgtcgtcgtccccccatgttggaaagcaacgtgccatcatttctcgccctggggctgtaataagctcatcatcaggacaggaattctctggatgcgtgtgcgtgtgtgcgtacaagagaacggagcgcgggtggccgtgtctgccgcagtcagtggcagactggcagagtgcccccttgacagcgcgcggtcggcacggtcgacagcgcacgcccgtcccttgtccatgcaggcaggcaggcaggggcgcagggcatctggacatgagcagcagcaggagagtgcaggacggacgtatgtgtgcacacgtgcgtgcgtgccaaggcccctgcaactgcagcagagtatatccagtctgcagggaggactgcagactgaacgtgaaactggcaactgcatggcatcgagtcgacgcccaactcctgtgcggctagctgtgtgcctgacgcaacgggcaacaactgctactgactgacgcacaggcggccccgtttctgcgtcgctgagtcattgcatgcagcactgaagaccagcagcagcagctagcagcgacaacgacatctccggtcagatcagagagaggccgtcagacagcagttcctctcctcctcaccctaaaccccccatgcatatatgaactgatgatgaacgaagcggcggtccacatcagggggaaagatttcatgggaagcaaccggccggcatgcgcatgcaacgcgacgcaaaggtttttcggtcgccatgcacctcatcgtcatcgatcacaggcacagcgtttagaatatttggttcatcaagcgatcgacgagagcaacgcaacgcaaagtcagtgtgtgtggctggtgggataacagcgcatgcatgcatgcatgcatgatcgtccgccgggcgagatcgttcgagaggtggttgcgccttgcgcgctccctaatttttcactggggagtaataatgcctccgatgtgcatggagcgcccggcctgacgtgacggcggccggacttgatcgagcgaggcgccatatctttgctgcgatggatcgccacgcgcggggaacggaaaatatcgccgatcgctttgccaaggaaagaacagctagctagcgcgaggaaccggagtttcatttcatccacatccacgccggccgcccggccgggcttctgaagaagctaggagaaaaaaacgtgtcgcgctgctctcatcttctttttcactgtttcaattttttttctgacgacgaaaggcactactgcatgcgtttcttcttcattctctcatgtgtctatattattgttggattggagagaaagcaaaaaaaaaaaaaaggaatctcgctgcatgcatgcatgcatgcatgtatcgtgaattcgtgatatattgcttgcagtttacaacatcatttagctacgccggcctatactataatagggccgtctgtactagtttaaaagtttaatggtcatcagctgtactgtcagcgaatgaacgagtggcgcgcgcgcggtatggaaatctgcccggggcgctgctgtgcagatattcgcgtgcaatcgtcaggattctgagaacaggagctccaaacagtgggccaaatcaaatcgcctcatgaattatttgtcggtaaagaccgaccggccggtcgaagcatcgccccctgaatttgattccccttctagattgactgcctacacccaataaaatacacggtctatccatcactgaaaaagactgcgcaggtcaaatttaatttagtagtactaactctcgacaaaaaaaaccccatgaagcgtggtttttatctccaaaggaagggggaaaaatcagggatgatacttgtagctagccatatcctttgtaggaacaaaaaaaaggctaggctaattaaattaggtggacagctatagctttgcttcatcagtgcatgcacggttcggttcggtttcgcatggcttgaacgaacgcctatacccaacggcttaatcatgccgggttactcacacaaggcaagtgcacgtcacgctatctgttgtgatggcgacggcatggcacccgcgcaccaacctccgtcgccatgggctcgtaaacgcccaacatgtggctgctcgtatttatagttttatatgattgtgaatttgatatttatgtacactatatataatatatatgcatgcaactctaagtgtgtgtgtacatgtatatatggaggtgtctattagtttgcataacttcaaagaggagccaacatgatgcatgctcctccctccctttttttatgctttccttttcaccttctcccccctttcctttctagaggaggcaagtcaagatcagggactcgagtaagattctagcagggatctttttgtctacaatagggacatgcatttgtagagactaatcgagtggcaattctacgtgttcccgtagattcgggatacgacgtagtctagtcattataacatatacatatcttctacgtacgcactttttctccattcgaaaatacgagtccatctggcaggatattattaacacggtcaacattaaatcaattggactagcaataactagaatatctataaaagaacgttttttaaatggaaatagcaactcctatcatcctcctatatacgacgacatcacgtttaaactttgtaaaaccccaccaaatcaaatcatctcggcactcgtaacctccact

SEQ ID NO: 1865 - DNA, 3027 bp, Zea mays
  misc_feature (1)..(100): optimal_loci_235948_G1, chr6:162161644..162164670, Cluster 11
agtagcgagtggaaggacacgcatatgtaccgtcgcggggtggaatattcggagtgcatatgcaccggcaccggaacgcagcggcacgttcacgcagacgcaaaacagcgcaggggcggctgcagatgctgctgttgctgcgcgcgccgtcggccgtgtctcggcgccgcggagcgacgtgcggccggccggccggcgcaggcgacactgggcacacgcgagcgacgtgcggccggcgcaggccacgccgggcgcaacaagtggcgtcgcgtgaccgtgagggcgcggccaggttgggcggcgggggctcccgctctctctgtgtactcccatgctgtgcgccgaccgaaagcggcgcggtggatgcgtgcggcgcgcgctttgcggcgcgggcggccgaacggggtgggccccgcagaaacggtgggggttgggggaatgtgtggatgggcgggctcgtggcgtgcggtgtggtctgatctcgtcggatgcgttgcgttgctttgcttccttggccagcgtgagctcagctccacccagtctgccctctgccgttgccctgccagagtgcgccgtcggcacgcccgggcccgccaagcaagctctcttctcctccgctggcctcggcttgattctacgccacttcacttcggtttccacccacccgagccaagtaagaatccgaagcttttgccgttgtccgtctacttccagatcaccaccccacagcatgacagatgtggccggcctggccgcgctgctaccaccggcctagccgtcgtccgatgcaggaatcgaacgaccgttccggagtggacggcgggcgtgtcggcggtgctggacgttcgttcgtacgtgcattgcacggtgaacgatactctacgttagaatccagtgacctagggtgccacggcacacgggttatggccgcgcggcgcacaccggttaatgattcgcttcgcttcgatctcgctttcaccacgaggcacgagctgcgtcgtcgcgcgtgcgctgtccagtcttcagtgcccactgcccgtgacggcggtgcccggcggccgtgccagcttctgaatcactggaagcgcgtcagatgatcgaggggcgccaagatggagaaaaaccggtggtttgcgtacggcttgcgcacatgagctgagcttcgacttttttctggcgatctggagacgcctgccttttgcaacgcccaagtcttgagttggaaggtccgctcctctactaaagtcacgcagacgcgtatatacaatgccagccaccgtcacattctttaactgagggtttacaggacttttcttttaaaaaaacccaactcgtccaatcatcgcactaaagacgaatcttccatgattgggctcggcttcgttgctccactgcgcattccgtgtggttttttagtcctcctcccgcgccaatggcagccaggctccgcaaggagaacgaacggctcctttttttcgctgcgtgctggaccagctccacttgtgaaggctatgtgtagcaggtcaacccttgtgagtttgacacttccccattggtctctgtcccagaaaaaaaaggggggtgccggtgtacttgcggagcttaccgagtttgccccgttgaccacaacaccgctggtcgatggagggttgacgagcaacgaacaggggcgatacgggatcggcggtcgtgcgtccggtccgatctcgccgggcggaggagatctccgtgcagataagaaagtgacgccccacgaagtcggccgaaaagcgcgcgtacgggaggccgggagggaggtgatggccgagctgcccgtgccgcaagcctaccgtgaggtgtagtgcagtgtagtgccattccagttccagtccacccatcgatccgtccatgtctttcgactccgacttgcacccagcgctcgaactgaagcgagcagccgtctgcggcctgcgatgctcactgctggtcgtctcgcattgcagcatgcttgcgcggcacaggttcagtggatccatccatccttgccgttttgacgcttcactgtggtagtaatgaacccagcatcggcctgctcgctgcagcacctgtggtcagtctcctagctagttacttcttgcaagaattcatgcgtcgtcttgagctctacagtagtctttcccccccttgttttgtgtggcttttcagcgacaggaagcgtaaagatcttgccgcaccgcgatccagtattggccaaaagtgagctgaactgagctgaatgtcaacgccattgcttttgtcaatggtgcggggcagtcgacgaaaaaaaaaacgtttggcgcgctttgctttatgttccggatagctagtggagtacagtagtatatagcagccagcagggtcagcggccaaattattcttatataatactgtagcaaagagtgtagttgagtcaatgtccttgccaaaaaaaagcacagtatcaagggacatccatcaatagcagtggatgttgacttgcaaaggcttgacaaaccctgtagtttattcgatgacacaaagttgaccacaagtggaaaaaggatgggatttgtttgtttcgtcgtccctacttttcagagtcgagcgctgtattgtatcgtcaattcgctgtcttttgggctggccaactccaacagatcacatcaagcccagtctgaaactctgaatttggttcctgcaattggcagcttgccactggcccttttggcattggcgagctggcgtgtagtgtaggataaggctgtcagttggctaaccactcggcatctcaaccctcaagtggatcaaatagacactgcggcaagaagcatagctagctggtggaggcagctatttttctgcactgcacgggtgctggtctacagcagtagtagtagctgagaaactttggacaaatcgacaaaagggctgctgcgtcaatgtgtccgtggaatttttcgacgagcgcggcaatcttgtttattttacgagtctcaatcttgtttattttgaaagaacacgccatgctta

SEQ ID NO: 1866 - DNA, 1459 bp, Zea mays
  misc_feature (1)..(100): optimal_loci_236349_G1, chr6:164283113..164284571, Cluster 11
cgaccccctacccctcagttccccccgatgtcggggtcatgtcgggtctggttggcctagctagcctcccgctcctgcccggccgatgcgacgcgacggcgacggcgactgctgcctgcgtgcatgtgaccctgccatgccgtgccgctgcctgcgcgcgctgcctccgctccccgtcgccgtcgcctccctttggcccttgcaatactgtagagacccgtcgacgcacgtacgacaccgtcactccgtaccacgcgtcaccggattgttttctggtctctctccgtttgcctgggtcctgggctgggcagcctcaaataaaggctgtcaaagcctgggtgtcccggcaaaagtggtaagtacttgtgttcttaaaaaaatagatgacaagtgattcttctctctaaaataactacacattaggttaagaataaagagattcatgttttttaaaaacaattatatacatgtcgtacctcccataaaagatgtgatcatctgtagttttggttgaaacgaggtaggaaagtaaaataatgactacagctaggctttcttatacccagatacacaattacctttattattttataacagattgaactccaaaaatatatatagtacatgactgatcgaggggtaggccggtagtgctactgtgcacaggggtgctggccatgcacagtacctccagctctctagtacatacatctgaaaaggggcagtgaccacacaggacgcctgccatacaagggttcacatgtgtgctgccgtggagtagtactatataacataccgtatgtaataaacgacacataaaaaaagaaacggcaattcacacaggtacgtgcatgacgtacagttaatgaaacgggattatgcacggagagctagctagctgcacgtacggtgctccatcaactgccgcatgcgacgacgatagcctcatgccctcatgtaaccacggagagtacgtgcctgccgcctggtggtcaatgcacggctctctcatgcatgcatggcttctttgggagaatctgcgactaataacaggtgcacgaccacgagtggcaaattcgtgtctctagtggataccatggagttccctttttcttctcgtctggtcagccatcgtacgtctatccatttattactctcttcaccctaaaaaggaataaagtgcgcctcacgtatatcgacaagcttaacttcttcttcatttttttttaaaaaaaactgaaaacaatattgatatttatatttctaaataattttattacaaaaattatatcccaaaacaatttaatggcacacatttgaagagtttttggcttatattatatttggtagctttaagaggaaacgagtgactttctacacaggaggcggagactagacagtgggtcatatatacttgtcttttgtccttccatgcttactaatagcaaaatgggtcaac

SEQ ID NO: 1867 - DNA, 1626 bp, Zea mays
  misc_feature (1)..(100): optimal_loci_236382_G1, chr6:164513529..164515154, Cluster 11
tttagggacctgcttgacacgtcaaaaaagtttaggtatttatttttttagactatctacatgcagtagatgttttattattattattatataatataactttttaaaagtttgttttggttcatgggtataaagtaacagaatcgcggcaaactctaaaacgttggtcagaaaaaaaaggagagcaatacaggactacaggtacagtacaagagatgccgacgtgagagacgagtgtccatgtctttggtcttcgtgaccagttcacgctggcactggcaggtccgtagttttgtttcacgcactggtacccgccacgaagctccagtcaaaccaggtcggctttgcaggccagaccggttcgagccagaaaagctgagccagccgacagcagggccccgcgacccagagtgcgtacaaagctccccagtaatctatgctgtgctgagtagtagcgtgcttgctcggggccgagagccgtgcacgggcgaaaggcagtcacgcaggccagtgcagttgctgcggcgcaacagcggtcgcagcccggagcccgcttgtgggttgtggtggctccgggctcggccgctcgccaccccccgtccacgtcttgtcacccttcgggctggtttggaggtgtctgtctgtcttgccattaaactcgcagctagactctcatcgcaagccaacaaagactcctccctgttcacgccattgatcggctgcccgtcagcccggggcccgcgtaacagtggccaggggcggcctggcctggccgccgaagcgagggcgcaggcgcggccgcggcacgggggaacaggcacagcgctctcgctcgcttggcgcgctgcgcctgcctgtggcccgcctggatgccaatgccatccggtcactgcttacagtttacagcagcgcagagcaggagctcgtgaggcaagcaggtgggtcgaatcggggtgacgacggcgacgcatggttcgttcacaaaacgcccggccggcccggcccctgcccaggtccccaggcgcggacgcgcggtggcagcgggccatggggattggggacgagagagccagccgcccagacctgacctgacctgtgccccggcctcgcacgcaccagcgcaggaacagtgctctgactctgtctgacccacacgcccgataaaagcgaggagaaagtttccgtctcgctgccgtaggtctcgccaggcctacgcttactcttcagccagcctacgccccccgtcctcctccacggcctcgcgccctgccacccgtttccatcgtctggcgcacgcgcggtttttctagtacaacgcccgtggccactctcaagcgaccaagtagtacatgacaagcttggattctttgatggatcgtgtaaactagagcatacgtatggagcccagaacaagtataaatttctatgagttctatgttatggacaatgttagttggtcgtaagatttatattggtttgagtagaacatctctatatccagtcttcatgggctcacactaccgatacctctatttctcgatgctaataatagaggttacaacggggtcaagaggaaaggcttctaagtctcttacgagggagtgacactaaagagagtcctacatt

SEQ ID NO: 1868 - DNA, 3474 bp, Zea mays
  misc_feature (1)..(100): optimal_loci_236472_G1, chr6:164867039..164870512, Cluster 11
tttttacctggtttgtctttttacacaaatagcatacatataagagcatctccagaagtttggtttagtttacttgctgaactaatagctctagcaaattaacttacggataaagagtttctctcgactatggaaacttacgagacaaagcggggtgtttgatatttatcgtattccaagaagctcttgtaccaagctatgaagggcaatatttttctgtgtgttttttttgggcagcataaagctgcttactcagatgtacaccctcttttcctgaaccagaattaaaagcttagcaacatctcctttctccccccggagagcaaaaacatccgtgggctgcagcccgtaaactgacggccccgtctgtgggctgctcgtactgggctggtaaagtctacccatccagcagccacgcccacgcgttgttgccctgccctctaaaaaagaccagccaggctcaggcatcgcatttgcgcctccgttctgctgcatgctatggatctgctgctctcgcctccagtcctagttctcatgttattgaactctctctctccttttttcaaaaaaattatctagatgtatcgtatagataccaaaatgtcttgctataatttaaggtgaaatgaagtgaagtctttaatataaagtaggtcgtcacgatgacagtgaatcctaatgagcgctccccggtagaaacaatcaaacaatgcaatcatcacccatcccagtccgagcccggccatttccttctctgtctctctctcgtcagaacgttctggaactggcccgtatcgttttctactactgggcatggggctcatcatcatacacaccagtcgcaccaaagtaaaaaaaaagaagagagaaatcatggaaggaactggaaaacgaaacacaaccgtacgtcgccagcagtcggcgtcgccggcaaaacgcacgcacgcacgcaccacacagctagcgaggcgtctcgccgtcgcgggtcgtcagcgtcggtatagtaaatgatggaaacgccgtacgtcgccggccgcgtaggtcagtcagtcccaccgctgagcagtggtgccgtgcggggccatccatccatgtgtacgctctccgggcgcggtacgcgtggccggcctactacacccggtacgcacgcacacatgtgctcgcgctggcatggcatggcatgcacggcacgggcagtgcgttttgtatccatcgagctagcccggcctgactgatacagggccgctcgcccgctcgtgttgtctacagctgccggacgggacggaggaagaaaaaggcaagagcgccgaagcagccagcggctcctgttgttccctctcggaagccggaaagcagcagcagcgacgccgacgcaggtgggtgcggcgggcgcccggtcccgggtcacgacaattcacacgctgctgctgctgcttctgcctcagctgctgagctgcttcgtctgtccgtccgtccgtctccgtcgcttccgcctccacaccacatgggcccagcgcgccggtgcccaaacgcgctctccggtttctgcccacgcgcaccgcacccgtccgcgtcgaaacatttttttattttaaaaaaaaaagtcgagtaataataaaccagcgcccgagcgcgacctgcgttgcgcgcgtggcgccgagacgaaaggcgtcgcacaaaaggcgcggggaggcatgggcctcgcttgtcccgactcgaccgggagggcccgtgcgcccgtcgccgtcgctgtcgctggtcccgcgacgcacgagcacgtgcgccaaacgcccaaacccagccgcttttttgttgttgttgtaatgttgttgcgtccgtcactcggtgcgtgtgcgctgtcactcaagtgcagtgcatgaggcaccggccgggcgcttgcgcggggagcgttgcactgcactggactgcactgactgaactccacgctgtggggtggctctggcgcgcacacagcacggagcggtgagtcagtcccatgccatccagcgcggccgcagatatttcggccacgtagtaaagtatgcagctggaatctctgatgctgtctgatggaatggaatgggatggaatggaatgataggctagagtccttccagccctagaggtgtcaagatcgccgtcatcaatgctataggaataggagtgatggattttcgtagggagcgagcgacgagacgtaccgtaccgcgtaggcatgcaatcagtgccgcacgaggaaacgacggccagccactcctttgtgccggagaaagagagagaaaaactaaccattcaattgcaatgacagtactagactagtaattaatgaatcgctcgcttgtagggacgccgagagtgcctgcagctgcacggccagtctatctatggctctcgtggctccctcgtgcacctcgttgccgtagactagaatgcacaggtactactaatagcctgccccgaggtatcaagtgtgcaaaatgtatagtaagaggttgacggtggccacgcgcatgttttcacggtctgcgggcgcgatcacggtgcgtggccgcgtggcgcaggcacacaccgaccgagcgagcgagcgagagcagcctgcagccgcccacgcgtaccagcctggtaccatctcagaggcgtccgagatatttcctctctcaatcatgccgccggcgtctccctgcccatccatcacctgccgcgccagagagacagagaggccgagatgggtggtggcgtccgagattcagctgccgccgccgatctatccccactggccaccgcagagctcgctctcccttctccgtctcacgcgcgtggtgcggcctgcgggggaccacccagagacccgagcagccgagctcgctctgtcagtcgtcacgggcgcaaggcaaccccaacccccaacccggcagcagcaacgtgcatgcgtgttccacgacgcataacatattctaatcgcagtgcctgccgcggcagcagagatcccgtcccgatccgggcacggacccgcggccggatctcgatccatcgtcgtttcgctctcgtctccttcgcgatcgcgatccaggtcaccgtcacggcggcgtgtatggaatggagggaccgaccgaggagaggtgttggcggtgactcctcactagcagtgcagtgcagcagagagacttccgggagtcattcctagtggtgccacgtccacgctggggcccgggtctttacgtgtaacgtactgtgcgttgaccctctcacagaggcttcttggcgtgtcggggcggggcacgcaaagcgaacccgagccatcgacgtttttttttggttagttgaagcaagcatgcatgctcggcacatgctcgattttttaattcttctttcctctgtgatgcatgtgttgcccttttccgcctgcatgtgtgtctcagacgaaaggttaattttgttcgcagcgtaactgccacttgatcgctacgtgcgtgt

SEQ ID NO: 1869 - DNA, 1479 bp, Zea mays
  misc_feature (1)..(100): optimal_loci_239096_G1, chr7:10987875..10989353, Cluster 11
agtgtgtgctgactgctgaatgatcatacaacaaatagacccttacagagaggaggtaactgggaagcagtcccggttcatcatcatatcaagagtaacatatcgtaaccgagaggagagtatgcatttctgccggaaaagtgtggagtgaatgtgaatgatcgagcggctttgtgagaaaatatcgccgacatggagccgggtgatcagtgatactaccatcggtgcccgaccctccgcgtgtgtgtcgtcgtgcacacggcacgactgttcgggcggcaagtgaaagcgagcgtgggttgccgcgcgccccgccccggcccggccgtcggcctccactggtcacgggtcacctgtctgtctgcctgcttgcctcggcgtccactcgtttggagaatgacaggggaaggaatgtgccccggcaggcaaggcagtacgtgcggtacggttcgaagcacgcgagccgcggcgagcgtgcgtgaggggcggcgatcggttcggctgctcccaatctgtcgcggacccacccaaggaaagggacactacaggcaggttagcggcgtccgaaggcaaaggcacaaagccaatgcaaccaaccaatgtgtcccgtccccatgccgcgtgaccgcgtcccctccttgcacgccgcgcctgtgagactgcgagcgagcgcacggggcgggaatggaacgcgagcaagcaggcggtggcccaggcctagctgcacgaacacgggaccagagcacgctccctgcgtgcgctgcccggacggacggacggacgtgcgcggccagtggctaggctaactggcgacgcggggctattagctgtcatcagctagcggagggggagagccagagggacgcgtccatagtacacaccacagcacatagcggcgatgaccgtcggcgctttagccagccgcgtcgcggtcgacggccccagaagaccctcttttcctaaagaaaaaaaaaagacgtactactactacgtgctgccaccatcatcatgccggccgtggccaccgcatcgaacgccatttgcgccacaccatcccggcccgcctatctgctctgctgtccgcggcttcccagacttccattccacgcgcaactcgttcccagagctggccaggaactgaccagggcgtcctctcctctccgtgtggccaggaactacccggcccatagagcgatcgcgaaccgacggatgcagactggtcaacgaggcaaccacaacgaccccggcctggacggcgacggacactgtggaaaattttgtactgccaactacctccgttcttttttttaataaaaagtatgaatacaaaataagaatttgagaggagggatggttggagagagagagcctcagataccttttttttctttatttgattcgtgtttgactgacgccatattttactagtttgagattatttaggatgtctttggtggatcgtgcaaaatagaaaacgtg

SEQ ID NO: 1870 - DNA, 2590 bp, Zea mays
  misc_feature (1)..(100): optimal_loci_2457_G1, chr1:12870713..12873302, Cluster 11
gtagtcgtgactctgttaggatttttagttagggtccttaagatcctattcttttagaattctactaagacgttttatatacttggtcatgcaaccaatgagtatatactatgtagcaactaaatcggcttcagacatagcacagcacctctcatttctttctttgagtgtggattgcccgatttgtgaagtcgatctgccgtcagacagacgagacagctagccatttaattgccgaaaacttgttccaactaattccaatgtgagtgggtctctccattccttggcctgcccccagtcccggcccccacactaccaggcaaacattttgagcactttttggttgccttattatgttgttggcagctgtggaactgaagcgaagaaacgggataacattcagagaggacgctgattgcctgcagagggcgaagaagctgcattacggatgcatcgcttaccaacgcgagacacaatgcaaggccataggagaagccctgacggtgtgctgttctttttataacccgtataatatatgtaataatgccaaaccttcgcttgtgtgtaagctctaaagtctttagatactggtggtgggcactattgagccgagatcaatgtgggatcgtccgagtccgaggaatcacatgcatggggtgggggtgtgcatgatgaacccttctcgatcggagatcgatcgatcgccctcgctcgcttgctagctcacgacaaatatggcttgcaaacaaaagccccgatcgaccgacgacactacgcatgacagacgtcctcgtcggacgtcggtcagtgccgtctgtacaggcatctggaactgacgagagagacaagagacaagagacagagatgcgtccagctcagcgaagagagagagagagagagagaacaggagggatggccaggtcgcgcgtgcaaagtgccattatgcatgggccattcatcattttcattcccttctctcgggtccggatgctgccgcctgccgccgactgcgatgccgatggggccgtcgggccggcgtcagctacgaggcgggcaagcgcgagcgagagacaactcagacaaagcaagcaaaagcaatcatcgagcgagcgagagacaactcagctcggcacgccatcatcataagcacgcacagtacgtacgtgcactgtagtagtgcatggctctcgatcgggccgtcgggtgccactcagtgccagctcgatcgcggtcggcaaatggcatggccgtacgtgtgtgtgtcgagtcgagtagccgaaatcgcggcgcgcgacggatggatgagccagcagtgccgacgaaccaaccctcctgcccccggccccatgctatgctgccatacacatcttcaagcaagcatgcaatgcatgtgtgagcccggcccgccgggaaagatacggcgcggcggctcaatattgtcaaacgaggcctagctagctactagttggttggttggttctttgcagtcagtgcccgtacgtcaccccggtcgtcggtggtgtgtgtgcctgcctcctatctctcgatgtcaaacgcagcatgtgaggagctcgtcgtcgggaaatggcggggtggtggtacagtgctgatcgctgaataccatgcatgcatgtggtttcagctgcaggcaggtaacaggtcgtggtattcaatcatggtttgcacttcgccacttcctgttgcattatatatattgcagttgcagcacgatcgacgccggccgtccgtcagaaaccggcggccggcatgcagctccagcagtgtgccgtgtagagcgagcgcgtactgtccagtgtcctctatatatctcgtctgtgctccttgtgtgcctttgcaatgcaagtatttcacggcaccaatgcatgctagctacacctcagaggcagagcagactgaacgcccaagtctgcggccccttccattaatttaatccaggcactgcaccggccggcaggctcctgttgcgagaggaggccagtaattaaaataaaatggtggctgctccggccggcaacctaatcttgggcctcatcgagtgtgcgtggtctcaagtcttctaaatataaagctagctagtaccgtggtcctgcacaggaggagctagtaatgaccagcagccatggattccatctgcagatcaacgaccgcttgttaacgcgctaacagtagcacatgcttgaatcgatcgggaaaaccctagctagcttactagccttgcccaatctagcacgctaggcacactgttcatatcttcccgttggtcgatcttccgagacggtgattatttctccaagaagaggttcgttagatgcatcgccgcaatatatatgcacatttttatcctcacgatctgaccccatcacatttcatatgtggtaataatcaggttggacatggggcggaacccaagtgcagggaaggcccaggctgctctattagtgctaatgaacctataaacatgcaccaaacagtatgggtacaaagtacacaagactatatatttataatataagtattattttttgctcgggctctcaaagatttctagatccgcggaggaaaaacaagc

SEQ ID NO: 1871 - DNA, 1834 bp, Zea mays
  misc_feature (1)..(100): optimal_loci_253362_G1, chr7:103957565..103959398, Cluster 11
agctaggaatcattccagtccattaatctgtaacaaacgaacgaggtctgaggtgtactagcggatgtgggccatggccagtgggtcattgtagcacgtgtacggcttagtcctctactctctttatatcccgttaacatacatagttggcggagcggttcccatccaccctggatgtcaccgaacgttcgcaccactcctaccgcttgcacctcatgtagcacgttgatctacccttgcccttctaccactttctactcccgttggccatgatggttggcggtagcggctcggtcaccatggggtgccatggtcgcgacggtggcgatcgatgccccatttccttatttcgcttcattttcttcttctgcttcatacttgtcatcctcctctgagagagagaccgcctcaaaaaaggaatttgtcagtcgtaggtaggcccgaatttcgaagagattagaaacactggagctcgatttaattcgattagatttgattcagggagtagagaaaaagaaagacagacctttgggcatcctggccaacaatgactcctctagctccatccggatactagagtccatatgctcctagagctggtgcctagccttgcctacaccaaccataacaagttttcatctgaccctcctcaacatggcaaaagccaagttctgaaatgaaactctgtgttgactgctgaagaaatggaggtttttgtttaagctggacagtgcttgcatgatagagagaagtcaacccatgttttgatttgacgcctgtcaagggttctaatggggaaattgcttcaagcatgcccaagggggaacccccgaggctagagatgctctcttgactgatggagcccacttgtaaccatgcattgatggggacaaacttttaggtcaaatgatgctgaaaaggaaaaactatggtaagcctgttgtcaaggcagaaacaccaaagagaaggaggacgacccgacaaacctcaagcaaaaagtttgttgctgctcagtctaagtcagcggtgactggaaaaggtcaagttaagggggcaagaagaaagatagtgatcaagatgttacagaggagtcttctttggtggattgggataatttgccgagagacagcgatgaaaaaaagaggaggaggaacttccccttaatcatcatgagaaacggtcaatggcacaacatgatcttggtgtctctatcctgccaaaagttcaggctaactttgagggtttggacttgtcattttacaccatcgagttggacgaaatcgttcctaaccaaccgttgataggtaaggttgcactttctatgttggctgatatacctgaggttcgtgatgtagacatgggtaagaacagcagggcgagtgaccggtgagccccaagcactagtagtccctccctgtgatccatagatggaaggtggaggaaatccgagttatgaaaacactaagataggaaccgtctcatggcttcaagaacatatcccggctgactcaatctcatcccgtaaggctaaaaatgtttaggcacctgctaaaagcattgctggaccacttaccgactcaaccctagcccccgaggctgaaaaggttgagacatcgattgaagttactcctgagccacaagttgactgaaccccagcccctgagactaaaaggattgatgttttgattgggattgttagttagccacaatagtctactctaggcgctttagaagtcaacatcccaagtatggctgaagaacttttcacaaagaagtctgctactgttccttcaccagcagctaatgtgagaggttctgacgttgccaagtttga

SEQ ID NO: 1872 - DNA, 2068 bp, Zea mays
  misc_feature (1)..(100): optimal_loci_25470_G1, chr1:154326166..154328233, Cluster 11
ttgcttttggcatcaaatgatgatggcgtcgatcggatcggatctcacaccaatcaggtagctggtcgatcatcaccgccgacgtgtgtgtgtgagtagtgctacgaccaccggactgatgactgtgcctagctttaatataattgggtatttgcaaaggtatgtatggtgtagacaggcagggatggctcagcagaatcatcactcactttgagccctacgatggacatggatgtccggtaggagatcatatatcagatgcagaactaattaaagacggttttttgcttcttgcataaacaacaaggatcatcagcatcattgctcggaatcacctttcaggtattaataattattagatgaagcatatatatatgcatgcatgtttttatggtgtggcacatatatatcatatatagttcactaggtgggacttgggagtctgacgacaaagatatatagaattcatgcaactagctagatttactcccaagaaaaagactggtacgtagcactctcctgtgttaattaaacaaaacaaaaaacatgctgccgctgtgagtgacgatgccgctgctgcagtcgccatcagagggaatctgcgtgctttgagagatctgcttttgcaaactccaatgcagcctagccacctctctctctctgcctctggcgcggcgcggtcatgcagtgtgtgagcgtaggaggcgagagaggaataaagcgaggtggcgcaaggcctatgcgagacgatatcacatcaaagaaagagaaagagagacgagcgagctccgggccccccaccccccaacccgggcccacgccgacccctctatccatccacctacgacgacgatgaacggatcgcgcgcacacaatgatggcaacggcatcagctgagcagcagcagcagatgtgttggaagggacaacgtgctgacaaaagctgcgggctggaagtttgctaactcaggtgcacatgctttcttgtgctgccgctgcccttgggtacttgcactcttgcagtgcctatgcgtgccctgtgggctgtgatgctggtcgatctgcatgcgttgataggtttatgtgttcgccaagattcgttggtttggttcacttcactctgatcaaagcacgggattgaaacgaaacagaagaatggactagtgtgatcaattcgagtaaacatccccttagatcaaattaaattaaattaaattagcctcgtggtctaggtaggctaggctagctctccaatccagccctcctagctagctttcccttgcttccccctaattaaaataaaatatacgcgtaaaccagtcaaaaaaggaaggcgacagtgcatcgagaccagatagaagccctactcccgggctccggcacacaggcacagctagctgcttgggttgggtgtgtgtgttgcaggcagcatgcagggatcgagcacggagtccgatgcgtaccggccgatggctgcgcttgtcagacagggagatgcctgctcgcgacaaaacaaaaagcgcagctgctatagctagccaaacaattcccttcttctgtttcttcctctttttttttttgcttctgtgtctggtttccctgttcgacgctccggcggtccggccatctctttcgtccatgtgctcgtcaatctgtctgagcatgaaacaggcgatcagctggtccagtaacgtaaagcagcagcagcgggcagcagcggcagcttcagcttcaagttttgcatctcttcagatgtctcgccatgtgtgtgtgtgacagcctagctagctaagatatgtggccgcccgccgtctttgcgagcgtgttcgctggtgtcagagaaaatccagagaactagtactggccctggccggccggcatgtagtggtaagctctaggtgtgcctgcagtgcttccttttgaccccctatcacacagcatggacgactctccgaatccatcccgtacgtactggcgctcggtatgcgtgcgtctctgctcctggaagccctcatcctcatgcatgggatcggagacgtttgcagtgcaagaaacctgtttcaaattaa

SEQ ID NO: 1873 - DNA, 1630 bp, Zea mays
  misc_feature (1)..(100): optimal_loci_255675_G1, chr7:116395016..116396645, Cluster 11
acgaaaacaaagcgtgatcggtcgacgaatgattgaaaatgaacaaaacaaggcatttcgttctagactctagtacacgtttaatttcgttctagactctactacacgttcgaatcattccgacgggaatcggacacacacgatgcatgccgtcagcactcagcagcagtaataagtagcagaaaagcctagagttttcaggtaataatagtgcagcttgatcatactatatatattgcacaatgaaagcaaagcgtggccggtcgacgaatgaatgaaaatgaacaaaacaaggcacttcttcacctaccgtgtcatccccggcccaggctcccagccacaccacaccacacgtatggctggcgtcgctggggctgtccgtgtcggcgaccggtcaccggccgcggggctagctggacgggggaggtgggggtgctagctagctacttagctcgtgtggtccgtgtgggcgcgcgcggtacatgcagtgggtgggaggtgtccgtcgccggcggtcggcgctgtgcgcacacgtgcggtgtgtggaccgctagccgcaggcggggccggagccggggtggatcggatcggagctagaaggagggagcattttgggaccaaaccgaagcccgtgtcggacgtgtcccgtctccctccgtcccttgggatcatgatcacggggccgtgatcgagctcgagcagctagctagggctcgaactcgacgccatcgatgccattggtcctcgcacagctagcgccggctcatgatcctcaggttgttgttccctgaaagacgtcgtgggagcctagcactgcactggcaaaggcctgcggtggcatgcatgatgcgcaatcatgcgtgcgtgtgcatcgcactcgcaccccaccccacccggatcgccgccttggaatctcgcaaaaagagtttcagtcggtcatcgattattagtgtgcggccgcaggcaggcaggctcggtacgttttgctgtgctcgtgtcgttgcactactggttggtacagcaatgccaatgctatagcatgttaactagtagtacaactgtgagaaaaaagtgagaaccgccggccgagctccacaactccatgcaagcaccagcacagcaaggggcagtcccacgtgcgagctggttcgttggtattggtacagtgagtcacgcgggccagatgggacaggcagggggaaggtgccactactggcccacggcccgcgagcgtgtgtgtcaacctcagccgagcctcacacgatcttttctcgtactcgtacccccgcaatcatggaacctgtgctgctggtgcaccgggccagagcgcgagcccaacgcgccccccaccgccgaggctactgtagtgtgtgtaccatcatcaggcatctgccaccagcaccagcgccagcgccaggctcggccggttcagtttcggtccatccccgtgacctgatgccgccgcgtgctggatctcgtccatgattgctcgccgctggaaacctgctggaggatccacaggccgggcgcaggcacaggcacggccgcagcccgcaggcgcaggcatgcgctcgtgattgcgcgaatcatggccgtccgccccacgcgcgcggttaccgacggtcgtcaa

SEQ ID NO: 1874 - DNA, 1568 bp, Zea mays
  misc_feature (1)..(100): optimal_loci_257190_G1, chr7:124265771..124267338, Cluster 11
gcaaggtaccgaaccggactcgcctcaggtgtcctaatcgaggggaagttatgatcttctttcacaccgtgaatataaattaaagaagaggagtgacacgtgaaccaatttttgtcatatcctctccgccaaacacacatggtagagatatgatccgtctctaaacggtcagtaaataaaaggatgtcgtcgtcttctttgtcgactaccaccacgctaatgacttctcctatcaacagcgaaggtataaccttcaaccttcatttagtggcttaaggtctacgggacgggcaagttttctgtaatctcacaggagagagcactagacattgggcagagcacattaacgcatggatacgataaatgccttgagaacatggcacctgcaccgtctctgctcctgctcgtctaactcgtggcctactggtggcctcagctgcaaaacggagcagctctgatggaagtaagacaatggtgacgcaaaggaactagtataagttggaggggttatgtcgatcgatcgatcgcacttcccactaaaaaaaacacacacgtctttgacaccgcagcactgatcccatcccatgcgcagacagtcgtggacagatggacctggagccggaggttagcgcgcttttaatcatggccgcattcagctttgcatctgccgacatgcttgcattaaaaataagcacacgagtccatctaatctaagcggcattccagaggcaaggacaaagcaggcgcgccactgacagctatctcggaaagatttcagctgcagtatatggctggttctcctttcgatcagaacgttcctctctggcgctcgctcagacagaagccacgcccgctgtcagtggtcacgagtcagtcatcgctgtgggtgacagcgagctgggaatccgacaggaagcccaaagccgaagggttggcgttgtgtcgtgttgtgttggtctatcgctctatctagcgcagcagacagcacactagcagcatgcataatctgacggtacagtacaccagtcaccagacctcagcgcttctctactactatctctagctgccggctgttgcacgttcaatcgagaatggagcaggaactgctctcaattcttcggcgccgcctgttggacttggacttcggagtctgcaaagctggactccatatctgatcggcggaccaccgagtcagcatcaaatgggcctaagacacattgtagatcttttgcgcagcccacattgtagatcttcagtttcgggccctccggttccgggcttttggcccagttttccaagtatgaaattggaagcctaaaccattgacgatgaatcagtgatctcactctggtagtctgcctaaactgaagaagaagaatgtacttaaaacttgaggttaccgtactagttgtttccagagacgcgataggatgccggcttaccctgatccgggggttccgattccgacgaaggcaacgaaacgaagcccggcctcgaggaaaggcgcatgcaagcgcatgcgccgcagtcctagtcctagatctggagcctggagcgagtgtgggtgc

SEQ ID NO: 1875 - DNA, 1648 bp, Zea mays
  misc_feature (1)..(100): optimal_loci_260276_G1, chr7:141583602..141585249, Cluster 11
tggcactgtcagagttcctgacatgctcaagaaataaacaattaaagttggatgcgaccaacgtgagaatttgccttcttgctgttttttcttcaagtcatgcatgcatggaggtcaacggccctctgcacttttaccgggtcagctcgcgacttgtccggtcgagatccacagtttcacggtcctcgttcttcagtgacccagctaaattctgccgcgacggcaacggagttatctccgagttgatgcccctgcaaaagctacaaaaagtacaagaacgtaactgaccatggagcaagcataactcgtacgaacagtaggctttttcttaggagcgatcataatgccgagcctctttacccaacaataatactagtgcgtttttctctatcttctttttccctgccataatgcttcgcctttattagcttttgattttgggatatatatataccgccataatgtatttcgcgaaccgcgctttttgagggcgtggagagggagggccgccgatcgatgtcgatcgagatgtgcgcagctactagctactatagctagtacgtgccaaaaacgccatctgattctttctgaagcttcgcctcaggaaaagcgtccccatctcaagagggtggagattagtatatatgattacctaatcagtgtctcgtccttgttaaatatctcgattttctaacggccctcatgctgcgctggacatggccgtggtggagaaaggagccgattcacatgggtggggtgggggggcaggacgagaatctgaatcgcgctgtcacgttttggtgtggaaaccttgcaagagagtacgcctgtactgtgattgttcaggtcatcaagtgtaatcggaagtagttgtgtcggtagaattcatgctttccacttctccatagcgaacagccattcaaccccacacacacaccaacttcttgaacgtttcttctgcgaactataaaatgaagttcaaaaaaatgcagcattttgcttttgcactgtcggttgctgcatataataatatagcttaaaaattcatgttccctctctgaattcaacacgttcataagaaaatatatgtcttcaacatgtattaatttacagggcactcgcgctacgggtttggtttgttcaacagcgagctgagagctccgctcaattaacaaaacagaaggaagtttgtcggtcagttcttcacaggagacaggcaatatacacgagttgaaacgaaagccacttcctggccaccactttaccaggcttgtatcgtccaagaaagcgagcaaatagtatcattgtaccaggatgaaaaaggcggcgacaagaaataagtaaataaagaaaaaggagcagtagccccattcttgcaagagcacatgaacaagatgcatgaccaatgtcctctgctctctcttcaccaacagctaacctctctgccgtaccccccccccccccccccccccctgtcgctgttcatctgttggtaagcacacgacacgtccataaaagactgttaagcagcagagggccaacgccatacaggccacagctgtggacattgaattagcgaaccaagcaagaccgaccccccctcgccattagcgttggtttggacggacgcacaatcgcacatgcatgt

SEQ ID NO: 1876 - DNA, 1674 bp, Zea mays
  misc_feature (1)..(100): optimal_loci_260289_G1, chr7:141606268..141607941, Cluster 11
taatttactccggtctgtagtctgtacttgcggtattctagaacaggtgacgagaggaacaactgaagctgagaaagagacgtggccgaaagtacaaagacgcgacaaaatggtcctaagataagataaatgcctcctttagagaaaagaaaccctaacatgcatgcatatctagttgtcattcttatcggcaacaacggaacaaacaatggcgtagttaagtttggatgatctgcagaggcatccaaccgctgcgctcggtggtgctccaagaaaactctaccagagaaagctccagaaggtgtggcgtggagcgaccacgtgtgcactccaatcaaacaaacctcgactgcagatgcaatgcaacatactatgcattggaatagattaatacagagtccaagttggatttcatgctgatccacttcatcacacacatagattgaatcattgaagtagatacatgaacatcccaacacgagatgtaaacgcatcgctatccgactgaagtcagaggcatcgcgtgtgcgtctgcaaaatgttcatggtacatgcacatgcgctggatgcatggagctcttgctctccaagcagatggagctgtaataatccgatagcgacgtgatggattccagaaaccaacaggggtgagaggctgaggatcgtagacgcggtttcagctcttgaaggggcgggggcacgagagaaagaaccgctggatgtttcagacaaccgagtttctgctcctgtacaagaaacaagagttcatgagacggactgcagagtcttaaattgatccgacacacaagagaaaccgctcctccttaacaaccgccaccagacctaccattgactacgcttcaagcctgcatcatctgacccgccatttcagcaaggcttcccttcccccgaatgcctgcatgcatgattgaacaattattccccaaactaatggatactattattttcttcctctggaaaaaaaaacaataataaactgtgaagtgtctgcgtcagtttgctccatctctggacaggcagacgagacgcgactcagcgaagcaaaagcgatctcggacggttcagcagcatggccagatagatagatagagatgcacaggaacactcggacgtgcctgccaataacgtgtgctgctgcctaacagcgctgccgtttcccgatctgaacgggggcttgcacgcatcggcagctaaagtcacctgctcgctgctctgttgaggcctggagaaatggacgtttgtttgagacggccagtgcttggtgcagtgcctgatagatgatgtcctccagttggatggcattgccgatggactgaaaagaaggtgctcgtgaatactcatgatagtctcagatggacatggcaccgtcctcttcttttatatactaactaaaagtgaaaatacaaaatcatctcatccacgctcactgctgcttctatttcttataatgaaacagggggcgttgcccttttggtcaaaaacgctcactgctgctacagagaagaaaaaaaaaggctcttgggaattggaattgtaaaggccggtgccggtcacttgttggttcaaaggaaacttcaggagcgaccacagaatgttcatcccgtgaggtttgttggttgcctgtccacatctgtccccatcccttttccaacc

SEQ ID NO: 1877 - DNA, 1793 bp, Zea mays
  misc_feature (1)..(100): optimal_loci_260319_G1, chr7:141694238..141696030, Cluster 11
tactatatatgctgcttctgagttctgacgatgtcaaaaaaaaaaaaagagtggaggaaaaagagacgccggcagttataccgacctgtcgcggtcacgagactggcccccgtgcccccgccggccggcacaaggtcatgcgcgggcggctgctggctgcaggcgcagcgagtcagtcacagtcagaccaccggccgcctgcgtgtactctactcggtgctgcttcaaggctcaacagtctgcgagaccgcgcgatggcgtgataaccgcctgtgtacgcgtagtagaccgtagacgcaggcagcaagctgggcgtgtacgtgtacacagacaggctgcgtgctgcatgaggggtgactgatgactcaggagctgttattagctctgccatgtactcagttgatctgacgccctgacgaactgcatgtatgcgcgtcgtgggcctgttcccaacctaccagtcttgtatgatcgtatctttttcctccctcgtgaatgatctctgccgccagtagttttatttcaggacgagaggtaccgacgtaggagcactccaatactttttatctcgaaaatggcatcggcggcgactggcgagggcatgcagcagctgctccatccaggaagaagacacaggctgcagggggcggccggtttatttgtcagtgcaagacgcacacagagctaccactcgagagcttggccagtccaaaaggctactggaatccaatatttcagatcctgttgcgagcctgcgaccaacaggttgcgaaaactgacccttctgagttctgaccgaggtccatttcttgctttggattgaagaagaagatttggggggagtttaacagtcctgcagatttgcacttgcataaccttcagtgcgtctatcttttcttttcttttatttgttacgtgaacaatcgttcgacggcatcgtgcatccagcgacgaggtttgttgaaccgttgcgcgacctaatgccattgaatcacgcacctcgaatggtggtcacggaggtgccacgctagctataccagccagccctggatcaacaacccaagccaccaccaccacctacctaatcgcggaggctcaacagtgatagcacttagtacctctctctaaaccgcaccaaacaaacctacctaaatcgtccattattagcccttaattcctgctagcgcggttcgttcgggaattcaaagctaacacgaacgacgccaacgaacctctgtcgcctgccgcgcgcgcgcgcgccgaaagaatccgtctagtctctcatgaatcttctccggcagagacaacatggcacatctccatctccttgcgctcgacgatatcggtaccagacacagagagagacaaccacaggacacctgcatgatctttcaggacaaaaaaaaaacagcaactaaaacggaggagacgtgcggttaattggtgtcctaaataaagccaggcatctttgaacatttcctctcgaagaggtagtaatggaacgacgaaaaaaataaatgacaaaagaggtatccaaaattctgaatacgaagttgggatgtagataggaatgctgattatctgtggaattagatgggtgcagagtgaccccgtcaatccatgatgggtcatcttggatcacgcacgcacaacatgtcctgttccccgtgtttcaatcttatgtgattaaaaatgcacggaacaggacatgttgtatcgcgcacttcagccgctgctgctaaggcaaaccaagcgagaaacagaccagaccgttaagctccagcatctcaagg

SEQ ID NO: 1878 - DNA, 1426 bp, Zea mays
  misc_feature (1)..(100): optimal_loci_260985_G1, chr7:145323037..145324462, Cluster 11
  modified_base (336)..(336): a, c, g, or t
  misc_feature (336)..(435): n is a, c, g, or t
  modified_base (337)..(337): a, c, g, or t
  modified_base (338)..(338): a, c, g, or t
  modified_base (339)..(339): a, c, g, or t
  modified_base (340)..(340): a, c, g, or t
  modified_base (341)..(341): a, c, g, or t
  modified_base (342)..(342): a, c, g, or t
  modified_base (343)..(343): a, c, g, or t
  modified_base (344)..(344): a, c, g, or t
  modified_base (345)..(345): a, c, g, or t
  modified_base (346)..(346): a, c, g, or t
  modified_base (347)..(347): a, c, g, or t
  modified_base (348)..(348): a, c, g, or t
  modified_base (349)..(349): a, c, g, or t
  modified_base (350)..(350): a, c, g, or t
  modified_base (351)..(351): a, c, g, or t
  modified_base (352)..(352): a, c, g, or t
  modified_base (353)..(353): a, c, g, or t
  modified_base (354)..(354): a, c, g, or t
  modified_base (355)..(355): a, c, g, or t
  modified_base (356)..(356): a, c, g, or t
  modified_base (357)..(357): a, c, g, or t
  modified_base (358)..(358): a, c, g, or t
  modified_base (359)..(359): a, c, g, or t
  modified_base (360)..(360): a, c, g, or t
  modified_base (361)..(361): a, c, g, or t
  modified_base (362)..(362): a, c, g, or t
  modified_base (363)..(363): a, c, g, or t
  modified_base (364)..(364): a, c, g, or t
  modified_base (365)..(365): a, c, g, or t
  modified_base (366)..(366): a, c, g, or t
  modified_base (367)..(367): a, c, g, or t
  modified_base (368)..(368): a, c, g, or t
  modified_base (369)..(369): a, c, g, or t
  modified_base (370)..(370): a, c, g, or t
  modified_base (371)..(371): a, c, g, or t
  modified_base (372)..(372): a, c, g, or t
  modified_base (373)..(373): a, c, g, or t
  modified_base (374)..(374): a, c, g, or t
  modified_base (375)..(375): a, c, g, or t
  modified_base (376)..(376): a, c, g, or t
  modified_base (377)..(377): a, c, g, or t
  modified_base (378)..(378): a, c, g, or t
  modified_base (379)..(379): a, c, g, or t
  modified_base (380)..(380): a, c, g, or t
  modified_base (381)..(381): a, c, g, or t
  modified_base (382)..(382): a, c, g, or t
  modified_base (383)..(383): a, c, g, or t
  modified_base (384)..(384): a, c, g, or t
  modified_base (385)..(385): a, c, g, or t
  modified_base (386)..(386): a, c, g, or t
  modified_base (387)..(387): a, c, g, or t
  modified_base (388)..(388): a, c, g, or t
  modified_base (389)..(389): a, c, g, or t
  modified_base (390)..(390): a, c, g, or t
  modified_base (391)..(391): a, c, g, or t
  modified_base (392)..(392): a, c, g, or t
  modified_base (393)..(393): a, c, g, or t
  modified_base (394)..(394): a, c, g, or t
  modified_base (395)..(395): a, c, g, or t
  modified_base (396)..(396): a, c, g, or t
  modified_base (397)..(397): a, c, g, or t
  modified_base (398)..(398): a, c, g, or t
  modified_base (399)..(399): a, c, g, or t
  modified_base (400)..(400): a, c, g, or t
  modified_base (401)..(401): a, c, g, or t
  modified_base (402)..(402): a, c, g, or t
  modified_base (403)..(403): a, c, g, or t
  modified_base (404)..(404): a, c, g, or t
  modified_base (405)..(405): a, c, g, or t
  modified_base (406)..(406): a, c, g, or t
  modified_base (407)..(407): a, c, g, or t
  modified_base (408)..(408): a, c, g, or t
  modified_base (409)..(409): a, c, g, or t
  modified_base (410)..(410): a, c, g, or t
  modified_base (411)..(411): a, c, g, or t
  modified_base (412)..(412): a, c, g, or t
  modified_base (413)..(413): a, c, g, or t
  modified_base (414)..(414): a, c, g, or t
  modified_base (415)..(415): a, c, g, or t
  modified_base (416)..(416): a, c, g, or t
  modified_base (417)..(417): a, c, g, or t
  modified_base (418)..(418): a, c, g, or t
  modified_base (419)..(419): a, c, g, or t
  modified_base (420)..(420): a, c, g, or t
  modified_base (421)..(421): a, c, g, or t
  modified_base (422)..(422): a, c, g, or t
  modified_base (423)..(423): a, c, g, or t
  modified_base (424)..(424): a, c, g, or t
  modified_base (425)..(425): a, c, g, or t
  modified_base (426)..(426): a, c, g, or t
  modified_base (427)..(427): a, c, g, or t
  modified_base (428)..(428): a, c, g, or t
  modified_base (429)..(429): a, c, g, or t
  modified_base (430)..(430): a, c, g, or t
  modified_base (431)..(431): a, c, g, or t
  modified_base (432)..(432): a, c, g, or t
  modified_base (433)..(433): a, c, g, or t
  modified_base (434)..(434): a, c, g, or t
  modified_base (435)..(435): a, c, g, or t
  modified_base (787)..(787): a, c, g, or t
  misc_feature (787)..(886): n is a, c, g, or t
  modified_base (788)..(788): a, c, g, or t
  modified_base (789)..(789): a, c, g, or t
  modified_base (790)..(790): a, c, g, or t
  modified_base (791)..(791): a, c, g, or t
  modified_base (792)..(792): a, c, g, or t
  modified_base (793)..(793): a, c, g, or t
  modified_base (794)..(794): a, c, g, or t
  modified_base (795)..(795): a, c, g, or t
  modified_base (796)..(796): a, c, g, or t
  modified_base (797)..(797): a, c, g, or t
  modified_base (798)..(798): a, c, g, or t
  modified_base (799)..(799): a, c, g, or t
  modified_base (800)..(800): a, c, g, or t
  modified_base (801)..(801): a, c, g, or t
  modified_base (802)..(802): a, c, g, or t
  modified_base (803)..(803): a, c, g, or t
  modified_base (804)..(804): a, c, g, or t
  modified_base (805)..(805): a, c, g, or t
  modified_base (806)..(806): a, c, g, or t
  modified_base (807)..(807): a, c, g, or t
  modified_base (808)..(808): a, c, g, or t
  modified_base (809)..(809): a, c, g, or t
  modified_base (810)..(810): a, c, g, or t
  modified_base (811)..(811): a, c, g, or t
  modified_base (812)..(812): a, c, g, or t
  modified_base (813)..(813): a, c, g, or t
  modified_base (814)..(814): a, c, g, or t
  modified_base (815)..(815): a, c, g, or t
  modified_base (816)..(816): a, c, g, or t
  modified_base (817)..(817): a, c, g, or t
  modified_base (818)..(818): a, c, g, or t
  modified_base (819)..(819): a, c, g, or t
  modified_base (820)..(820): a, c, g, or t
  modified_base (821)..(821): a, c, g, or t
  modified_base (822)..(822): a, c, g, or t
  modified_base (823)..(823): a, c, g, or t
  modified_base (824)..(824): a, c, g, or t
  modified_base (825)..(825): a, c, g, or t
  modified_base (826)..(826): a, c, g, or t
  modified_base (827)..(827): a, c, g, or t
  modified_base (828)..(828): a, c, g, or t
  modified_base (829)..(829): a, c, g, or t
  modified_base (830)..(830): a, c, g, or t
  modified_base (831)..(831): a, c, g, or t
  modified_base (832)..(832): a, c, g, or t
  modified_base (833)..(833): a, c, g, or t
  modified_base (834)..(834): a, c, g, or t
  modified_base (835)..(835): a, c, g, or t
  modified_base (836)..(836): a, c, g, or t
  modified_base (837)..(837): a, c, g, or t
  modified_base (838)..(838): a, c, g, or t
  modified_base (839)..(839): a, c, g, or t
  modified_base (840)..(840): a, c, g, or t
  modified_base (841)..(841): a, c, g, or t
  modified_base (842)..(842): a, c, g, or t
  modified_base (843)..(843): a, c, g, or t
  modified_base (844)..(844): a, c, g, or t
  modified_base (845)..(845): a, c, g, or t
  modified_base (846)..(846): a, c, g, or t
  modified_base (847)..(847): a, c, g, or t
  modified_base (848)..(848): a, c, g, or t
  modified_base (849)..(849): a, c, g, or t
  modified_base (850)..(850): a, c, g, or t
  modified_base (851)..(851): a, c, g, or t
  modified_base (852)..(852): a, c, g, or t
  modified_base (853)..(853): a, c, g, or t
  modified_base (854)..(854): a, c, g, or t
  modified_base (855)..(855): a, c, g, or t
  modified_base (856)..(856): a, c, g, or t
  modified_base (857)..(857): a, c, g, or t
  modified_base (858)..(858): a, c, g, or t
  modified_base (859)..(859): a, c, g, or t
  modified_base (860)..(860): a, c, g, or t
  modified_base (861)..(861): a, c, g, or t
  modified_base (862)..(862): a, c, g, or t
  modified_base (863)..(863): a, c, g, or t
  modified_base (864)..(864): a, c, g, or t
  modified_base (865)..(865): a, c, g, or t
  modified_base (866)..(866): a, c, g, or t
  modified_base (867)..(867): a, c, g, or t
  modified_base (868)..(868): a, c, g, or t
  modified_base (869)..(869): a, c, g, or t
  modified_base (870)..(870): a, c, g, or t
  modified_base (871)..(871): a, c, g, or t
  modified_base (872)..(872): a, c, g, or t
  modified_base (873)..(873): a, c, g, or t
  modified_base (874)..(874): a, c, g, or t
  modified_base (875)..(875): a, c, g, or t
  modified_base (876)..(876): a, c, g, or t
  modified_base (877)..(877): a, c, g, or t
  modified_base (878)..(878): a, c, g, or t
  modified_base (879)..(879): a, c, g, or t
  modified_base (880)..(880): a, c, g, or t
  modified_base (881)..(881): a, c, g, or t
  modified_base (882)..(882): a, c, g, or t
  modified_base (883)..(883): a, c, g, or t
  modified_base (884)..(884): a, c, g, or t
  modified_base (885)..(885): a, c, g, or t
  modified_base (886)..(886): a, c, g, or t
cgccggtccgggcgagggcgccatgtccgggcggcacgagtcggacgggactcatgtacgggagaagcgtcgggagccgggcggagcgccatggacgggcgggcgggctggaaggtggagcatggcctgggaaagttaggcagggagaagaaaggaagtatgagcttatccgctcagggaagcgtctgctgtacccgtaagggaagggagaagttaggcaagtgagaaatgccgccggagtgcacaggtagtaagaattgggggaatggaaggggcggcctggacagatttaggctcaatggatcaacgtgggggggggagaggccagagtgtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaagaaacggggaaagtaagaaacggggaaaggtcgcttaacgtaaatatgtagatatggaggaacaaatacagggtattctttataagaagggggagaaagctctccatttctctcgcgggtcgaatatataatttccagaaagatattgatgacagggcgaatgcgggtctgttgaaccgttgcgtacgctcactgtcacgccgctgcacctctctttaagaaacggggaaaggtcataaagcggtcgtcagcgtgcccagaatccagagaatcgataccgggtgaacccaagacgtcaaaatccgacttgctcacgcatcgatacactcgttgacgtgcacgggacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagaagattagtactagcctacccttggatcccagactctcatttgctagaacgacgtgcacgataagcagccgaggtcagagttagcctgatttaatagtccattattgcgacaaccatcttgaccatcgtaactccagtgattaatctatcgtactcgttatgcacactgactctcgtatctatgcagtcgggttggccgtgtgccgctgcttcagctttctctgcttcgtcccgaagtttttgtactcttccacgcgtgctgagcgctcactagcagcagcgagtcgacctgtcccatcgctatctccagtaccaggatgagggtgcgacgggggggcaagaccgcacgtggcgctgtggatatgagtcggagctttgcctcgacctgtgcggccttatccgtgtcttctgagttattatcggttctatgtggggtcgtgaacgtgtctccgtgtatgggtcgtgggtggccggtatttgagcggtggcatctattcaggggcgacgcggggatgagacggggttcccatggccgg

SEQ ID NO: 1879 - DNA, 2183 bp, Zea mays
  misc_feature (1)..(100): optimal_loci_261272_G1, chr7:147195191..147197373, Cluster 11
aacacgtataaacaaattctccacatgtattcgttgttcataatttatgattaatgatattcttcatacctaatttcctgttaaaagagtggaattagagccataagtgacgctttgaatgcgatgaatttgaagaaagctgttgcgatttgaatcgtacgaactaaatttttttgtcagcttaaaaccaccattatgtgttgtattgggctagtgtgtgattagacatcgtcattggctcattgcattgtgaacttttatattggaccgttgtagtatttagaagcatgcatttaatttatgaatatcctgcaagtgtctttgatgtatacgatattcattttctacccgtccgaataatatgtgatccgcacttttattacctgaacatgaacctaaatttgcgtgaaaataattaggatagaatatgctactcatcggtgttcatcccgttttatccttgatcgtgggtgcatatctgtacacacctttcagttggggatgttagtggtaactcgtaaggtgagttcagttgagatggagctgggccgagctagcctggcctacaggctacagcgcagggcgcagccgacctccgagcactctcacgtccgtcgtgcgggcgtaggtgcaggagcatcaaggcgggtaagcaaaaggtgcagctcaagacttgtgggggcttcaagccttcatggacgcggagggggcgaagccgggcgacgtgttcgtcgtgcggcacggagcaaacaccctgcggctgtcgtggcggtcggcgggcagaacctatgtagtccatggggggaaaaatatggagcgatattttacacatactctcaaaaccgaaacgtgaccatttccaaaataagaaacgtgactatatgttgctggtggctgcgaagggcgagagctgagggaaaaccggaaacggagcagcactgcatgatgccgtccactacaggggatggagagggcggactttgacggtgtggcctggcgatctcccggttggcgcacggtcccgggacgcgcacccgtgccaggcccaggtctggcacggtcagtgcttcgcagcccgcactaccgctgctgaggcgtcgcagtgtatccgtccactcggccactccgctctcacctcatcatgtagtacaccacgtacgaagtacgtacgtgtacgtcaaaagcggcacacgaccgtcgaccggtggtgcgcagacacacacatcacccggccaaccgtccttcctgcgaccgtacctatactgaaggcagcatgccgccggataagccgacgtacaaaagggggataggccaggccacaggccacttgcccactggcccacagcaaaacgtggcgttcgaccgtcctccgggcccgtctacttttgccctactgcatagtacgcgcgcgtatcccgcccggacacgtacgtgccgaacaattcggcgtgcttccctaggcgaacagtggggtccctcgtccctgtgctgtgcatgatgtgtccaacctgttagtttagacacgtgtcgcattgacatactcccttggtacgtgtgcggataatgtatacgggaatacggctgtactactggactgtactggtattcctggtacaccatggtgctttttacattggaaatattctacccaagtcccttgccttctatgattctactagtctttcttttttacggttgcttcaatcatcgatatgcagttgatcaatgatcatgccgttagataaatagagcacagcatttcaacattctttatgactggacgtctggacccactggccaacttggaaaacaagtagatgtcaacacaggcgagacttggaaattgaccgagaaccaagatgaacacgatgccacgtgagggacgatcgtttagtaaagcaaacggaaataaaaaaaaagctacagtgatatgacaggcgatgatattttgtaataagtgaacgatatgtgtggaaacacagaggcggagactctgttccattgtcaaaaaaatctaaaaacattgcaaatatcgatgaaactcacgatttcgaatctcacaaatgaaatactatgcacaaacaattaattccatagggacaatcatggacgagttatttaatgtgggatcttttgagtgatctctaaagggttagttgacgaaaatcaagagacaagtctac

SEQ ID NO: 1880 - DNA, 2029 bp, Zea mays
  misc_feature (1)..(100): optimal_loci_261785_G1, chr7:150030450..150032478, Cluster 11
caaacgaaaaggacagcacgaggagggccagctagctctctgaaagcccccccatgcagaagaatagaaggtgagattatcatgctgcagctgcggttaagccgtcgctgtcaggccggtgttggattggatccatgcgacaacagtacccggatgaccaccacccaagccgatcgtcgaagcagtgccctctgcgacggcgagcacagaccaaaacccacgggcgcgattgcgtgatccgcgggtgaatccgctgttcacgcgtccggcatcccgccgcctcctccatgcatccgtcatccccgccgatccatgatctcatggatcggtcgtctgctgtctcatctgattccgaaccggcggccggagagcgaggcgaccagtgaaaagctagaaagttagaaccacctgacgagttggacttggacttggatcgtcgttgccactgccaccaaagctgctctatggctggtggagcagtcgagtcgaggtagctaggcggttggtgcatggtcattgcccagcagcgccgtacgtacgtgtgcaccatatgcacatgcatgcatgcatgcagatctggcctaactatttatcatcatcatctcgtctgctgttgcacaagatacggaccactgttccggcatgcgatagtttctgatcgtctctacagactacagtgtgttatatatctagcctagtttctagtagctacggccacatgtcacaggatcgacttgcttgttgaggtgtcacccggccgtgacccgtggttgatctagaaaaaaaaaatttattcacatacggtatgcaaactggttcaggtgtagccacactcatatttataggctgcgggtccacatgttcagaagttactgattgtaacctctatccatgtggtatgccgggattttttttcccccggttgatcttgttttgtgacttgcattgtgacgctgtctatttattgttagtatgacattaggtttgactcaaaagtttcaaacactagcatatatcttcaggagggagagtccgcgcgcacctgcaccctgagtggcctaggtaagctaataaggcacacgaaaaggcagcaaagatgctctactagctcaattatttattatagcaactaagtgcacaaatggtcttgatagatcattattataagcgagccagggaggaggattagctcaccaaactggtagaagctcaggatcgtccatatcttcaagtaaccccaaaacattattattggcggattgaaacctttagtgctaaccaatctccggtctctactacctctccaaaggcgtaaagaattactccccctcggttttaaactataagttactctaactttcttgtcgagtcaaaacattctcaaatttaactaaataaaagttataggaacaactataaaaatgtatgacatcaagaagatatactacacaaatatagttgatgacgaatctaatgatacatatattcgatgtcataaatactattatctaataatcggacttaagatgcttagactctccaagaaaattagaatgattaaaaatttgtaggatggagggaattctggtaagtttgggcaggtatatagacaggcagtacacagtttattattggcccaaaaccttaaccacaaagaaataaggctaatgtcttgcatcggtaattatttctgcgagtagagtagggatcgtcagatcggaggagacaaaaaccggagagggactttggttgacacgcacaggcttccatgataggcttggagttgcataataacacagacacacagtaggcgctacgctatactgcatagtactgtaaacgacaagaggcctagctagttgagttgttggcagcatgcataaatcccccatccgacatttccaattgctgatgagttgttaccattaggcagcgcccccgtagttttttcccatccgaactttgaattgggtgagagatcgtagcagctgaaggacgccgccgagctgaggcctgaggccggcctcta

SEQ ID NO: 1881 - DNA, 1441 bp, Zea mays
  misc_feature (1)..(100): optimal_loci_261786_G1, chr7:150032595..150034035, Cluster 11
accccccgttctgtggcaagagtcaacaagctgcagtgagagaggtggagaggacctgcatggtggctggtgtcgtcgtcgtcattgtctcactctcaccaagcaagcagcaaccgccaaccggcaaggacaaaaagtgtcaacgctttccgagcagaaaggagcctgcaacgccttgtgttccgttccaatccgttgcaaaccaaaccagccagccaaacacacacacattgcagcggtgtcttgtgatcctcttctcctggcctgggtttccccattttcctctgccttttgcccggccctccgtctttaatcatgcagtcatgacactgtttggaaaatgaagcgcgagactcgtgctacactgctagtagggatgaccgaggcacatcagacttgggttgggtgggtggtcttctccggccggcgcgaatcgaacgcatcgcacggatcaggggcgcccggacggaaagcatatagggacggggggcccaggaggtcagcgacaggccagggggggaggggccctcgactgacaagttggttgccggtgcacgtcttaaccggccgggtgatgaccccacgcacgctcgcgagccgagcccgtcgcgtcacctttcccgcccccggctcgctgtcgtccgagaccctacgcgtccgtccgacgttgcatccggaccgcgacggggcccaaggaccccacctcggaacctgctgcgctggggtggggccgttgtacattgtacttgtgcgtcgtatggactcggtcgagctagctaggtcgacgcgcagcccgcagctacgcctacgtacgatgaacactgccggccgatcggtgccgagctaaatcgagtccaccgcgattcgaggcacttgatgagccgccatgagtattttgcgctaccctaccgggggccatggacgacgacgacgacgtacgtacgtacgcaggggttggctggcagggttcctgttgttgcggcgtggcacggggggaaaccaggcgtggtggctgcggctgtgcgtgcagtgcagatgcgagagatgccatgccagtcgctcgctcacatcagtcgatcccgtcgtcgcggccgcgccaaaagacagccacacaccggcgtttgtgttttgtttccccaatcttccgtacgttgagcccgacgacagaaagcctcacctcacctcacctcgtcgtctcgggtcgtgtcgcgtgtgctgtgagatgatcccaccaaaaaggcaaccagcctagcagcgcaggtgctgctgcacagccggaccggacagcggcaggcagtcaggctcaggcacacatccagccaaagcggccacgcccaaaccccaaacgtacgtacgtatggctacattttgacgcgtcacgcgtgaggaacccacttgccacgccaacgctatttgctggaacgatgaaacatgagatata

SEQ ID NO: 1882 - DNA, 1973 bp, Zea mays
  misc_feature (1)..(100): optimal_loci_262148_G1, chr7:152372154..152374126, Cluster 11
tgtctaaaacactgcattagtaacttagaaccctatcagctatcgagcacggaatggattgggtgggtgtggggaggagatgaagtctctagattgcgcatatggtcgtataaaaaactattttttaatattgatgatataatttatatagtgcattttgaaataggaaatgaggtaagaaagactaccgtatataggcgggtcccgttcacgttctgagaaagttgtctctctagcctaatcagactccgagcaaaatttgatcggttgtgtctaggtcttgtcgctgatccccagggagcaactacaaaaaaaaaaactcttgtttcagcgtatgattaaacggtgcagggtggagtggatggctggcaacgaaaaagaaggtggacacttgagttcgaataatttgtcccagcgtaatgttccaataggatcatatactgcagctaccagcatttcaattcgtatttaaaatccaacatgtttatttgtctttaatttgtaccgacttctattatttacatagtatttatttttatacattatagttgcagcaagtcgaacagctgacttcaatacgaattattcccgtatcgtccgaacatgatacatttcctccgagccacaccgcctgccacccgtgtatgcgcatcccatccatcgcgcacagaagatcccaacatatatatatgcatctcttctgctggccgcactcgcaacttgcgttcagtgatgacgacaatagggtcaccggtgacgcggcggctcaccccgacccccgtcgtcagtgccgtcacgcagtagaaaatagacgcggcgcgaagattcgtggcgtttgcgcgccgcgagcctttccgccggcgaccggggcggacgtggacgtgcgcagccgtccgtcgacactactcggcggcacctcgccgttgccgggaagaatccaggacaggtcgggattccactgcagactgcagaccctacgttgaggccgcacgagattgattcccgattggtggggaggagagaaagcggcaaagcaagcgcgatgctcagcgggcgataaaggagaataatactaacgataataatgctgtagataacctggcggctgttgtgcagttggctggctcctggttctggcctggggccaaaatccttcgggctgatttggtgctaagggatcccaaggggatcccttgccaccaaattagcccttcgggggggtcaaatgctcgccacgaggacgagggtcgggtcgctttacgaattacgtacgccctgagcggtggttgcgttcgtcttttgcgaacacatagctttcataatttacggcgacaaaaggacgggaaatcatcgaagaacaggaaaatcctccaaaacctctacaggcttgttcatttgatctatgcgttcgtcttttgtctcacccgccgcacttgttgtccggccggcgtcggtttagcgccgaacacggactgcaatgcttcgaaactgtgctgtgctgagcatgctccctgtgggttggattggacaggacagtccccaacgcttgaccaacactatctgggcttgcacgacatttgtcttgtgtattcaaatgctcttctttgagagacattcgctttgtactaaagcagaggaagcctcatttcttcttcttcttcttcttttcatttaaaaaggaaagtttgtaggttgaacgcggactgcaatgcttcgaaactgtgctgctgagcatgctccctgtgggttggattggacaggacagtccccaacgcttgacctatctgggcttgcacgacagttggcttcgtgttatcgtgtattcaaatgctcttctttgagagacatttgctttgtactaaagcagaggaagccttattatttcttcttcttcttcttttcattgaaaaaggaaagtttatatataggtcgaattatgtagagaccacaaaagaatggatgatgtttttttg

SEQ ID NO: 1883 - DNA, 2048 bp, Zea mays
  misc_feature (1)..(100): optimal_loci_263438_G1, chr7:158753890..158755937, Cluster 11
ctttgcatggtgccctgcgctcgcatcctcgctccatctgtgcaccacatggcctggtggagactggggttgccgggttggttggcttggctggctggccctgcttgtgctctgtgcactcatcaccagttcggcaagcgtgcacgtggcggcggatgaatgccgcgattttatttagacacgaaggagatcgggttggttagattcgtgtactagctaccgagcagccagcgagtggccaacgccacgatggctagaaatgttcggaggaccagatctggcattaagaaattatgagcggtccaagtgcgaaaggggcatcgaactcctccgatatcctacgatggataagctcgcaatcactcctcactccgctgcttcagctcacagtctcttgaaagcatgtgcacaggcgggcctactaattcctcgcgtagttagtggtgcagcagcagcagcatcttggtgggtgaatggccagtgactggaccggcctcatcaacctccgcacaagctcaaaagcatactggccaacacacagctgaagtgctgaacagtgccgtaacgcagtccggccggtggcaagatctgaagggctgcatgccccgcaagcgcacacatgcttcctcgctactcttactttactgcgccagcgcgcgacaggccccggccccgcacccgcacccgtcatgggcttcgcgaccgcgaccggtgattcgatcaaggaagaggccgagagcgagctagtacgaaacgaaacccgcatggatctgatgatctgatcctggcgagctgccacccacggagcccatgacgcgggcacatgtgccgccgactgccgacgagcggggacggtgtcggaacgagagccggacgattgtcccgtccccggcccgcggcggcctcgcccgataaggtgcatggatctggggaagacgctcgcacatgcgcatgacggggacgctctaggtgactaggtgtaggggcgcggcgcgcggccggcggtggcgcgcatcgcttgccttcttttctctggagcgtcgtcgagtttgatggcgatgtggacgtcggttcggcaccagatctgccagtgcgagcaggcctgcctcgatcgaggtgaagtcacgtttcgtgttcggcagtcgatgggtttcgtttcgctgtttgctcgtgcagctagcagcggtagcttccgccttccggggagctattagattcggcaaaaaataaataaaacccgagagcgctgcacatcgcacatgcgatgctggtagttggactacacggcgcgcggtgctcgagcgagggcgaatgggcgatgaaacatgcttaccaggctccgtttttttaaaaattttttttttctcggcagcaacaaatcgaagattaggcgtgcatgcgcgtggcgtttcgacaccggccaaagcgcgccgtttttttcgaatacgtgacaaaacggtagatgctgtatctatgtctatgtctctactaagatatacagcgaagcaattcgtggtcttgtttaatggaaattgagtgatcgagaaagctcgattaatcatctctactggagcagaaaagaacgccgacaagcgccactcagcgctgcgatatctgaggataacgagacaaaaaagaatacaaagaaaagaaaataggagggggacgatcaaaagaaacggaaatgaaaacccggtcctaaaataaaaggaaaatacagtcaggacatgtttagatatagggatcagagcaccatttctctctcacttgacctttgttctcggtcgcgcacatatgtgtgccatcctgtgtaatttaaagcagacatgcaggatcatgcaaaaaacacaccaaatctcacagtaataatggctcacttaagaaaaactagacgaagcgaactcccactgtccacatccacacaataaaatatcccgtttcacttgggccacgtatcttttaacaaaactgtatgctgtgcactgtgcagagactattcgggtggcctgtccgctggattgacgagagacgctctctctctcgattct

SEQ ID NO: 1884 - DNA, 1737 bp, Zea mays
  misc_feature (1)..(100): optimal_loci_263827_G1, chr7:160737124..160738860, Cluster 11
acagtagccgcctgctgctgcttcgcctccgtgtcgtccaatggttatccccatgtggcgtggcgtggcgtgtcacgccatggatcgcgcttcgcagcaaccagtcctgaagcgccgacccagcgcgcgacttgcgtgctcaaaccagctagcgggaggtcgtggtgactctggtggtgtacggtttccgtggccccgatcgatgagacgatcactcgaccagcctcgctccgggctagacgccttttgcggtcggggtcggacgctcggccgggggggatggacacacgacaccagcacaccgcgggcgtcgccatccgccaggcacgtgctctggttggttgctgtcgtcggtagagacgaggccggccgggcgcgcggtcgctagtgcctggcccctgcgcgtctaggcgggcgcagcagcgcgcgcagtgcgtgcggcatgcatgcatgcgctatatttgttgacaagtcatagagcatctccaagtattatatagtacagatgaatatggaatgagtgacagtcgatcggtagtaaacgaacgagtcgatagtgaatatcgtgcatgtgggttctacttgtacagtagctgactgttgccgattcgcccccccctgatccccgcctccgtgtcgtcgtccaatggtcatcgtctcctaattgtcgcgtgtgtcgtgtcacgccatcgaccgcttggcaccaaccagtcctcaagcgcgcgccgaccgaccccgcggctagctagctagctttaggttgcgtgcatgctggaaccagcggcagctcgtgcctcgtggtcacagcctcacatgggtgctgtggtacggtgtccctcggcccgatcgatgagacgatcactcatcaaccctcatggctagacacgccggccggcgccgttgcaggctttgagactcgagagtacgttgcggggtcgacggatgacgctcggggatggacacacacacacacacacgacacgacacgagcgcaagcaatatcagaggtcgacgggcgtcgccatccgccgtgcacgtgctccttgtagtctggttgtatggcgtcgatagagacgagacgagacgaggccgggcggtcgtcctgtggcggcgtctaggcagcgtggtgcatgtgcatgcggcatgcatgcgctatttgttgacaagtcatagggatctcctgtagcatcggcagcgcgcatgcagatgtgcattcgtcccccccgtggtggggcgcgcagccggctggtcgtcgacaccgcgcgtactgtgttcggataaggctatcccgcctcctagctaggacggtggcggaagtacacctgtcgactgtcgttggggggtggtgattggtgaaggtgtatgagcaaacccgatcgagtgaccttatcgaatccatatccattcgtgagatatgcattcgatctacaccctccgcccataccataccataccatacccaacagcaggcccactgtcagcacctgcgcgtcccagcaggcgtcacgtagctgatcggctagtggctgatcacagcagggtccccaggagcaggaactgcccggcccgcgtgatatttcctggctgtgtggaggtctggaccggagagacccagccgccttattatccacccctagctagccctcagccagccccccctccacatgcgccgcacgatcgatacgtcgtcgtccgtccgtccgtcgcgatcgactccagacaccagaggcggctgag

SEQ ID NO: 1885 - DNA, 4158 bp, Zea mays
  misc_feature (1)..(100): optimal_loci_263831_G1, chr7:160745089..160749246, Cluster 11
tgaccaaaatacaagaacttcaaatatggggcggcagcacgtcatcccgttcgatttattgctaggatgttggcatgcggtatgagattagttgttaacgactgtgaaacttgcttgtccatgtgttttgttaacatttgcagctggtatagttagtagtaccagtccacatcgcagaactttcaggagagaataataaaagtgatggatgcatggggtggcgaagaagggtaatgaaagcacacaacaagctagggaaaaagaatttacgatatcccaacactgcacgcaataagatccgttgacgttgaagcagcgatgatgatatgcaagagctagtttttgcgcggatccaaggagataataagtataagttggaggttgggaagcaggggcgtggcttgtccgggagtaagggcgcctccgcttgtttaatcgcccccgcatcatttaacaaagcaagcggagatcatggagcatgtgaggggacgatcgatcgagcatcacatgatgatggggatggattaggtagtgttgcctcgcctcgcctcgcctagctaattaattaactactcccgtcctgatcatcagttcatgctgatcccttcagctaatctcggctgggaacagcctagctagctagctatagctagctcgatgtgcgtgtaaaggacatggttatacttatatacactgcctcgatcgggacacagctaagctcggctgatgagtgccattaagaaattctagtctccttaacgccctgcagataggcacgcttgttctcttatgacgagaaagttctagggcacccttgttaattagtttagattgtttgaaaaggagatgcttcaaggcggtggcggtggtggcgatataaagaatctgggaaaggtataagctgccgttgaataactattaattcatgagcatttagtttgggatcccgcgcgttagtatctggctatctggtaataacaagtcggtcgtcgacgtgcttgtcgttattatttgcttgcttcctctagttttttttttcttcttcaccacactgcactgcaataggggtcaaccaccgagaaagctaccagcagcgcagggcggcaggcacagcgcagcacgcatatgcatcgccgggcggctgacaacgcagaggtgagagataataatcttggcgcgcgcggggcggattgcaggttccttgcaccagcggcagcatcgatctcctcgtccttgtggacccgccgccgccgccgccgtgcgtggcgccggccccctacccctacacatgcattgccgagagcgtccatccatggcggcggatctcctcccgcatcctcgcgagctgacgacgcgtctaccggaaacgggggcgagggatggagggggccggggtcggggccggataggataagccttaccggaaacgcgctaggcacaggtcaacacgggtggtggacgggaccgggaacttgccggtaatggaaggagggcgggtagtacttggcctgcgcgcctgcccgggtacatgcatcgaccgcgctgtagctgtagctgtcccgtcccgtcctgggcagcagatctctccctcaccaccaggcgtcagcaggccggccatggcatgcgcttcatcggatgccgtgactgagttggattcgaacacatccgagatccggtcctggtttttacaccttgtaccgtggctttacagttgggaggaatggagggtggcatcagcttgcagccctaagtggactgaccggaacgggacagacgcatggccgagtcgataagctacccctttcctggcagtgaatcgtacgaccggatagactcggggatttcctgcatccagcgaaaagctgcactgcatgcacccgatcgaagcgaagtgttcgggtccaacaacgaagtgcagtcaaacaaaaaagttactggattctttcagtagaataaaaaacagtagtagtagtagagtagaatttccactggtgcgtagtagtaggagtactgcacatagtactgcccagattgtaccccaaatcccgaaacgctctcccgctccgagaacagatcagtactggcggcggcagtcgcagttgacagcaggtcgtcagcagcagcactgcagcggcggccagtagacagcgggacgcccccccctgcgcgcaggctgctcctccgtggccccactcctcagccactcagtgccgcctcttccgaggactgactaatcagcctgtggacagtggcgcgtttggaatcccggagcgcacgaaaagcagagatggcgctgcgcggccactgcagttttcttccccggatcggcgggccgcggccgccgggtgccgacacgtccggggcgcgggggcgtgtggtccctggcgcccgagcctcgccccgggcgacgcgtggggacgggggtggatacctgtgcgtcccgtccactggcatcggccgctgcccgttggcgactggcgcgatccagccagcccccaggcgcggcgccagctgccagtgcaggccatgtgcctacgtcccctgtctcccgggctagctacgcgcctacgcccacagtgccctctcctgtcctgctgctacggctacggccggggctgactctctggcacggcactgactgcctcgcctcgcctcctttgctttgctttgctttgcttgcgcagctgatcctagccttatccactgttcctttcccctccccctgcctggctcgcctcgccagaaagcatttccccccatccttgctgactcgccgagttatcttctaatctttcttgctggatctgttgtgtgcgtgctcatggatatgctctaatcctttgatggcaaggcattggcatcggcatgtccgcgagaataagatgcaacgtatctcgcatactacggtgtgtgactgggcgtgttcttcatcggtgcagtatgatagtctgcatctttgcttttgggggcgagacttcgcgcgttgtttgtttagttgtggtcctagacctttgattaaaggatggggttttcagtcccagttaggaaaacaggattgaaggggtttccaactcaaactgcaaccacttcatgcactagtgttcacttcaatagatcatgtacaacctagatactatgttggtgttctccaaacgctagatacatctaagaaacttgttaatacaatccaatgtatctaaatattttgttcactagaaattctcaagaaatgactcgtttatatgggttgtataggtggaaccacatcttacacttaaattaccatgctagagacgttacttcactaagatatacgtctcttgtgtgtttttttttcatttacctccttggatactccttaagaaacatgcatttatatggtttgtacatgcacttaaatacattgggttgtatgaacgggatttctaaaagtatctagtgcttggagaaccacaccataatatgtaggttgtacatgtcctacgtaactaactttgagacaccacgcttcgctaatgggatagctaggttaaatggtcgagctgtacaccacgaaataacacgctagctccctataaagactattatgtgtgtgtgtgggtgtgacttagagaatctcctgcccgatcttttcaaataaagtgatggccctttccaggagcaagcgccaccttgtcgaccactcttgtgtctgcctagaaggtcgtgcgctcccaagtaatctccaaattaagcactgacatatatattcgtgcacccggcccctactccctccctcgatgcaaagctttcaggggactgggatcaaagacaggaaaaacaaagaaagggacatcgagatcagagaataatacataaggcccggccggccgggcactttggaacaaattaaaggaagaatatagatgaattataaagcgttcaaaccatatagaaacatcgctctctttgaagttaatgctttggaacaacgaatatcggattctctaaaaataaatcttgtgatattcctatgaaattatttgtttttttagtaattttgcaggatttattctgctggttggagtgttggacctcttgaaaaccttccttttgcgtacgtacgtcgctcacctagttttccttacactacatttaaacgttcgttctggaagtttt

SEQ ID NO: 1886 - DNA, 1440 bp, Zea mays
  misc_feature (1)..(100): optimal_loci_263846_G1, chr7:160773315..160774754, Cluster 11
aacattaaataaacaataggtataagaggtattaaaaatggaggggaccaatgtcccccatttgtcctctatgtggatccgcccatgatgtggggctatcccatctggatacttttattcaatgttagttaggttgactcctcacttagctagggccaggggaggtctgtagaactcagggccctaagagcagtgtggttccgttatggtgagagccttaaagtcagtcgatttggagtaaaaagattatttggctgggagaaagaagcatctaatgagcaaaacatggccatcgttttggagtagcaatgagagaggcaacgcatgaatggatcgacttgctacttgaagtagcagtatttacagtgctaaatggttcttttgcaaacgtctcgtttcgttccctccggttttttcttaaatttgcaagctcgaaatgcttcagctctgtactgcgtgcaagctatgagcgcgacaattaacgcaacgtgcagatcatcgatcatacgaaatacgacatatcctctcgttgcatgcagcctgtagcggtagcgctgaaccttgctaaatacgtgtgtcgcaacggaggccgcaaaaagatacaggattaggcagcctgcatacaaacatgcatgtaactgaagataagaggtcctattattttctctgaacactgattctgaatcgacaggaaaaatacgtagtggtacaggacgtcttttctcttttgcttaacatctcggctggccctcggaggtcgtgcggtggagtggtgccggtgcaggatgctgaagggaatgtactgctactatgcatcgtgctgcgtcagggtaggccgcgcgcgtcaagccatctgactgtcagagccaaggaccgtaagtacatacctgcagtcacgcgggcctgcatacgggcacatggcgggcgcaggcgctggggagcattcgtctatggatctggtggtgttggtgatgggcaaccgaaactgtgttcacgtacgtccacgaagcctactaccaatagcatgcatataatcgttctgatgatgccaacgtgtgccattgcagcgccaccactgaacgccacgtgccgggaaccacgcagatgaatcgcgtgcgttccgctttagaaaactcagactgacaaggatgcaaatggcgactgacatcgttgggaacaaattaaaacttttgcagggattttggatcttcaaccctagtgaagtagtgataggcggaacgccggcctatcgcgctcgtgcacggccgccgttaaacctacctgaaatacaatggcttacatgcaaaattctggtcaaatatatatatggaatggaatgaaatgggtactctctctattcaaattatataaggccctttatattttctaatatattatgtttactatataatcaaattataagacgttttggtctgttaa

SEQ ID NO: 1887 - DNA, 1926 bp, Zea mays
  misc_feature (1)..(100): optimal_loci_264079_G1, chr7:161910276..161912201, Cluster 11
gctagctagctagctgctcttttcagcagctatcaccaatacgtacttgtagtcgatctcgtagtagagatggctccacctcccatatataggcacgaaaccatgaacctgttttcatttctaaatagaatagctaacagtaacactgtttgtctgcagtgcactccgtgcgagcaaaacaatgtgcacaaagaagctagcaataacaagatctatcaggcccttgcgttgcattgttgcgtacgtgggtgttgagtcgaggtggagcgtggctggcaactggcaaagcaatgtctgatgaggacgacgggccaaaaaaagggacgagctagctggagcaaatagtgggagctcctttttagggggggggtggggggtggggtgggcatggtgcatggagagagacgaacacgacctcatctctttctctggttcccagcagcaacaggctcttcttttagctatagagagcatggggtttgcactagttttctctcaactctccggccggcgctcttccatgccgtggacgcgtgatagattgagatgatgcatatgccgcagaactattattattcgaccagctagtatactatatttatatataaccactgcatggcgttggcgtgcatgcaggagtcatgcatgtgaaagcacggtgcatgcagcagtgttgttgtttatatattagacgatagcttagcgtgacaattatggctagctaggttaattaagtctatgatgagaccaagataatgttttgttctgctcacacacgcagcttttctttgctccggggaagatgcgtgtggattaatctctgcatgcatgccacgctctaaccaacagttagcaacaaattgaaggtcgatctctcttgagtggccggccggtgtgtgcttcatcctctcgagcttgccactctctgcgcgatctcctatgatcatgggctatatactagtgcacaacagacgtcaaaaagtgttcagagataacaatatatatacgattgcgcccatgaatcattagcagcgcaaaagagaaataaactacactgctgccggtgcgtggccagggaagcgatatatatcgccttcaaaaggcagctagctggtgccgggcacggcgctgcatgcatgcatgcgatgcacggcctttttgtcagcgcactgacctcggaaagaccgacagcatccatgcaggcacgaacacacatgggatccgcagcgtgtccccagcaccagcactgccgccgcccatcacgcaccggccggtactggtggctcggtgtctgtctgtcagctcgggctcggcgcatcgccatgtacatcagtacatgtacgtacgtacatgcagcatgtgtggccatgcatgggggtttgcttctactactaccaccaccttcccttcactcctagagacgccagcagcccccccggcccgacaggggccagcgccgtgcatgcacgttcatctttcattcaagtaccaactgctgctagtgctgctagtactgcactactagaccgagggctgctggctcacagtgatcggtcatgtccatgcaacaagcacgcaggctgtgcgactgcgagttgagaaagtcttgctggtcgtgcattcgccatcactgccctgcccggcgcattgtggcaatgcgaaaaaaaggggggaaaggatttcacatccacgcgtaccctttggtctttggtggaggaggtggaggaacagcacctgtgggctgtggccgaaagcgagcgagcatacgagagacgggatgaggcccagcaagggaactgtgcaaaactggcacacaaacacgttgggtcccccggccggcccgggcttgcggaatgattccatgcggtagcggctaactgcttccgccatcgacatgtccggctgtttcccctttcaaattccaag

SEQ ID NO: 1888 - DNA, 2901 bp, Zea mays
  misc_feature (1)..(100): optimal_loci_264096_G1, chr7:162024498..162027398, Cluster 11
cattgattcctttatttattttttactcaaacaacgggagccacttcttccttccaaaggagcagggaacggacgccaccggagccacagccacaattccacatttccaccaacccagcggcggatcgacctccgcagtggctgcctctgccccgcctccacagcacccatccacatgctctgccggctgccgcacgaacggacacgtgacgcgagccgcgccctgctctgcccctcgcgggcctcgcggccccccaccggatcgcaacgagatcgcgcgcccggtcccgccgcgccacgtgttaggcgcgcccggttcggggccgcaagccaaaaaaaaaaaaaaaaaaaaagcgcgcgaaagcgcctgtggcgacgctccactcgttcgtccgttccccagatccgcacgttcgtttcgttcggccgccgctactacggacgccggcctgagtgttgttgtgaacaccggccaaatgacgcgcgcgagtggcaatgatggactgactgggggccgcgccggcacccagcaagcaccatgatagatggcggcgagaagggaccgcacatgcggaaccggatcgccaatcatgtggcgccaccatactgcttctctttctcatcaaaggtttatttgttggatgctgggggcctggtgttcagaagatattcccgttgcctgcttacgtgcgtgtgcgtgcgtcgggtgcgctctctggtgtagacgcgcagtatatgcgctccgctttgggctacccggcgaccaggaaaatactgctcgcctttcctttttcaggcgcggtatgagcctggcgtttgcggtcaacgcagacgttgccatagtgtggctggcctaggaacgatggagacaccacggttggccttgacctagcttgacaccggcaaccgtaggcaattcttcttaagtgtacctagccagcctcttcacgttcgcttcaatgcatttcacgtcccgttgcggattgctgcagctgcgtatatctgcatgctatggagagaggctgcacgcgtactcctaccgtccagacgtcctactgtactacgcacacatgtgaaataaagggagcaggcggccatgggcgcgtaggtggcgagggcgtgatgggaacagcggcgagcacagcttggtggccgtgcatggccctgcaatttgaatggctcttgggaccgccactgattggtaggtcacctggcatcccgccacgtgtcggcggacggcccacgctggatgtggacgcgccacatgcaagcacccggctggttagtttcggtccgatcaccgcggaatcaaggcgcatgcggcgacgagctctgctgcactgtgtgcagcactcgttcgtggtcgccggcatgggccacgacgacgacgagcaatgacgggcgcagcgcacgtagtctcgtacgaattggcaacacagaaacaggggggcccgctcgaccgaccaaaccaatcgtagtaaacgcgccgatcggtgcccgccagcgcgcgcgcgcgcgcgctcgctcgtgggcttcgtgcgcgcgccgccgccgccacggctgatgagcgggcgaggcaatgcgcgccggcggccggcgtgcacgtcggcacgcgaccacgcgtctccggtgcccgtcgctcgtttcgttgctcgggccggccggttcggtaatgcatggtttcgggttaggcgcgcgccagcacggagccgtccgatttaaggttcgggacagctgctgcagccacgcgcgcgcgcgcaccgcatgggctgcgatgcgatgattgattgaccggccgcagccgcagcgcagcgcagcgcaaataattgccgtcgccaaatgattcgggccaagctcgatcggtcctaaactcctaattagacgctcgctttctgtaccggcggatggtctgggggaacgagtttagcgcaccttttgaattgcgtccgcctgatcgcacgcgcgcgttaggtgattaggtccttcctgcttcttttttcccccatgagtttatggtattactatatagttaggcgtacggccactgctgataaaattgcggtcacatctggtcatcatttgcccgtagaaaaaaatcctggggagctgccgtcttctgctgggctcggtccaccgtgcccaccgctcaggtcagatgatagcggcagtgggcaggccaagaagcggacgccgcgcgcgtctgcttccgggttccggctgatgacagcggacctctgctatctgcgcaacgtccgcgtaacatcactagcttagcctatcgatttttttatgaaaaaatataatagtattcttgttttgcaattcaaatcaaatatgcagaaagttagactctccaacagctggatgagctgctggaaaccgctgtttctggagtacattcttggtttacggtttcccgcttgcttgagctgtatctcgccggaaactagggaaaaaaaagttcgcctgtttctcgagaacacgagagttcgttgtgtcaactgtgcacctcaaacctcaactcgagttacccttttagctaggggttacgtacatctgaacatttccgctgtcgcgttccaaaagtacgtgtgcatgatagtcctcgattgaccgcagccctgcatgcaggcgtttcgattcgtggtgctacctagactccagaacccttccgagaagaccacttctcttccgcgcgttcgcgcgttgcattgaaacattgaatccttatgcgagcaatgacattgtccacatgatgacgactataataggcatctgcagcactatattattggcgagttgcatgttcatgccggccgttcaaatcatgcaccgtcccgggcttgatggcctgctcttctcttttattaggtgctcaatgatgcgctcgacacgtccgaa

SEQ ID NO: 1889 - DNA, 2122 bp, Zea mays
  misc_feature (1)..(100): optimal_loci_264302_G1, chr7:162994802..162996923, Cluster 11
cttatgaaacatagagtgactccataaaccctattagtatatatgctactgctgctgaccggtaatcaaaaaacatgtttggtttggcgaaagcactatatatgtttggaagtatatttttctgccttggtcagatttttaataaccgggagaatatgtcggtgaaattaggccacacaggcggctgacagtgttgtctccttcctccttcctcgcctataactataatcgacgggtgtagtgtagggaaccaaggtctaacaattgtagaagcgtcgggaattttccaaatggagagcgagtctctgccgcggggtgattgtctacgctacaccgcgggactgattagggccgcagtacgtgttaattagctagctggtggcatgtgatgggcagacactacgtggattccgtgttgacatggatgcccgccagaaagttattaatatgctcgcatatatcgataaaacaaaaccgaggacgaatgtgtaatttatagtacgtagcgtacgtagcgtctaaagctaccttattatgggtactacattggaattctatgacgtaatcaatttaaaattttggatgcaatctgccgacaaatgattgcttatcactaacacaacacaacgcgcgcgcgcacatgtactcgtacgacgtgtggcaagtcagaaactactagtggattcgttcgtcgcgtcgtcggaacgtgtctttatctctccgatccctatctaggggtggggtgccggctccccgcgacgcacggcacgagacaaggaggacgccgcggtggagtagaaccgtgggaaggtgacccgggcgagggaggtcagaaacggtggtagtggtactggtgcgcatgcccgtgtcttcaacggcggcacgcgcatgcggcgggggctgcggggggaacacttggactcctcagcacgccacgccacggggcagtcgtgctaccgcgcaagtgccatctcttgctgtccacgctcttttccgtccgttcatatatacgatacgaacgcatccacccgccggcacggatgccaaggccaagagttgtgaatcactggatctcgtgcagctgaaatgggaactgcaaaattgccccagcaagcagcgcgcaggcaacagttgcactcatcagttcagttggtcgtgattattaatttttaatcggggaaaaggacgatgcatgcactcatcagttggccttgattattgatcacactctatgcacccgtcttctagagcgcttccctaccactctgacctcctcacaataatctgtgtagtaccggagtaacagcatgcctgctcccctccgtccctgccctgtctcgtcgacgcagtgatggcgcatggcggcacggcagaggtaacgcggcgcgtcaccgttccttttcctgataacgtacgagcagccatatgccataatcgaccagctaataactccgtgtactcgtaaggaggacgagcacctgtaacaccagacgcaggcagaggagaacagctccagctagtgagactagaccacacgtcagtcgtactgtcgcctatccacccgcaaaaaaaaaatattctgtcgcgtagagagcactctatctaaaacgcaagtctcttccaatcaagtcccccgacccaatcatcaggcttctcctaatataggagtgatgcccgattgctagggcgagaccgtgcggtagacgtctgcctgctaatgcgattgatgttttttttttcttctgaaacgacgaccggagaatcactggacgtgatgtggaccgaggaggttgctggcgatgacggggttgccggagtttctttcttttctttttttttaaaaaaaaggggaggtttgctgtgctgacttccacctcgtcttcttctggtttggcgcctcgcgctgtgcgtcacgggtggccgctacccacctgccaccgccatactcggcggctctgtttggtccctgttgtttaatggatgggtttggctgctctactacatgctctacgctgtcgttgcgtacttgcgtggttgcaatctgtctgccccgagagagatgcacaagacacttgagagttgagacttgagacacgagagtgttggatatatagcatggtcc

SEQ ID NO: 1890 - DNA, 3896 bp, Zea mays
  misc_feature (1)..(100): optimal_loci_265088_G1, chr7:167626489..167630384, Cluster 11
tttagttgatattttatcttatttactgtatctacgaaggccaattagttagtaaatctctatttatgtcccacgcaaatatcaggccccgctcagattttggtctgggtccacccctgtatcaagagcatcgatgtctccatgatatgtaattatttatagatggcaggatgaaacaccatgttattagtgtgtaagtatcatacgacgacacatctagaatgtctatcacttgtagcacatgaaccccttagagactgtataatttagatactatacgttcggttctccaaacactaaatataactaagaaacccattcatagaacttatggtatctaaatcttgtttcttattcactagatcccctcaagacacgactcatttatatgagttgtatgagttgaatcgtatgtagatttataaaatagtgctagagacgttttcaccaagatatcgtctcttatgtttttttatttaacacttgataccatgcccttattagttattactccttctaatgaggttctactctgaaagctcattgacgttttgtgtttgcggcctataatcaatatcgtaatcaacaactgcgacatactactcgggagaagtgtataagcgtagccgaaaacatggaaatggcgaggtaggattcacacgaccagtgtccagtccagtccagtccagtgcagccgtccagacggaggaaaggacgagcacgcacgcaacgcaagagcagagaggtagtactgcgccgacggacgggacgacggctggagtcaatctggaatcaaccctagctagggacaggccagttgcgcgcgtcaagcaaaagcgatggtgcacgatcgcgagagctgtgactagttccatctgctacacgtgtgacgtgcgtgtctttgtcagagcagcaaatatggatcgagacgcggcacaggacccctaggcatgaggtcgctcgtggattcggccggctagctaaaaactgcttgaattgacgatggaatcgagctctggctgccggacgacggagatgacgacgatggatcctctcggcgacgacgtcgtccatatgccgcagcggcaacgtttctccgattcgtacgcctgaattcaaggccgtagcgtcggcgtcggcgtggcctcgaggcgccaatacaatcttgcgcgtgatggtgtgtgtacctgcgacctgctgcccgtccacccgctgctggctgccgccgtacgtattggctgtgagagatggaagggcaggatgttaacggctgctggtgccatgtctcctgtactgtagtagtaccaccggtgatcggtccatggaccatggtgtattaacactcgacttaacaacaagggcagcatgcatgcaggggtatctctctcgatccattgtccgtggcgaagatcagcgtgcgtgaatactgaagactgaagagggagtgggcaactggcaagaggcgatgagggcgagatggccagtcagtcatggctggaaaccacgcacacgctcgagcccatgcgtgcgtgacgcacgcagtgatgcgggtcgcgctgggctagctggtgcatgcatgcatgtacgggtggtgatgatccgtaagaggaggccggtcggcccctcctgacacgtacgtgtacgtacagcatgcagcagcagacaccgctgcgcctgcgctgcgttcatgctccatgcatgcgcaggtccttccataccagcagcgacgtcactcgtgaccatgcatctcgatcggtgccgacctggccctccagctggctccttggatatggtgactgacacgtccaccgtccacgccccggccggacttgccatagccaggagccagggggcagaacctgctagctgccgcgtcggatacgctggcccggcccgccggcagctcgatctatcggtcggtctcgaccatactacgtacgtgcacactgcgctgcgctgcgcctgcgccgcgagcccgcgacgcgagcgatcgccaagcagctggcacgcacgcgcaccccgcccatgctcgatctatccgttcagactctatctgagactttccgggctcgcggcgttactccccggcgggacgaggaggtcggcgatccgatccaaccccacggccgcatcccccgtaccgtccgaggaggatgcacgcggagccagccacgtcgcggtcggctcgtacgtcccgtggcgctccatgacgccgcccgccacctcgcgcgcgccatgccatgctcacccgcgtggggccgggccggccgtggccgtacgcgcccatgccagcgtagggccgctgccggccggccgccggccgttcggtcgtccaccccctcgcccccgcccaccagcagcagcggcggcgatcgatccccgctgactgactgacggtggggtcagactcagacggatatattacgtttctagcgaacgggccgaggcccattccagaggagcatgggccaccatcaattccgatcaacgttagggggaaaaaagagaggagaaaaaaaagtcaacttcttcctagaatctgcccggacgtttcctgaatctggacagcgttattatacgctgtactagtactactgtgcgtgactacggttgcagccccgtttgtttaacaggatcatgccgcatctggcgtgtgtacagggcccaagatatttctgccgcgactgcctttgttcgtcctttctctatcgccatccggatctctgtacaattggttatgttagccattaatgcatgaccccaaagggccaagcaagcaacgttcttatccctccattttcatcatgaaaaagaaaaaaaagaagaaaatattagttgcttcactcgtaggtcatggtccacatgcttatgaacactctcaagtccaagttctgcggagacggagaagaacataagctaaggacagacgacagattctaggcaagaacgacacagcttggctgcctgagcccacacgcatggtcatggagcacccaaacgtcaactcttggctggcaaaacgctgaacgaaattatttgcaagggaagaaggggcctaggcgacgaaagaaacgtgtgtgagtacccgattgacaaggcgatcgagccctaggagggcccatcataaatctggcccagctcatcacactgaactagcagttactcatcaggacgtgccagagaagttaatcatcaactagggttcacatactgcttcaatcaagatcactaactaaactccaagcgaggcaaacgatcttcctttttttttatgctaatacaggagagctgatggatgatatacatcccttcgagataggccacttgtccacacgtacactccttggtgatgctgcgtttgcgtccatggtcatcagtcgatagcgtgcagttcctgacaacccttcttcaggcgtcaaactccatttatgaatctatcacacatattgacgagcgtcaaactaattccaagagctttgcggctgattaatttacaagaagccaagtcgggcaccacaatcgtcttgtaaataaataaaaaacgattctgagttcacaaaagccagcagcaggcggtctgaactctgaaactagttccaggagtagatggcttagggctgggattttaattgggcttgcaatttgacatgccaccatgaattgactagctaacaaactgaatgatcagtacaggtatttccagtgccgttgctgtcgaaccgcgcaattcgtcagagctgttccttcgtttgccgccacaagatcggggctagacggcgacaacagacagcgaggtcagcacaaatagtctgctgagtggacgacttcaccattaatgcttcgagagaagctgccgttgccggtagctgtacagtgtggtttgacaggttttttta

SEQ ID NO: 1891 - DNA, 2056 bp, Zea mays
  misc_feature (1)..(100): optimal_loci_265213_G1, chr7:168273877..168275932, Cluster 11
taattgattcttacaatattaatttattctaacaataataccttaggatctttatgctttataaaaataaatagtttgctataaaatttatatttaacctcttttttatcttctcgatatgcgatatgctccattgcggtagtattgctatccctacgtaaaggtaaaggcgttatgcagcctacttttcgcacctattcactagtttataactaagctaagaagataacgtacataactcatgtaacacgatataagggcctctttagcacgactctcgctcctctaaaaacacttttgacttagacttctttggcacattggcttctatgaagaagccaaagctattttgcaatcgtttgctttttgtgtttttgtatcaaatgtgtatgaggaaacatatgaggagccggtagaaactatatttttggtgctctggctcccagaaataaaacgaatccaacttcagagagctctcaacgagaagccattttttgatcgtttggtagagcttcacggtaagccttgaccggagccgttcaaagagccgtgccaaatgggtctaaggatccccgacgaacgtggcgtcgtctgccgtgccacaagcgcggcaggtgtccaccctgctagatcactgctcacctcaagcgcaagtgtgtggctgttgttgtttaaaaaaaagtgtctggctgttgtccacctcacctccgaggactatgagtcaaatccgagtccgagtatggacaaacggacaaggcacaccgcacacgctgacacgcgacggcgacgcgcacgaactgtcagtctagctactactactacgccctactcagagtacgtacgtgcaggccacagcgacggcgcgcgacgtcaccgcccaaggccgggcgcgcgcaatggctagcgccgcacgggggcacgcatacgccgcagcccggccggccgcagcgcatttcacgcgaggagcacgacggggcgatggagagggacgcgtactaactacgtcgcgcggcccgcccctggcccttttctgctatactgtactagttgggttcgtcttgtcgcgagcaggaccggagcaggacgggtgcgcgggggcccatcgtgcgtgcgtgtgtgggcgggcgggctcgcgaaagagagagagagatggagctgcgggcggcaggtgggacgtcgtgcgcgtccgccgtgtggtgccagtggatggacacaagcgcacgctggcgtccgctgcgggagggagtgcaatgcatggccctgttgctcgacgccgtacggatccggtgctcctaggcaagtgcgtgccattttagctttcttcttgtgatcagtaattaagccaggcttattactactgtcgtctacggattaaagtttatagaaccgaatgaagcataaattcacatctacgacgacgccgaacaaatgaaacgcgtttgcttgtgtgccgaacatatacgtaccgagcatgacgtatgtatgtattcagctgttctgtcggtgtggaggatgacgacgacggagaagaagaagaaatatatgcctaatagaaataaaaaaaaagaaaagaaagaagaagaagcacgtgcgactgaattatatgcatgctgccctgtcttgaggtaacaaaagctgggtagggtggcgacccgaatcctgccagtgaaaacgatctgtcgtgtcgttccattgcacccagagctcatcatcgccagcctcgtgattttgtggccgcacactgtgtcagcgtgtggccgccgtacacgttaacaatcagtaaccttttagaaaaccccggcccggccggatgagggaggttgctgcatggacactccagacaacacacacacacacacagcgaaatatgcgtggctaccattggcttgtcgtctcctccgctagcccaccgcctagctagctagattctcctctaattaatcgcaattgaatgcgtcccggggcctggcctgacagcgatggcgcgcgcagccggatacatgcccatgcgcccatgccatatgcgtgcgtgcccctgtgcccatgcatgcatgtg

SEQ ID NO: 1892 - DNA, 1790 bp, Zea mays
  misc_feature (1)..(100): optimal_loci_265628_G1, chr7:170663457..170665246, Cluster 11
tatatagactaggttagttggaagtggaagtacctttaggcctctctattctgatcgtgctccagctatgttatccataatctggtaacaacgaaagtacacaattaggtactagtaattaccacgtgattgggagttaagcttttggtcaaccttttattatattagggtcttccactataaaaaaagtccaccacttctagtagtctctccgatcagttaaacatgataaaacatatgatattagttatgaaatctctttcgatggagttatttgcttctttgcactcattaaacatgggctttcgacagaatgccctcgttctaaccggtgaggcgaaggcggtggtcgagactcgagaggacgagcagccacgaggcggggaagacgaaggagaggatggaacggaacaggtggtgggaggaggggcaaaccgaaagttttgatggtaaaaaatcaatattttttttgctaaaaaaatagcaggagtgcatggtttaagaaatgcatacgagtgaagcccccataaagagttcctgcaatcagccaatgaagttaggctgactccctacgtatccaaacttgtgaggggatgtacaaccctatttaatatgagatctttttaaagatgatatttagggataactgaaaaaaatacaagagtcaggcttttcacgaaatgcttatttctaaataactctatatatgttatctcttaactgcatttataatctatgagttcagagttgtatcatatggtcctttaattgtctcttatatttgagcaatttttacataagtggactgagaactgagaagcgaagtgtttggtggccagaatccaattctgacgaccagaagccgaatcaaatataataagccctataaagagtttgcgcgtctagccgatagaattagactacatacttcaccttgtatgagcatgtacaactctatttataatatgggatctaggatcttttgagagtgtttacggataaccagcgtcagcagatttggaatccgtggatgcgcacgccgtcgtactgtacgctcgcgctacgggccaagtgatcgagcaaacgatagtgtggcagaggatgaaggcaaacaagcaccgcctcgttgcaaacgatagtgtggcaggcaagacgcctagccgccggctgcgttgagttccatgtgtggttgtgctcgcactcgcagtagtagccgccagtacgagtacgtacaccacgcaatttcatgcgtgcgcgcagacaatgttgtccatgcatgcaatgcaaaggtttcatcgaagacgaagctaggaaaccatcgtcatggtgcagctggctcgcctgcaagatcctctgtacccacgtcagcagaattggaatccatggatgcgcacgccgtcgtacgtactgtacgctcgcgctacgggccaagacgccaagtgatcgaacgaaagtaacacttttacagtgcttggtgaaatctccgttggagcacgatgaggtttgattaattcgttcaggagcccggatgtgcggcggcaagaacgtccggactgggtcgccgtcgagcggtgtggtgcatggacgctggctctcgcgagtggagccgtgacgcgtgtgcaggtgtgtatgtatgtcgtcgcatcgccgcgcacgaatgatgctgcatgcagaatgatgctgctgcccactgcaaggaggccatcgactagctagccccgtagaccctgtgcatgaggcaacaaatggtattggtcccaatcaatcaaaatcagtttttttttcaagag

SEQ ID NO: 1893 - DNA, 1950 bp, Zea mays
  misc_feature (1)..(100): optimal_loci_266442_G1, chr7:174247527..174249476, Cluster 11
aaccaaccaaaccgcatcaaagttgaaggtgttgcatccttgagacaaagcacatcctttggattttgctgtgttaggtagctccgccgctgtgaagctagctaggtgtgtggaatagaaatgaagggcgcagctagctcatggctactagctaacagcgcacgagcgaagcatggtaataactatgtttttaccaaggcatcatatattgtactgtcgtctctctctctctctctgttttttgccaaggcatcatatattgtactgtgtcgaggatagaaaatgtaaccctcgagacgagggagactcctagccctatgctacgtactacgcagctgaaagagtcgagctttcacaaaagttgtgggggaaagaacggtggtaggctttattcttgggcgcgtgcatggctttggcatcacatgacatgagcagctgcggcattgcctagcctttgctaataagcttggccaaatgacctcttatttgatgtggtgtctatatatttatatttaatcaagctttagataatttaacaaagaagaactgtgttgttccccacatcaaacaactacactacactagtgtaatgaagatgtgggtggccaacgtagtatatatactcgctccagtacgggtcctgttgcgctttctcttttttgccaaagtgtggagcatctgcttggctggagttcccaggagggaaaaccggccctcaaatgctcggatgacaggtggtattggctgctgcagatctgctttgcacgacagccaagggatggagaaggaaggaaggaaggaaggagtggctagctagctgctggccctgtggctgactgactgactactgcgagtgacaccgaggcgagcctgtgagcgcgcgactgcgcgtgagtgcaaacatggcgtgctgccacctgcgtcgtctgcgactgtctcggccaccggccggggcctctccctctcccgcgccccgatgctatccagcacagcacagcacagcctctgtctcgccagccaacgtacctttcatgtacaacaacaacaacgtattttatcttcatcttaaaccaactgcatgcatttcttttctactgcaccagcagcaggatgattattgtctggatgaattgaatgaatatgaatcgtcgtggatagcagcagcagccagcagcagcgatggttctgtttgctcctgcagcctgaacctgaataataatggcgcctcgctagctagagtacctcggccctacagtaaccaacagtacgtgctagtaaactcagcagctgctgctgctcactgtcgtattggcactgcttctagcgcaacgaaaggagaccaaagcaaagcaaagcaaccctaacctagcatggggcatatggcgatcaatggcgttggcgcctagcgcagcagcaggtactacgtactacagtgctccaataatcgctacagctagctcttcacgataggagctctcgatccaatgaacatgcacgatacatagcggctacctatagctcttctctgaatctgttcctcgctccttgttgcattgtcctcggagggaccgatcgagactagcttcagctggcttccagttgcacttcgctctctctctctctcacacacacacacaaaatcacaaactgcatgccagccagcacaggcacgcactccagttcagttcgtcgctcccaaaaaaagaaacagattcggtgggcgctgttgatcttctcgtaccacctctttctctcgcttctcgcttgcttgcaaaatatctacgcactccaacaatccctaagcaccggctactatttaatgcctatcactagttttaggtcaaacaattgtagctttttttgttgccgcacatggattgcgaccatacactaacgaaacatactgcaaagcctcgaaaaacaccttgggaaaacttttttgcccgagta

SEQ ID NO: 1894 - DNA, 2081 bp, Zea mays
  misc_feature (1)..(100): optimal_loci_269092_G1, chr8:11804415..11806495, Cluster 11
gcatggtggtggcctgcttccagcagccttgcctatgcctggtgcggtgaggttacaggtgaggcgagagatcggacggtcggttggtcgtttgttctgtgcttgtccgagctgtggccaaccattagcagctggattggagtgttccgccggagattgcgctgccttttttttttgcagctaacatccttatttccatgccagtagcggcgagatcggactagaaaatccaggcgtagtatcgatttgctcggtagaggaaggaccgctccttccgataagatgcagcaaagggataagcagaggggcggcaccacaaactgatctatccaattgtacgcatgaaaggacggccggcatccatatcccgcgaaacgtcaggcacgcccgcggtccgctaggtccaaaagatcgcctgccgcacgacgacgaatgcgcagtgtcggcaggcaaccataaacgccatgcgagaaggcagcgtaacgagcggcagtcggcgcggcaatgctctcttgcgacatggcgacactactgccttcagatggagatgggacgacgaccctcggctgctgtgccaggccggttacagaacgccacggcgcgcgggttcggttcggacctcggactccggttgcatggagtatggcaggacgggggacggcggacggccagtcggccggaaacaggggaggcgacgtgccgctgccgctttgcggatggatctgacgggagatatctgaacggccccacggcgcgcagagtgaactgcaggcctcgtagacggggaggccagtaggtacggaagtcacctcgtgttgaaaaggtggacgacacactgcccacgcgccgtgtgaccttttaaaagaactgcgcgccaaaggcgcttcgctacggagcagagccgaagccgaggcgaggcgtgcatggaactgcacggattctgaggcgagatggtggcgtttcgtccctcgcggttcccgccagccctgtgcgaaattgctgccgcggttcccgcttcttccatagccatccacacaagtacagaacagcgcagcttgactgccaaaaacgatgtgctccctaatcaacaagcgaaccgggcgtgccgccatggcggcgcccaaagacaaggagcacggttggtggaagccgttaccgcgtactactagcagaagcgaagcagactgcgcacgtcgcgacgggcagtagccaaggttcagcacttcagctggagctgctgcgtcggcaactgccgccgactcggcatcgcccggcggccgtgcgccggcctcgcgctcgcgggtggagtcggcggcgcctccaaaaggtgcggcgctgaccgcctggcctggcacaaccaggcgcggcctggcctgtccccgtcgcgtcacgctcgacgattctgacccgcctgtcgcggccagcactcgcggcgggccgtgaccggcgctcgggtcatcgttcggcgcggaacacccgtccttttcgggcagcccgccgcaccggcggtgaagacatggagcaggtgcctctgcctgccacacgcggaggaggcgataatcgctctctttgtcatttcaaatcattttttcttcttctgtatgaaaagtatcagcgtatgaccgagttgtgttatgtcgattctagtattttacgataatacgattataccaaatcaaaacgatatcgattctattaccgtatcgaaacgatatcagtgcaaaaagagttatataatatttagttttacctaaacgctccacatgatcctacataaaaatataatatataatattctgctattacgattctgcgacactactatataacaattaatacgaataattatttaaatgatttagctatagtaaaatattgtttaaagctagaaggaaatagaataatgctaaaagttctattgaacatataagcaacgaactaaattaatttaaattaatattgtagcctttagtatcttacataaaacatataatttacaaaatcgatactattaaaagactgtgatgtgatcggatagtatcagtggaaaaagtaatttaggagggacagacagcctcata

SEQ ID NO: 1895 - DNA, 2321 bp, Zea mays
  misc_feature (1)..(100): optimal_loci_269307_G1, chr8:12911686..12914006, Cluster 11
acgcagtggcgttgcggaagaagacgagtgagacgacggcaccgcgcgagcaaggactccgtacgtgggtcggggtcgggggcgcacttgtagtacgttcctgagaggcagctgacagcgagagaggcgatgtaaaatcgataggttgggagttcagttgggcgaggaaaaagctcaggagaaaaaccagccggggtcgtcgtaatcaatctcgcaggccaggactggcagagacagatcagcgccggtcacagatttgggtggcgacagattactttacagtgatgtgccaaaaccttctttcctcgctaaaaagctcacacagtcatgcatgtctttattagcaattgccacgaactgatggtccggtctagacgagaactaactccaagggactctcgccggaaaactactccagaggactcgccggaaaacccaagggtgcctggccttgtggtcgcggtgaaagaaaccttcgtcttccgtggtgggtcgtccacttgggactttctttgtcggggacagggcagggcaccgctcgcagcaatcgtggaaactttctttgtcggggacaaggcctaatgggatttgtccctggcaacatcaaaaattctggcttcgccctcgcactgcgagcgacgtctttgttcactcgtcagcctctctccgcgtgcagacttgtgactgttctctgaattctgataagtacacaaggccatgctacgacgttcttttaccaccacttaacgattaacacgacagaccaaaccgagtatagtatagtagacagaagagcgagcaagacgaaacaaagctcagagaagatgcctcactttcgtttggactacttttggtgtgccgaagctttgtctgtttcagtgcaacttggagccggacgggcccaagaacactacaagctgggcagacgacgtccatgtcattacgcgttcacaaaaccgcgtcgaaatttggggttggtgtaatgatcgttttatttagcacacaccatgtgacaatacgccgagcaaagtgctgcaatgaaacctaaaaacaaggtgagctcaaatattatggacaccttcgcaactctctattgaagttatatatgcgtgcaaaatttcagctcagacggaggttgtttggatcggttttgcatttttttggaacttcgattcggggcagataataaaaacaaggtgagcgagcgacactgtttttttagacttttcagcatctgttttgcgattggttcgtttattcactgggctcggactcacgtacgctttagaaacatttccaaacagtacaatcactatacttggccgatatatatatattttttggtcggagcatcctttttatatataagtgctcaactttttttttcaattttggaaggttttcctcgcaagcacatttctaagctgttttacactatatatatatatactgagcactgtccattagagtgaagtttagatatagggatagataatctgctggagatagcctagctgatctaatttaagcgtttcgatcatcatctagccaccaccggctgacgtttactcatctctcttgggtcttggaggttcaggtgtagcgttattagaaagcatgccaaagattgcctgagtgtaaaaaaaagagcttttttattgactctattcatcctctctctctaatcgtccgactagatccttcaaattatcggtttccatgtcatgttttcagtaaagaaaacctctggtcaacaaagctctaacacactccagtttgaagacactatatatcaataatgttctcacaataatgacgtacccatactacatgtgactgtgaattgcgacgggggaggagtaaagtacgaaaccgcatcgcttgaaaaccagttgatgtccgttttgcgtcgagtcatgccggttggttgtcaaacacagataattaagcatagtagagtagaccatacgcagcgacagcagtacatctgtctcagtcaatctctcacctacgtacctgccaatttggttgtggctatatatggcgcctcttgatgcgggccgggatggccctggcctgaacgtgtcggttcttgcgtacgtgtgggtctctccgtctctgaggtggtgtacgtgaccggcaactcgtcggaatggaatggaatggaatgacgatgttaactcggtgagttcatgctcgcgcgcactcgagaagcttctcggtaacattcgcgaaaacattgactactgttcagtgaaagcgaaacacgccgcgacaaatctgacaaccaaaacgcagcaaagcgattgccagttcggtta

SEQ ID NO: 1896 - DNA, 2552 bp, Zea mays
  misc_feature (1)..(100): optimal_loci_270540_G1, chr8:20526239..20528790, Cluster 11
aacaagtgcttgtctggcgagttactaaatgaagcgcctccagggggagaaggcgtgtcagcgaaactcccaggggacatcgatgtcggcctcccatgaatcggaaagaacagctaatagagtcaatccgggattatgaaggccatcgacgcaaatcagcagcgaaactcttagcacggggcgcagaccaaacaatatagcaaatttctcatatgcggagatccgcacagctccgcctcaaagcacgaccagatgaatccgaggcgcgggccgacggtcgcctccaaaacgacactctaggcctcgcgtgtatcagacgagcacgggttgagaaaggagttcgcctgggattgtcgatggcgacacacgacccaaggtcccaacccaaatcaccaggagcgggaaagaagagatctgcggctccgctcagtgctcacatcaaagaactgttcagggagcccatctgccgtcttcgcagcgggacatgacgcggcggagcagacggagacccagaacctgcaacggttttctctacgccggcaacggaaccgaggtggcacgggcgggaagccgccatccggttctctcagcggcgacggcttcctggacctcgtccacgaaatctggggcacgtattcgaacgaagaggaaaaaataaaacactgagccatggcgaggaacgcagaagaatcgaaacgcaacggaaaagcgtggaaatcatggcgatggcgccaggagggacggccggaggtccggagcccgccgaggtagctagggtcgaagcggcggcggcgatgggcgtgccgcgtgcctgcctcatataataagaaggcagtgcggaatgatgggctgggctcatgtcgtcctcttgacgggctgagctattttgtgtcgccgtcctgtttcctttgtgggcctagacgtccgagggtcgctcggtttcgggctgctcgtttccgcaggggccgtggccggggccgccagcaaaagtcgtcgtgggcttttagatagatacatggagatggagtaccgtcttcgttggacgccgggcaggctgggcggaacgcgaacgacggcgacccgtggtctggtcgaagctccggcggcctccggccaccggccagggcgtgctgagtctgaccacgtttcccggatgtcttccgccctggcatttggccgtagcagggagccgatcgaggacaccatatgttacacgcggcttccttccctcccctcccctcgggtccgcgtttcggtcttggttcagacggacctgcgcttccccacatctggccaattggccaccggtcccggtacccccaccaacatccaaagcacgcgttccttgtgccggccggcggcggcggcggccatgagctgtgctggcaccaccgcgcgccgggccaaccggtcggacacgtacgcaccgtggtgtggtccctccggcaccttattattgatcgatcagcagcaggcagcaggcagcagcacagcggccactgaacatgcatgcatgttcttcgttcgtctgtctagactactagagtcgatacatactttcacctcggcacgcagacgcaggacgggtcttctcttccaccgttcgtccatgttcagacatgcccctttcagaccgtatgattttccttgggttttttttcgatttccatgacagcgccaaaccctggtcgcagctttggaacgtccggtcagtcatggattgccggcagttccgacccgtttcgtctcctctgaatctgaaagagaacgttctctctgtcagactgtcacgtccggcatccaccaggatttcttccagtccacgggacaagcagctcgacgtctttgtccccccctgcgcgcgcgggctagctcagtggctgccgctcgctcgccacaccgtcggtcgcatgccatacatgtgtgcgtgcacgctgccgcgctctcgaaatgtcccacgtccttcgctagttcgcttgtcgttggtttcgagacagtgacgttgccggagaaaaaaaaaactagagctagctcgccgacggatggtggtgccgtgagccaagggtttctttttaagccgtgggtggtcctcctgacctgaccgtgaacgcaattataattcggccagaactccggtgacgatattttgagccctcattaccggatggccagcgcatgcagcatcgttttcgtttcgtctcacttcctccatctcgttctctctgcgtgccggtgccgctgccgcatggttttcctcggctgtttccaagcaagcaacgcatgcatgcatgcacgcacgcgcgctgggcattgccacggcccacggtccatggacgacgatccaacagtgcgtttggagggagatgcgtatggggtgacgaacgacgagctgctcctgctcggtggcgcggggcggtcgctcaaacatcgcattccaggctcagaaatcctaaggaatcagctcaaatcaagtttattttatagaaaccagctcagtttcttaagtactacacaaaaagctcttcaaaattgtaaccctcccagggcatatg

SEQ ID NO: 1897 - DNA, 1694 bp, Zea mays
  misc_feature (1)..(100): optimal_loci_270964_G1, chr8:22796502..22798195, Cluster 11
acccaccgatgaggctggatccatgttaaggtagcctattatttatcctattgatgatgatccatccacaataattccagcttttgtttcatatgtatgacctgtccctgaaagatagtctgatacatggttttgtcgtcgcatgcagcagtgctggtagggaatgacttggccagcgacgcaaacatcgtcgcagaacacgcttattgttagatgacaagagaacgcatgcatgcacttgaccatataataggagctgtatgctgcaactgcaaggcgatcagaacctgcatgccattgccaccatcaggcgaaagggttgggaaaggttcaccgccggccggccgcccgggacctggatcctgcaacgtaatgcaaaccagctacatcagcatctgcatggcgttttcccatagctacacttactctaaaagcctctgtacttattgtaagtgtgatgagctagagctctatgaactataattataatggttagttctcgattaatggtaccacttatggtttacgtttcgaattaaagccatctgttcggaatgctgtaatatacatagacataatactgttgaacagcggccgcgaactgtctactgttgttgccaaatggccggggatatacaccatcctcagacatgcaggcaaataaacacatgtttctgtttttcttgttggttgaagttagtttgaaaaaaaaaactaacactttatatagctatacaaacaagtagccagatctaactgaataactgatacaggacaaataaacatgtcgcctgaaccgctagctatagtgctatccagactcatctcgcacacgccggctactcgtggccaggctaacaaacagttccgcagcagctagcaacactgcccagtccttgtagagtaccatcaccatttttttcagacaaaaaaaaaagtcatcgaggtgtgcgccgcggcggtggaggcgggaacgaaccaaacgttacccgccaaatttttacccgggaagggcccctccgcggcgtcagcctgatcggcgcagcgagagaggagatcccgtgtacgcgggcggtgggggcgtagcgtagcggcgcccgcgcagtccaatcggcgccagggccggcgctggtatcggggacggagagccgcacccgaggcgctaccacctgcgcgttcctgggcccggatgacacgtggggcccttcggtcgggtagcctgcgagcgagatgggcccgggcgcaggaacagtgcagtgcagtgcagtgcagcaaacaacagcttccgcgtttcattctgagttctgacggggatatgcttatgcgtttataccctccggaactcgggatatttggtcgaccaaagcatgcgtttgagctgattttccctccaatgttctaaagagagactaaagttataatgctatatgttttgtatatagattcttatcataaatcctgcgtgtttcagttcatgttactgtgcttaccatatgttcaaagggcctacgagtcataataaaagggagtaagtaatataggaatggtaccgctcttgggattgtagcttcaacagacacatacattgttttttttcttcaaaatattttcgtaaaggtagcaaaaccaaatgcatagaggcaccaacgaacatagtagggtttgagccccccaccgttcaagattatgcctac

SEQ ID NO: 1898 - DNA, 3271 bp, Zea mays
  misc_feature (1)..(100): optimal_loci_285639_G1, chr8:118421323..118424593, Cluster 11
actgagctagcttagcacacgtacgcacgttagtcgatagacgacaagagggtatagatgttggttgtttagcgctactctccagtgagcagattttgagcaaatgaaagcagttcaccagcaggcagcagacagcaagatcctaccagcagcatgagtgtgcatatgcatgtacatgcatgcatctcctaggctaatataacagggcgcgccctttgcggcgccaacagatcgcggttcccctccccccttctgcgttccaaacgtgaaccatgcgcgcttgtgcgtggtcctaagaagcagtacctagcgcttgcttggaaagccgtcgtcaaataccagcgacgatcccccatcccccccccccccccgccccgctagctaagctagcaaggttaacctcacctttctatcaggaagcggcggcggcgacgtacgagtcgatggcgacgatggaaagctaatcgatagtacacgctggctggctattgcagtcccgattggaaatttctgcgtgcgtacgtcatagatctcctccgagatcggttgggccggatggcggtaatcagtagtagctttattaatctgctttcgcacagcactagctagcttgtccgatcgatgcttattttacttggcaaattggtactgctgcttacccccctgattacgacctcgcgtggcatgaatgcgcgttgttgaattctccatcaggtgccgtcgcgtcgccactccaatgcacaccgagacctgacgtcaacaaggcaggcaggaatgtaggatgcggccggagagagagcgttggacgtcggaagcatatatagagaggctcgagctaaatgaaaaaatatataaatgaaggtctcttcacgagagcatgtctctacatgactttttatatatatgttatcttttaaactatatttatagtctaaggctcagagttatatatcatgcagtatatatattagttatcgcttgtacatggaaaatggaccgtggactcaagctaagattgtatatatatgacctaaaattaattagttaggtgcatgtgagttgctaggatttgtatatatcacattaacaacgcacgtacgtacagctcccgcgaataataaacctggtcaatcgcacaggtgcgagcgggacggcacattcaacactgaccagacagatacatgcatgcatagagcgtgctgtacgtactctgcatggtaacaataaccaaccactcgctagtggtaacccaactacaaattaggtactacgtgtactactctaactatggaatgtagttttataacaaaactttaagatataaatgctggtattgtttttctaaaaaacatattgtttagtaactacccaaaaaaatggtaatatatacgttcctttttaatttaatctgagagagtgagtagcaggacaggcacacaagtagcatgcatgcatgcgccagcataatacgcgcagcaggaggacaatcatgcgggccgggcaccagtttctcaggtgatctgactgcacagacgtactacgtgctagctagctagtagagcggaacacgcgcgcgtgccccctcgaacatgttgcgagcatgtcggtcgtcgtcgtcgttggttgtagatcgagtagtacgttgggtagtccgacgtcggcgtgggaacatacctactgacatgcatcatgcatgaggccatgcatgcacagggcagttctggttactagtccaccagtcccgtgtacgagtattcgatcgatcgtcaggtatccctcatatatctacgtcggtgtggttccatatatatccgatatgcatggccagttttgattgctgtattcctagctactttcacgccagatcgcccagttgttgttttttttagaaccattgggacggactactactccccagcgggcagcggcccatgccattgggatcacggtcagagctaggctggcgaggcgcactgtgtgagctgatcgatatgatgccggtggactacggaattggaatcacgctgctgtaatgtaacgcggcgggccctaggactaggacggtggccgaggccacctgctctgggcccgtggtgcttgccggcggcagcagaggaggcctggtatcaacagttccaattcgggcctgggcctgggcggacgccgtaaagctgctactgatgagtgacctctttatttcaaacctttacctaccttatttgggccgcacatataatattcttttatccaatagaaatggacaggagagtgtatatagattagagagtgaattattattcttggataataagccattcattccatcactagaaaaatgaatggatcagataaatatacttcttctttccacccctagttttttttttctgtgcacatccattcaaatgataacgaacatatacatacatgcatgcaaaccgcattcatatctaaaacggattatactttgggacctgcgtatatctggctacactaatctgcacgaagtagccgctctcgttatgacgagttatttctaatcaatttcgtgagttttaaggtttgatggacctaacgtttttttagggttgggctgttaacatacatgcccgcatagtcatttggtgtcgtattgagccgtctgaaaaaaaaaagatttcaatcacatttttttacatgtttaagagtgaccgtgaggttttaacagttttgttttattaagcattgttacgcattataacaccaagcgtctgtagtccaacggttaggataattgccttccaagcaatagacccgggttcgactcccggcagacgcagtatcctaattttttttgtggggtgggtagacggcccgtttccattttgtattgttaagggcctccaaggctcgatgggcctcacggcaggaactgggccagaaccagtatttccaattttttttgtggggtgggtagacggcccgtttccattttgtattgttaagggcctccaaggctcgatgggcctcacggcaggaactgggccagaaccagtatttcccccctgtgtttcaggtaatccctttttgcgatgtaaaatggagtaccatcatttttagctactttagaaactaaccgtggaaccgaaatgatagaagcatgcatcttgctatagtacaggaaagctgaagatgaaacttgtataagctcataaccaggccgaggtacttcctccgatccatctgaatccttgtggtcttacaagcacctgaagacttttagcatgagaaa

SEQ ID NO: 1899 - DNA, 1705 bp, Zea mays
  misc_feature (1)..(100): optimal_loci_290662_G1, chr8:146017658..146019362, Cluster 11
tgtgcgctgtgcccggccataccataccgaccatcatatccagagccagaggccaagtaaagaaaaagtgcaaaacgttgggccagcaagcaggagcagtccaaaacgcacggacgcgacaagtttccggcctggcaggcagcttgtgtggcacgagaggaagcagtactacacgtctctctatgaggaacccgctggatcgcagagaccgggggtcggcctcatccatatccatcacgcaggcacaacgacggcgacgtcgggtatcagggctatatcgggtgtgtgagctggccgtagatagagtgtagacgtacgtgtagctgcagggcacacatgcatacatatataccacacgtcgaccgccagcactgcactgcactgcactgtagccatacgcgtcgcttttgttgccagccggccaccgggcgctgtacggctggagtagggcttccttttttttttttgcgcggtgggcgacgagaaaacagctgcgcccagcgccggggcatggcgacggcggtcctgacccccccaataatgcccccccccccccccccctgcggaggcgtaacatgcgctgcctgctgcgtccggcgtccgcggttggctacatgctacagcgtggaggtggatggatgggtgggcaggagcaggatgatgccctcggtccgccggcataactaactgcacgcgggcgtagcggcagacgaccggaccgaggcacacgtatttcatttgctgctgctggtgatgccggcgggggcctgggcagatcactgaatgaagcagtgtctgcagattatcgtactgcgtagtactaggattggtagatggacaagaaggtacttattcacacatagtagctagtaatagcgtcagtagagtagtagctgttgcacgtgctagtatttaccactggaacggcgcctgtcgcgaccaagcgaagcgttgccgattgtcgtactgccctgccatctctttaagcgacgcgttgctgctactactactgtgttcggcctccacttcccagacacaccaaacagacaggcgtcgcgactcgtgtcaacagctaccagcgccgcccgtgcctgccttgcctagctcggcggcaagacgacacgcgccgccgccgcccagtcgatcgagcgccaaccgaaagcggcgagcgcaggagcgtgtcgtcgcgatccagtcatccgtggggacgtggggtggggtggggcacgttccaactgcccactggcaatatatagcgcgaccgctcacggccacgggcgccgcgatcagaattccgcgcgccggcgacctgcagatgtgcgagaaggatagaacgaaccaatgcaatgactcggttgcgtcctcaccgggcggagcagctacatcgacgtcgtatgacatcaaatgtttgaatatcaattataaatattaaatatatatttaataaatctatctcattctttaatttagttttacaattacactatatttaatatccttaaacattattcacacactcgatactatatactttaatttagttctacaattatactatatttcatatccttaaacattattcacacactcgatactatatacgtacatattaaataatttattatcgcctatatttttataataaacttattatttacattttctataaaactagttaaaggtgagaaagtttgtcacttatttt

SEQ ID NO: 1900 - DNA, 1521 bp, Zea mays
  misc_feature (1)..(100): optimal_loci_2929_G1, chr1:15088803..15090323, Cluster 11
tcggttggtccacccctttagcgaaggggatggtcctgggttcgagctctgctctttccatgatttttccacctctgcctgagattttagggtactgagattttagggtacacacgcgtgcacgttcaccgtgcaagcggccaagcggcgggtatgcatccggttcattagatcaggatcatagttcattagaccagatcttagatgccatcgttactgacattctctcgtgtcctaccaagttagcctctgccaagcaggggtactagttgctgtaagccattgcaagccgtgcagtgccagcagatcagcttgtgcctcctcaaaacgctgtcccccacacggccacactggactagtccgtgccatacagggcctcgccgccatagtccgctagaagccaccaatccaatatgtaagcagttgcctctcgttgttgacgtgttaacctcgtttattacttaaatatggtagttcgctccacaacttgtcgctccatcaaagatagcagaaatgcatgcagatcttctgctaccgtcagaagtcctccttgcgcacaagaacaacatgcgtgtgtcacattagcaacacacctccagtagccacatcctcccgcgatgaccgtgcgcaagatacaaattgcctaaacgttgcaaagtgtacacctagcgtaaagcatgtgctgttgacctgtagcatggaagaacatcaaatagagtgattgctaagtatactagtagcatttcttaaagaatatcatgcatgcagttcggtatgcatatcaaaagctctttgtgcctttgtttccctcttgaacgaaacatcagctacgaataattgttcggttctgatattaattgctagcgacacatgtttggggacgaaagaagcagtcagtcatgaaggacgtcttccacagattccaaaccgtggcggcatttgattgatgagataccataccagcaagcaaaattaagcttgaccagcagcagaatttgacgtgctggcatttcccttttacttataccggacctggtttcgtggagcatctgcttatcgttatcgatcggaaaaggagtagagtgaccggcggcggcggcggcagtagtacatacagcgacgacgacgtggcgatctctatatacatctaccgaatatacggcggtcgagtagtgcgggtctctccagaccgcctcctgtttattcctaaaccttttccttttccttctcctctcctctaccttgcgattcctgtcagacgagaagatgccggcccggctttggacgacatgtgtgtctgggctgggcgtgggcgcacgcgcggcgcaggcgaatccgcgacgcaaaaaaaaaggcaccgcccaccacccccggccggtgcgaatggcggccagaccgccacggcctccgcgctggccgctggcgcccctgttgactcgcgtcgtggtggaggtggacacgccgcgcgttcgcatccgctcctctgctcttgcctctgggcaccgaggctagacgaactgg

SEQ ID NO: 1901 - DNA, 1899 bp, Zea mays
  misc_feature (1)..(100): optimal_loci_293205_G1, chr8:159114330..159116228, Cluster 11
tacgtagcgagcgttcgtttccaacgagccaagctggcatagtcgcatgagatgagccacactcctccacgcaaccaatcacaccgtatttgtatagctatacctctactagccactactagctggatggctgctaggccatggccacacggagcgactcgtggatgtgcccatgcttattggttccgaatcgtccgagcacgacataactagaaagcgactacggtaggcggcccagtgaatcactagcgtttgcttgttcccggctcttgccttttgcatgcatgggctgacgatgatgggcgtcggccggccggcgacggacaggagtagtagggtatatgatgggggatcgcatgcattgcatgcacatatgatcgagctttctttccactgttgctgttggccttgtccggtcgtcctcatgcacgatgcatgccaggacacgctattagctgttgggagttgggactgctagctgctaccgcctccccggcccaagatgagccatatatatacgacattgtaccacagcgtgcatgcgataccttgttcgtcgtcatgtggtgtgcagtgcatacgttgtgcactcggccagcaatgcatgcaaggagaggagagaaggtgcgtgggcgtgtggcagaggcatacagtgaaattgcaagtagccctgccagtgccagtgccagccacgcgcgcgctctgctgatcgggatctgcatgcccggcctcttctattcccagcggccggcacgcacgcacgcatgcatgcgtggtcctgatgtgttatcggcccagcccatgcatgcttcagtacgtgtcctgcgccgcgccggtagctagctagggccggccgcggccagccagcctgctggggggcgcacggcgttgtgatcggccgtaccgtgccccggcacatatactgttgagttgccttgctctacagctaggtccgtcttcaacgactcggatccatcggtacgtacgttcccgtacgtcgtcgtagtatatgtatatatgttcccctcggattcgatttcgatggaaggtgcatcgtgcatgcatggcgtagcagtaggaggagtattattgatgtccatcgtcagctgcacgccggccgcgccagctagctcgaacgaacaaccacatttcgttcgccggccggtacgacctgccgtgctgatagatcgacagccaagacgtacggcgatgcacggatatcccctcctgattcttgctagctgctagctgctagctgctgttttatttagcacagggcagtgcgtaggagtaaacattgtcgtctagtcccgtatttttacacactacactagagaccgtcttacaatctggatatcactggaattctcacctcctacgtcgtatttgtcgtgccgtgtcgtatacgtacgtacgtacgtactcgagactactcgtggatgttagatattcagcaggccggtccgtccgtaggcatacgacgtgtgccagccagctgccagcatagtacgtgtacatagcagcgcaagacgatagatgtaatgtggcatcgttttgatgagtcgtacgtacgtcgtctcaccgatcggtgggacataattgccgtagccgacgacgcgacgcgcttgcagttgaaggccggccggcttgctacacgtacaggcgtacagcggatagatgaacgagaacgagagcgcgcgtcttgagctggcggtgaccatgcatgcagcccccgccgtagcccgtagtaaatggacggggcatgaagatttgctgcgaccataaacaaatccaccgacaggagatataacgtaatgaatgtttcgtgttgccttcattatattcgtaggattttatgcataaataaggtttatgcatggtagattctgcccacagata

SEQ ID NO: 1902 - DNA, 1422 bp, Zea mays
  misc_feature (1)..(100): optimal_loci_293947_G1, chr8:162548940..162550361, Cluster 11
gagtcatgatccttttaaaaatcctagagctacaaagcatggcacggaaaacacacggcgccttgtatataaagtagtaattgcttgatgtgcgctaacgaagcatgaattcaggagcacaagatggaataggaaaacaaacaatattattgtagtaacaataaaaaaactcaatcccattacatggctcgttatgcgcaggtcgatcagccgagtcgccgcaagatttggcggccttgggtcgagcgaagagggagaccaaagccaagttttcggcaaagagacgagatggggatcatcatctcatcaaaggctgcctgccaacgtttccaccggtgagaaggatggatttctcatgttttttttttctttaagaaaaatctaggcttataccccacgcatacaatcctctcccttaaactaatcaagaaagccaagaaaaaaaaagaagtcctaccgctactactctagtagctggcatcaaccccaagaaaaccgccctgcaaaacatcaaagacattgttaattaccctctgacattgtactcttcccgtctactagttgaatatactactactactggctactgcatctggttcgatttgattgtcctttcagacacagaaacagtctctgatgcgatcactgtgatgctaagtaataatgcttcatacaactcttctttaaaaaaatactaaaataatatagtagtagtagtacttatgatgctgaatataaatactgaagtggtaaggattgtgcttagaagttcagaaagtttggaccgcacacactgtatcacgatgcatctatttgttttggactttcgtattattgctcatttgcttgcagatcactccaatgatggaaggctcgctcgcatgatggcaattgagcgtcccatccccctctctgtcagtcagtcagtcactcactcccatctaattttgctgctggcctttccgggttccaatgattgccgggaaagatggtagctgcctgccgccctgccccccacctcgctacgggggggcgttgttggcgctttgcttgcaaccaaaggagcatgccatggatgcatggccacgaacgaggaggactgccggccgctgcaccggctgcgacgcaacgcaactacaacgtaccgggggggggtccaggacatggccgtgccacggcacggcgagaatgcaggctgcggtggtggcccgactcccagaccggcgtactgctgctgctggctgtgctgacatgggaaaaaaaagttggtcccaaacgcccgcgccgatcgcccctcgctcgtctcatcacctcggacgtgtgctttcatcttacttcaccggttttttcttagcgaggaaacgccgtctacgatatcaacacgcacgggagttttgtgtaggaaagaatatgcatccaaaa

SEQ ID NO: 1903 - DNA, 1578 bp, Zea mays
  misc_feature (1)..(100): optimal_loci_294605_G1, chr8:166163918..166165495, Cluster 11
gcgtgctcctattgcttcttctttttccctagaaaaaaaaacaatttgtctataacccaaaaacacgctccgaaaatggctactaggaatctataccaagttgccgagagagtagagactccctcctggagcatttatgaggcaaccatctgaactagagtttagatacacctgactgactgagaccgatcgatcggcaacccgacttgtgcgcctctggcagaacattacaaggtggtgtagcagctgcaatacgccaagtcgccaatactagtgtttctttcgctgttaccatgactttgtgtagtaggctgtagagataacccttgcattaacaaccgttgcttggacgacataaggagattccaggcctcttggaggattcccgcatttgtttgtgctaaattgctggtggctaattaacgactctgaccggcgaagcaagtgaaagacaagtagcatacagaagcagaactcccgtgcagactctagtctagtctactaacagtattagtgcacagcatacgtgcagtagcgcaccaacatatggcatgaaactgccgcccggaacggtctgaacaatctcagttcttggcgcaacacacctttaattatcctgcttccacattgcaggaatgcatgatctctcccccaatttgacgaggcgccaaatagcagtatgcatgatctctcatcatcaccttgattagaataagatggtaagtcagcaacttgagcatagcagaaaatgacatgctccatcatcatcggtatcgggaatccccatccgttaattggaaggccggcagaaaatgaccggtgcctgcgcgcgcgcgccgatgatgattgctttggtcttgttgccttcgctgtcgatcgacgtgctgattgaaaaacatcgattactaaaagacgaggcaaaaatgcagtgctaagctagctaggttggctgagaaaatgaccataatgacgacaacgataagtgccggagctttgtgatcgccgaaaaggggtacgtctcttcctagggaagaaaagggagcggggaaacactagctggaacacaagaatctgcaaggacactgacgaggcaaaagtatgaagtacaactaacgtaacaattaaatctccagtagtaattaacagactcggttcaaaggcaaactctttttttttttgtctagaaaacagacaagattcacagcttaaaatgagatgttccaacaacaaagcattgcatagcacatggcgccatatatacagaataagacaactgatcagtattaagtattagaagaagaaaaaaaaacataatgaacacttccacagcaaccagccaatcagctgccttgcgcaaatcgacatgtcaagttgaaagatttatgctacatccaaatgggtttctcaggccggcttcagttgagacgctttcgtgtttctggcggtgagatgagttccaacattcattagccctttatataggagcaactattggttcagattttggagcaattcaacgggaagtgagaagcaacaaaggataaggctctgtgcctagagattgagatttgtcaaata

SEQ ID NO: 1904 - DNA, 2997 bp, Zea mays
  misc_feature (1)..(100): optimal_loci_2959_G1, chr1:15155754..15158750, Cluster 11
tttccccttttttcttaatatttccaaactgggtattacattggatcccatgtgctaaaatttagcaaggaactaaactgttattggacgctaaagtttagtacttcatctttcagcatttctatttagatatctaagagctaaattttagcgagtgtactgttaaattttagcctaaatgtttctgttgggctaaattttagcaagtgtactgttaaattttagcatattccttttagagtggtatgggtgtgcatagactaaatgtttccgttgggccctaatttaacgatgtgtacgcaggcctgtttagatgacttggtaccggcatatggcctcgtactgtttcatttgatgacgcgagcgtgcggcccatgcagcagcagcacgccgggaaggcagcggattttgaagtactattggacagcgcggcgcggggaccgggtcgttggcgcgcggtggagtgggggtgggtggtcctggcgtcctgccctgcgcgatggtcgatggatgccccatgcgcgtgtaaccgcccagccgtcgccatccgaccaggtgggcagacgtacgtacggtggcacgcccacggcccatcggccatcgcgatcgcgttcgtatcgtgtcctctcagctcgcagtcgcgcgcggagtgcagcaataacgaaagcgccaacggaaggcgctgtcgtcgtcagttcaccgcgcgccggcgccctgtgtcctcgtccctctcgacttctcgtccagtaagaactctcgcgagctgcggagctgctggcgatggccggccggtgggatccgacgtgcgtgcaacctcgaggccgcaaacagcctggtgacagacgaagccagcaagcacgtacgtacgcacgtctctgctggtctggatgtgtatggatatggacgtctcacgtctggacgtcgtcgtcgccgttgtattgtatcatgccaaccacttccgtaccgtaccccctcgcgtgccaacatgaccaccgccggtacgtctccatcgtcgtcggtacgtttccgtcgtcggccgtcggcgtctcaggcagctctcaattaagcggacgtgttttggtaatctggtggaacgccgcgcgcactgagggtttgggggccccggcggacgagcgagcgagagacggtgcatgcatggcaaatggcaacgagagggcccgcccgcccgcccatccaataaccaacccagacgtagcgcaaccaacgtacgagtcctgtgctggcgcgtacgactaccacgctagctgccgcgacatgcgaactacggtccaccaggcaccagccatgacaatatatactgtatatatatttttcttcttctttttgtttccgctctctcaagttcctgctctgctcctgcctgtccgcggtgccgatcggcgagagagcatgcatggacatggaccacgcgagatccaggaaccggcacgggcccatgcgtggcaggcggccgtttcgtcaggttccccgaaatgccccaactgcgcggctgcaggatggctcatggctggctgcctagctggcccgtgacagacaccgatcgatcggtaacgacgacgcacgcacctgaagcacaggaaggagcctccctctcgcatgcacgttagtactcccgtcgcatgcaattgcaaacacaggagtggtagtaccgctgcctggtacatgcagcaggctacctccgcgtgacacgtttcgaattgtttatttaatcgcaagcaggcccgagcttcctgtgcagatccaatcgaccagacaggctcaccaccgctaattcatttacgtatgatctttagaatccgcgggcttcatcaatcaatcaataataaagtggaagaggtaaaaagaaagtacggtactaaaagagaaggtgtaaaaaaaaaccgaaagaaaggaggggccgggggcccaggggtggactgtggtggagtggttggttttggttgagctcgcgacgtccccgtcggaggtgactggggccggggctggctggccagctcgccgcgtgcaagggcaaacggcaaacctattaagaaaacgaaagcaaacgcgtcgaccgcgcgccagcgagccgccagccgtgcgcgtgacatgcgctgaggcacgggcgcggggctcctggggccgccgtatcgtagcctttcctgggcacatcaacgcatgcatggcatggcacggccctagtagagtagtagtagtactaccctccggactccggtgtgcaggtgctggccactgcgcagccggtacgcggagccggcccggcagcggattcgattggacagagggaggggaggaggaaggaccgaaaagctgacaagggcagcagcggccactgccagcgcggtggttgcggtacaggtacagctagctactaggctggggagccgccacggctagtcgatagctgtggttcctgtgtcgtgtctggtctggcagactgggccagtggcattgcctgattacagaacagctttatgcttcattcaatcagtttgattgaaataatctattgcctggatgtgcatctgtatgttctgtagcatagcatgcgggcggtgggcagtggatgcagacgtgcagggaacaagacaaagcgatgggatattgcgtcaagtgggagggaggaggaggagactgcaggggaggccgcccgtcagccgagaaaaaagagccccctcctgtcctgtattgtacaccctcccgtctgcaccggcaccgctttcgcgctcgcacgaatgcatggatggatggatggatggatccggcgtgtcatcactcatcaaaggttcagacttgacaaacaaaagcaaagcgaacgaggctgggagcctgggactgggaatagagttgctcatcaatctcttcccttcccttcaactggcactgaattccgagcatgcacatcatcagaacccgccattggactagtacgtactataggggtgtttggttgctcctactaaagtttagcccgag

SEQ ID NO: 1905 - DNA, 2984 bp, Zea mays
  misc_feature (1)..(100): optimal_loci_299992_G1, chr9:13480201..13483184, Cluster 11
gtgtataagtttttggtactactcctgcctactgttatatatttcacgtattaaattaccttctaaaaataacgtataatcatgcataactacttaatctaattaagtggacggctcttattaatgattttactttcgcactaactatatatagggttggtgaaaaatgagacgttcatcatcaatatgtacataattgaagatcaaaattgtagatacaatattcattgaatacgcctatatatatattgaagtccggccgggaagtgtcgttcgatcgggctaaccatgtctgatatgatcctctgcaggtataacttctttgattgagtcgatcaacaacaatgaacatctgtctgcctgcacacaataacaaaaaggctgtcaacttttggtgtggtgggtgataaagggccggccggccggggttgtgtacatcagtattcagtacgagcattcgcgttgttactatctaggagtttgtgtacatcagtattcagtacgtaacaaaaattacctagttcatttttcaccaaaactttgtggacgcggcaacatctcatatataatagtcatctatctaggagtaactaattatatatatattgtacttttttgttagtgtgtttcttttaaaacgaaaggtttgatgcgtaatattgctcgcgttacgtgtcatcaacgccatgcatattatatatatgttaaggacggaaaccttctttaattcctaaccaaaagcttcgcagtacttgtgcaaatagggtcgcgagtcggtcgacccctcaaaaataaaaggaagttcatatatacatagctcccgaccatctatcgattttcaaagtcggcagcagtattgtttcagtggccatgccatgccatgccatccatggacccgtcgaaatgaatataacatcgtcgccatcaacccatccttaatccgtaggttccggcgaatcgtcgtccaaccatgtcgcccgtcgcgcgcggcagaacggaatcctgtgcgcctggtccccggcccccgccggccgaccggtggtctagtctactactaaaagctttctacggagagttaatggcgccatcgaggcatcgacgacggctaatggtgcgatctgcgacctcattattgcgggatcgaaaaagaacggggccatcgatggcagctttgacgaactagctcggtcgccctgtctgcctgcctatccgccaggcggctagctgccgcgtccccggtcgcccgagcggccgccgccgccgccggccgtccgtccgtcgacccgccgccatcatgagttcatgacggggctggcgcctggtgtttattgcgcctactgttattacccacgtacgtaccccgcgcgccactactactactacgcagcagcagtttattgctcctcttcaatgacagatcggaggcgctgtgcaacagcggtggcccgccatggatctctcccggcgcgcccgcccggccgcatttatgaaacgaatccgcgtgatccgacgtctgcgtgtgggcggggcgttgtagggagggagtgctgcaaatcggattctttgcagccaaattagtgaccttattgtttgtaggacctgaatgcaagcacagcggttctgattgaccttttctccaagctagctttatagtatatatctcaagccgtagaagcacgggtccttgattgacgtctgtaatccatatagacaaaatattatagaaccagtataattcggtacaaattaaaatcaagtgaatacaatagttgtgatcactccggccggtagtgaatgggcattgtcttaatccaattccacgagggaaaatacattatggcacataatgagtgtgtgtgtgtgtgtgtttttcatgtctatatatgatgatccactgatggaccggcagctttgaatactgcatcccccacttgttcctggaggcgcaactgtggaagccccaccaccgatgggccgccgggcaccatggtcgcttgtttgcgagctcgatcgggaggccgtgatcgatgtttcagatcagatcaatgggcccgaaaattagcttgccacagtacccaaacgggtaataatgacgcgagtagctgctccttatatatcatcaattcatcatcatcatcattattgttgtagttttttaataatatcccctagctagttcgagttgatccgttgtcgacggacagtttgtacgtggcggccggggatcgtcgtcctatccgtccgctactgttacgctgctagctccctggattctctcgtaggtacgggtacggccgtgcatgcatatgcacgcgtacgaacgcgcggcgattacagatctccatccgccccccgccaagtcactgtccggaccttcgggtggtgggggatccgcgcgcgtcgtcgtcgtgagaatcatgtttgcgttttgctccataacagacgcgtacggcgaacgtgtgccacgtgcgttgcgtatactagctataatatacgtgtgtcatcaggacacgtgtcacgtatgcacgtacgtgtgtatcctaatatacatacatacatacatactctgactgtgggtgttatatagctaccgccgggatgcatgaggtatacatgcatgcatacagttgtattactaccacctagtgtagacgtttgcacgtacgtatacgtcctcagtgtgctagctaatagtacaacatagatacgtacatagtaacgcacacatatatatacaccacccagcgtgcgagctaacatgaatatatatatgacctgaattacgtactactgtaagggtagtatattgtctgtctagtgtagtagtagtgtgtgttattgcagccggcgtacagtatctcgtacccacgtgcacgccgactgcatgtatattcaatcacgatacgcgcgcacgggtgagagtaaataggctccccttcgaaccggggaaaaccaaaggaaattaagccggccggggaaaaacc

SEQ ID NO: 1906 - DNA, 1451 bp, Zea mays
  misc_feature (1)..(100): optimal_loci_301175_G1, chr9:20325171..20326621, Cluster 11
taaggaatcgcgcacgcactgcagcggagggaacaaattcagcacatcgatcggcggcaatgatacaacagtagtataagagctgtccccttctttcaaaacgacggatcggagctatagctttacgatatatgctatgcttattaggttgtagatgcctctccctccaacggggggtgccgcgaggaccatgatctgccgagaaagaaagggcacagcagctagctagccagccgatcgattgagacgagagaaaccgagggatcggaacaaagctttgcaaaggccgggcaagtacgactggaatccaacgcgggggaaaaaagataggccggcccgcgtcgtcgtctacgcctaccactcgccgcttcccccgaaaaagagaggccggcgattcttgtgcactggaacagtaaaggagattgattattccccattcgggcggccattattggtggaggtggtggagtgctcggtctgtcacatccggtggacggagctagctagctctccgatccgtcgtcgacggcggatgcatccgttctctctctctctctctctcctttgctcgatcgcccaccatgtgtcaacgcgttgggccgcctccagtctccagcattgcttttcgccataccgagaccggccggccggtagctactactactggctcaatccacgatcgacgacggcgatctttctcgttctctgccgcgcgcgcgcgcgcgtgtacattattatactccctccggccgttctccggatgatatctcaacggatgttgaccgatggatggatcgatcgatcttgcagatcagtcagtcagagctaatgcatgctcgtgcctcattacattatatgcctagcatttagtcatcagttccgttactcctcactcagtcgtcgatggattctttcttggtacagtacacgcaagacgcaagacttcttgggcgatgatagcagctgacaagtaatgtaatacatacatacatacatacatacatgttctcaacgacgaaaggaattcttactggaatagtagtatatatattacgttgattgagcggtagacgatgatgcagacgatgatgcgtgcaagctaggtgcaatctcgcactgatcacgaccggggctaaggctatctgcaggccgctagcagcatgcgtgcacccgtgacacttcacgcttgatcagcttaattaagctcaagcgtcgagctagggagagatagcgactatcgagatatggatccggacggcgactctcgcacacgtacatgtacatcacttgctttctgctgccagcatatttgttactgctgagagatagaggcgacgtggatccggacgatcgagcagagctagcagctagcacacacatgcatatgcagagtgtgccagcgcgcagcgagactctgaaacctgaacgatcgatgatgtgattatgattca

SEQ ID NO: 1907 - DNA, 1499 bp, Zea mays
  misc_feature (1)..(100): optimal_loci_301733_G1, chr9:23326263..23327761, Cluster 11
taaagaaactaaataatatgtgttttttgaccggggtaacgagtagtatttattatttttttaatgcagaaaggtaatgatttcgatgattcgacgaacgttcgtctggacgaccggccggccggccaatggattcgactcgcgattgacgcggaaagttacgcttcaactattcctcgcaagtaattttactgagcgcgtggttactattactatccagtagtgcacccacgcgattgtacgtggtcggcacgtatatatgtagcgctacgtacgcgcgtagatttgaccctgtcgtcgaccgtgcccatgatgatccactaccgtcactagctagcgacgagtcatatatattataattatacacgccagaaaataaatgatgcgatgatgtggtagcaggatgttttcctccagatctttccccttttaccttcgatccggctgtggtctgaaggctgccccgcggctagcgtagtatagcctggacacaactggatcccagacgacgagacgacaccaacgcggggtccgatcgaaagcaaagcagcgagcacgtcagtacgccacgcaccgtgtgtggcccggccgctgctagcgaccaaacgtgagctttttcgccgtcacgtacggtatgtctgtcgggccgggccccggacgatcgacgcaaacgcacgcgatgagaggaacactgatctcgccatcgccgtcgtcgtcgacgtcgtggtggtcgccgccgcgtgttgtgttgtacgcgccgtatacgtgcatgcgccagccgccgtatagatctacggttcagaagatctcacaagataaaagtcagctacgtgccgtaaatttaatctcctccatcctgctagctctcgcagtgcgcgcaccgttaaaactgaaatgtcactagaaccgtcgcgattctgcgcttccccctttttttctggagtagtggaggagcggaggccggcgatcgtcgtcgtagtcgatgattcggttccagatcgcattagctctcgctaattagtaattacccatctgatatattcccggctgcctcgttaatttctccggcgcaatcatgcatgcgtactgcatggcggcagcagcaacaacaaaaactgtttttttgaagaagtcaaatatatatatattcagctagcttcgaccgaatacgtataatgaacaaatatattaataatattttatcgcgagtggcatttccacgtcacgcatgctttccgacggccggccgggcgtattacgttgctccacgagacgcccaggcacagtaacccccggtcggtcccctccctcccctacctgcacctgcactgcacgacgactggcgagggccgatcgatcgtgcaggtggtggccgatccgatgatccatcgtacgtgacagcagggcagaaaaggcagagggcggcgaggtgcatggctacatctggcggccatgccgcgccacctgtccttcccccttttcctcgtcggcgaaaccct

SEQ ID NO: 1908 - DNA, 1509 bp, Zea mays
  misc_feature (1)..(100): optimal_loci_313675_G1, chr9:99452166..99453674, Cluster 11
gttttctacgacaacacatctctagcacacccgatgggaccactacatcagctcttcatctacatgccccctcaaagaatggcgttgtcgggaacaacatcgatcaaagtgaatggccataagccaaaaatcggtccactccaactcgaggtcctcaactaggagctcttagagtactacaactagctaggtacttaagacctaggttgataagctcctaaaccatttcacatggacccgtagcaacgacatcaaggtcacgagcacttgaattcactactagaggaagtcaacctcgccacaccctcggaggagcgcaacgctgcccttcgacaagagatgaactacatgatccatcaagtgatggtgaaacagtcgaagatcctcctcaactccatggagaggatcattgcatgagtggtcaaatccattttggtcggcaacaacatggttccaaggcccacgtttgtgtcacatcaggtggagaagttttatactcgatcgatggagatgatgtagtttagagcatgataaggcatgaaggcggaattcaacatctatcaccctagagcattgaatgacatcccctcggtctatgaccaatcaccaacattcataccagaggggtttgaatgcaagctgcagtacatgctgctatgtgagggggaatagcctccccaacggtcatcccctaccactcaagataagaataaaaatagttatcctaaactatttgagtggcaggctaagtttgaaagtgggtcgactctcagcagcatgacctcgttttatggaggcgctgacatggctatcatgtaggaagaactattagggcttctcaaagaccagtttggaattctccccaaacagaaggagaccaactacatgaagccctattcgaatgagtttgaccggatgtcacctccatccaagttcaaggtcccttaattcttcaagttcaacaaggcccacaacaccatcaccattgagcatgtgagccaatacatagctcaactaggaatagcagcagcggtcaaacacatgaaggttcgactcttctctctatcgttatcgggacctatgtttggctcatatacatcactcgatcctaggtccatcacttcttgggagcaactagaggagcagtttcatgcacacttcttcgactttgataagatgatgatcttagacctcatcgtcctctgacaacggtagtgttggtcttcagaggcctgctctacccaacacataattcctacgacgcaacagacttttaattcataagcaaaatgttggcccaagcatcaacttgtttaaggtggcatcctgaggcctagcatggaaggtacataaagtcgatatcttatctataggtccaacaagaaagtgatgaagctgaggtcactatcgtcgattgggcctagggcgtataacccatctttccccccctagatcaaggctcatgaggcggtcacgggattcaatttcgacctcatggagatagagcca

SEQ ID NO: 1909 - DNA, 1420 bp, Zea mays
  misc_feature (1)..(100): optimal_loci_319856_G1, chr9:132819904..132821323, Cluster 11
agctgcaccggacacacgtctcgcgtgtgcatgcctgcatctcaaatctcaatcaactgcaagagaagctcgggcttcggggttgattgtgtccgccctttttttttttcaaacgcgtatcatcaactgcatttggcaacatccgaaagatgtttacggtttggccactgccactccaagtctctccagctagaggccgtagtacgtacgtgccaactcggtcggtgacaactgttgcgcgccatgtcaacggctacaatcaataatgagagggatgtctacttgtctagcacgcaggactacccggacccgcgctatgatttttctcttctacaatctacctgtcgctagctagcagtaggtttggtttgatttgtgtttgccctttctcgtcgtcgtctcgtccaagaagctcgggctcccgtcctctccgggcgtgtgggtgtggctgcgtcgcgtcgcggggagcggagctgccagcctgccaggtgtgccccgttgagcgttgagtatgcggtgccacttgggaactccgacggcgacgtcgtccccccgcccccggtcgtcgtagtggccaacagttgcgacgcccagcgcgcgcagggtatggcagctattacggcacgttttgtaattacacgtgttgcggcggttgttctgagagtcgtagaagcaagggagagctactggatgttctccacacagcgtgtaggtttaggcttcatataagctagctgttgttttacaatacatatatggtacaacttgtctctccttgagaaagttcgttaggagtgtgttattataccctattcctagagagtggaggaagggtgtcagattaacgctcgattaattagtttaagattagacaccatgtgcgcgcggctgcggatgaagaagggtgtttgattagacgggtctcatactcgaagagttctccggcccgttgcctgcatgcgccgttagcgacctctcttctttctttcttttcgtgaccgtgtatatgacaccccgaaatgggccggtagcccacgctagggattagtcgggccagatggcccataatcaggtcttggaggtccatgtgcgccacctgccgccatggccctcgcgtccactccaccgtccgcgtttgcgcgtcccggctgccggtcgccgctccatcgccatggcgcctggctagcttgacaaacgcatgcaacagctgaacccatgtgccggatcgaagccgcggagcgaaaaccgttgacctcccacctgcgcctctcgaaggggtgctgttcgttctggagcgttgactgtgacccggtagaggatagagacgggcatctgtaccctcgcttcacactgacgcgcttctgctcgtttagggcggtgcttggttaggttaggtggtgggtgcagcccggtctagttt

SEQ ID NO: 1910 - DNA, 1540 bp, Zea mays
  misc_feature (1)..(100): optimal_loci_321088_G1, chr9:138586953..138588492, Cluster 11
actagaagacttgttgcaacttgcaagtctaaaaggtcatgtaagagcccaaggcacgggttggaagaagcttgaacgaagacacgatcagctgcattgaacgtgtccgaatatgctctaagtaaaacaccggataacagaacgacagtatgcaccgaacatgttcaacgtgtcactaaatactgcacgtgacagtacttagagagattgcacaacaactcgagacgagctataacaaatgagacgagtcccgtgcaacaccggccggtcaatgcaccagatgctcgtgttcagaaggctgacaacaaccagtaagaaattgaacacctacttataaaactgtggtacatgcaatcttagactatgacggtgaggacagcgaaccaaacatgccccgttagttgctcggtcctacgcccggtcgtgctttcaccttgcacgtcgtttgccgttccaagggaaattctcacctagttagtgccctttttttgtgccagagagaacgaggtgctttggacgttgaagttcttcgtgcaacaaccggttaaaaccgaacccttacgtctctactcgcagacgcagtggttattacgaaacgtgtttcctttcgcaaataaagcacctcagtagtcacaccaagcggtgcagtacgtacatcctcaccagtagtagtcgggccatgaatagagagactcgtaaccgagtggagtaaaatggaatgcgttctatacgaattaagaaaaaaaacataaattccgtcctttttgttaggttgtctggtcacggctgcaagcaaaggatgtggctggtgcgacaaaaggaacccctaattaactagtggatttgacggccgtgggagatcggtttaatataaatactttgtttttttatttccttcgagacctcaccaaagccttcccaggtcatagtagtaagaatgcagagtacgtactagtactggcctccacgctctagaaagttctgggctcactccgcgctggacgccggctcaccgtcaccatcttcagtcaactcaaacacttgagagagaaaaaaatacaggaaaggagctcgattgctaatgacagctgttctcctaatgacaaccgctaacatggacgagcggggacacacgacacgagctctcaagtctcaactgccgaatttgtgtgacctgcttttgtcgggaaataaattacctaactttttttctctatatatatctctctctcccttcatttttttttttgcctaacctttcaatagttccactcaaagccgttccctatctaatttggatagagacgagtcatggcctagagattcagacagatccgttctactctaatcgtttgagcaatacctgaatatgcaacataattatagtagctctaaaaaggttaactttattcctttcctcgatagaacaaatcagcgaaaacaaatggtcaaaatacaagtggatagcatcttataagccttaattaatgcagcgaagcatggtccttttccagaaggcctaatggggatccatttctgt

SEQ ID NO: 1911 - DNA, 2546 bp, Zea mays
  misc_feature (1)..(100): optimal_loci_321863_G1, chr9:142819624..142822169, Cluster 11
gttcgcacggtctaggaacatctctaatagattttctattatcaacctttatattaaactttactttatactgtgtttgcacattttatacacgctccgtacgtagaagataaaggtgtcgaatcaggacgaaaagtaaagtgtgagcatcttctcgagaatcatggctttctaaggctatgacattttgctttccatatttgatttataccttgctacgtcattgtgcagatatattattttatttagccacttaacttgcacacctaaaaggtttttttttttttttgcaggcgcatttgagcagtttctgcgcttttttccaggcggcagtcgctgggcagtggcccatcctcgaggagccagaaagaacggttaaccttcaataaacggtggcttggcgtagctgtctttctacagggatgcggagcggggggacgagactgtttacagcatccctatagaaagaacgacagatgggctcccgcggtcccgcctcccagaccccagtatatccctgaacctgggggaaacactgtgtatatatgcaaatgcaacagaagagatgcaaatgcaacagaggagagaagagtatatgcgcgcgtaaacagtctcctggatccctctgacaacaaagaaacaaacaagcaggagtaacgacgagtagacagcgacggcacgagcgaacgacgcctgcgcactggtcaagcgtagagcttgaattcttggtgtggctgaaactggaaagcgtagagtatactgccctgaactgaagcgcctttgttactgaagatctactccccgagaaacggtgacaggaaggtgaaatcgctcgctcagccggaatgatgcatgaccaaaaatctgtgcgcgtgctctccttggctcctccctgtgatggctactcctgctaaattgctcgaagctagtagacggtagtagtagtgtagtgtgcgtgcgtgtgaggagcagggatcgacgttggtcccaggaataggaccaggtatggctccgtccccgatggaacaggacgccaaccaactgcactgcatcggaggtctacagcactaccgcttttgtcttggctgtgcttttcgtctgcgctctctcctctcctctcctctgttgtggagcacgtcgatccatcttccgctctttgcctctttgggtttttttttttgcttgcttgtggtcaagtccggttggaaaggccgaaggagacgagcgagagggggtcccaggctcccacccagcccggcggccgcgcgcgtccctttctccttttcggatgccccgcgacgcagcaccgcggcagcggcaggccatcgtgccgagtcggttgccgcgtcgccatccccgctacgctatctttaccctggtcctcgcgcgtgttgttatttgttaacttgtcacaccaccacctcctccacgtacgccttcttccctttctccctctcggcctcgacgccgactttgctcgcgctgacatgtactacaaggtacgtgcgcgccgggccggggtgcctggaccacaccacagccggcgtccaaacatactacacggaaaacaggcgcggcggatgccacgggcgtgggcggcgtgtgtatacggcggcgtcggcgacatccataggcttatgcgctggacgatggggacgtgacgggtggctggcgtgggcggcgtcgtgtatacggcggcgtaggcgacatccatagtccagcatggtgctgtgctgacagtactaggaaacgaaccacgtggcctgattaatctgtgtagccgtggtcctcaataccaccctggcgaaaagtggcgagcgtgccgtacactactcgatgcgcgcgctcaacgcatacgacaggatgccatgcaatgcaggtaaaggccagtaccttctgcggacgacggcggcagtgcactgccgtatacgacaaggatgtgacataattcgtcccagttattactgcagctagtataaatatacagtttacacaagcatgagcaaaataaggatatatataacgacagcagcagcaactgttcgtcgtcgttagctacaacgcctactactagctgcatgcgttgacaaaactggaaggacgcctgctagacctaacaagttttctcgtcagacgatcgtgttcgtgtccagctgtgtgcgtttagctagcgtgcgcggagagaaccagcccccggccaagaattggaactcgggtgtcgtcctgtgtgtgtgtggttccttgcgacaaaagcaacaaggcttcatcaactagcttcaagtggtcgcgtgctgcgtgcatggacaaaatcacaaaaggcgcatgtgcgcggtgcgccacacggcatgagagatcgtcaattggatgggatggtgcattatcagcagacagcaggcaactaagtgcacaacaaagatgaaagttggtgctaataatagagcctatatacctagcctagctatagctatatattaaggatctactgtagaagggtactagctactatacccatctctctttttgttcctcagacagaccttcacgtc

SEQ ID NO: 1912 - DNA, 1700 bp, Zea mays
  misc_feature (1)..(100): optimal_loci_322827_G1, chr9:147650987..147652686, Cluster 11
tagtaatgcgcatcgcaaataagcacacgtgtgtagagtactatatgcatgggcctgaaccgtaggcaaacataatcatggaaatctggcgccttcccctctctgatcgatctcgtgcccgtcgccgccatcatctcgatgcacttgccaaacactcaaacagagctgagacgagaagaatggtgagtgatgaagcgttggaggagcggatcattgggggtggatctgctcttgtccgagatctgggagaatatgcaaacgttttatgggtggtgctgtcactgtactgtacccggtgcctgtccttggtgaggctatggaatcttttcttgggttaaggacctcccgctgcagagacagggaatcgtacgaaccatgcagtacacacattacttgtcgtcatgttggacgaatggaagctatgcgcctaccagcagaagacccgattggtcaagcgataggtcaatttcaagggagagagagagagagcgagcgctggaaggtggctgcgagtctgcgaccgtagtacagtacgttttccgtttccagtgaagtcagtcatcacagaggtcgtgggacggacacgtggtagtagtagcacaaaccagaaccagcggaagggcccacgccaggtgtactcccgtgtgccagggcccagggccaaccaacacgcgtatgccgcggttaaacggacgcgacgacgacggagaagaaccggagaaggcaggcctactgcaggtgcagcaccctctccatgaatgggccaatacgtgctacagcaccctgcaccctctccatctccaacgccgtcccccgtcacctgtgagcctgatagtgatactgattgctggtcttcaccgtttcactgtagcctcggctgctgcgcacgctgcagtagtcggcctgtctgtcacacacagccctccatggtgacttggtgagaggggagggacaggacagacggctatcggcaatccgccctcgaaagccgaggattcttaatgccttctagctagcgaccctaggtttacagcgccatccgcccatccgcgccggcagtttttgtatccagtccagcaagcactgtggcgggaggccgggcggggaccagggaacccctcgccggagccggaccggtgactctctcaccgcgcgcgaacagttccggataagatcagcggccgagaaaggcggcctgccctgtgcgagctgcatcccattcacaggagtgagcactagccactagcagggctgggctggcgcgttcgctttccagcctcgccgatggcgtacgtgcatggccttggcactttggcaggcctgcgccagcacccgtgctcgcgttcgcgtcgctggcgtggtgttgcaggtgctgcggccggctgcggccgcttgcttgaacgacacaccgccgcgcgcaggaccgtcgtcctctgcccccaaatccccaatgcattaccacccgggcacggtgtcgccgagtttggtgacctgtatttgtccaactacacttgccaccaccacctatatcttttggtcgtcatacaatacaatacactgatgatataccacctccatccgaaacaaaatctaaaagctcaattacactctttgttcaagtatctacaatttaataaagttaacttttgcgacactgtattttatatataacatggaaatatctggtatcatcaatattg

SEQ ID NO: 1913 - DNA, 1676 bp, Zea mays
  misc_feature (1)..(100): optimal_loci_345198_G1, chr10:122268382..122270057, Cluster 11
cgtcatcatgtctcgcatgtgattgacgcgcgaatctggttgcgccgcgcggtgcttttccggggaacaggacggctagaacggggaacaattagggtcgccgccgttgcatgccatgccgctgcctaggctggcgagcgcgatttcttttccgttcccgaagccggccggccggcgcgctggtacagtagtagtataggtatagtagcccgccctctctctctctctgcgtctttcccctctatgcatggctgaatggctccatgtccatggccacaggggcgggcacggccccagacttcaaaaaaacgccagggcgtggatctccagacaacggccggcggtagtatgctgctgcctgtccgtgtgacgcgataacgtggcggacacgggggttgtccatttcctctcgttcccacgcaccggcaagttcgagagctgtactactaggagcaagagaaaacccaccgagagcgcggtggaactgtggaagaagcgcatggactgctccgcgccggcctgcccagcccgaccacagcagttgcagagaagcagcaggacaaggcgaggccaacaagcaacacagcgaggcgagctggcggtcaaagtggccgggcgcgcatgcatgcaggggctagcccaggacacgtcgcgtccaacagttcggtgggtgattgggactcgattccgatgagacgagacgagacgccgtgatttgattttgatttcctcactgatccgttctccgtcctgttcgcgcgcatttggctagctagggctaggcggctaggactggaatctagtggagtacgagtactacgtaacgtactgctcctggctccttccactgctccatctcgcgctagctaggtacagcatagtgtatcgacagtctgctccaggccacagcgtgggagaactggcaaagctgctagccgtctagctactaccactgctacagtgctactccactagctaccggtggctgctttctgcctgggtcacgccgtcacagcactctctcggcccagccctgctagctgcagactagcgcagctagccatgctttcacctttcatctttcatcaacgggaagcgctagctgctgtactatactgttactggaaccgacgacgttgatcgaggcgtcaacgactcctgtattcctactgctcggggtccaaacggtgcgcccgtttttttttttttttttgttcttgagccgacgagcgtcagcgtcgggtggccggccaatacgtaacgtactcccgccggcccatgtatgcatatgccgcagtctgctgctatgtgctagtatgccctatatatagctgctgccttgcctacgcgagcgagcgagagagagaagtacgaggtgattttgatggttcgttcctccactggcgccgctggcactactgtgcgattgtaaaaagcgatgggatagatgacttgtcaatgacggattgataggcgcgcgcgtacttgccctccagacactgtcgagcgctgtacgtagtaggcattattgtaggagattgtacagccctatgagcaactctgatgcttcaaaactagtagagatttttttagaaatttgaaacccaacacgagctacagcggaatctcacagcttccaaatttggttcgagagacccccctcaaccgtattacca

SEQ ID NO: 1914 - DNA, 1862 bp, Zea mays
  misc_feature (1)..(100): optimal_loci_345199_G1, chr10:122270362..122272223, Cluster 11
caagccctgaagcaacgtttatttatctttcctttctccagtccagcgcgagcatacagagtctcgccccgcggtgtccacatcaaataaaatgtaggacccctgatccgagggtttctagtggagttgatgataggttggtaatggaccagatagcgagttgagcttgagcatgtgtgccccggcccgctgcatgcatggacgcatggagctggccctggcctggcagggggggggggggggggggggcatgcacgcttcctcgagccatgatagctgccacgcgcggggcatgggcgcatggcgacggggctaaaacagcgagcggtcagtgacgtgaccatgtagtccacggtagggccggccggaggagcaccggcgagacgggggccagccaaaagccccgtgctggcagtccctcacatgtgtcgccggccggcccgttgctctgctcctccagccccgcgcgcagtccagtcacgtgggggcgcaggcgcagcgcagagccgcagatggcctcggcccgcccccgccgtaccgcgcggcgtgctccggctcctcccgtcccgcggcacccgcgcatggcgtaccagagcctaccagcagcagtccagccagcacctcggctggcacgtggcactgcagtagcagcagcagcacacgcacgaatccatgcgctcggatatctctgcagtgcatgcagtctgcatgctatgcgtgcagcggccgcgaccgccgcaaccttgttcaccgcgcgttggccggttcacacgcacggcggggcgcatccgggagcccggcgaggaatgtggtctctgctgccagtcagacgcgggcgccggactcgttcgaattcgcgcgggctagctgtaagcttgcggtactttttttttagctgccggcggctcagtcccagaaagattccgtgcttaattttttttcccgatagcacatcacatgctggtgtagcctgtagataaacaaccgcgtgctgtaccttttttttttgggaggtagcatactagcatgagcttcctggggatacgtcgagagcagttgtgtgggccgagcaaagcaagcgaccaagcggtgtgcaagcaagtgtgtgggctatgtgacacgttgggctacaatgggtcagatgaaatttactcccactcccaacacaaaccagatgaggaggtgttttctagctacataatttctactacatttttttccccttcttcagactccatagaaagaaaatgacaaggtataaggaacagcataaagattagcatcggaaggaatttaaattgctgctgcaatacatgtgtggctagccagaatactccacacagcctgcgaaggcgacacgacattcttcgattattagcataaataggggaaataaatagtcagtaaaaaaaatagtcgcggcaggttagctagattcagggaaagggcaaacaaagggtgacgtgactaccattcaccgatacatacatgtgttatatacgcaatgggaatggaatgaagtgttcagcgtactaatttgtggttcaaagtacacatagaaccccggccataaaaaaggattatgtcgccgcctcgtgatcgtgaagcagcctgattgtgaatgtggaactatatagtaaaacaaaaaagaagaactgaacacaatctcatcaatcatttgtatcatgtatttattacacaaggacaggataaagtggcagctttacatggctagatgcaggtgctaatgatcagtgaagttctgaaatgtgacactcggatgcaactttctgactgagttatcagataaaaaaggaaatcccacctgtatatggacattagactggcttcaacggcgcacg

SEQ ID NO: 1915 - DNA, 3006 bp, Zea mays
  misc_feature (1)..(100): optimal_loci_346851_G1, chr10:132346201..132349206, Cluster 11
acatgtacccggattctcttatattctagtactttgttgctgctggttgaattgagatattagtgttgctaacagcccgcgcggtagaaagtaacgacatcagctgggagctagctagctggtagaatctaggtatagcacaagtgactttgaggttccatattgctctttgttgtcaagtgacaagctcttattaacaatcacagtacgtaactggcttcttcttgcgtactacgtgtccctgcaagtcgacatcgaccatcgttgggggcgtggccagatgatgtttgcagcaagttgtgagtgtacatatgcgtgcacagacagtaaaacgacaatcttgataatcgcttgattcttaattcaagatcgactggcttgcttgcgtagcgaattggcctggccgccccttgcatgtccttttgctgttcttgattgacgatgacgacgaccttgacttatagttgccgcacgatcctattatatccgtgcctaaactaactaacaaagtatgcgtctagcctttgtcatctcatctaacttttaccggtgccaatcgacgaacatatatgccgttgcgtaaaagaggaatgttaattaggctgagtccagcagcctgcgagtgcggactcggaaaacacacacagctagctgagggacgagcgtgttcttgcgaaaagttgggggaaataacatagatgatctacgatataaatcagatcagcatcatcatatctcatctcatctcatctcatggaccttggctttgcttcgacgacggcacatgtacgattgctcagatactaactgtgcgatcatacaaaatggtaataacatagatggtcgaggagaacgaaggttgacaagaatatatctccgtctgcagaaggctcccgacatatatggcgtcggtcctcaccttcctcggaggctcagctgaaagcctgaaaattttactcaaatgttcacaaagcttatatggatgactacgtacgtacaatgagcgcccgcctcgtctcttgaggttctgaatttagaaacgcctcctcacgagccaccacacgcatggcggccgcggacgctaatgcggtgaatttacatgagattttcatgagaactagtctacttcgttttcacatgacaataagttggtcaagttgcccggtaaccagtccggatctttctttttctttttttaaaaaaaggagagttgttcaactcgtgcgagaaaatccagataagattgtgccgttttactagcaggcccttgaggctagtccacgatgcaatacgaattaaagcctcgtcttcattacattacacggttgtagggaaggcccgcgtggtgggaagcaaaggcccaaggagacctattttttttcgagcaaaagtgttaagcaaagggtctggtactggtactacgaatctcgccacgcacgtaaaaatgcttcttttgcgcaagcaatccacacggaatactccttgtgcacataaatatcacacttgttatgaaatgtatttcacgaggatatacatgattattgcatctgtcttaaaaataagtgcacttataggattttgtgataagcaacatgaaaactacatattacctcttttggacgtggaataacggttgtgctttaaaagtagtgaaagtaaaaaaaagaaaaggcctgtcaggactaggtgtaacatatatacctacaagtgcactcttgttttagcagcgcaaatttgagatgctagaaggtatactcactcagggcactccaaattaaaaagaaaaaaaaaactagatggtttctatgattaataattaggatatcagccaaacaaggagcgccacagtgtcactgccactccgttctggcgccaagaatggtactacagtagatggaacccagccgcgccgaacggatgtggagcggatggcccctgctgcgcttcccttcccaactagcggatgtggagcggtgtcgcttcacttttggccgcgcggctgggtccgctccacgcaccacgcgccgagtcaccagcctgccagcgtccggtccacgaatcacgtcccgtggactttggacgacacgtctctgacccggctgctggtgctggatggacctcataatcaggcaatagattgcctagcctaggtaaccaagcaacaaacatatggctagtagtgaaatgctgcgactggagtaccgtcagctaaacgcagccggcaatccacgctctgattgacacagcagaagccggaagccttttttttttgccgggctagaagcctacgtctacgcgccgtgcatccggtgaacaggtgatgtggggaaagcgaccagagcgaagccccggaaaaacctggtcgctgttaacgacagtcagcggtgtagcgatccaacagtttgtgcccagcacgcgatagcagtacgtacgatgcaaaacgatgccgggacaacctttcacttccagacttggattggacacggtagctagctagtgttccagagttcgtttcggtgcgtgtcttcttcttcttcttttttgtttcgtacccacctgtttttggcccactgctgggacgctgtccgtggtagatgttagatccatcggtacgaagcccatgccaagaattttttggcagaaactggtggccgcttgtttttccgcccgtccgtccgtccagtgggctgcgcgtctctctgccctctccgtcccctcgtacgtacgacactcctaacgattccctgcagcgtgtaagctcaacaacagtttaccaaatactccacatgtataattgagcactatacatcatggcgaacgtaacacttaccaatagaccataaaaaagaagaggtcgatcagcacataaaactcataaccgagtgtgtacgctcttagtactaccccgtagatacagcaaaaactggtattaataaaaacacccaatgctagctgcccataaatattctgtccgtacccatcccaataataaaagagcgcaactta

SEQ ID NO: 1916 - DNA, 1519 bp, Zea mays
  misc_feature (1)..(100): optimal_loci_347549_G1, chr10:135691591..135693109, Cluster 11
ctcgtgcgacgcaaagtcgaaacgccggacctgttcttccgcactagtaggatacggacttttgtaaaaaaaaaacgactcaacacctggaagtcaaccgtgtgaagtcgagggactagtagtactactagtatgctagcgctaaagatttctggtccagataaagcatccaattttgacccggcgacggcaagacgggagaggggccagcaaggggtattggctgttgcctgttgcctgttgcctgtaggtgagttgagttgagtggcggccggggagccgccacgcgagggggagagggcctcacgtgtcgctcgagcacatggtgcacaccacagactacacagacagccgacaggtccacagcgccgtccccgttccgccacgtttattggccgaaccttctgggctctggcgcgctcctcgtctgcagccttcaagactgaagacccatcgtcttgccttgggagttgggactcccgcagctaccgtggtcctcacgggttgcctgaaccctgaacacaagaaccgggaccccggggtttttttgaatggtcaaattgccctaggcagactagtagagagactgtgcttggtgcttggtgtttgcatctgaactgaagcatccgttcccacgcaaccgaggtttaacggtaacggaacaccactgcactttgatcctttccttgtggtttgttgtgaacgaatctgccaaattacgggttcatggaatgaaggattcgttccgagggttgtgccgctgattccaatcagaacggaatgaagttcgatgctgatgctgtggattacctgttccccatggtgcgctaggtcacaaatattccgccccccggtccctagttcgcgccgaacacgaacaatattcctacgggcctggacggcacgcacaggcacagcacagaggtgggcacggagcaaaagcgacgcatcaagcatgtggcctgcgtcgcttctgctgcggttcgcagttcggcgatgtgatggaggcgcaccgcggggccgggtcggccgtcggcggggggtggggtgggtgcgagcgtgtggtttgtaggcgggcgaccggttgggaaagcgacgcctgcctgcatcccctcccgcgccggcgttttgtcaccactcgccctgcaacagaccggagcagcgcgggaggggaagcgaaaatgcggtcctgcttgtcggcctgtgcagtgcagcacagttgccggccgttggttcttcttccactcgtcggcgggggctggggccagggtagcagtcagtctgctgttacagatcaaccccacgtcggttgggggcgttgcccgtctgatccgactctctgttctcgcgtttcattccatcaccatgcgaccagtgttgtctgatggaacgctgagttgagcagagtggcatctttgtgagaattcaacaaaaagagacgagagacgctagttaacgtaaacgatagcgcgcgttctgtttcaaaactaactttgagaagttggaattagaaacaagc

SEQ ID NO: 1917 - DNA, 1427 bp, Zea mays
  misc_feature (1)..(100): optimal_loci_348259_G1, chr10:139298815..139300241, Cluster 11
aataaacactgccagatgtcaaatcaaatccgccgcgtatctgaccgaactcgttgcgctgcacctttcgtgcgcgaccctttgacaataaagaaacacgtctcgcacgcacgcacgcagggtctcgtatctatcctagccacacgacgacgagacgaactgttgggcgtctgcatgctaggtaaggttcgctgtgtctgtgtgcgctgcgctctctagcgagcgttacgtcactgtggaacacgtaccgagaagatttgacgtgccgtgccgtgccgtggccatttgcgcccacatgcaccgccactggaaccacacatccatttctgtcagtcagtgtagcgcgcgggtcgacaggcacacacgacacggcacgtaacgcctcctattcgcaggtcaggttttattcgcctgggcggcccagcactccacttccactagctagctgccggtgaggtcaccacgcgccgctccggattgacccgctggctggcgagtggcgacggcccgcgaagcggaaggaccgaaggggacaggaggacgagccggaaacgagcacggcctgaagtctgacctgctccaaatctcagtggacgcaccggcgcccgggacgaccaaccaccaccaccacttccactcccttgctctgctccgcaccatcaagtcaacctgttctcgtcctccctccccacgacgacgcacgcgcggggcgcggtggagatggtaggccaagcctaaatggagccacggtggaggtcgctatccatcctaggccggactcgctccatcggcgcggcgcggggacctgcagacgcccctcgctctcccgtccatgtcgctccaggaatgtccctagcgctccggtccccgctccctttccgtttcgattcgggtgccgccgtgccgggaattgttcgtgcagcggtgcagcctgcaggtgcaggtgctgacctgctgtaaacctgtaacgcgcgcggttcgagtttgtaaacctgtaacggtccccgctccgtgctgcgccggtggacggaacgccagtcactcagtcagtcggcgggacagtttgcctcaggtgcgtgatctttttttttcctctcttgttggagaattagttccgagagcataaaacatcatgggaacggccggttgggctaggcaacgagagtcggcccagaaaatatgagaggcccatatcaatggtagactcagttctcctttcatcaagcatttcctctgggcctactttttcacctggacctcaaccttggagatcagggataccgtcatccctctaccataaggcagcccatcgacttcccattcggccagcgtactcggcccagcatttgtcaggtgacccatcccgttaccattgcattgtttataaactagtggatgagctgtttgagatagccgcttgtcactct

SEQ ID NO: 1918 - DNA, 1540 bp, Zea mays
  misc_feature (1)..(100): optimal_loci_348380_G1, chr10:139882335..139883874, Cluster 11
ctctttaatccaaacagtcatgtcgaccaccgttgaaaggatgtaccacaattaattcatagcaaaatgtgagtagtttaattgagtcgatgcctcggggtatcggccctctcgaggtccctaaggattagttatgaccagtcgtgctaggaaaaaaatcaaataaagagaaaaatgattagttatgatcagtcgtggtatccacaaacttatggaatctatgtgcatgccacccatgtgtagaagtatagcatgatgggttgtttggttacttatgcatgtgtaatttggtgcacaagagagttacctcgatagactattcattcaaagcactcatcagatgacagatgatgatgcccggcctgcagaaattagcaactttgactgtaccgttctattccaaaatacatttgcgcggcggggccggataggataggacagtgtagctagctctgtccgggtgtcaacggaagcgtacagtatgaatcagcgacgtttagacaagattagacaatgagttcgtacggtgggcaggtgtcaccgatggagcccccacaccgtacccggtgaccacgagaccctctgcttgatccaacatcccaatccgcggctagggtattatgattacgtctgtgtttttgtttcggactgcaatctataagacaaaaacattgcaaatgcattagaaatcagttcaaattaaagctaaacaattgagcaaaacggaacagaggtctcctttctgcgaaaccctttgcacaccccatcaaacggtttcctcgtccagggtcctgtcccgtgtgacatgcatggccgacggagtgatggctgtccgggtctcccggtcactgcccagaccccagagctgactgacgtccaaattccaatgaccaatgcaagacagcgagggtctggaagtctctctccgcgctccgctggcgtttgcgtttgcgtgcgaaatcaaacgcctcgaagcggaaatataaaatatcgcgagggaaactgaagacattaacggacgtggacgctgtttcggctgacggatccattttcccgcgcttgatggaacttgatcgggtgagaaaaaaagatccaaaaggctccgttgcgtcatcgcgtggacgaggacgagactgcaggaacgggaacgggcaatggcatgctgactgacaggccgtcatcgcacggtcgtgtctcaagtgcagccgcgaggagtacactgtacacggtacacgtaccgacgagagggcggatcccgttccttcgtgtttggtggagctgcagcggaatcgctagctgcggagggatccgatgcggcgctgtgcatccctgatacctccaatgccctgcgttattcaatcccgatgcttatcttcgtcttctcgccctcaaacaaacaatttccagttttcactgcatgcatggtaatcgttagcgctgggacctttcactgcatggtacagtaataattagcgctgggaactgatgccatttgcgtcatcttctccggaatgaacgaacactatcactatccgctttc

SEQ ID NO: 1919 - DNA, 1486 bp, Zea mays
  misc_feature (1)..(100): optimal_loci_349253_G1, chr10:144515021..144516506, Cluster 11
cttttcagaaaccaaagaaaaggcatgcatggccgctgctatatatcccatgattccgtttactatattcatgtatatgcgtcacggatgatatgcatgttctcagcttcagaaaaagaaagggatcggtgcagtacgtagtggggttactgcatgcaggcgctgctgcactgcgatcgtgcttgctgacagcacaagtatatggtatatggtacagcgaaaagaaaagctagctgtttggttatcatgtgtggctgatgcatgctcatggagatgcattatgaggatgatgttaatataagaccaatgcaagctgatgaagaagaaaaatagcctatgctgtgccctgtccaataattgatgcgtcgacggtctcctccctatcctggccaccgatgattgatggagcaagtagcatggagacacttgcccacccaccgttctcaaacccagcgagaggaagagagagatacgtgtgtgtgtgtattgtatccaagacatatcttgcaaacatataataatgctgtccatgcaatcatgcatgatacatatccttaaccatgcatacctaacaagacgctgctccaagattttttttttaaaaaaaaaagtcagtcaaaagccggcgtttccttggacggacggaccaacacgaaatgtcttcttcattccttcgtccagtgagaagctctgcaccagctgcacgccttcttccttctgcaggctccaactgccgatcgagacttgttcctggtcctctcctgactgacgacgtgatgaggacgaaggcacagcttggagtttcagacgatttcacctcctcgtcaggcaggcttacctgcaggctcttcccggtgcaaattctcgagattctcatgcctgctggtatatgcatcccaaaggaagctagagtagtgttgcttcgctggtcttgtttcgatcaggtcaacttctgcacagatgatgtatatacctcacgcgcgcgtacgcggatataccctctgaagaagacccatcaccgttggtgctgaactttcagtcctagccaccagtatgagcagcacactgatcaatcatgtcggccacgcagaacgtcaaaatatatttatttttttgctgacaaaaaagaaacgccaacttgggctccgattgcgcgttttccttctcgggcgggccacagcctgagagaataacgaacgaccaaaggcgcaagaaaaagacgctgtggacggtggatcgaccgatcgtcgcctcctccttgcttactgtacgtatttggatttctgactgggttctgtacctcagtttcactctccacaagatgatcgaactagagtctattagacgctttcatggatcgtcttgctaattgaagatcatagtactaactactaagcatgcagcgaaagccatcacacgccatcagcttataggccacatctactcactgatcaacactctataggccggccgccccgcctgccta

SEQ ID NO: 1920 - DNA, 2781 bp, Zea mays
  misc_feature (1)..(100): optimal_loci_3605_G1, chr1:18639579..18642359, Cluster 11
ctaataaagcgagaaataaggaggggatggttggagttagtgtgttttgattttagacttaacacctccaatgcatattttctatagcagatttttttatgaagaataccatttgatgaacaccaacatatattaaaaaatgagaacgatcatacgtggcatggcagtcatatagcatgagccatgatagcataacttgtgtggttctcttctcctcactctagcatgtaaatccagccaacatggtgaataccgtgcggagcgacacatttgaacccaagcctcccgcagaggcaccatgcaacaacactgcacgactagctggtttcctctcttgatccgcgagtagactttgttaatccctttcatttccctgtctaccaaaccagtttttagtgagaaaaaaattgtttctatgttttctattctctctattaattcatgtgggtaccttagcaaattgtttagtattaagatagttaagggtccatttggatctactcggaactttagagctctaaaagttttagagcattttaattgagaaagcaggctaagtttaaagctaaatctatatcagctctaagtttgaaggagtgaatctaaacagactataaaacaaatagaaactactattaatgttctattgggagatgattagtggcggtgtggtggccattaggagaggattagtagtagtggcgtggtggccttatataggcccaccacagccacttgcgttctgctgacgagacgaggcccccctcacgttgtcggtaattgccgttgcctttgcctttgcttgcaggggaggggaggcatttttgtgtcctgtgttcaggaacgtgtcagtgctccgtaaacaaactttatctggcatttgattttgaaagtaaaattcaaataacaggctcggttttttatggaccgtttagttgtctccgaactttgcaaaaatgacactcgacaggtcggttagtttacatgcgacgaaggaagcgaggtgccaaggataaaccagtactgagccgaagataaccacggatgctgcaagccttggtgtcgagcaatgtcagctggatcagctcgagcagtcgcataaaagcagcagagtacaaaacccggcgcaaaaactaagccccacgccacgcactgttgccgagtccacatgcagtgcagtgcaagggggggcttagtttacaaggcagcggtaggaaagagcgggagataggccaagggactgcccgtttgtttttgtttcttcccacatcttttattgcgtgcagggatggctgtcagccaagggcattgggattcttagcgccacgcatttgtttaacctccccctcgcctgcttcttaataaaaccataaacatttcatctcctgttataaaaaacatgaggacacagctcacagtgtcccggctcccatgctgcgctgcctgcaaatactataccataacacggtaatatttattttcgccttccgtcgatggagccggtgcacagttgctcgctgtccgcgatgcatttgtatctgtatgcgacgcagagatgccgatctcaacagtaacaaactggtttagtaataagagaattagaaacgattcatagagaagaaaatcctttgttatttaaattttgaatatcaatagatttttatttttttatggactcacttcaattctcttgtcaccaaaatagccctaaatggctacaaccccatgtcccagttccaagtttcttttttttttcttctcaccctgtttcgagtgacatgccaaggagaacatggcatagtacttggtgttgcagcaaatcgaagatatgttccgatcagcgcagtggccctcctagtgtcactagactagagctgggcagaatgagcattcggtaccagcagtcatctcgctatctcagatcatctcaaggcccgtcttcctttctgtccagtgagcgagcctgctcctgctcaatcacccgtcagggcttgtgatgatgcccaggcctgccaaatttcaggcacaaagctgttgcctgttgcatcgaacaattagcagtgtaacaagtacacatatcttcagcatccatatcctttcagttccagattcttctctctctttttttggggggcacaggaggaaatagtgcagcttcaatgcaatgcgatgtggttggatggtgatattatattttctcaatccagagagagcagtcatcacatcatgcttggacagacacatcacgttggccggtggggcgtggcattagtttacctctgatccgcagcaggagcagctcaattactttacccggcggcggctgcggctgcttctgcctctctgcttcttgtttattagcatgagatttcaaaaggcccggatcggcgatggtgtcgctagagcagagcagagcagagcgctgcggattcctttccgatcgagttgcagttgcagatgggctgtccatctccaaacaccggaaaggccacgcactataatttgacctgacctgacctgaccatatcatactgcagtttgccccgcacggagagacggaaactgggtgccaaaagcgggcgcctttctcagtgggcttcccgcacgggatattctggttcagcttatcatttgcgactcgagcgctccaaggtaccgccggaccatgcgctcacagaacagaaactgggagtggttttcctcactgatccatcctgctgtctatcttacagcgtatgcgcgcgccgtccttgccagatttcaaatacaaatccacctagt

SEQ ID NO: 1921 - DNA, 1784 bp, Zea mays
  misc_feature (1)..(100): optimal_loci_37214_G1, chr1:224102365..224104148, Cluster 11
gcctgtagcctgtagacgacggggcgccgtggttggtcgctgcagttattgggctcacgcccgctcaagcagtgggtcgaggaggcggtgacggcgtgccgccggtgccggtgccgtgcgtggcatcatgggtgggtgcgcaccttttgaccagtgcgggctgcggagttgggcagtttttggccttgattatcaccgcggttcccggcgaccttttgtcgcgcccgttctccggtttctgcggaacgcgggcgccgtcagcgtcgggcactcagtcgggcggggagcgggggagtggggacgctgtgccgtttcagttcgcgcgcgcggggggatccacccacgaggccacgacccacgacggccgaaaagagctgcgcggggctcgggaagtcgggggagtgccggagtggcgtgggacgacgcgatttccacggacagagggatctagcatggcgagcaggtcgtggagccagtgggggtatctccaacgtctttttattgctggcacggcgagccggcgaggggcgccgagcgtcgtggatcttgttccgcacgtgacgggcagaagctccggtccgtccttgctagcgatcttcgccgacccttccgttttgcgcgatgcagccagacgtgtgcttgcttccccatcgtgtatctggcccagcctgcattttctgcacatgctggttctggccgctagctgtgctgtgcctgtgtgtgctcgactcgtcccacgttccgtccggtacaccggcaagtatgtacacgcaccaccaagtgttgtgttggtgtgcatttggtctccttgagaaattaaccaatggctgtcaggctgtcattgttgtatggacggttgagtgcagagttggctaagccaacgtgacgtgcaccaggtttctgatcagaggggggttacgcacgtgccgttacggccttttagccagtggtggtggattgcgaaagctcctttggtttttagtgcgtggacgcggacgccgacggatgaagaagagtagtcccggtctctaaaagctgcacgagtaaaacaggccactgataccaaaaaaaaaatatacacgtcagaaaagcacatgttgcttgatcggatgctaatccagttagtgcttgtggtttcgcctttggacagggtggaaacggaagtatactgctcgaacgtagtagcagtaactcggccaaagaacggaagagagaaacttgcggaagtgtggtgtgtggcacggcgggcccgcccgacgacacaaaacctggtacgcaaaccagtgctagtactgcgtttgacgcgcgcgcgccgcgcgcccaagcacgtcgtgacacgccagacagtagttgcacacagacttgtctcccagggacagctatcgatcgataaccagcaggcagcagtctactaagcaaggacgacgacagcagccgccctgcatcacgtaccctctagcgacgcaacaacgtgctgtgctgcccgttcgttcagcctgccgctgcgtactggccactggcagtggcagagctacggtcaaccaccgatgccgactaacatcgttacatcaatgacatggtgatattctcttatacctattcgttaaatagaagaattggtaccggtaaaaatatgatcttaacagcgacggtccagcagctaggcgtccggtcagccagcccatgggccatatggcccataatctcagcaaataacaggccaatattcaataatctaccgggacacctcttggctcttgtgtatcactcctagggtgacaata

SEQ ID NO: 1922 - DNA, 1408 bp, Zea mays
  misc_feature (1)..(100): optimal_loci_37265_G1, chr1:224467351..224468758, Cluster 11
tcatatacctaaactagcataaattctatgtctcgtgcgctaccggtataactagattacacaagtaataaataattagtggcaacaaaagtggagtactaaattttgggaagaaatggaattagtggaaacaggactgacctattgcttttgtcactcataatggtgtatggcctagtgttgataatattgagaccattcttgaatgtggtcaagaacaatttccatgtattgctcggctaaactttacaaaagtgcccaagctatagggtatatggagacatggagtcatttccatcataaaccggcctagatattttagattggatattcaaaaaattaaatgattaaagaaattagtactctaacgttattttgtgtcaatcccaacagcagagaacaattggaaaccccccaccccgcacaacacacacagtttgtttttatgtgaaaagcatcaacacgcaaaattggctccttctgcaagcgtctaaattttgcagtgttcttggcggaggtggacggagaatatatgtattatttggcggtgttgtttgtagcttggaccgtcgacaaagtgttgcaggcatcatcattttcggccggaaccgcgacagccggctggggacctgggtggcgccggccatgcatgtctgacgtcgagtcgcaactcgcaaggcggagcagagacgaggctccacctctctcaaggtcaaggccgctgttgcggcacagccgcacagcacaggcgaagcaaaataaaagccggacggacgaatagggcattgcatctcgcgggggcccggccccaaggcggaaggcgacggttgtcccgagaggcgcggaatcggccctgcgaacgttggaagagccggagaaggggacggagttgagcacatctggtgtgggacgcggcggccggggtgacgtcactgtgcttgtcgcctcgctatgcgcctgccccggcgagctgatatttcttgacaagggatgggatgggatgggaagggaagggaagggaatggagaccagtcgctgagcgggcggggaggatttgtgacaaaaaaacgagttcaagccaaatgcggaaccgcgcgcgcaccgcagccacgggttaccgtctgacagccactactttctgttagggaaaggtgtgatttttttttttcatagtgcagcagcaactacaacgttgcaaaaaaaaaaaaatcacagccgatcaatcaccgttgtataacatgtaaatctttcgtattccttccttcctcaggtccaaaataaatggttcgcgtgctactctttgggagtcaaacatttttataatcttactgaatatatagaaaatgttatcaactttcatatcttaaaataagtttgtatagaagaatgtcatatccgtaaaaaagaa

SEQ ID NO: 1923 - DNA, 3626 bp, Zea mays
  misc_feature (1)..(100): optimal_loci_3733_G1, chr1:19232372..19235997, Cluster 11
agctacatcatgaactgttgtcatctacagtaggtgccaacaaatatcatgagttttgttaaaaccattgctgttcttggacagcaatacggccaacgtggctccgtccatgctgatgacaatggattgcacacagattctaagactccatgtgagaggaagaggtggactaggtattaaatatgtagcttgtattattataaagttattatatgtataggcttctatttgggtatatataagacatgataatattataaagttcactaaagattatattattaaactagctgtgtcgatcaaatccattttgctggtacgtcggcgggccctcactcacacactatgaaaaacgacagtggaaacgtaggagcacgcaggcacagcagtagaactagctcgcacggaaaagcaagcctacagagcacagtagggtcacggcatctccttcgtgctcaaaaagctcggacagttgccggtaccacttttatcagtaacggctacaggacgtgggcacgtggcgagttttgcacggtctccagcgcctagcgcaaaaatccaaccatgcactcaatgacacgcacgtttctgaagcgcggagcgcagcaaaggtcaggaaagcaaccacgcgtggccagtggccggcgaggaggaggataagactcgaaagctgcacactgcgatggtcgttttcgctaatctggcctttgtcgtcgcctcgtcggcgtctgagatcactccagatcagtgagatgaatggcgcgcggctccagagaatggtgccatgtctgacttttccacgcatgtgaaaaatacgtccaaaggcttcactgtgcgttatttacacacggactgttgcgcgcacggcgcatccgtcgtatgtgtgagtgtgaccgcatgggttgggtgggccgccgacacgaacagctcggctggctcggcacggcacgccgtggccgtacccgtagtacgccgcctgcggccggagatcgacaaagcaaggcacgcacgacgaggcaaggaagcgggtgagaatcgcgtgtgtcgtcccgtcctctaggctctcacagcctctgcctgtttccccggacgacgccaaaaccgagtccgattcgtctactccgcggctgatgcctctgcctgtttccattcggcgcgtctgctcaggcatctgaaccggccggtgacacctaggcgcgcgcccttcttccctactccctagtatcgcccccgcgcgctgtgcctcacctctacccgtccgcctgtgcgcaactgccgacgtgttcccgggcgcgcgggctccggcgctcgtccaccaccccacccggcgtcgcggccacggcgtcgcggctgtcacggtccgagaccgacgcaccacggggccggtggtcagtagcaaggacccggcagcggcacgccgtgtcacttctaaaactgtgggctcagcagcggcgaaggggagggaggctgcgcgtggctggcggtggaccagtgtaaagcccgccgcgccgatgcagcaggagagtttttttttttagtgcgcgtggccagaaccggccagaagactggtggtgagcgagactagcggggcagtggcagagcactagcgaacaccaaatgtccggtagcgatcgaaagctgccgtcctgcatggcatgccagccacgccgtcgcgtcgtgcatggatccagacttccagagcagcacaggtcgagtcaacacaacagccgctcctttgcctttattaccacgtggcatgtccgttcctgtagcctgataaggctggcgtcgggcccggggcgggaccagatttgacgacgccctacagtttgtagtagcggtactactggacgttgcaaacggtactgtgtgcgtgctctgaccggaagcctgccccacccagctatggtctcgggtcaccgaacgtggggcatcgccaaccggtgtgtatacaggattggtatccacacctccgaaccgatagacgccatgggctatgtatgcggcgtcgactgtcctctcctttttctagttggtgactgccggtggcggtggttctccgcgctgccgttggtcctccctccccgtccgtgaaccctcccaacctgatgctgttctcttcttcggggtggcgaggccgtcgtttccccccgtgtccgtgattccgtgaaggccggctgcagtggcagacaggcgcagcgcgccgctttctttcgatcgcacccgtcgtctcagcagcagaagcagcagcagcttttccactgtcctgacaggatcactcacactcctgcccatgccatgcactgatgaccgatgcacgcacacctcgtttcgttttccaaagttttctactccgggcacgggcggtctgctgggcagggctgggcctgggcatgcgcagaactggtggatggcatcgcagcacggccgaaccgaacgcgaaccggaacagagctccgtccccggcggcggcgccggcccggccaatggagaatcgtcgtcgggtccgagccgagggacgtgggaagaagacgacacacacacccacacccacacgtcgctgcccgtctcaggtcctggcactagggagtgggagtgtgtgttggcactttagccatccatccatccatcaatcaatcggtgtcagtcagtcagtcggtcggcagtgcccacgacttttttttctgcgtggggtgggcccaaaagaggttgcttctccctccctccctccgcgccctgcttttttcagaggtctaggaatagattccccggctaccccgttctgagggcgcgggaaatcggacgcagtggctggcgtttcgtacaagagataggaactcggataacagcgtccatacattgaaatgttcgggcttccggaacacgtcgttcggatgttgggcaatgctcatctgttcaggttgtgctcgaataaaacgcagcagccagcgggacagtcttcacctcactatctttttgcgtcggtggcctgttccttttatgaggagaccgatggtttggcagggcccccgatctcgatcgaaccgccagcacggcacccacaccgtaccccatgtcgagaagcatgcagaaaccatcatcgtcttcgtgcacccctgcgaagagttccgttgttgtgctgtgcctgtgcgtcaccctcaccctgatgttgatgaaaccagccgagccgggtagatcacggtgttgacaaagcggccgggccggataaggtagcctttggatcatccacggtcaccccgaaatttaataaaagccgccctctcgccgtctcgcgtgcatgcatgcatggccatgcagatgcacgagcacgacacgaggagaaaatcttggccgaggccgccgtaccgaagcattcaactttcaacatcgctacgcctacgctagctagctagcctgccttgctgcgtgccgtgccgtgggaaaagatgaacacgagagagcatcgcatctagaagaacgtcgatcgagagtgcagcagcaggaggagctgaggagcgccgtgcctggcgtctgcctaggccctagggtttcgagccgtagccttttaggctgctagctccaactgcagcagcatcaatcgctaggtgtataggttgagccgccgc

SEQ ID NO: 1924 - DNA, 2218 bp, Zea mays
  misc_feature (1)..(100): optimal_loci_37808_G1, chr1:226930664..226932881, Cluster 11
cacgaaaatctactcgcgtacttacacgaaccacatcattacaggacaagagagacgggaaactaggatcaatcctaaacgtacacttcattacggacaaaaacagtgacgcgtgggctgatttgtgcgtgaaagcgaaagaatgcgttgccaaaaccagagattatagacagctgttagctcgcaaatctatcgatgtaaaaccgggagtatatatatatttaaaattaggcggagcgagccgtgatgactgaagttatgtgtttgacgtagatggcgatggtttttctcccactttcgtgtattgacaagtcgtatattttaagtccggataaaatcggcgcaacagtcgcaagtggatttcaatgcttttcttcttaaaacaacacatgcgcttacgaatatatgcacgcgagcacatgtttagctaacttctttccatgcatgcacaatattaaattacagagtacctgtaccatgccactttgtacccccagcttgtcttaatcctttatgtttacatttatatgcataccctcttccacacgaaagtataatcaccttgatcttcaagtcacctacagctggacctcacgtgtaagtgtaatcacctccccttgtcattcggtcattccccgtcctctcgcacgcacggaatggatacttgtatttttaggatagtaaataaatagataaaaatgtactttaaatagcacgtgaacgtgaacaattcgacgcggccattcttttacgctttattatttggcacggtctgtgtggaaatagcggccgggacagcgatttctgggactttcctggaacgagcgcaagtaaaaaaaaagcggtgaaacggacggggcacagaaaagcgagacgggaacgcacagacgttactgcgaaaaagtccgcctccgccgccggtctcgtgcgccggccgaaccagaaccagagaagcacgccgaggcttagccgaggagccgagccggagccggagccggggccggggcagcgaccggctgcgcagacggccgcggcccccaccacgtggtggcactcgaggtgttgtctgtggtctggctgtacgcgtgggcccgcactcgacgttcgttcggaggccggatcttctgcggcggccgattggattcgccaccggcgtgcagggtagccggccacccacacttaataacgacgagtaaatgcatgtttggctcggatatgtgggcaaatcccagctttttcgtctatgatgtctgtggtgtggcgagccgtatcattgcaggtaccactagctttagttggtcatgttgaccgggggggggggggggggggcgcagagcgtaataaatcacggcgaccagacgacctagcttacttgtttagatttgtggaggaataatgatttgggaggaatcatttacctacgtcatcgcgtgcgcaatgagcgggagatcacggccataatacgtacgtacttcgttaacgacggcgcacgtagagtactgcctgtgcagtacctttcggtaccttttggttgtgtgccgcgcgctctcggcgcaggcgcgcagcagtgaaaagacagctagcttagctggccagcacagtagccatgtgacgacgatcatacgtacggtatgtacgtggcgcccgcgtgcgtgatcagatgggttatgccagcatcaaaaatcaattaaagacagcggcggcgagggggaggccgcgacgacgtccgttccgcacccgcgtccgcatgctgcatgcatgcacgttgatggcggttttggacgggcgcgacaggacaggacaggagagcaggtgcaggttacagccggccgcgcgtcgctgtccgccaggccgtcgcgggttggcatgtcctgatcctgacggcagaatggttggcttcgatacgattatattacgggctgggtcggcccgctccacgcctccacctcaggtgaagagctcgggtacgtacatgttgggcggtgcgtgaatcgacgaaacactgggggagattcctcgtctttgttgggttttaccgtacgtcgatccatgggtacgtactactagttagccccttctgataatgctagattgctagtgatgaagagcatatcatgcccaagcgcttattgtatactcctattggctaccagcctaaccatatacggcaaataaataggcatcgtcgtcaaccctccgcagtcgggagtccgtacca

SEQ ID NO: 1925 - DNA, 2350 bp, Zea mays
  misc_feature (1)..(100): optimal_loci_38533_G1, chr1:230791099..230793448, Cluster 11
gtagaaaatctaaaacattttataattaaaaataaaatctaaacatttaggccatgatccaaacctctagaaataattgttagccgtgaataagttactagctaggtttagctgggctagagcagctatcaacaactaataggtatttgtgaggtataactaacaattagctggtctattaactaaaattactgaaatgtttacaacggagccttagattatctctagtagactccctattgtacaccctatcttattctatatttcaagctctaatctgcaaatattgcgatctacagtgcaaaactgtactttgcattttacacggaccggtggagatagtcagatagcttaccttaatttttttaggataattggagcactatacaaatagacgaccctgcattagaaagtttatacctactactgttgaaactactagtaggaagtgaatgccctttcccaatttgtcgccgggttcttctctccccatccctaaccccaacggtcggatctcaaccacctcccccgtagcagcgaggagcgagaagagagaaccgagggagcgagaagaaaaggccaagactcctttgacccgtgaacagtgtccggacccccaccgcgcgctgacgtcaccggcaagcaagagggcccgtccgtccgtcgaagcgcacgtggtcccacggcggcagccgacagcgacccctcattcacgagcgcgcgccggtgtgacaacaacccccacgcggccacgcctcctccccgtcccgttgctttccgcggcgctcgctgtcccttgcgggctggcgtggcgcgggcgcagcgcagcgcagcggccggcacccggtgcgtggtgcgtgccttggttgttcttcgccgcggcgggtgttcgtgtcgatggccggttcgcggtcctgggacctgggtccgccggtcggaccggtacgtggtggggctggagctggagcggtatggagaccgggccggggcgtgtcgggtctgggcggctggccaggaccacgttcgagtacgagtagtacgagtacgacgtcgctgtcggtcgtagcgttgttgtctctgcaaaggacgttttcctgtcgcgagcgcgcgcggcagtgtctcggttgtgtttcacgtgtgctcggctagccgcctgtcagacgatactgtgtgtatgtatatacacaggagtaacgacggagtcctgtaccgtgcatgattcatcatgagcggccacagatgtgttcgacgtacgacggcattagaaagacgatgcgcgcgtatggagcagtcgaccatgttggattgcgcccaatgcaaggtactcataccttttgttgccgtagtggtaggtagtacactagtacgtacgtacgaatagtcaccaggaggtgaggacacccggcctatctatcattgtactcctatacggtgtacgtcggacataggaacactgctctcaactgttgacgacactacgacagcgatctcctcctcctatccgatccggacgatccccggcccgcatgtctgtctgttgggcgtacgttcgctccaggtgcggttgcggcctcatgtgcagtggaaaggaagcggcgcgcgcgagacatacatgaacaggccatccgctgttgatcggaggaggtttggatcgcgcgtggcgtgggtcatcttctcgtgtaccactcctgcgcaggaagaaccagtgggcagggtttcaaagattgcctcgggatcggcggttttgaccgcaagcagcacgcaacgcaacctagggagctgaccccaatgcgtgacgtgacgtcgcccggagctgaccccaaacctggggagcaccgccctcggaactgccgtctggaaattactagtactggccaggattcatgcactctgcacggtcatcccatccagccttcccgagcgtaaacaacagaaaccaaggttctccacttgacggacgctgtacgatcctgctccagccagccagccatagtgccccccgcttctcaaccccacgtgaagcgggcccgtgcatcgcgcgaccgacccacccaccccaggtgaggtgccggcagcgcgcctagcgatccgttcaggtcaacggcaaagtagcgatcctgtactgtatggccgtgtgcatgccaggcgcgcacgcttctcagactcttggccgagagggatcgatccgttagcgaccccgagggccccagcagcctaccggcggctgacagacgcacgtacgtagcgtgctccaacaatgcgcggtcgccggcccgccagggctgctgctgctgcggcagttcggccatcacgtcgccggcctcaagaaccagggcatgccatctccagc

SEQ ID NO: 1926 - DNA, 4424 bp, Zea mays
  misc_feature (1)..(100): optimal_loci_3885_G1, chr1:19676800..19681223, Cluster 11
cttgacgaaccagcaagacctagctctcatatgatttctggccctcagtaaattctcgtcctgcttccgctgctcgccgagcgtgccctggccactttgcaggcgcgtcggcaccctggcttgttgctaataactgaaggaaggatcggaagaaactgttctaaacagaactatgctcgcacgtgcactatccccgaacgtcagtttatcgaaaaagactggcacacggactgatgctcgtgggcgaagctgcatatatacaagttatttgccacctccaacctcaatcatgcatgtgatgagacgttaacttctgaatttgatttaacctttgattctagcttgttgggcgggtcgggctctcaattgcccaaagctgaaagctccggcgaaaactgtctacctggccttctatagattctgcatttctgacaggaaatgtgctgcatcaccaatgatcaaataactgaatcttattttacccttcttttagttctttgatgaatatattatacccaaaaaaaaggagtatgcaagtgaaaaaacgacgaggttgctggtcaatcacgtaccacaccctggcctggcgcgcgcgcggatcggaagacaaaacgtagagttgctatatgagcaaatcgcagattcaacgttctatcactgtctccaagctagactccaatccaaacaggtctacaccagccatctgaccgtcttgcatagctccattccttggaaaaaaaaagaagagacggttttattctattctacacgttttgcctcgcgcctcgcccaccacgtttagtcctggtcttgccttgcggtgaccaggtgggggcgaccgcccgccgccggcacctcacggggggacgcggcgagaccgcaacatgactcgccgtggaaccctccaatttcgctttggcgagcgttcgctcaatttcagtctagtgaacgatctgactggcgataaaaacaggcaggataggcgcacgcgcgaggcaggaatgttgcgcatagatcgaagacacttagactgtccgtaatagttctctctaaattcctatctatatcctacttttgcaccacgtcatcaagattttaccttctatttttttcatctcacacagtagtttcctctaaatactcccttatagcccaacagggatggatccaaggaggggttgtcggagcttcaaatcagttcaaatgtcgtattttctagcccaccatgcatcggctacgtctacacctaaaagaatcatttaatattttgttacgtttaaaaaaaagatgttgcataaaatgctatgttaatgattctgctgcgagtgactagtagtttagtgtcatctataaagatggcagaagactaaatgaacatgaactcagccgatacacgtgcaccatgacactggcctcatcatagtttgcgtcctaaccctagccgtgacgtcgtgctacccgttggtcatcattcctaccccactactgtctatggttcaattataagtgaataaaaaaaactttaatcttatcaatccccgtacattaatcacaatcgaagaatcctacagaaaatgcacaagcttcctggtcaatcacgtacaactccacagcggaaggccgcaaagacttggtctgaggaggagtcacccggggaagaaggcggcagcgcaaaaggttgaatcatagatctgctcgagcccttatcatgcacggacacgtgcagacaggatagccgcagtacgcacatgcatgggatggggagctggagatcatgtcatgctgctgcctgcgtggtgcatgcattgttcatcagcctgcgcagggcatgtgacgcagccatctcgatcggaagcgtcgtgcgccgacaccagttcgtgttcgtgactgcatcagactctctgcgccggtttccgcggccaccggggtcactcttcctgatcgaggagggccgcagtgatccatttgcagctcgatcgcagccgccttcgctcccatgccaggttcagttcacctgggcgatcaggtaatatttttttttgttctatgtctgaatctgcagacaataataataatttgaacaacaaccaactagtacaattcacacgggacaatctgtagggttttttttgtatagttaaacaacgtaaagaaagtacatactgcaaatcagggcctctgaaaggtacgggaagtgaagaatcctacagaaaaaaaaaacaaattcgcacaagcttccttccttcctggtcaatcacgtaccactccctgcggctgcggccgcagcgcaaggcaaaacggggacgctgcgttgagccgagcgagcgcactgcagcttcgtagtctatctccatgactccgatccatcacgttctggcatccctcccatctgcaccacgtttttttttcctctctccggatgattgcggcgaccagatcgatggaggggcggccgccgccggcaccgcgcgcgcgggaaagcgagaccaggaggccagacgacgcataaggttgaaccatacatagatctgcccaagcccttatcaagttgagatgcactgcagacagggatatatagccgcaatacgcacatgcacgcgggacaggttgctcttatctatcggcaagctggagatgctagctgctgctgctgctgcgtgcatgcgttgttcttctttagccgccaggcatggacctgactggaaaccaaccgaattcctgagtttattctcttttttccccccttcgcgtacgtacctgcgctgcgcagggcatgtgacgcagccatctcgaacttaacgagagcgtcgtgcgccgacaccacttcgtgttcgtggctgtagactctctgcgccggcctgtgcctgtttccacggccaccggtcaccctcttcccgaggagctagctagctagggctgtcctgatccatttgcagctcgcagccgccttggctcaaaccactgcaccatgccatgccaggtccagttcacctgcaatcacactctctatcagagcttcacatcgagatcgatccgtgcgtagaaattcagctctgcttaccgccgtccacttgcgtgaattgcttgctcgtaggcgcgcggaagtccggagagtacgtccggataataatctttcctctcgctgtaaagctagtttgtacagagtgtggacggcggttagtccagatcgaaacgaaagttaagcaaaatgggattgcatttttctagtaaagtttactaaaaaaagtatattaatctgtattcttttaataaaattttagtacagaaaagattaaattatttgattttttttttaaaaaaaaacaaaataaaaactgtattgttttatggacgtaggaggagctagcacctagcagcagccaagtcgttcacgtagtttaaaaaaaacaaaagaaaagtctttgacgtacgttgtttgagaatctcagtcagatgtggcacagtagtgccatttcagatcccctgtggatgcttttgcgagctttccctgtcacaccatttccatttggttgcatcccgtgacgctgccacctttgaatataattggaacgacaataacgtatactcccatgtgtttggtcgttcagctctcccgtcaaccagtactaattattatgcaaagggcaccctaaagctcatgtgtaactgattttccccttcgtttttacgcttcaagactgggactacactttttaagtacgaaaccgacagctggataataacgtggagacctgtggtggtgatcatcagctgatgggcacgcacaacgtagcgatggccgatccagcgacaaccggcggctgcttcgtccggcattgacgtgacttctcccggccggcccgtacgcgcagaagcagaagcagaagcagaagcgtcgtgtgtgcgtcccacaccgcttgtaagtgctggcttctgctcttaattgcatccgtgcttcatcacttatctggctatcaggctgcagccactgttatcgcatcatatcgaaagcaaatcaaccagtgctgaggcccttggtgaaggcttctcctcactgtcctgtcatgtggctgccatcagatagccagttacccgtttgcccagaatagacatggacatctgaactccattcggctgtgtcagatcaaccccggccaagagccttctaaacgaactccctactttagcttcgtctccaccttatgcttcttggtgatcgagcaccattggagagattcgtctctctcctgaaagtattgacatgtttctaactcttctttattttaaatatttacatttgagaaattcaattcctgtttttatattactaaaacttttgtcttagaatagtgttgaaacttaaggtgcaaaatttttaatactatgaacagataacactcttagctaaaaggagtgaagtaaaa

SEQ ID NO: 1927 - DNA, 1533 bp, Zea mays
  misc_feature (1)..(100): optimal_loci_41603_G1, chr1:246414357..246415889, Cluster 11
acgccggcattgtggttgcggatatgtggttcagttcagtacttgagttcccgcggagtacttcacgttccagcctccaactgaacaccacctagcgcttggcttaaccgcaaggctggatacggtcggtggttattagcagacggatgcaattctttccccctctttttttgccgcatagagtacgtaagttcactgttctgcagtgtgcacacctgacatgcatctccaacttgaggttttccaacgctggtggtacacgagtctcgtgacgcacacatgaaacttgcgagaggagagaatgtatgaacggcacatgtgaaggtcgacggagggacgacaaggtgtacatttctccatttcggtactactgtatatatgcaacaaatgctgctggctgctgccgggtcgcatcgcatcacgtcagactctactacaagtaccgtgcaagccaaggtgaagggacgtctccaagaaagaaaaaaaaaagaccaaaatttgctacagctgctgctgccgccggcgggtcccataaagctacaacattaaacaaaaatgccattgagttgggtggaaaaatcgtcgatgcaactatcgagaaaatttttgttggaataaatacgaaactggtagtactagactggtcacataaaccacacgggaaaaatataaatagtgaagcaggaaagaaaacgacataggctgttccctctctcttccctcgtgtggtgggccgatatgggcctaaggccgcatagaagacctcatttggagatgggaggcccgaaacgtctaacaggctccagtttccattttgaaaaaaaaaaagattggccttcttttttcccttcttcgtcttccgggaggcgagcaaaagcacaacagtgggagtgtgtgggatataaatactctccggttggtcactgctgcctcgtcagctccagcccagcgtctggttcgtatgcttttgaaccagtgatttccagtgccatcgacgaggtggcgagctagacgccactattcctcccagcaggaagagaacaagaaggccaacacctccacgaaaagcaacagccgcagccgcccgcacgtatgaaacgggaagaaaaccaaggcattggccccttttttcccccacctattttgtagccgtcgccagagacgagcattttaccattggcagccagcactccagcagcagcaaggccccggtcggtggtcgccgccgatgccggcagcaggacgtagacgtacgcagtgatgtgtcgtccacaagccacgaatcggccggcacaggataggacctgtggatcacgggcggccaggtcggtcgcgagtggttcacggaacggttgcctccgccaccgccgagtctcagccgtgtggaactgtgtatcttgtacggagatgatggcagcaattatccctgtcccaagaggcgcctctacatctgaacttgttgcgctgtctattgagacattttccatcattttagctatatggttatctaaaacactactttacattatatac

SEQ ID NO: 1928 - DNA, 1686 bp, Zea mays
  misc_feature (1)..(100): optimal_loci_42043_G1, chr1:248416096..248417781, Cluster 11
ctcaaaattggagggataagagaggacgcaagaggacgttcccgtcctgactgtcccgcaaccaaacgcaccctaacacactgcagagagacaactgtgctaatgcgatgcttttttagggtaatgtgtgcccagggcccaggctatctgttgggcttagcccatttaggcatcgatctctaccctccaacatactcatggttgatagccccacgcccatacatttgttgtaacagaagttttaataattggtggccggaccattagctagcaataaggccaattccatgtcgttaacgcttgtaataaggccaagtccggccacagcaagatcgagttccttatttaatttgtaagcaacctgagacaggacaagcacatatatgcaaggacacaacacaacccaacaacaccctgcctctcactcttccaaaccctaatgcgccatgagctacaggtcgatcgatcgggatatacaaggttgttaattaggaccaggatatatactagctaggcagtattattgtttcttttcttttcttttcttttttggctcagagtaccgaatcgtgcgtgtagcaccagatgtgggaatggtacgtacgtgtcggaaatccatccgtatccaattggcattgcgtgcatgcagtaacatgtgtataagcaaaatttgctaggcatgcacactatcccccaccaattaactagctagctagctaggacatggacacatgcacatcctcctcgagccatgaacaacaaaaccatccatcaccctttcactttcactttcactttctggaaagcaataatgcatgcatgcattggcttttaggtttacactttattcactagccatgttacggctttattttgccgtcgatcgatcagaaccacctgcacaaattcacgcatcaaaagtgaaccctggctagctagctagcttccaggacatgcatgcatgtttgcttaattgatggaatggaacgacgtataacaatccatggaaaactccaaatggtactggtacggttcatgcatgcatgcatgcatgcaacagtaatgcatgtactcacgtcacgcattcagaattatatccagaattatagcaataaatttaaactagtaaaaatgacggataaaaataaagaaagatgcattcatgcatgtagaatgatggagccatgcatcgatcagttcttcttccttaatttgtttccctttggatctctcgtcctctagcaggtgttggcttgcccccccggacccggatcggagactgtgccgtgtgccctgccctgcccctgcccctgccgtgaaagcaagtcgaaaaagaagaggggggccgggggcggcggtcataggcatgcatgcactttcttcgcaacaggggcggcgctttagggagcaccacaccaccactgcaccacccaacccgatcgacgacggcgccagcagctagcagaggaggcatgcatggcaggcatgctgcgagagtgaccgaccggtggatcggagaagagagctagctacaccgtctcgcaacaacgacgcatgccactcgcgtccaccggctccgcgacaacggaggaacgtccagcgtccgatagatgctagctgcgggcggcatgcatggaccccggccttcttttaaactacatgcatacatactgcccatgccatcat

SEQ ID NO: 1929 - DNA, 3035 bp, Zea mays
  misc_feature (1)..(100): optimal_loci_42519_G1, chr1:250905847..250908881, Cluster 11
gcaatagactacaacaacaacctcgccctccgcgcgcgcccgccacgtccgccccgccaggggcttacctgccgcgaccgcatgcgcgcgcccgggcgtcggagcgccgtgctgacacgacagagacagcccacgccgcgaccacgcgcggaccccccctgcccctctccgccgccctcggcgagatgacatcccacatgcctgcgcgtgtgcggccggccggctcggcggcgcgatgttccgccttgccggcgggggtgatagtacgttttttttagttttctactacactggatcttcgtgtgttgttcaggcagtgaacgcctgcgaataatggtgctctgctcggtcggtacgccaggggcccgacacgaaaactgacgggcggtggacttttttggactcgtgtacgtgcgcaaacaacaaagatgctaatgaaggcctcccttggcagggggggcgcacgcatcgcgtagactctgcgtgagctctttgttgactgtgcggggtgagcgagggcgtgccaattgatttttgagaccaacgacgtgcggcgaccggtcgatcgccatcttctcgcccgccgacggcagcgaagggttccgtatgcatcagaactgaagaggacggtcgctggccggttagctagctccggtccgacttgacgctgctgatttggacggatcatgcgatccatgcgtagcgaccacgtactcctttccgttctacgcagcgacctcatcctggccatggcgggtactgtacacgtgtagcgcagtgattggaaggcccggcccgatttccctccgctgccatgagacagctctgctctgcgtctctgcattgcgggcagggcagctcgtctcgcgcgacgcttgacgagaaatcctactcctactcctacagtcctatacatgacggggctcattttcgtcgcgacaaccaaaacggcaagacgtctgacgtctctgcgtgcattccaggagcttttcgaatgctgttttttttttggtgtagcgctggctgcgcgcccgcccgcgccatgcatgagtccgaccggcgcggcgacggcgacgacgaccaggacggacgtccctggcgcgacccgacatccttttctatcctttggttttattttattttattttattttattccgctgatagtgccagtgccggggtacgtgtaccgcaaggattgggcgggggtgatgaggtggcaccgcgtggaccgacgtcgccatcggcggatgcggatggcgctggcgccccccccccccccccccccggcccgggtccacgtgtcgcctcgcggcccggcgcccgccaccctgcgtgcttttcgtggcactaaaaaccgcccggccgtcctccggtccggtcctcgtggcgtgggtcgctttcgatgactggcacgatcggtaacggaaaacgaaggtgtggtggcttcagtggctgggagtactacgtgctctgcaccgagacggcgagaccgggaccgtgccccccccccccgggggcccaggcccagagtaacgggccgaggcatcttttcccgttccgtttggaccactactacttttgattgtgaatcgagcttggacaatggactacatacgccagtgtgtggaatggaaccgtgtgctgctccattcacattcaccgacgtctgatagccggtgtgaccggggctgccgttgccgtggaatgcgagtggtagtagtactattccctggctcactgtcacctggcggagcttggaccgaaatccagcctgttgcagtggtggtggtggcctgtgacaagctccaccactgctcactcacgcactgtgctttcggtggtctataagcatgggtggcacgaagtgaggctgaggcaataggcatagcatagcatagcatgggtccccagggtcaacgtcgccccggccggttgcattgcattgcatggacaccgcaccacggggagttgagttcccacggctgctgcatgcaggcgcccatgccccggtggccgctccctgggtgcaagtgcaacagcgacagcgccgccgcccacgctttctccgtccgcccacggttagctcggaccggttcgacgacgaggtctccatcgtgtcctcgtggaacccatcagtcatcgactcgtcgtagcattattacggtatcagttttgattattctctagtactacgtacgtactagcgaatataatcctttttcttgtcctaaactaataaagcaagcagtgattaactagtatacttttgagagcgagggtcgtcttggtcggcgatctccgtctcccttttgcgcgcgtagtagtagcacgatatatatatataataagtacctgggtgggtcattttccatgtgtcgtctcatgtctccgctaattccagcggcaccagataacaagcacacgacctgattaaactaacccgagaaagcgaaacgcgcgcggccgcgcgcgcgagacgtgcaccgacggatgcgcatgacgatggacgtagcgtcttgcacgaactccatccaccattccaccgtccagaagactatcagccattttgcattactcgttggtagccgaatcattattttataaatcacaagatctctatattatcaatcacagccgaaattaacaactataaccgaattgaactttaatttaactaatctataggatgcagccccgccttttatttttactctcccccgcgggggctagcgctgaggtttcgtgatgcctgaaaactctcttattcgtttactttcacatcgcatctcccaaatcacgaggaaggtgaggctcccatttaggtcttgtttggataatctcacattcaccccaatccatgtgtattgaggtgtaaattattttaagttacgctctaatccacttcaatacacgtggattgatacaagggtatccaaacaaggtcttatgcctttcgcggaatgtagggcgcgatgaaaatttggtttccatcgttggcctggtcatacctcttaacaccataaaagccctcct

SEQ ID NO: 1930 - DNA, 3338 bp, Zea mays
  misc_feature (1)..(100): optimal_loci_42525_G1, chr1:250911587..250914924, Cluster 11
aacactagctcatggacaattgcaccataaaatgtggatggcactgagatcgcaagaatgcatgtcgccattcgtcaccgtgcaaacgccgtgcatggcggggctagctagcttggcatatatatggctggcactcctggcagccggcacacatccctgtctgtctctctctctagcaacaagttggcaagcgggcgcgagagagtagctagtgggcggaatcacagtacgtgtgtgctcaccacaagcccctgtcgtagcaagcttgccatgcatagctcgcgttcgtagggcacttttgtcgccgtggttggaggaggaggacacagccgaggagcgagctaccgaaaaggccgggcgaaagaactcacaccacccgtatacactgacgacactgctggttttgctcttgcgcatcatcgccatcgacgtctgctgtcacctgcacgctttgctctacttgtagcgagacagagctcgctcgctcgctagctatagctagggattagccagcagacagcggtggatcagattcgccggtaataactctcctggagccgtgggtgcacggcgcactcgccggccggccggattcccccttcgccgtttgccgcggtgcgcgcgggggtagtcggcaccccggcagacgacgactaaaaagcgcgcgggacgtggcgggctggagcatgagattccctgtcgctagtgcgacgccggacgcagctgtccgcgctttccatagcaaccaaccgcatcgccataccttagccacagatcgaggaggactcgactagctagctagctacctgtccctttctcatctcactctcagcgactcatcgccctcgatctcgtgccgctccttcattcccatttggtgaactgcgtgtccggtgtttcgctgcatgttatgttaggcaaccgatcatcatggcaaaaaaaaaaggatccaaatggcactcgccactcattattattattattattatatataagccaaacgggtggtcatgcacgatgagctaggccggtatgggagaagactgaaaaagcacgatcgattagctagcagtctagcacggcccgggcacggcttagaactgtgggttcagtctgcagtgtcgtaggtatagacacgatatggttactgaactgatatatgttatggtgatatcctaattattcttattattgggatgatttgaacagtaacaaaaaaagtgtcagagctggaccgttttcgttgatgctaaataaaaaaaccatctacagatttatcaaccttatactcgatactcaagtataaatagagacggtagcactcgtaccgacaatgtgctagtttttacatccaaaaccagctagtagtcacgtgcgataaccacttgccacatacgtaggagtattggcatgcagtcatgctgcacccatgcatgacgaccggaccggatcggagttaggggcatgagagtccgcgcgcgtcggggcggcccgggccacacgaccgatcgtgccgcgcgccgcccacaggccacagcccccccaccgcccacccgtcggacgcggctaaccggccggatcgaggcggcggatcccaaccttggacgggccgaccgccacatgctgcatgcgcggcggagtgatggagggcgactacgacgaccagaaccagattagtataatataatgcagcgacgacgtcgacatgggcaacttggcatgattaactgctgcaggagtaaacaaagcattaatcgggatttcggggacatgcaggccagattcaggtatgtgcggagagagagagagagagatactgtgggcagggcaggcgcatgtaggccacagctgaggcaggtaggagcattaagttagttgtttcatgtgtgatgacagtattacatatatgtctgttcgtttgactgaagagtatcgttattcagtactcctacttggcttattaattaatcctgtggactaagctagtgacggttaattcatttacatagggatcttattagagaccacgctgcacaaaccacaatactatagttttaaaatcgacactgatagcgcgcggtatccttgttggttcgtaagcacatactcgatacagtgattcctttccctgcatctggatcggtaatacgactcgatagctagtgacgattattcttttccttggatcaaattctttgtattcaacaaggtgaacttttatggccatcttcttccgttgctggtgagtacgtacgtaaacaacaacaacgtaacgcactgctagcgaacagtgatgcgtagacacaagtatcaaccgacgcccatgtggcatgtgcccagttaataagccgctcgctagctgcgcggcggagggagcacccacaggcgggtcctagctgcgccggtctttcccatgcaatgcattattatttgaacggatcggacggaggagctctcccccacaagcacagttgcacaatatcccaacgccacacaacgacccgacatcccgccgccggtatcgagattcagttcaccaaacgatctcgtctgatcgatctatatacctatgcgtgcaaagcgcggaactcataatttccttcctttctttctttctttctttcatgcatgcatgcatggatccattcacgcatctaccgtccaaagccgtgcatgcatgcatgcatcaattcatactccatgtgggggcagggcagtactgtgggccggcaggcacacagagtcacagagacacacaatagctagctacgtaccgcgatcgatccgtgcaacaacaacctccggccggccggaagtcgtcggcacatggcggcacatgaccgcgccacccatcgccatctatcctcactcggtcaccaccacacagcaggccacttgcgcgcgtgacgataggtagctaggtgcccccatggccccatgcatgcacgagcagcaagaccccctcctcgcctcgatcgcgcgcgcgcgcgctctgccgccccgccggagcgcgccgtccagggaagatccgggcggatctccgggccagtattctatgacctcagtccacatgctggccgcgcaaacaaatgcgctccgcccccatcattaaccactcatgcatggccatggctggtctgttgcagatgcagttgcagttgcaactgccagctgcaaccgtcgtctctgaccccgatgcagattaaacaaatgggatgccatgattgccggtcaacgtaacacacagcccctagctctagctagtaccactcgattaactgtcagcgtgcatggatgcaagaagattcctcggtttccatcatggcttaatttggctg

SEQ ID NO: 1931 - DNA, 1935 bp, Zea mays
  misc_feature (1)..(100): optimal_loci_42939_G1, chr1:253150623..253152557, Cluster 11
cagcagcaccatggctgtcttctcgtttcccatgtatctttctcacccgacgtgtagtaaggctcttgctgggccgaacgaggagggaggggagaggaggggccaccgccacaatgcccacccgtcatatctactagtgggagtggggcactagtgggaggctcgacggcgaccgggggtccctggtactgcacggctccggcgcccgcgggcgcgcgtgtggggggttgaagaaagagccgagatcaggggcggaactgcagggaatcattgtgctggctggctgatgcgtgcccgcccctcccccggccggtgcgtggacggcgacacgtacgccgtgctagtgtcgccgtcgaccgtcgcggtccgcacggtgggccgggtcgatacgaccggttggtggtggacgtggacgtggacgccctctccagtccacggctgtgcgtgcctccgccggagggcctccatccaccacagttcggaaacaagaagggccgatagagagcggtgtggccgtccgtctgctgcagatggagacggagaatcacatcatcgttgggctgggcgctggtttccactcgacgcggcggggcctgacagtggaaacatgcaatgaatgcactcacatgccgcaatagctacaccacgcgcacgcagtagtgaaacctcgtccgtccctaatcacatattcacagtagtagtgaatccttggctgctgctgctgccggtgccggtgcactactgcgcagcatatgcactcgcagcagcagtagtagaagaagaagtcgtctgcatgcatgtcggtagcgcccgccctcgcacctgcttagttcctgtcctgtgcacgcaaggcgtgcgtgctgcgacgacgaccactaccaggacggcctgcactgcactgcactgcgtgtttctccccttctatcgtgcaaagtcagcaaccgtgcagcacaacaacaacaacaaaaaattaaacaagtacgcactgctggtcactactgttgttactgacgctctgtacgtggcatggcccccatgcatgcgtcttacaatcaatgcgtgtgcttcttcgacgtttcgatccggtccctctgcttcttcggccttccggcaggcaaggcatgcgtacggtccagatctactgaatgcagtgcagcagccatggtccagagagccctgatatgtcacaccttcaccatgaccgtgcatccaagcagttatactccgtccgtcatcttcaatgcctttttttttgttttgtttttttgccatccatctaatctattttcgataccagaacttgcatgggaagatgcaaccaagttgacatttagttcacatatttgtaacttaaaggttcactgacaacgttaaatcatatttgtttaaattcaatcgttgttagatatcacattagaaattgataccgatctattgaaacttgttgccgccggtgtgtgaaattattatcatttacgttatatttggtgaaccaaacaccacccaaaaagtgttgcgtacgttgccatcggtcgcacctcttgtatatctatctataggcagaagaagaagaaaaatatgatttctcgtacgttacgttgtgcatgaattgacctctcgtatggttccattccgtcgatccagtgcgcccattttctgccagtgagagctagatgaccggggcggccgggggatggctgttgcctgttgcaagtgggagtagtagtaggtaggtacactagtcaagcctgggttgaccttgatacagtagagtctcacgaacagtgtccaagaaacgtacccccctagtacgtacagatgaccaggctcgtcaccgtgcgcgcgcgtacaatacaatgcgtgcacacgagagatcgatcgcgcattcgcgcggcagaaaggagacctacgctgctgctgagatgctggaaggag

SEQ ID NO: 1932 - DNA, 1933 bp, Zea mays
  misc_feature (1)..(100): optimal_loci_42942_G1, chr1:253153595..253155527, Cluster 11
tttaatccatctggaaaaaatctctcccaaataaaaaaaactaaaaattagtgagaccaaagtacgtccgcctgatcgaactaaaaaatattttgatgcagtttttttcttttttttgccagatgtgaactcggtcgaaacgtgttgagactgtctacagctgctatcatatctcatatcctattttataaacagtataatgtatagttatttttttattttatacaatctcgtaaggtcgtaaacccgagcgagaaaacaagcattgccggacctaagcgagagagagagagggccggttcgagccggtggcccagccacacgattgaaggattgattggatcatgagtacacctctcgtagagagagtggctggtggtacggacgccgacgcagtgccgcactgccgctcgtcgatcgtcgtcctcggtggccgtggcctgtctcgttgggcaggctacgatcgatgcgtggtcaccgtgaacgtgtgtgctggcgtacagcgccgcggtcacttcctacgccggacggacgctgctgcgcctgcgaggtagtacagggcggcactgtggcgctaccgctgcggctggccgagcagtggggccgggccgcgtgaggcggcatcgggcgacgggaaagctgaggcgtagcgaggacggacgctgtcttgtccggctttgaatgcgcgcgcggccgcggttggaggcggagccggaggcgcagtggcaggctttcaggcttgtggcttgctcaatcccacaaccgccgtggcaatgcatccgcacatcaggattgtggccgaggacgaccggtcgctagtcgatacgggaggagtacgtacgcctagccaatgcagccgcattcatttccagtcagctgccgtatcgcttgcattgcaggtctagtagtagatctgtagggacgtacgtactctacaagtagacggacgggaaacagtccgcctaccggcagcaactgcgggcggcaagaggcagcttgcttgtccacgacgcatcacgcatgtcgcggcgcctcgagcagcaccggcccggccgactgtgcagcgcggccggccgggcgggcgagcgagcgagcgtgccactgccatgccatgcgcgcctgcctcgtcgatcagcgtacccgtgcggtctaggcatctgctgctgcgcctgtgcgggtgcgcaacgcaggccaccggctacctggcctggcctccaccggactgcggactccctaccaagcggcagcgcaggcaggcagagatagcaccagcagcccttgtcagcttgtctcatccgagcctccttcctagctgttgcttctgcgcgcgccagaccgccagtgctgctgcatgctggcggggcactgtgcggcagatctcgtgaggtcacccccgtcatatgcatgcgtagctgccgcccgggccctaggctaggcacagcacagcacagtggccgtggcatggcagcagtggccgcgcagcacggccacggcaccgccgcatccgcctgccgcgggggatggggatcagtgtagagaatcctatccgataagtatttccgatcctatagctccagcatgtccgtcgcccagggcatcccccggagggcgcggggggtctatagagccctggcgtgcggcgtccacgttgcgcgcgtaatacggacacggaccgcgcgcctacgtacgatgatgttatggattcgattcgaatcgatgttgtacggtgtatacgtactctggtactctatccactgatccatgctcctaactctagcctacctgtagcaacaaccccaaaaaaaatcctgccacggtacaggtacgtccgtacctgaagcactccagggcgaaaatgggttgccacgttgaaaaccgttgctactccaggacgaggacgtggtgcgcgtttcctaataatattcatcgcaaa

SEQ ID NO: 1933 - DNA, 2989 bp, Zea mays
  misc_feature (1)..(100): optimal_loci_44019_G1, chr1:258395977..258398965, Cluster 11
gtctcgtgggttggtacttctcttgtcatggtggacggcctctgacaacaagactgacttgactcgtactggtacgtggtttggcagcatcaaaatccgtgcaccgtgcaaagatacaaaagcaaaacgacggcgagaaggaagaacccatgtccgcgtaaaagagaaaagcaatgcaatgcaatctggaaacatggatagtactgcactaccgctcgcccccaaaagaggaactccatggaacaacaatatatatatcgatcctctcattgctactcctagtgaattgcattgcatgggcgcacaagtaccaaccatggcgccacttccatttgttgctttcgtctgtcatgcaagcaatatggaccgtactactaccactgctgctatcaagattcaagaacacattttttttaaagtcgagttttggatggaaaaagaaaccaatgggatcctcttttgttgcgcgctttacggataccccccaggcggccaggcccccaccaccaagcgcgctctcgccgcgactcgatgcagaacagtggggcagtagtaaatctttgagatccgcgcgcggctctgcttttgtggagatccgttcacgtagacccgtgtcaaagaggtcggcgctgcctctgttgcggcatgcagcggcgtgttttcggcgggggtagcggtagctatagcagcagcagcaaatgaccaacaatctgtgggagtgcgtacagaactggcctacgactacgagcgaggaggatctgtgcgagcggaggagggatagtgcacagagcgagcgtactgtatagggctcgtgctcctgcgtcctgcctgggaatgtgatcagatgcaaagtagcctggatgggttacctggcctacgcgcctagcccgtgttccctccgggccacgcaccggccatccacgcccggtggcgtgccgagcgctcacgggacacgccgggcaaaagggggtcgcaagccgttccatcactgcccccccccccccccccccaaacctttgggggccctggcgccaggcggcctacgcccgcaagcatcctgcaccctgctgggaacggacagtcacttcggtagctgtacgacgagcgcggccggcacacagtcgcgtcgctgatcttgatcgcacggtggcgtgcgagcgcagtcgttgcctgtgcttgtgtgcgtgccgcgttgctgtcgttacatgcgcatcatgggctgtgcgcgcaggcagctcagctgggaggggagggggaccggccggggagctttgataataaatgggggggggcgccggcgcggaccggctacaccttccgcgcggtcccgtacccgttgagttgattcgccgcgcgcgccggccaaggacggcgaccgccgaactcgccacccccccgccgcgccgcgcgccagaggcccgtcggtcgggacgcgcacgcggcgccctttttttttcccagctccggagtttggtgcagggcatgattgcgcgcgcctctgctgggctggggcgccaccgtgaacaatgatcgcccctttcgagcggggcgcagcagcttgggggggccgccgcatcatcaagacgagctagctgctggtaaagcagcagcccagcgccctgaactgattctttttaaatgaatcttttttatatatataaagattcatatttatatctctggtgaccaaatttcgttttggtattgtgacgcttaggtctgttactctgttactgtatatataggcgaacatggcatttttgttttccttcctacttacaattctgaaaggtcgttggtgcagatcttgtttgaccgaggccctgagttgcttcgagttgggtcgccggagggctcaggctacaggggactcgaccacgtgaccgctcttgagtgtcaccgtgttgatccatatgggttgtttgtccatcatcttcagggcatgagtactatgtatctgggccggctgggttgaagttggagtcaaattcattttggactcgaggccgagtgtaataagttgatgctgcgatcgatggagtttgagttttttttaagtcgtcgtcgtcgtcgtcgagggatcggatcggatcatcttggattcgccaaagtataggatggattttgtaacagctgacgacgaaggagtactgaagttgtcagtggttgcgagatgagctcgaagatctcgcacgaacaagcaacgtatatcgaggcatcgaaagttgacatttctcctagtgtggcaaccatatatagttgccttcagtcgttcttctatgattaattagcgtgttctcctacctggcttgccaaccgtcgaggattattctgtagtggatttgtggggtagatcaagaactgaaggtaaatacatatgagacgtaaagatttatataagtttgagctctccttgcataataatatcatatgtcctctatggtggtggctattgcttataatctgccctacatatgagacgtgaagatttagaaaaggttatttgatgccgtacctgataacaggtgctggattgaactgatgaaaaatatagcacaattatgtcatgatatccgataaactacagtttattataaactgtgattaaaaaaacattgttctgaaataatatgtacgtacttggtgaagtttccactcacttgaagatgtcgccacctttggggtgcgcgtgtgtggggtgcactagtgtgcatagtagaaacaggttgggaccaggggattggacaccacattaataaagatgcgccgatgatctgtccttcatgagtgcgccttcgcctagtgctttgcctgatttgctcatcaaccgatccgatacaattttatgggttgaagtccatatggaaggatccaccaacagtatatatagtgtacgtgtggaatgcagtgttcgtcgctatataggttatgtgtcccccactacatatattcagtattcgtgcttcgagtattgcttgctctctttgat

SEQ ID NO: 1934 - DNA, 2446 bp, Zea mays
  misc_feature (1)..(100): optimal_loci_4471_G1, chr1:23230585..23233030, Cluster 11
ttatgtttcgaaaaataaaggtaatgtcattattaacttattacacatgtggaacacagcatatcatctttgtttatctagtttatttaagcggcctagccacagctcgatcgatcagtacttgaaggggatatatatgatagtgaagctagaaatttaatttattttgttcgccattgaagagcaagagaggtataggccaatgcgcggtaccattatcataaaacactgaccagagacgacgacacatgttcgtaccgacttctattgtttctaaaatatttcgtttctatggattataggtgtagctgtctgaatagaacggactttaatccaaagcgaacatgcttatatagccacgcgcctcatagcatttacatttcttggtttccatccatacatgcatgagatgagagcaaagctctctacatatacatcttcagtctctctctctatagatagatagacgatgagactgcaccttgaaccttttgacgacgacggagcacctgttcaacgtggctatagatctagctagagggtgcgcgccaaagtcaagcccgccaactgactggcaagttttttttgctgccggatcggtacaacaggacgcgtagcgtaaaggcgccggccggagcagctaagctactacgcgggcacggcagcgccacacacatgcatgttgtacgagcaccggatgagagatggaagatactccgtccggagcagccgttctcgctggtctgacgcaaggcaacagctccatcaggcagcaggcagggctatctctcctcctatagccgtccatgctcttgttctttccgagaaatagaaagagcgagcggctacggcaaacggcatgcgtgctgttcacccacccaaatgtacccctgcctgcctcgtgtgtatagcctctctctctagctagctgtccgccgtctctcggccacgttacgtacgccatgcatggcgatgacaggtgagagagagcgagagagggtggccagggtgagtgcgccacaccgttggccagtgcggggcgccggggcccgggtctatcttcgttgctaggtcatggccatttggcgcacttgtcgtcggccgtacgacggggcagttatccatcaaggggcgcctggctttttgcgatgcatccgagttgctgctgcttctgcacccccaccacgcacccccgccctcggtccagatgcagcgtacagtagtacgcaacacgcgctggatgtcggggcagtcaggcgcgagagcaccggcaccagcgactggccctctggcccgcgcgcccctcggctccggccgcacgacagcatgtcctgttcacgccgtggcgcccaccggacaccgccggtcgagctcatctctccccggcccttccccgtccccggcggcgtaggggtgggtggggcgggcccgcgcggtcgctttcgctggaaagccagccagccagccgcgggcggataggatagctctgcccggtgttggctggtggtgcgctgcgcggcagcaggcttttccatctcatcgactgttgacgacggggctggaggagcgcacgggagaggcggcccggggacgcgtggcggcgcgccgagcgcacggccccgggcgcaacgctgcccgcgggggacgcgacacgttcgaggcgtcccatgtgcgcgcgacgagactgcggctgccgggacagcgatacccgggccaagccgacgagactggcgactggtcctcgatccctccgcacgacctgcactgcctttgcatcgtctttctacggccggccccacacgccgtgcacgaccgggctgcggctgcagggcatccttgtagcccccgcctccgccccactcccaatctctctctctctatctctctctcccatgcatgcatcgtcgtctcgtcgcccattcccccctcgggtcttctctctctgctggtcgcccattcccccctcgggtcttctctctcgtgcccagctggctgctagatctgcgtcgttgtcgtccaccaccctggaggccacttcatttcatgcacgcacgcacgcacgccacgaatgtctgctgtctgcacgtccaaatctgtcactcaccaaaaggaggatagcagtaaattaaaggccgactgaactttatcgatgtgcaatattctaaacaggataaaaatagaaatgcatatttgaattatttggtattttcgtatccactaaaacttgtaaatatggatattcatatttgtgtcggtttataatatctaattctaaatcaaattatcacttgtgtagtaattttttattgataaaacaaaatggctattggtttttctactgttttatttaaatttatttctacggtcttgggggtgcagagcaggtgtgggctgaagactagttgaatacacatacgtaagctttgatctaattgtgacaagcaga

SEQ ID NO: 1935 - DNA, 1407 bp, Zea mays
  misc_feature (1)..(100): optimal_loci_46253_G1, chr1:270989008..270990414, Cluster 11
aaattatctaggcttgtcttcttcttaggcgcctgagcaaacgctcaagtttcacactaagttattagctccaaggaaatgggggtcaacaatatgtgaacatcgcatgcaactactacgcgtttcacaactatgcactagtcgtcccccctccccggcctagtttcttgtcctgtaccctgtagcatctcgagtccaatgatcccccttatatcaaattatatgtaccacgctacggtgcacatgaggtggcaacaacacagcagtacgggcaaaagtccatcatcatctagaagaagaagcagggctggctagcacgtacgcagctagctcactagtctctagctatacagccagtgtagatgtagattcaggcgcgagcctatcgtcacagctcccgtttttttccctcttcttcctgatgactgagagcaacagcgagcagtcgtgagtgactgtccctttctcaattctgcacccaagaagttttcccatgacgggtccatgtccaagttgagttataccggccggttacgtgacagactgatgatatagatatttagcgtgcatgccgaggctacggagcagagagcggctgtgacggtgagatctactacatagccgaaagcagaggggaaccatcggtacgtacgaccgggtccctggccacaggttctgcgagaatcttggaggcacgccgcacgcaccaacccgacgccccactgatcgcggccgatacgtcccggcgggcggagaaaataagaatcggggacgcggcgtgcgcgcacgcgtcggctactcggcggcctggcgcctggcgggtgggcgtacggctgccttgaccagcggtgcggcgtggcgcacgtttttctggctttgcggctgcggggagagaggccggggggcgggttcacacttcacacgcagcacggccctcccggattcgtgggaggggcagtcactcaggcctcccggcggcgtgtcacgtgtgcatggcaggcagctccagctcggcgcacgcgtgtgtcgccatccgtggctggctttagacccagtcgtacggccggccggggagctggactcgatcaaaagcgagcttttcaccggaactttacagggtgattgcaccagatttttgtgactttcctcgctgctactagagtctctgtcagttcctaaactcacgctagtggtagtgggtcttcaaatctgctggttttggtttggttgtttccagaaggtctcgaaatctgcataggccctcctccctcttgccgacatgaaactcatcagatgtatataccatggcgtgcatagtttttcgctttcagaaaatactctactgctgctactactacaggaaaccaacgtgtttgagagagatgcccacgcaagccctatcgtaag

SEQ ID NO: 1936 - DNA, 1682 bp, Zea mays
  misc_feature (1)..(100): optimal_loci_46388_G1, chr1:271749657..271751338, Cluster 11
cttaggtgtaatgagggccaggctggagttgcattgggctgaaatgaaccaccattcggcccggctcgacccagcctcagcatttagagactctctaaagttgaagtttggcaaatgcttgggggcctgctacatcggcctagcccgccctgcgacgggcaagcacctgggccaggaatagaagcgcctataccatctgggctgcaagaaaagggacagttgatcactttggtggtattggcccaattcaacatggcgacatagcaggtgtccgaactgtcggctccagtcgcattcaggcaaaagctcggggtgggcgggtggccaagtcggcatacccatccacccatcgcaaacagagttgccatgctaaccccatgccggccccatacagtgcctagcgctcgcattaagcccgcaggtcagccgacccagtcttccgatcgatgggggcgttcatcggtgatcggtacatgtagagaggcctgctgctggccggcgggtcggtggcctctagcgcgtgtccaactcgttgcatacatgcatgggcagcatggaggccatgcgtgcatgcatgcatctcctctccctgttggacccaggtggcgcacatttacgcgtagcagcatgcatgtctcgacaacgacgacgacgacgccgtcgccggcggcaggcagacgtgtgacgggttcgggagcgtcgtataaggtcggttcgccactgctgcttgtccgcactcgatcgaccgagagaagtggtgtggtgtggtgtggcggcgaccaacctctcccctccctcctcgtcaaagcagatcgagggcgacgaccaacaagcaacgcgaaattaacctgtgtgtgtgcgcgcgcgcgatcgagcgccgtgcctaaagcgcgctccacggatgggtgcgcccggagctagcggagaacgacgtgcatccgaaagagagagagaccgcacgacatggggggccacgcaaagtcctcggcttgcggcggccggtcggccgtcccctgccccagtgtcccggcccggccgagccgccgaccacgcacgcggcgcgcgaggggaaggaaaccgataggtcggaccgggcggccggagtgccgggcggtagatttggcgatcgtcgcatcagtacgtcacatggaggctgcgctcgctgtcgctggtcgttacgtactcgtcaccgtcccgtcccgtcccgtcgcgtcgagccgagcgctgtgccaagccaatgcaagtcgcggccaggatactcctactactgtgccaagccaatgcgaagtgcggccgacggccccccggatgcgtggcaaggcagcacgtgcttgtccggcgccgtgccctctgagttctgaccgcggcgtgtgtgcctgtacgtccgagggcaagcatgcagggacagtctgccgaatcaaggctgaccaccactggggcgggcgatcctcttggggaatcccggaagatctcggacgggccgtgcgtaacggcgtacacacgctgtccacagggccgccggcagggcggggccgcctgcggctacgctgtctgccgtgctgtcgccgctgcatggaagataaagacacgctcctcagatttttctgtgcaaaaaggatgacgacgaggagcagcagtagattttttttttaacatagtatgtgtctagtgtctaggtaggt

SEQ ID NO: 1937 - DNA, 1636 bp, Zea mays
  misc_feature (1)..(100): optimal_loci_46391_G1, chr1:271759143..271760778, Cluster 11
ttataaacatgggcttgcacaattgacttcacgtcaattaaagcaatcagaagtgagaaacttcctggcatgaagacttcactttgaagctcctacaaggttacaacaaaggaaggacgcatgaagactcatctacaaagactacacatgtgaagcttcatccacgaagacaaatattctatgaagccttaacgaaaatatttacacaaagaccatgcttgcagatactacgccaagttgcaaactccaagaacctttgcagatgcatgaacatgactgcaagggttaattaaacaaagactaatttatagataaggatgaaggattagaaaaatgaccatacaaccttaatgtaaacaaactattgtaatataatagttgaggggtaggagagttttcttgtgtacattatgaagatggggatccctataaatacctcctaacatgtattgtacatgaacaagaaaaaaaattatgcaataaagtttaaccattctatgaagccttaatggaaatatttacctcagtaagacctcaagctatgaaatccaagaacctttgcaaatgcatgacacatgattgcaaatccaagaaccttcccccatccgttgtaccatcccttctactactatggaaaccatataagccacccaaatccatcactcccattaagctacggccacacatccacataatgcaaaatgaatccaatttccaaccatctcaacaattaatgaagtttctacgtattgagacattggtcatataaaagatgctatgttttcggacatctctaattttttttaacagctttcgcgtccatgtgcgcgcgcgctgttttacctgaacttcgtttgggcctaggcggggcgcatgcacaagtacagtgccatgcacgataaacggcgaggcagcaggacaggaacagaggtctccactccagcagcgttccttcctcgcgagggttgttctagcggcggggtggggggactgtgccgtgtgatcctggccggctctggccggtcggggaagtcctggaccgtggcagcacggctgcctgtcctccggagggcacgccggtgacagggcggtctcgcgtgtccgttttggaaggtggacgacaacggtcgacggaacacctgaacaattccgcgcgtcgtgattcatgtgcgggttttatcccatgcatgacaccgatcgcgtgtcctggattctggaagacgacgcatatatacggccgatggaggcattatttgtcaggatggatgttattggcacgcacagtgcgcagacagcgcgcgcggttgctgggtggtagtgatagatcacgagattattggcgcgtcatgttgtttgacctttgttcttgtgagggaggacgaacagaccaacaagtgcaagcacagaagcagcctcctcttgtccgtccgcgggtgtgtggtacaggcacgacccgttctcgacgctgctcctaaagccgtctgttggtttgtccggcgctgtttgtttgcccggccggccatgtgtgctgttatatatatagttttagcactgattttaatttcatgtagtactcagtccgtcgccgtcctaaaatagttcaagttctaggtttcgatacgtgaatgaattttta

SEQ ID NO: 1938 - DNA, 1947 bp, Zea mays
  misc_feature (1)..(100): optimal_loci_46528_G1, chr1:272340869..272342815, Cluster 11
acgtacgtgtcactggagtgttgtttggacatatggatcgtaactaattaaccctagacactccgggctaagctgccaaaggatagtatcgcacggaagcatattattatctataatatatatcggaactacggtatgcatgcggagttgcggaccatgcatgccaaagacagcacaggcgcgcaatcgcagtacaagctagatgatcgtggagccccatgccttgtgcctagctagctatcaagctagctactagggcgaattgttggttattactgagtcgcagaagagacacaccctagcaagctagagccatttaactagtgatcgatgcggctgccgggtgccggctttccaagcgtcttcccggagtatactactacgtgcagcggcggtgcatgctgcatgcatggcaatatggcatctctcgtcgtcatcctctttccactgcccttggcagctgataatgagctcagtcagcacgttaagcccattattcgacacttgggtgcaggagtcattaatgccgcggacaaatgttggtacatgcatccgccatctttacagccccggccgggcggtccgatcctagctgcgactgcgactacgaggagatgcatgcgagaaacgaaattaaacccgggttcccatgcgtgcgggagctaggacatgtgtgtgcagtgcatagtatgggggcagcgccatcggaatgatggaggaggacgtactactacgtaggttttggtgtcgatcggattataagctaaccgccgatccatccaaacggcgtggcgagcccaagacgctactacatgcatgcggacatgctagggccgcgtgttctctgcgacttcggagcgggggcggggggcggcgtggtttgcaagccacgacgacgacgacgccgggcgcgcgccaacctcgctgcactgcacggcctttcacacgagccgtacgtagatagaacagagtaagtacgtactactccagtaattaagcagcggttattattacgagcagatcagcggcacgcttctctcttcggtcgcgtgtaaactactcccgcccaccagaatgttgtcgcccggcgcggaccggccggacgcacgtgccggccggccaacctgatcgagacgaaaggggacaaacaacgcagaggcagcggatggggcggcggtgccatgcgcgcgcggcacactgtgtacatgtacactctcggcgtgtagtgtcgtcggcaaatgacaatgcagatttgactacgtacgtactcgtactgtacgtcgtcgtctacaccgaaacggtcgcttcaggccgacgccatgctggtactaggagtagtagatgcgtttgaataggaaacatcaagtcacggcacatgcatgggcggcgtacgacgacgttcgtgttcgttgggaatttctccggccggccggggcgaatgtaccatggaggaggatgcgtgtacttatacgacatggcaccggcgcccaagcaagttgccaaccaaccgtaccgcaacgcgccgcattgaacaggagaaaaggacaggctgagggctgaggccatcggtttccaacccacgccacgccgacttctctctatcgcatcggggctcgctccagtccccgtaccggacggccgtgtgtgtgtgcgcgcgcgcgcgcgcatgcagagaacacgcgtcgcgcggccgcggacggatctgccggaggcacgcaccgaggccccgccccggccacggggcaagccacgccaacgtatgtaaacgggtttggcggtatgggtgtgggtatgttatatatgtatatagtactgtacacggcgtcacgtacgcacgcggggctgcgtctgcgttggccgtgccagcgcgtgtcgcttgctgtctggctggaccggcggcggtgatgttcgctggagccgagcgggttcgcgcacgtcacacggaag

SEQ ID NO: 1939 - DNA, 1506 bp, Zea mays
  misc_feature (1)..(100): optimal_loci_46530_G1, chr1:272343225..272344730, Cluster 11
agccaaccactgatcaatcagtgatcatgaatccatccacctcgcgccggtgtcattgcgtgtccgcggatgggactggacgtcgttgccgagcccagacccagaggacgcgacggctgccagaggcctcttttattcatgtcggccacgaggaagccggcccccgtccgtcgctatcgctatcgcatctacggggcagatctcagcgccacacttcaaaaaccaagactatcgtatactagaatagacaatatcataaagattattgcgtctaattaaggtagccgtccagaaagagattgcgtcttttcagttctcaattctgaaaataatgtgttcatggatattacttctccgctagcttaatgttaatttggggagggatagtagtacggtttctgttcgcgtcacgaccagcgtttcgatcggagtactccgtacgtagcgcgcacacacacacactagcacttgagcacatgcatgataatgccactgtgctgtcgatgatagatcacaaccagcagtccaccgagtcgctgcaaaggagttattaggggctagtagttaacgtgccggttgccggatcggggacagggcttatgaatgtaccagtctagctagctagctaccggcaacaaccatatccttttgcttgctcccgcgctcgctcgccacctctacactccacaatgaaacgcgccatgcatgcatgcatgcgcaagcagcatgcaggccgggccggccgtggtgggcgccccgccggtgctcctgtgtgcgtgatcccgccggagggacgtactagttagtagttactagtacatacaaacaacaggcaacgacgacggtgtgcccgccggccagcagtagtaggagtaattaccaaccaccatttgacgatctaacccccggccggccccgctctcgatcgctctagggactagtagggtctatgcctcgatctccactgctcttgcgtgccgcatgctccccggccggccgttacagtgttcgtccacatgacgcgcgtacggtgatcgagtgagccgctgggtccagcttagcttggccataaatggccgtgagtaagcgtggagggaagaggaaatggcccggagaatttcacgagagtggtaagaacggttgtcactggcagtagtaaacgccagtgggataacagatagatagatagatctgcgtacgtttctctcctcacgtgcgtgcatgcatgcatgcacatcgttccgtgctgccgactgacggaggcgctggctgtgacgacatctcccgttccgttccggttcgctcgaccggccggcgcatcatgacgccgtacgtgggcctacgtacctccccgcagctcctcatccccgcgcgcatgcacgggaacgggatcaaacgttctcgcattctactaccagacgcagctgcagctccgccatatgcacgctttgtctcgtgtccactcattttgccagcaaggtccaccacctgcttcttcttttgttg

SEQ ID NO: 1940 - DNA, 1746 bp, Zea mays
  misc_feature (1)..(100): optimal_loci_5007_G1, chr1:25715757..25717502, Cluster 11
tttaaaaatttctgaaaaaatcaaatattttaagtttaataaaatatatatatatatatatataaataaataatattaaatcaaataaatatgctataaaaagtataattaataagtgtactaacgatatttatttaatgttatatattattgttattttactgtatagatttggtaaatacgctttgattttgaagaaagttaaactaaactataattgaggatggagggagcagtaatgacccatctaattgagtttggccaggcgaccaggtcggccagttagtgtgtagtgtagcagtgctctcttgcttcaagggacggatgagctcaacaactatgtagacatgtcagtcggatatgtgtgtgtgtgtgtgtgtggaggtttagagcagataatcgagaaacagacatgaaaaaaaggtgaaattaatggcccgatgtgtactatgaagctatatatatatatatatatgtgtgcataatccagtgtttgcttgtcgtctgtgcaacaacgttctagccaagatctatcgcttatcatcagctggtacgcgcaataaatggaaagccgtgcaggacttgcgtgcgggcacagtatttacccctagtcaccaagagcgcagcgataaaccagaagagcaagcagagcatcagctggttgatggtgaaaactacccatggcatgaccacaaatttaccgacaacacgagccgcctgctgtgtccgcgttgctaccacccaatgctacacacatgggatctctctcttgtttcagcaaacgaaatttggattacttggacgtctccgttgcagtgtgtttaattagtctggcattgtggttccatcgatcggggagctaggcagattaattaataagattcagttagcttgttcgtgctgctagctgattgttcccacaggctccattggccataaacaaatgaccagcattccttgcacggatctccggtggaggatcaagggacacgctactgtggcttgctattagctagcgagcactgctaatgacaggcaggctactagtactagctacttgctattttctagttaggactgctgttacagtcaggcacgctactacatgattaacttgcaagctttgtcgataacgaatgaaccgcgcgctatataagctagctagtggcagcatttttgcgtcgtcgtggtcgtcggcggcgtcggcgtcgtcgtatggagcagaacatgccatgtatggacagcgaagcggagatacgatggatcacacagtgtgaacccgaagtgtgaactgaactcacgttgctgctgcggacttcagcatactgctcgcagtcgtacgtacgttcgttcgtcgccgcctgccttcatgagctagctgggcctgcaagcagaaaacaatggacgtccatgcttcggttcagacgacgaagactcaaggaaagagagcaaaacaacaaacgcgctgccacggtgttccacatgcacgcgcatgcatggaatgtaatgggaggaagaggaagaagacagcaagccagcgagatccatggcattattcttcctgcaccgaacgccggcctgctttgaccctttgtacacatgacgacggacggtgacccgctccgatccgtttccatgcatactgtctgtctgtgcagatgacatgctttggcccatatattctgcggcgtagttgtttccactaccttcgctgacgatgaaccattacgctcgttctaagttcta

SEQ ID NO: 1941 - DNA, 2670 bp, Zea mays
  misc_feature (1)..(100): optimal_loci_50700_G1, chr1:294625460..294628129, Cluster 11
  modified_base (2459)..(2459): a, c, g, or t
  misc_feature (2459)..(2558): n is a, c, g, or t
  modified_base (2460)..(2460): a, c, g, or t
  modified_base (2461)..(2461): a, c, g, or t
  modified_base (2462)..(2462): a, c, g, or t
  modified_base (2463)..(2463): a, c, g, or t
  modified_base (2464)..(2464): a, c, g, or t
  modified_base (2465)..(2465): a, c, g, or t
  modified_base (2466)..(2466): a, c, g, or t
  modified_base (2467)..(2467): a, c, g, or t
  modified_base (2468)..(2468): a, c, g, or t
  modified_base (2469)..(2469): a, c, g, or t
  modified_base (2470)..(2470): a, c, g, or t
  modified_base (2471)..(2471): a, c, g, or t
  modified_base (2472)..(2472): a, c, g, or t
  modified_base (2473)..(2473): a, c, g, or t
  modified_base (2474)..(2474): a, c, g, or t
  modified_base (2475)..(2475): a, c, g, or t
  modified_base (2476)..(2476): a, c, g, or t
  modified_base (2477)..(2477): a, c, g, or t
  modified_base (2478)..(2478): a, c, g, or t
  modified_base (2479)..(2479): a, c, g, or t
  modified_base (2480)..(2480): a, c, g, or t
  modified_base (2481)..(2481): a, c, g, or t
  modified_base (2482)..(2482): a, c, g, or t
  modified_base (2483)..(2483): a, c, g, or t
  modified_base (2484)..(2484): a, c, g, or t
  modified_base (2485)..(2485): a, c, g, or t
  modified_base (2486)..(2486): a, c, g, or t
  modified_base (2487)..(2487): a, c, g, or t
  modified_base (2488)..(2488): a, c, g, or t
  modified_base (2489)..(2489): a, c, g, or t
  modified_base (2490)..(2490): a, c, g, or t
  modified_base (2491)..(2491): a, c, g, or t
  modified_base (2492)..(2492): a, c, g, or t
  modified_base (2493)..(2493): a, c, g, or t
  modified_base (2494)..(2494): a, c, g, or t
  modified_base (2495)..(2495): a, c, g, or t
  modified_base (2496)..(2496): a, c, g, or t
  modified_base (2497)..(2497): a, c, g, or t
  modified_base (2498)..(2498): a, c, g, or t
  modified_base (2499)..(2499): a, c, g, or t
  modified_base (2500)..(2500): a, c, g, or t
  modified_base (2501)..(2501): a, c, g, or t
  modified_base (2502)..(2502): a, c, g, or t
  modified_base (2503)..(2503): a, c, g, or t
  modified_base (2504)..(2504): a, c, g, or t
  modified_base (2505)..(2505): a, c, g, or t
  modified_base (2506)..(2506): a, c, g, or t
  modified_base (2507)..(2507): a, c, g, or t
  modified_base (2508)..(2508): a, c, g, or t
  modified_base (2509)..(2509): a, c, g, or t
  modified_base (2510)..(2510): a, c, g, or t
  modified_base (2511)..(2511): a, c, g, or t
  modified_base (2512)..(2512): a, c, g, or t
  modified_base (2513)..(2513): a, c, g, or t
  modified_base (2514)..(2514): a, c, g, or t
  modified_base (2515)..(2515): a, c, g, or t
  modified_base (2516)..(2516): a, c, g, or t
  modified_base (2517)..(2517): a, c, g, or t
  modified_base (2518)..(2518): a, c, g, or t
  modified_base (2519)..(2519): a, c, g, or t
  modified_base (2520)..(2520): a, c, g, or t
  modified_base (2521)..(2521): a, c, g, or t
  modified_base (2522)..(2522): a, c, g, or t
  modified_base (2523)..(2523): a, c, g, or t
  modified_base (2524)..(2524): a, c, g, or t
  modified_base (2525)..(2525): a, c, g, or t
  modified_base (2526)..(2526): a, c, g, or t
  modified_base (2527)..(2527): a, c, g, or t
  modified_base (2528)..(2528): a, c, g, or t
  modified_base (2529)..(2529): a, c, g, or t
  modified_base (2530)..(2530): a, c, g, or t
  modified_base (2531)..(2531): a, c, g, or t
  modified_base (2532)..(2532): a, c, g, or t
  modified_base (2533)..(2533): a, c, g, or t
  modified_base (2534)..(2534): a, c, g, or t
  modified_base (2535)..(2535): a, c, g, or t
  modified_base (2536)..(2536): a, c, g, or t
  modified_base (2537)..(2537): a, c, g, or t
  modified_base (2538)..(2538): a, c, g, or t
  modified_base (2539)..(2539): a, c, g, or t
  modified_base (2540)..(2540): a, c, g, or t
  modified_base (2541)..(2541): a, c, g, or t
  modified_base (2542)..(2542): a, c, g, or t
  modified_base (2543)..(2543): a, c, g, or t
  modified_base (2544)..(2544): a, c, g, or t
  modified_base (2545)..(2545): a, c, g, or t
  modified_base (2546)..(2546): a, c, g, or t
  modified_base (2547)..(2547): a, c, g, or t
  modified_base (2548)..(2548): a, c, g, or t
  modified_base (2549)..(2549): a, c, g, or t
  modified_base (2550)..(2550): a, c, g, or t
  modified_base (2551)..(2551): a, c, g, or t
  modified_base (2552)..(2552): a, c, g, or t
  modified_base (2553)..(2553): a, c, g, or t
  modified_base (2554)..(2554): a, c, g, or t
  modified_base (2555)..(2555): a, c, g, or t
  modified_base (2556)..(2556): a, c, g, or t
  modified_base (2557)..(2557): a, c, g, or t
  modified_base (2558)..(2558): a, c, g, or t
aattgaagaggggcatggaacgccatttggcccttcctggctccgttccgaaggtacgtacgggaggggcaagatgttttggccgcctgtcccaggcccctgctctcctcggcgctcgacgtgacggccgtccgtccttcctttcgggctacggcgcgcgcacccccgtagtcccgtaccacgacgcgaccgcgcgcacgggggagggagggagtggcgccgtccggcctttgtgctgctgccctgtcccgacaccggggccggggggacttcgtgctcgcacgcacgcacgcacgaggggcctcatcactcgcgcgccgtggctgccaaaaggccaggccacggagtggacactagccgccgcagcgttgacgtttagaacagagcagtgaggcggcagcggcagcagcagcagtactacgtgcggacagcaggacaggcgaattgttcgcagcatcgcatcgcaggcttgtgcgtgcgtgcgtgcatgagccggagtatgcccaggccctgccatgcccttgggagatgttcgacgacgacgacgtggattggatggatggagacatgaacgacgacagggctacaggaggagtgaactgggttgcccttgggagaggcaggcaaggcagaccgcgctgtcctcctgccggctgcccagtgcccaccccctcccgttgcccttccgatgcgtatcgacagatcatggtaaaccaaccaaccaaccacccaaccacccaacgtggctctccggctccggcagctacgacacctcgggggggcaaggcatgcgctttatcatgccaaacccaatcccaggacacggaagaagaaaactagaaaaaggaggggaggcaaaggcaaaagaaaaacaagagagagatcgctgtcgttcgttcggtgcctcccagaccagaactgatacccccctcatggccatggcctcctcatatatattttttttctacgacggagaaaagctgccagtatcggcgaatcagcgatcagggggtgacggggaaaaggcgggcgtcgcggccgtggggagcacggcggcggcagcgtaacgtggcccaggcgtccgtccccgcgggccactggggcacaacgctgtctgtccctcccgtcgtgtccctcctctcgtttccaacctgtgtggtgtggagtctatttttcctcaagctatcttctgtgacggacggacagcttcacgaggccgtacgaggtaggtcatcgaaagcaaagcaaacgtaccttgagaatggcactgtgcacgttgctctatgctagcactggtactagtacgtactacccggaaacgcaaaaatagtcagggttttagtaatcacactctttccacccgacaaaagattgtgagtgtcctgtcgggagagaaaaagagatacttgcgtgggcccgtgtgcgtgcgttcgcatgcatgtctgagtctgactccagctcgcagggctggtgcgccagctgggcctgaggaagtgtagagctccgaaactcgtgtactagttgggttgggtctcatctcatgacgggagagtgggcggccactggatcgattgggaggaatgtacgtaggcccagctgcagggagtaggcagcctaacgaatcacgtcggctgccactgcctgggcgacgccgattttcttctgctacgttttggtgtggttttttttttggcgttaaaactcgtgttccaccactgcgaacgtccgtgctctctgctttgcttcgatctgatacgatcagatttcctgcttgtccggcactcttctcccttgcactgtcctcaactgcgcacatggggaaaatatcacccgccatgcaagcggtgcggtgcagcaccgccgtcggcatcttatctttgctgtcgctgcggcccaagacttatccagaccggccgatcgtcacaaggccggccacgactacaccggcggcgatgacccgtgtcccggccgtaacataggggcgtttggtgctcaagttttttccacaattttagaaaaatattgcagtactatatatagaatggtgtttggtaatttaactaaaatctctgttttcaaaacgggaatattacaaacactgtacttgtcctgaggtattctaaacttagatctggacttcagtttttaaaaccgtagtattttaaaccaatatatcatcataactaaggtatactatagtatttttttaaaaaaaactatgattttaaaaaactttatttccaaacagctcgccgatccggcgtcgaagagttgtagcagtgcagcagatgacgccaagacgtgcctgcccataaacggttgtcatggctgtgcgtgtggccattaaggcatgcggtgttggaggtttccgtgtgcggccgaacccgacctcgacgtcagatcggcacgaaatttagatgtggcaatatgcgtaaaaatcgtcgtctatctcttgtctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctaaagattcagcttgattcgtttggcttttccttgaagacttctatcatattctctttctcttacaccaatttattctcacaatcttgtctagtttacctatggagatac

SEQ ID NO: 1942 - DNA, 1522 bp, Zea mays
  misc_feature (1)..(100): optimal_loci_52103_G1, chr2:2086831..2088352, Cluster 11
aggccagcacggatgcaaaacggtggcaaacgacggcaaccgtaaatcaatctcgaaaaagaagagtagcaatgtagcatgccctggaccgagcccgagaagcggtcgtcgccctttgcgactattccgtgtggcgttgggtcgtcgcccgaagccgatcggctggcgtcaaccacgtatcccagcggattcgatattgggcttcccggcagacccgacccgacccggcgaccccgttgttgaaatccggaggtttccccaaccaccgccgtgtgtggtgcagacgtcaaacctgcattgaccggcctgaccccccctacaccaggacacgccactctagcctatgtcaggtggttttttttttgcaaaatttatttgaggtgaccagacacacctcggcccatacataatttatgtgacggcccactcccaattatgcattatttagcccgtagatatgtggaggccacgaaagacagattgcgaacttatgggcctcatggctcgaagcctaagctttgattgcctgggctgcaaaggcccacgctctctctctttctccgcggcataacactaacagcatggtatatttatgtggtatatataatgcaatgcatgagcagtcgcagtagcagtaggcgtatgtatacataggcggatatagacggcaaccggcaggaattattgcgaggagcatcagaatcagatctcccccccatcccccttggagtcaacaagatctccggctttgcgtggagtggagccccggaaaaagcagtttctcaaaactacaaaaggagaagccaagaactattaccgacgttgtagcgcagtagtatatgtggagtcgacgttgtagcaactcgacgggaggatgtggccacggcccacggggctgccacgcaccaagcagaagcgaacaagctgctgctgcatgcgcttctgcaagcaaagcaggagcaagtactgtggtccgcctgtccgactctgtctgtgcgtgtgtgtcactgtctgtctgtctgtcagagtgggtcgtgttcgtgtatcactcaggccggactggacgggtgtcgcccggatggcacgagaggtccggggtcctccccacagccacagctccaggcctcgtcggaacagaaaaaaaaaaggcgcgcatgcgggctccaatgattgacgccgcgggtgccagccaatgggaacttctcgctctccgccgttcgccacctgcaggttgcctgcagactcgcggtgcggtgcagcctttttttttttttttttactttaccccaaccggtggtgaagacgacgacgagctagaggagaagccgagaaggcagtcaaccttaaaactggacggggcggaagaggtgattgatgagactataatttattcgttcgttcgtttgttagttaactaaagaattgatgatgctgccctttaccttcatcgcctccgcctgcactgcgtgcttgtctcatcattaggctggtgtggtgtggtgggtccctgctcctctccggt

SEQ ID NO: 1943 - DNA, 1469 bp, Zea mays
  misc_feature (1)..(100): optimal_loci_52113_G1, chr2:2095786..2097254, Cluster 11
atccggaatgctagaccatatggtcaatccggaatgctacatggacgctgaaacctatcctcaagtatttttttatgataattaatgatcacgtttatcttttaatgagcagcgtagccagcagtagtaggcctagtagtactacaatgcatgtctctcctgccaacgactactcgtatcccagcagacaactctcacggcgacacgtacctacggaccccggctgcaagtttgcgactgaccactgcaaaatgagatcactggtctggatccttggcaggcccaggcgcaagttgcccgcccaagttcaagttgcgtgcgtgcctgcggctgcgtctttaattaattaattaattaattaatttaccaaaaggagaaagccggagaggcacgcgcgcggcacatggggccaccagagcaaagtgacaaaataccggtcttgattgcacggttcacgtagcacgagcagaagattcatttttttcttttgcttcctcataactaaaacttgtttgattttggtaatgatggcgtttcctccgtccgaggcggacggaattctcgctttctgaaaggaaaatagtttagaatgtaaccaaaaaccatataaaaatgcaccgaatggctgtccactatcacggcccattttgagcaccggctcttgcaatttcatatatcaagtccttagtttcctttgtaattttcgtgatagtgtacagccctaaaataaataaaaaaacccgcatattctacgatataaaagagacaccttttctgaaaagggaaaaagtgtaagattggacgtaaaaaaaaagagagacacatgtaaaagagaccagacgcacatgaggcatcagcttcggtggatcgagcgagtggtgtaggatttgcttcttttccacgaggtttgggagatgcagcagccagccctacgtgcactgcatccacgcctccatttttcctcctccagtctcttttggaaaaagtggagtacagtggtggggatggcgtgcgtgcgtgctgtgttccccacaggagaattttgtgtgcgtggctgcctttcctttggccatcagccatttgttcacttgcttgcttcgctagcacgctacatgccatccctcgtcatcactacaagcaacaagcagcagaaaagaaaccgcgcgtctggcttttttctacttgtatatgtctcaacttgcgcacttttaaacataatatatataaaaacacattcgcggcagttagcgtctaatgattaactataactaggtaccgtaccacatgttccaattttagttcaacttgatagactttctctaataacaaatcaaatcatatgcccagaccagcctgccgggattacttgcatggaccagggcccaagcgttccttgggcgttaaaccaaaggtttagagcctcagatgcactcgaggggacccgatcgtggccggggatcccaagcgtt

SEQ ID NO: 1944 - DNA, 1665 bp, Zea mays
  misc_feature (1)..(100): optimal_loci_52177_G1, chr2:2259683..2261347, Cluster 11
tataatgttagtgataatctactagtactaggagtatagtataaacgatctcgtcgtgcccagggagacagcaaggggacaggaaagcgggaatgcaataacggggggagcggaggacagatcgatgggatgagagaagggagagatgctagctagctaagcctcgccgaagccgaaagcaaataagcatcgcgtcagctaagtataataagatgccgccgggcgacgaggtcgatagcaatggcgtggaaagcgacgctgctatgtgcttactctccctctctctttctctgatggcgactcgctttttggcgatctatcgagatgagtgacgagggctttctgagattgcacactgatgttgggctcctaacaagtaaagtagctataggccgcgcgccacgcaccaataatttaacgcagggttttagtcgcgtagctgtgctgcgctgtgcatcccatggattggggagcggatcatgcatgcatgcatgcatgtccctttgcttcttttgagttcgtgaagatgtctagtagtattataataaataaagcactcaaagcacactaattaaagcagtacggacaatggagcagcatcgacaacctttttttttccttaggacaatcaaataacacaccaccatggatatacgatagtacagtacgtgcgtgcgcatatatgcagccatcgcctgcgctcgtcaaccaaacatgcatgcgttctaggtatacgcgtacatgtgcatagggtcaaagtaggctcactgtgctgtgacgtagtaagtgcagtgcaggcaggcactgtcgcaggctcccagcactagctagctagcaccagctagccctagctgctcctaaccccaccgctctggctactacccccacccccaccccgccgccgtgacgtcgcgcgctgccacgcacagcggattcctgggagacctcgaactcgaaccattggtggttagttactatgggaatccatagcatagggagggaggtgccggcacttgccactgctggtaggttgagtacttgtaccacggctagagaaggcaaagcaaaactgcaaaaaggctggcgtggcctagcctgggcgcggacggcagatcatggaggaatgatcgtgcctctcgctccatcgggagccgaccatgctggatcgtctccaagctttctttctttctttctttgcgagggctccccgtggccctgtgctgtgggtggctggcgacggctaggcaagcgaacgagtgcgccgtggcccgtggagaggggccgcgcgtgtgcacggtacggtgcgatgcatgcgagattgcgagcagcgcgcgggcgatgtttttccggcgccaacatggtggtgcgtggccggccggccgtgcgtcgtctccgtccattatgttcgatccaccaccaccacggcacgtcgcaggcagggttcggtacgtacgcacacggggggtaaaataaagctagctagtagctagccggcgccgcagctccatcatctctgtggcacagcaggccgcagctactggtggtcggaaggaacagtgcggtggcgcgagcagcaggtcacgcgtgcgtgcacccgcggcgcgtcgccgtccgtccgtccgtccgtcctgccttggggacggggtcgatcgggtcccgagtccc

SEQ ID NO: 1945 - DNA, 1535 bp, Zea mays
  misc_feature (1)..(100): optimal_loci_52573_G1, chr2:4291937..4293471, Cluster 11
actgaaacggagcagggcattggttcatcgaggagtgcagtgcgtatgggaaagggaaggcaaaagcttcgaattatatttcaacaggttagctggctccatgaattgaaacaccgcaggttattaggtcgccatatatatgtaattatgtatggcatttaacagtaagtcttatcgaacgcagacgtaccccagccatgttgctgcatgcaccatgcagtacgcgcacgtaccgtcgtcgtcaaccagggcctgcacgcgcacgttacgccgtcccctctctccccctgccggcgggcgggatacgacacagctagtagtgctatagcctgcatgcatgagcgcgaggctgtgactgtgagccaccgcatctgcatagtgccgatcaccaacttggcacagctaggcgctagcgcgcatatctcgcgacgatcctcgatctcaagccgatcgagcctgcaggggcgtgggcactatatatattatatatagcacgacacgagaaaggctaataaaacgccgctgctgcatgcgcgcctctgaagagcaatgttcatgtaatctgtaggctgtagctagctgtgtgcatgcatgcatgatgtatggagattggacgagctagcgccatggcgacacgccgccggccgccaatggaggtactgggaccggacgtggcagtggcgcatgtggtgtgtctacgccgcgcgcgcagctatctcggcccaccatgcatgcacgcacggcagcgccgggcgcacagtgtccaggagataacataggcagatgatgctatcctagctaccatcttccccggcccggaaaaagaagccggccgccggctgtgctgaggggccaatcgacgatggagcctgcaggatctcagaaacgggccatgcatggccgccccgccggccggccaggatgccgcgcgccgtgtcgaggggccggccgagcacaagaatagatagatagaacgcggacactgcgactgcagtggcgcaacagttccatttcaccagcacccatcaatcagagatagagcgcgcgcgcggccctgcaccgcacaggtacgaactgctaatcaatggaccaccggccaagcaatggatggatccgccgattgtctctgtgcttagtaataatcgctgctgtacttgattactggaggatcagatcatgctgtcatgttgacccaacatggcgtttaataggttgttcagaaacgctgtgtatctgtgcacgcacggtctcggatagattgggccttcgtttggcatcatagctccaatgtaacgtaagcttctgtagctgtttggagctatcctgttccagacgggataaaccaaaacaagttcacataaggagtccctcaaaccatcttcttacggaggtttaagtgaaataaatcacagctaaaaataacaccttcactcagcttcaacgcaagcatgtaggcaccaccgtgtgagaatgccatttttggcctgcgcgcatccggagaggaggggcatgcaaccaatgaggtggctttttta

SEQ ID NO: 1946 - DNA, 2346 bp, Zea mays
  misc_feature (1)..(100): optimal_loci_52574_G1, chr2:4293583..4295928, Cluster 11
agtcggatggtttgtgacctattaacggcatgagaggaatatcactgtaattcagtaattgcattaataagtatgtgaagttgtaattatcacacatttagacacctagtcatttaacatataatacctaataattatccaaactgttgaattctaagacctgcatctctgtcctaaaaataatacaactctagtatgtaaatgttgtctaacgccggatagttcatttttataaaataaaaaaacggagggagtatgtaattattagcaagtgaacgcatgcatatttcagaccttgaaaagatacttggacggcaaccattcatcttggactacgacacgctaagtccaaggtatgcgatttcactgcctctgataacaatcggtttgtaaccgtaatttgtattttttttccctactagtgattgggtaagcaaaactgctgtgcttcatgcgccgacaccaagcaagaaggtaccgggccagaagaaattgagtaggccaatcttggcacattcgaacaggtaccctaagcaagaaccggcccaactgacgtaggcccgttagatcccccagcaactcgggcggatccggccttttggttttccaaaaaaaaaagactaagcccgcgtgtagacggcagcacacaaccaaggccgctggtggtctgtccagcccactccgctgcttcttccttcatagcccatgtcggtctcctttaggaaacaaataaaaagagtaaagggcccaatactcgactgccgtcccaaaaaattctcttctgggcagcaactgcccaggggcagaggaaaagaagacgagacgagaggagaggagaaattcctacgtgatgacagccaggaccaggcagggttcggtctgggcgtgtggggcccttcattccaactttgcaagccctcgctctcgtcagtcggaatcacacacggccaattcctcgcgcgcatcatttcgctctgaaagttggaagacgacggacgtcagtgcatgaaggctttcagcatcgttcccctggctccgagtcccacttgctctcagcattcggggatcttggcgtgcatgtcgccgccggcagacgatcctgcacgactactggtagcagctagcctaggagggagtacagtacatatatattcttattcttaataataatgcatgcagcttagctttattatttgcttcgcttcgctttgccttgccttggttgggctagagtgagtgagtactagctagcagatagatgagcatcggctagcttttggttgggtggtgggagacgagatgccaaaatgcgtcgcctacctccactccgactccacctcgacaaccatgcacgggctcagctccgcatgtctgctcttttaagctcctccgtccagtcgcttcgatcgcttctggccctgaccataccaatcagagggtgggtccgaataatatatataattcagtagatcgaagagagtgacggccgtgagggcagatcgtctagtctcccggttggggactccctctttaattacccatattcagagcagcgacttggagcatgcatgtagccaatgcaagcgagaggatcagctagccctatactagtagatagcgttgaatatatgctagtacaagttacacgatccaactaatagccgatcgaatactacgtgtacgtggtagttataccctcctaccccacaccccagcccggccggaaaatgatcgaacaggaacagtacgagatgccaaagccagatccggccgtcaaagctagcgtgccggacggcggcagcaccgggaaaagtgacgcctagctgcctaccaccagctcatgctcatccatccaacggtagtggaggaaggaggtgcagcaggcgagcatggggcatgggcatagggcatatggcctactagatcgatcgaacgaccaccgatctgcctgcccgcccgagcactttggatggtcgacgagcttgcggcccggtcgtccgtgtagggcgggggatcggagggacgaacgacggggacaggacagcccagcggcgacgcgcactaccaccagtgggtgcgcatccggaaggggatgccgccatgccgatgccggggcggatgcggatcgcgaccgcgccccagcctgccctccttgcattgccgtcacgttcgttcgcccagccgccgctgtgccttttgccgtcgtaccagtctagcggagttgtggctcaacttgttttggcagccaaagatgataagggcgatcgtacgagacgatagggcgaatcgtacgagaccgacgttttctacccatagatttccggatttccccatgtttatgcatgc

SEQ ID NO: 1947 - DNA, 1701 bp, Zea mays
  misc_feature (1)..(100): optimal_loci_52583_G1, chr2:4310024..4311724, Cluster 11
aaaatgtcgacaccactattgataagcattgtagttgtaaactcgatgggaattttagagacaattggtcccgataaaacttttcgtgggaaagaataagatagcagatatattgaacacagccacaagacaactacgcaacaaccaccctcgaaatagcaaagcttgggtaaccatcacctctgatatctgacgatatgtgagactgaacatccaaatttgaaggagaaaaccaaaaaaaaatgtctcaagggtcaaggttgaccctatcatctctggctctgctactgattactctaacacttaatgtcacgatgcaagccgcagcaaaagcatcacctcgcttccccaaactgcgtttgtttagcacaatcattgctcaccttacccctgcaaaaaaaaaaaaaaagcaccagcaatggagctgtcgccgtttcgggaattatgtccagttcttaactctgacaggaccgtttcgctcgcataaacaacaacaacaacaacaaaaaaaaggggggggcagggtccgtccgtcactgttgttgttaaggtcataaaaacaggtgattacaggtacttgtatccacgcaaggtcaactgcgctccccagccactccttccagttttttcgtgcatctctctgtttctctctctctttcttttttctggtggccaataattgcatgcgcacacgatgcatggaatttgcaggtcggatcgggcctcgcccaggtgaggccgcgcggtgagccgctccgttgagccgttagatcggaagcctgaaagcgaggtggccgcgagctggagccacccggctgcagcatccgccgctcttttttgtttttttttgtctcttttcttttctttcacgagcctgaagaggcaaagtggagctgccccgctagtcctggcctctgcacagcacggcggagcagcttccccccgtttccgtctgaatccattgaaggtctcctctcgtgtacaggaatgctttccaagacggcttagacggtgctgatgcatgcatggatacatctcgctgtcttttctccggggtcgccgcctcttggacccgggtgggcggcaggtacgtgcgcgtgggcagtcaagtgcagcggtcagtttcatcctcctgggactgggaagacgaacgaaaacgaaagccaccatttttgaaggacacccccctcccctgacccctactacccttggcaggtccggggttcacggcatcttcctgcgccggcatcgcggctcggggaagggggtccaagacatgctctctcctctttccctgccttccctctgcctattgtttccaccgaatcgcattccccgacggcgatccagcatatttttctttttcttttttttctggttactggcgtttctttcttttcccccctcctccctggccactcctgactgctagtactttgttcttcgttcactgctgctgtaaacggtgtaatgaaatcgctacgaaaatcctagatgaatagatccacgcgtgcctgcgcaaaaaggatacgtacggctcgtcgccgccggtcaactatggcaggaaagcagggcggccggttgaacccagggtccaaatcctgcgatctctttcaattcgtctcatcttctttttatcatctcctcctggtccttttccgccccttggactggcatcaaggctgcacaataataataaat

SEQ ID NO: 1948 - DNA, 1592 bp, Zea mays
  misc_feature (1)..(100): optimal_loci_54245_G1, chr2:13289679..13291270, Cluster 11
attcggtgcttcggtatgacgatctttaaatccttctatagctttgccgttcatgatttttatttaccgtttggttctaccttcagttttagacttttccatgttgatgtagatctccaataaaaagttaatcatgttaatcacttttttttaccttcatccaagtctattgcatcatttgaactataaccaagaagatatgatcgagaagcgtatgtataacaaggatcttgttagaataggagatacggtcgagatcacaatagatatgtacaattcaagactgactcggaggattaattaaactcctaacctatagattatgcatacagataacaaccgagaattctctgtgtggagggatatatgaatcctaacctaatttccctcacgcgagagatttggatcgacacacatcatacaacaagagacgagcccagcactatgcatggaacggtgacagatccacgaacgatccctgattaccgtgtcttgattctcgtgttgcttgtttgttcttcttgctaggattggtgccttgaagtgtactcaaagatgaatgaccggttgatcacatctgccgactgcgcgagccatcagagcaatgtagattatatgactgacagggctgggagcaaattaagttcggataatgaaagtagtcttcgggtcagagtgaaagggccgtaagtccgtaacaaactcggacaccgccgccgactactggctggcgaccgtgacggactgacgggtatactattacttccgctgcacacggaccggaccggcacaggaaagtttcttctccgatggaggacggctccatcgatctggccaatgttgtgattcaatgtctcgatgaacaataaaatgcgttcttgagctggcaccgtgcatgtgaggcgcgggcctgctggggcgccgcatgagagaagaagttgggtcgtactcgtacgttggcgggtgacgacgctggcggacactccggagctaggagagagaggccgtgcagcgtgtcatttggacacacgacacatcgatcgatcgatgatctgtgtgtggcgaaccacacacccaggctgctccccgtttgaatccgtgacgcggacttcgtgcgtacacaggatgagaccgcggtccgcgcgtatgccggtacgcgtaccggcgtacgtatgcatcatgcgtgcatgccgcctcgcatgcagcgaacgggcgccgccgcccggcgagaccttttgccgccgaactggaagcagcgggcggcacgtacgcacggcccatttaattccatcaggcatacgtagtactaggcggcagcagggtgtacggtacgtgtacggtgccaggtctcgctcgcccaccgcccgtcgggcgccggggggcacagcgcacgcatagctagagcggaatgtacacgcacgcgtgtccgattcggcggcgcacctgcgcgggggaggggggccgccgtggcgcgcctgtacgtttccgtgcaccgcgggcggctagccggccggccggtcggtcaaacgaatgatgcggagggggatcagccgcggcggatagtctccgctccgctcgccgattcacacgga

SEQ ID NO: 1949 - DNA, 1794 bp, Zea mays
  misc_feature (1)..(100): optimal_loci_54437_G1, chr2:14255282..14257075, Cluster 11
ctggttttttgtgtgtttgtggtcgaatgtcatcaaatttatattagaatttaaatgaaaatatttttatgtttggatataattctttaaaattgcaatttaaataaatcactgtatgaattttagagctatggctcgagctgctctgacttgggctattctcaacagtagtttcgtgatacatttcatgatgccgcattattatttttagacgacatggcacttattgagaatagccttattagggaacaaacagctggttttggttcttgccggttaatgatgcggcggcgattagtcaagcccatgaggcgcaccggccccaccagagaatctaggcctctaggggtaccagtatatctatcaatagctatatgccccgctcgtcagttggaggaattgtcttgccctcgtgtctcgtccggcccacggagatgtgtcaaagccaggaattattcgctgcgctgtactgctgtagtagtagtagtactaccgtcgagcttgcttcattgcttgggatgggagggagtcaaataatagagaactcatttctgcatcaccatgttgggtggttgaggcgctgaatccatggttttctggtactagaattccagtctcggcagttcttgtcaccggtcaaaaggaaccacccggggaaagataatgaatggctctgagtactattcatctgcttgctgctggccgttagaaaatctggatggttcgtcagtctctgagtattcccatttgttttccttcaggtgatctgtatcggccatacagcccatactgtgtgtgattcggttaggtgtgctattatttatgtattatctggctgagatcgaagacaaaaaaaatcaaacaaaaggtattatttttttgtatatataaaaaaacgtctgggcattattctggaggcaagattatctataataatgcaggtaacggtgtgttttaaatagaatatatcagtgactgctggtagtaggaaacctttacatgttccttcttctcgttctcattttctatgagatctctctctctcactctgtctctcgttcacacagaatataaatgtttttttttattttctccgcacaccaagaatctttcttggtcacccatgactcagccaagccccgcattattgcttgcgctcctcaggaatcttacgttcagtataatcagggggctgagaattcagtcgtctcactgtgctgaacctttgtgtgcagttcaacctgacttgacaaagtgtactaaaacgcatgctgagaaagtgagaagggcccgactgaaaaataataacgacgccgtcagccccgactggttaaccgatgctgactaggtctgggacaaatttttatcagcactgcacggggttcccgtgccaaaaactgacggccgttcccgtccaagaacagccgccccccccccccccccccccccagcacacacacgcagctccatgtcggcatgtcgacatgctgcatctggcgcatgagaggatccagccccccttttttccccctgtggtccttttcccttgtggtggtggatccagccatttgcaggcccgcgacagcagccacgtcgaaaaagggcgcgagaaatgttgcgcgaagcaaagcagcaacagcggaattggagagtgtcagtgactgatgccgacgggacggctgcgtgcgctggcccggccgggcggccaccggcttcgcttccgggttccagctgaaaaagtgacgcgcccgggccggaacaaaacatcaaagcccgtttttttaacaacccttt

SEQ ID NO: 1950 - DNA, 2119 bp, Zea mays
  misc_feature (1)..(100): optimal_loci_54920_G1, chr2:16927363..16929481, Cluster 11
aagccaaccaaacagacggatagtagtgtgagtttgtagtagtttttgcatatcttatatctataatcatatttttagtacatagacaagtcttataccaagaatcatatttaacgtaggtggattttatgttgttggatactgcataaaatctaatgcatatcccattatcaatttatgttgggattgtaagattttggcacaaaatctaatttaaaaattagaatatgttcggttaaaaatgagataatagaatgagatgagaataaggcacaacgcaaacagaattggctggcccgtgcatcctcattcttcatttgctcagggcggcagcgagcacaggcccacgaggctgctccgacgtaattggcagtactactacaagcgagagcgagggcggctgggagagaagcggtcacttctctcgagcatccccatgcaaaagcggcgcacgggccactgatggcttcggcatcattgtgttgtgtgtccaccgtgctccaccacgtcgtccggtcgtaccctttgcctgcctgcatggcagcatgcatcgtacgtggaggtcgagtcggtgcgaaaaggatgacgcctttggggtggaaactctagccgcactaccctgcaggtgcagtctcgtgcggccccgagccatcatcattcgtcggctaaatctaagcctgtatgggtttgtagtagctagtaggccgctgtaccccggcatgcgtcgaattttccaccaccgtcgaaatatatgatgatgacctgctgatagcatgcatgcaacgccaacattgtattagcagccagatcacacgtacgagccagtatagttggcgcaagctaagctagcgagagggacaggaggaatcatgtcacgtcgaaaacctcggcaactactgttggttggcgaggactcacttgcatgatgcatggtgatgagagactgtcaaataatttgtacgatcgacgacacaagtgaagtgctgatgaccgatgtgaaccaaagtttcgttaaaagactaaaacagccaaaaattgcacgagagacagctagctagctagcgtaggcgcggtagctctcctatggctagctggctgacccagcacaagttgcacgcgtcgggatcgatttggacgagacggctgctagcgcgacaccgtcctattcggatgtcaaccatttgtttactcatcatcagggcaaaacgtacccgggacatccatgtagactgctcgtgcccgatgtagatctctctctctctctctctctctctctctcaagtgtgaatcagtagaactgggtcgggtctttctagtagtttcctgtagccgtttccatcttggtgtatgttgctctattttatcttctctcaatcacgggagaaaatggaccgtcatagtattgttgtcggaaatgaccaacagcagcgctcatcatcagtctttttggaactcaacaaaagcagcactcatcatcagttcgacagttccccaaccattttgaaactgggccgaagccttccaatatcgctttgatacatccattgataaagtcacagcctgcatcctcctaggcaaagcccacttgagccagcccataggccactctgtatagcccacatccattgataatgtactcttgtcaccgccgcggcaaccaccgaaagctctaacgcacgccgcgtgcgggggagatccggcggtggcgaagcagtagcagcggaaagtaccagtggggcgagctcgcggacgatgacggcgccagcgacctcggcctcctccagccgccggttgtcgtcgggcccgacgcgagcggcctccgaaggatgatcgatcgagtaccgcttcgacgacgaggggcaacaaggtcaagttcgccaccaccacccgcacctgcagcgctcgtggaccaagttcggcgacgccggctcgcttctcaccgcggtctccacccaagattcgtctgataacaatgttagcacagcgtctgtagaccatgcatggtttccagttggggacttgcttggggtactatggaaggaacatgttgctaccactccggctgcttgtgatgcaattaatgatactatgttaaaaatagactaaagttagcgttttg

SEQ ID NO: 1951 - DNA, 2441 bp, Zea mays
  misc_feature (1)..(100): optimal_loci_54924_G1, chr2:16932637..16935077, Cluster 11
ttaccggagacaataaaacctgaccccccgggatattgtcttcattttactaaaaaaacagttttcgcaacaatggagtatattttctcggaccatcctattccgacaaatgatgctcggaaatactgttccgccaaaaggaaaaaagaaaaaaaaaggaaggtaacaatgacttctaaaaactagatgctcctgcaattgctatggatgtaatccaaacataatcttgcattttatgaggtgccaagtttgcagtatttcataaataaagaaactcaacctctaggccagcccagcccagccatatatacaacgtttcttcattggaatgtcaggcaacatcgagcaattggtgggctggcgacaaaagcggacgagaggctccagaccatatgaaaccataccagtccctttccaacagctgcaactcgcgtggacactaactaaaatcgtgtggcacggatttattttaggtgagcgatcacgtacctgcacatcgcttcagataactaccgcgcgtcggattactcaaacgtctgactagatcacaacttggtaaaccagtggcctgatgagatggctagatgcccccttctataaaacttttgctagtgccgtcttgtttcgctagctggggacgctagaaagtgcaaatcttgcaaggcaatatatgtgctggccgggtcatttcgacgcaccatagttggtaaatagggccagtggataaccttatttagcaaaggttcctgtggcttgaccagctttttttttaatggcgaatatgatcgagatatggtggcagccccatttggagagaagggggccctccacctaacagaagataaagctcgcccatcgatcagctaatggctctgatggctgactgctcatcgacaccattaaggcattagcaaggagcgagcacgagcagctagcagtagcaaaaatggaagccgcatagcacctgcaccggcgcaatatttttttctccgggccatcggcaataattgggcatatcttgaagcttacatcaccgatatcttttgcttacgacgaggccgaggccgaggccaggtccagggatgcagcagtgcagatgagcccgaacccgagccccacccagctcttcctcccctagcagccagctatcgctagcttcgcacagccaccaataagccccccctcccccgcggcggcatctctctccagctcgctcgctcgctcgtgattcacccgcaggagccacccaggcacgagggcctatctcttcccctcgatcggcagacagacgacggaagtggccgcgacccgggtgccggccttgtctttcggctttcgcgcgcggcgtggacgatgtgtgaccttgacatggcgatgcgggtggagaacaacgggcgcccccgtcaaggtacgcccgtgtgtcccccactccttcctcatcttcccgcttccagttttcgccttttgctcgcttctgctgctgctacggctctatctgctgtgcatgagcatctgcctgtgtcgtcccgtcccttcagatcgcacagtttgcgttcatgattgtgcgccgctgggcgctagccatgggggggctcctttgaccgcggcctttcggcgtggaggaatcgcgctcgcggctcgtgcacgtcggtcccttcccttcatgtctgtctcggcgcgcgacctgtcgagggcgctgttccttcgcaatggtcgcgcccatgccggccgatcgactgggtttcgtcacattacactattggcgacctacagactacagcgactgcgctcgggccctcgatgaacaacagttcgccgaccggatagctgctgtgagcctagcctgttcctagctttgggtcgcgtcgtcgttacccgtccgtcaccagtgaagtaaagcctgcggttagtgagatatgggggggtagacaagcaacgtgcgggctgctgtgggtgaatgcatggcaagttcagccagcagccgagcatagagcttgaccgagagaaacaagccagcagcttgtaaacaggcgtggagccagtcaaacaggacgccaccagctacctcggactctcggaggacccaatgccagtgttagcacggcacgactacaacacatggattggatggatcgtctttttttcacactgccgggggctgccttgacggccatgcatgccacagctgctcacggtctgctattcattcatgcatgctgtaatgtccccacagacattagcacctcctcacctccatttgctaagagttaataaacctattagcaggcgtgtttcaggacctcatctgctaattttagctataagggcctctctagagcatctatagataattgttagctacaattaattgtaagtgtttcaagctggccagctaaaatcttaacttattgtcagctagaccccaattaacaattaggata

SEQ ID NO: 1952 - DNA, 1627 bp, Zea mays
  misc_feature (1)..(100): optimal_loci_55003_G1, chr2:17231680..17233306, Cluster 11
actagctagggcggagggaattttgactgcggggccgaacagaaatggctcatgcaaattcagattgccgcgggaaagtgtggaaccgacaacaagattgctgcatgcaggagatcgacagagggtggcgggccgggtgaggcggagctacaggggcattgggcggtggcagcgaccatgagggaatacatgtaggactccatgcacacatttaggatacctaataaaacgatcccaattacgttagcgtgagatggaagacatcgtctttaatttcgcatatatatattagaggaagccaattatataatggagcaaagcaagaggatatacatgtataagagtcgacactgaaacacacataatcacgtgcgtgagccatacctgcactgtacagcgaggaaacgagagggagtggggtgatatggacaagacaggtccatgacatgcaaatatatcatatcttccaataacaaggccgccttgcggttgcagcaacaccaccgcaccacgcatgcatgatgccgtcgcctatactcgcgctcctgtgtgcgacgaaagagagggcgtagaggagggttcacgggaggttccaaggcgcgcaccccaaatcatgcctctgcctcgaccccaccccacgcacgccccgtggagagattcccacgacgtacatggcttcgtgcccccatggcaaagagcactactagccagccagtggtctcaaagcactcgtggccgggactatgatgatgagatggacgcacagtcagtggcaagttacaccggtcgtgcgtgtgtgccgccgatatgtgtacattggtccaaaaaaacaggcatgtggtgcatgccatcgtatgcatcgcttacatggaccgcgacagtcacatgtgacccgtatgtgacccgtacatttcaacctcctctcgtccagcaggtccacgggtgaaacatgcattttgtgaaataaagcatgcatcgtggttgaaggtgaggtagacatcgcgtaaagaatatacgtccgacagtatgattggactattcacgtgcaccaccaaactattcgaggtgtagacaaggcgacactcgatcgagcatcaatacgatattttctgggcgtaagcttaagaggttggaaagataacgtccgcaagggaagatttgaacatcacgaaagagaatgtacgaagcccgtagattcaggcatcaggatgtcctgcgccatcgttacgacagataggacgattagtcgattactcaaaaggagacactctgaccgcacccgtacaccgctaggcacacgaggctcgtggccgtttccgcatgtcgcttatgcacagcatcgctgaagtagtaccaaacagaaaaggctcggaccattcccaagacatccagacgacggtatcagaaattcagagagcaagagcaacaaagtggcccagcactgagcccataaacccagctttacccaccagcaattaactaccaaatcacgtccctccacgagggcagctccatggtcgggggacagcgctcattccatcaatgatgcatgccaatagcaacttacccagggcgtgctaagaccttttccttcatggaaagggcaccaggacgccgcgcctccaga

SEQ ID NO: 1953 - DNA, 1751 bp, Zea mays
  misc_feature (1)..(100): optimal_loci_55650_G1, chr2:20716573..20718323, Cluster 11
tgttgaggatttattaaaaagaaagaaaacggaaaacaaataaacaactgggaacgtagagagaccaaaagagaactgtgggccagcagactgcagactctaattatcaggaacaggtcgaaacggtttgttcttgggccgaatgcttcacggatggaaattgggctgtaagtggactcttctggtatcgtgcgcgatctaatagtgtttctgggcctttaccagccttcgtgtggttaccttaaaatccaagtctttcctgcgaatcttcttttctttaggaagactagtaaatatgcttgtgggcttatagcgcgcgagaggaagaaaaaaaaactatcgaacattcatacgacataacaactatatttgttattttagttcgctagtttgttctggagtgtgttgtgtagctcgctgctgctatcctactacgttcttgagtggaatcaaacttagatacatagtaactaaaacaaagtttagatacatagaaacttgcttatcatggaattttggctcttgaatatcgagaaaaggtaaagttaggagccaagagatccctgatgttgcagaaccaaaccaaaacagagctaattacagtcgaggccagacagtcgcaaggcgacagacgtggtaggccgtgggcgtgatctggacactcatcggtgatgaacaatagcgcacgggaggggagttacgttcatggcatgtagacagggctgaaagtttaaagcctcgtttggtttatgaaagtggagtggcatggggtgtcttttttttttgtaattatttctgttgtgttgtgcgttgcatgacgatgcgtcgctcgaatcgatgcgggcatgcgctggggcaccgagcatgcatgcgcgtatgtgtataatagtattggccaagtggccaccacactggcgcttgttaattagtacatgtgtatgcacaactggaaatctatagagcgggaatggaatatcctacaatctataaagctgcctgttctttttcgttttttttttggtaaattattaagcgatttgtcttgtaaggagtagctgtttgttactgttttgcaccctacatatattgataggtagtagagaggtttcgttctccgggcgacctgggtgcgatgaacccaatacggccatacgggcagctagccaacttggcgccacacgtccacgtcgattccgcacccaaaatgggccggctaggtcgaagacactgatgcctgatgatgatatagacgtggagttatcacggaaatctcattcttatctccacgaccacgaagaaaaataaactcacgagaccgcatcgataagataatccacggagaacctgtgcttgtatactacattaattagtaggaattgaaggtcgtgacgcaacagaaaacacgaattttggagcctgaataattaattaaaaagggagcctgaaaagtctccgcagccagcactgaagaagcaagtgtgtagtaatggttccagattcagtgtatgctgggctgggcactactagagcacgcagagccaaacccttccccgtcacccctgatttgtgggatggtttggtgagaaagcttggagcgctttgtggctttcgtcgtggtgctctcgttcatctatagaaataaaaaataacaaacctggtggtggatcagctgcatggagcgctagcagctcgctgatgcgcaaggaagtcgtgcaaaagtcttgggcttctcacgtctcgctcgcgttcgc

SEQ ID NO: 1954 - DNA, 1748 bp, Zea mays
  misc_feature (1)..(100): optimal_loci_59518_G1, chr2:43353180..43354927, Cluster 11
gagtcctgacccgtgaccggcacgccgcgagatgcgcgcgtgcgcggtgcagtgcagtgcagtgcagcgcaggcatcgatccgttgggcacgcaggcagctagcatcgtcacgtacgtcgggaccgttttgaggagcctggtcctgtcgtctgcgcacgatggcatcgtatctagctacaggctcgctgcagcgatctgctcgccgtatcgtatggagatggatggcgacccgagtgtggccggccggccggcagctcgtccagggctgctgcactgcacctgcactcgtccggcacatccaactgacgaagcgaccacaagcacatccatccatccgtccgtccgtacatgcacatagtggcgtacatgattgagacgtatcctttttcagtgcggtgcgtgcaccgtacgtacatgtctacgtgcatgatatggtccatgtctatatacactccgtcaaagatgttactggatatacgctagattgtagaaaacacaggtacgtacgcttgcaggacggattacataaaaaagcagattcgtcactactcgtgtcggggtcaccgaggacgacacaaatctggatggtccgtcagatgtctagatacacatcaatataatgcagctctccttaaaattctaagtgtaattttttttaaaaaaaactcaatagacctctggtggtgtagctagcttaagtgcttgacacatgacacgcgccactttggacacccggcatccaatcggtggaggaagcgagtttccatgcccacatcacccggtgcccccgccgccgttcctctaccgatcagctagctagtcactagtcagacgacggggcgaggccaggtgcagcgtacgggccggcgcgcacggccgccactgccaagccgggcgacacaagtgcccgaccgactgggactgagactgatgagcgcaacgcgtccgagagggacgggatgaacacaacaacatggcttcacgtaatgctttgctttggttgacccgcggggccgccgggggctgggctttcaacgacggcatgatggcggccggccggccagtcgatcgacgtgggacgatggggcaccaacgatctgcggcacggcggtggtttttactggcctgtgtgtgtgccacgaccgatcgagcggccctggcttttgagagccgcggcatgtcatgtgagcggcgcctcaagtgccgtgcatgcatgcacgcgcccgcccgctccacgcctcactccaccagccaagtcagtctcacggtcaccacccaccatcatcggccacaggcacagcagccgtcgatgcactttctttttttttaatgctaagagattacgagtcaattaacaccatcaatcaatcctccgaaaacacataaatctcgcgcacatgtgcatataggctagcagtctcctcctactatacacacgaagacagatgacgccgacgtacaccacgcacgcacgcatgtcgcggtcacgccttgcccaacccaaaacatattatagcgtgcgtgatgtgatgagcgcccccgttcgtacgttttaacttgcggcaggcagctatacgcgtagaacgcgatagccatgagcgagccatgccgtttccaattaatggaccaccaccggccggtctaaagtcgtgcaaaactagaagcccaagccactaaaatatgattttttttagcttctctgtttcgaataagcatcaacccttcccacaaaaaaaaaaaaatccta

SEQ ID NO: 1955 - DNA, 2656 bp, Zea mays
  misc_feature (1)..(100): optimal_loci_59831_G1, chr2:45202126..45204781, Cluster 11
cctactgagcaccactagcagtactatatactatgctacagtgcgctgtgtcacgtcttcagagtttcggatcagatgcccttgtttattttgttaatctacctgcctacagcttattattgcccttttttttgcttacccattggtgcaatcgtgttcgtttcttaggtccttgttaatatgcttcttttgtactacctccatttacagatatatgacactgttgatttattttttttttcgaaaaactttgaccactcatcttatttcaaattatttattaaaaaatataaaatttttaagttaagcacaaactaccttaacttctccggagatactctcctgccgggactagctagctagacgacaaatctcgtacagctgctgctgctgcgatgtaccccgtactgtactgtacttttaatacgctggtcgctttgtagtttgtacgtactcctgtagtagaacatcgatagtgtgttcggttccatcattcacgcgggtgcttctagaaggtgttttaggatttttaggagaaaagtgtaggattcccatgcaagtcagaagcatgtgggcattaaaaactgagaagcggggcctgggagatatttccctagctagctagatcctgtccaacgtgggcatgcatgtgggcatgtggcccgggggaaaaacgctctgctgcgttctggttggcgtggcttgcaagtcagacattgctgcaagcggcggcggtgcaggtgtgcaacccgcgcggcgtggcaggagctagcgagccagcgcccgcctcagggctaccgtccatgccacgtagtacatgtgtccggcaacggcgatcaatcgtcggcaccgccggcccgggcttcgtacgtacgtgctctgtggcgtgttgcatactagctaggaaagtcctctatctgacgacggagctgtgctgtgccgatagcccgccggtgggcgacggcgaccggtccgcctgttcctcaacagcgacgcctgacgcctcgcgccgccggccgccgcgctgctgggcgaaagccagccgtgggatggatggatcatggggcgcgcgcgagagtcgagacaccccggtttggtggtagttccgtagttggttgcggagcgcgtgactagtctatggattgggattgctctgcttggaaactaaacacacacacccggccgggtcaagcgtttcgccgtgcctgcaccggcgctctcgtagccatgagctagagcagtgtagtcaagacagagctcggtagttcagatcgacgcccagggtaagaagagtagccatagtattctgcgagcattcttcgtggctagatagacgcgcgtcggatttgatacgcaacactgcgacgacagtcaacatcagaatcgttcgggcggagatctttctggaaggaggaaaacgaacagggcagccttaataaagacgagggcaaatacgatttggcgtgtcgcgttgagccgttgacacttggagactgactgccatccatcgatcccggcggcaaattaaacccccggctgacttgaaaaccagatgggacccggccggactgggactgggacgtaaacgtacggccccgagaaggacgctgtcacgctgctacatgggcccccccgcgtggcgtaataaatgcggaatgcccatgcacgcacacggcgacgacgcggccgcctccggccacgcacacgcaggcacgcttcgtgcggccgcggctgcctccagcacgccgggtgggtgtgtcgcgtcgatcgagtcgtcctctcgaccggggtatatgctttatgcttgggttgtccgtcgccgtcgcgagacgagacacggggccgatgctggctgcgtggccctcgtggatcgcctacgtgagtgagtactccttacttgcctactacgagagcgtgccggcctggccggaccgcggccgggtggttgcacgctcgcatcagaccgtggcggccgcacgaacgaggcgtttgcgtgactgagaggccggcggaaacgaagtgcgcacggaaggttcgaccggctagctccggtcggtcggtcggtcggtcactagaccggtgattagcgaaacgttcacggagactgtgccagactacaagcagcgttccggtggcgtcgggcactgaccgattagtctcggccgcatgcatgcgtcgtacgccgatgaagtcacggatgacaaaacctatcgtcagagtccacagcggtctagcaaggaacagccaaactgccggcggtgggttgttggtgtccggcaagaaagtttggcgctgactggagtaaattgtaaatctcaccctcgacgtacgtggactcaccatgaggagccactgtgccgaaaaggcagcggaacccccacgatcggtcatggatgccgcggatctcgggcaccagggagagctaccacactacacagatcgagcacaacccagcaagaccgaagagaaacgcacccattcccatgtgtgatgcgcgaatggtgccgaaagggacgctgcggctggccgggtggcggtggcgggtgctaaacgaccaccgtgccggccaccgtccatgcttttccatgcgagaggtggtcgcaactcgcaacttgaccggcagcggggatgcgtgcttgcggcggcctgcctgtag

SEQ ID NO: 1956 - DNA, 1496 bp, Zea mays
  misc_feature (1)..(100): optimal_loci_60213_G1, chr2:47517875..47519370, Cluster 11
tagttgggtttgggaattgggggtggggcaaatcctggattgcacgaaaaaaaaactatgaacaaaaatgaaatgatttaacatttgaaacaaaggggatgataatattactgagcgacgtctcttgtcaatgattcataaaaaaaattcacatattgacacgcgcgcgcgcgtgtgtatatatagtgcacatctgccaacagtaagacagattatctagtgccgtacgcgcctacctgactacatccctccctcccacgcgtgtttcctagaaaatatcagggttattagttttttagaactattgatctgaaacgcacctgagattacacaggtgtcacactagcagctagctagctaccacgttttgtaggaaaaaagttaatatcagtttgacagaactattttttaggctggctagctagctagctaggcacacatccaaagctcttccttatctccagattctccggtagtcgcacgacaaaggaattggatatcaggatatgtatatagagtcgtcagatgctcgtccatatatcggcacaatatcttgtaaagcagaagaaaagccaagagcagatcggagataggcgatgcttaacccgttgccgtgcattttgcattgttaattaattaatcctcacggcagacgggcagaggcaacgcacgatcagcgagtgcagatacacatctatccctccctctggtcaatggcgactgcatgcagaggccggcatcgatcggtcgacaaagagaacaaccgggcactttggcacgtacgtagtaaacaagtgcggagcataagatgctccgatcctgtgcgcgcgcgattaatgcgattaagcagatagttaagctaagcttgctttgctcataagctaaccataaattaaacacgggggaaaggtagcgtgcgtacgttgctgaggccgctgtgcactgccaacgagccgcgtgcgtggcttgttggtcagtggaggatatattcagtgatctgttgctgaagcaggacacgtccaagcacaaaaggacagcacggtataatgcatgcatgcacgtcgtataatcacttcgcgcgtggaaaacgagagagaatgtacggtgacgtactgggagcgggcgttgcatgccgtgacggtcctgatcgatgccgatgctccatctccatcgcaccggacccgtccttcggccctgggagagcatggaaaacgtggggaggcgcgttgtccttcggctagctgtgtcgctgggcgatctgcgagagctctctccttttgcgcccgcctgaatacttgacgtcttttgcgccgtcatgccgccggcgccatgcgcatagtacttttttttgtgtgttggtgacatgacgattggttgcccacacggcctggatcagccgcagtacgttgcacctttgttgcttttgcttgcttgttgggttgcttcgtcagctcccacggtgccgtcctcgtcatcgcggcatgctgtgatctatc

SEQ ID NO: 1957 - DNA, 2394 bp, Zea mays
  misc_feature (1)..(100): optimal_loci_60228_G1, chr2:47595324..47597717, Cluster 11
tcgtggtcgtcggagatttatcattttactgggatggatggcgacggtgaaaactgcgcgcctggactctgtagttctcgccatggttagcgagctactcctacctcgtcctcacagatcggcccggccccggtgcgccgtattaattattgcaaccgtttgacctcgcaattagccaggaatgctatgattattcccacgcgcaacagtaaccagcagtacgaacaacgaagaaaatgcgctagagagatgccatctcagtcgtctccttatccgtaatgattggctaagcagatagtaatcccgcggtctgcctggtgcccttttgctcgcggcacgtcgtgcaatgcaacggccggccgcagcgcatcccgcgttttcgtggccgaaacctcccatctgcctgcctagcttgtgccgtctctgacatgtacaccatccatatcacgttttcgtcccggcgtttttgggtaatggccgacttgtagaacgagcggaaatccgcgacgatccaaatgatccatggcaggcgtggaacacggtgccttttgctatcctcgtttttgcgaaacatgttgtcaacgtgaaaatctgtttcatggcggccgccggccgagggtaggatttcatgctactctagtatagtcgggctaccaacgattcgttcttactagttggctatgcatcaacatgcagatacggtaggtagagacgagtcaaggtgaaaacttgagggcactagtacgtgccatcttcttccttcttttttcgaacggacggcaaaagccagcactagtagctagtgccatcttccctctctgcaactgtagcccgcaccaagtggcgatcagcaggtcgacgcacacagtgtcctgccacgcgtagtgcgctgctgcgttatgaggtggatcgagagagagagagagagagagctgactcagtgtgaggcagcagaacccgatccagcaagctgccaatggatggccccgccacgccacaccccactccagactccgggtccagaggcagaagaacccgatcgagcagttccggttcggggccccgatgcacaaaggcaacgatcttttccagggaatagccgcgcggggccgggtgggaagagagaattccgccctcttttttttttccctttctttgattgatcacccaccatgcagccatgcacgatcataatcaccgacggggaggagcccaccggccggcgaggcggcgacggccgtacgtccagtccattggctcattcatccaccggatcatgccgccgcggcgccgctcccttttcaagatctggtcctagttttccggccagaacgctacagaaccagcgatccgccgcggggagctgttttggcctattgaacggccggttcctcttccttgtttgtttgagaccctgttgtgctcacaatccaccatgcatgcatcagtggttgcgcgctaagaaacgcgtgttctttttttttcccattgtttcttatttgttgaggagacgactgaatattttgtgcaccacacgcatttttttagtacctgttatgtacccactccatgcaagtctctggatgtctagttcagccgtttcaaatttaagataactaccccatagccaatccgagccagattatacaacgtcttaacttttttttgttatatatctagatacatgttatgcctagatgtatagcaaaagcaatgaaaaaccaaaccatctttataatttagaatgtaaatactagatagtatatgtatttatcactgctgaaaactgtagttcttatgttagtgcaaaaccgatagggaagaaatgcaaaactaaaatttatggtttatgtttagaaccatatatatcacgcgcgcgctcacacatatatatacgatttcccatagctattaatataatgcatttcatattagaatattaaaatatattaatacccccttacatataaggctatataattttatttttctttacataagttaacttattttaatcaaggtgtttgatatatctgtatttataatagaattataagagctttattattcataaaaatatacatcactacacacataattcattgataattggggggaggttagtatagaccaaaggtggctatatataccttggtggtatttgagattgagtaagcgattatatagtttaaatattaatattctcgttatcctattctagatctcacttcaaactctagcattgaccttgagggacataatctaggtttaagcaaccatgcacgtagtctacattattacatgattttttccatagacgaacaatttaggttaacaaaagcggccaaatcgtccacctctgtcaaaagtcatgcattaatgtagctttaggcg

SEQ ID NO: 1958 - DNA, 2254 bp, Zea mays
  misc_feature (1)..(100): optimal_loci_61579_G1, chr2:55028812..55031065, Cluster 11
gccatggcactggatgtggcgcctttctgtccgcgtcagcttttaactcttcttctccgtgtagagcgtggatggacccaaacaagacttgaggaccaaccaaccaagtcttgatgtttcgactgcattatggtcaatgcaagccgggagaagataacatcacctgcacctgcacctgcactgtccaatccatccgtcctggatccagcgaggatatcgtggtcggcactagcagcaacctgcaaccgcttgtcaggctcaaggtattcaagtcctgcacgcgtttcccctgcgggctacaacagcacagcagcacgcggcggttgctccggccggtggctgtggttgcgacgggagcgacgcgctgggccgcaaggcaacaaaccgggtggcggcatcgggaggaaaaagctgcgagtggacgcgggcgagccgcgcgtccgttcaggtcacggtggcggcggggtggcgtcaccctgctccggccatcttggacacgccaggattgcggtgcttctgacgtcagcaatcgtcccgtacaatccgaagggaaatttgctcttttttttttgctgatagtagtgatggttttcgctgtggagggtgacggatggagcgattcttcgctccattgcattggcactgtgctggtatgcagctggatgcactactaggatggccattgtccacaaatttctctctctctctctttcttttttgcgaggaggcccattgtgcaccatttggaggcgctagctgcggcggcgtggataggtgatggaagatgcaccacgatggccgcaagcatttggacgcagtgcagctctgcaggcgtgcagttaatttggtgggcggctgagaactgttcgacaagcacaacacgacggtaacgaccaactccacagatgcagatgcggtgggacttaaaaggcagccgccgccagcgactggacttggatcacctcgctcgtctaattcaccacgtgcaaattttgaatggacagtaacatttttttctatctatttaccataaactctaaagtctggtttggtgataagtgaattaaaggaaatccataagacaggaaatcttttaccattcaaaattgaataacaatagattttctcatcatggatctcatctagttcccttatcaccaaacgagctctcaaagtgtgaagtagtgtttgagactatttcacgtattctggttcacaaactttaccatacagcaactcgggaaaggctccgtttggtagagtttctttgagggctcctgcaacgattccttgaaaaaatctaccaaaaaagaagctctttgataggctcctcctgaaaaggagaggagctactccaaaaaaccaagaggagccagaagccataaaatgtggcttctaccggcttctctcccctattttcctctccatcgagcccacattgtgatagaagatgaaggaggagctgtgtttttaaccaaatagggtgctcttttctgggactcttcctgaatataagaagtgagctctttttctagagaagccagagccaaagctagagctgaccaaggaggagctccaccaaaggggccttaataaaaaaatctagagtttgtaaagcaccctttagctactattgtaacttcaattttttttcctcggagccaagttgtgtgaagctaaatccatttcgctaaaaaaaaagcatagaacaaaactaaaaaacgtggagtaaaacagtcttaaacaatccttgagatacttctactcttcattcaacttgtcttcaccgggagttgcatttggaataggaaaaaacagcaacatgcaatagaaattccaaatagtgttgtaccaagttccttcgcggtgattgaggaggttttgttaccttgctttctcttctttctcttaatagttgttttttccatttagcttaagtcatgcgtaaaattgttgtgtatgtcgtggaagggattgaggggccctattgtttgcgtacgggtagagtcttggcaggcagtggggcagtgacccatctagaagtatatactaagggtctctttctctttgttttataccttagcacttttaagttttaataattgtaagcatataagaaatatgtgtcttaggagttccatatttcttaccgtgataaaggggctccgagtctccgactccgaatactactgtccctttgttagatccggcctttgaatctcgagcctccttagaggaggtttgacaaacccct

SEQ ID NO: 1959 - DNA, 1675 bp, Zea mays
  misc_feature (1)..(100): optimal_loci_62708_G1, chr2:60879982..60881656, Cluster 11
gtcacccgctggtccatgcacgacgtcaatcaacacagtagtaacgcgcacgacgacggattcgcgccacagtgccgcgcgcgcagtcgcagatgtggtactacctgtgtactgctgctgcactagtgtgcagtgcaccgatcgagtgtgcttgcattgcatgcatgcatgcattgcacggtgccagtcagtacccccgacaaggcgacaacggcgccgtgtcccgcacgaatcagacgccgctcgccatcatggagcgggacgggcgcgcccagccctagcccatgcatgcatatacgccgcgcgagcgcgacacgcacgcgggtacggctctcggtggcacgagcacgagcagtgcgtggatgaatgcgagcaccgtatgcctagcccatcggccatcggccatcggccatcgcccatcggatgctgtagctagctagcccgtggcctggccggcctgtctgacctcccatccggtgcacagtccgcggggggtcacatgtctgcatgcatgcaatgcacggcgcgcagatccaacgcacacaatacgatcgcctatagtacgtagtcagtagctagtcacctactatatagaaaagatgtaaagctaaattggctgtttgcacacagtgccttgacacgagcctattcattcacggcctctgtttccttccgcacgtatgagctagccctgtggtaggacttaggagcatgcgacactgccgacgacgacatgggccgcgacgtgggatcagaacagaacagaacaggaacagctaggcagcccgaggcttgtgcggacgcgttggcaacgcgcgatgcagtccagcggcaaccagccgccggtgggtggaccagagcctagcgcagcctatacacatgacatgcacggcgtgagtaggggtagggtagagaaagctagcgctatcgtccgcgcgcgcgcagcagcagcaccgcggcacggcaccgccgggtagcccgggggctccaccactccagcagctcccaacgcctgtacatgtcgtcggccccgccgccccgcgcacgtaggaccacgcggcactgcacggccgcgcatcgcgcctcaccggccgatgaaggcccagcgtccgtccggctcccgcgtgcccctcgcttccctgcctgcggcgtcgaggcggtcccccattctcagggccagagcagggcgtcgtgcctgcgcgaataaaggcgcgtgcagtgcacagaatgcctcgccgccgccgcctgctgctggagcagaacgatccagactaccgagtccgaaggcttcgaggcggtacgtcccgttcgcacagggccaggcggccacctaccggcattgaaaagggttttgtttcacgcctaggattactgctacacaaattgttttgactgacgctgtcctctacgctatggggtgaccgtgtctgttcatggcagggctggcctagaaacaagccgcgccctctattaatcaaagcacacaatcatctctaccaatagtggtataactgaggtgaatgttttatacgagccgcttccgtcaaccgattaaacgagacatgtgttaggaattttccgttgggtttggacacatatacacatccccatgaagctacacttatttccgttatcatcctcatatggccatactcatcgtggtataacattatat

SEQ ID NO: 1960 - DNA, 1593 bp, Zea mays
  misc_feature (1)..(100): optimal_loci_6475_G1, chr1:33288083..33289675, Cluster 11
tcgtacatggaaacaaaactgcgctctcaatcgattgcagctcgtgacaacttttgtgcgctctcaatcgattgcttttcgttttttttttttttgacacgaagagatgacggctccctggaaaagagggatgcctttgccatcatactacgagggtacggtgcagacgattggtagttctacttttgtggtgccgtggcttctgtaacctggtggctgtggcaccgtttccttgcgtaacagtaacctggtggcttgccacctttgcattgcatggccttgtcctataagtatcctattgctcacccgtcacccccaccgaaataccgtagcaaaccccgccggtggagatttgcaaagattttaaaatcgaagaccaacttggggcaaagattgatttgcagccgaggagctgccaatgacagtacctccggactcccccagccaggtcccacccaacccatactgaaaagacagtagatgaaattgaatgagctctctctctctctagatcagcctttgctttttcacctcgccagagtttggacctgcgcgaacagctagcgcatccagttgaccagattccgaacctcacaacaacaacctcacaacaacaacaccagcagcggcagcgacaggcagcagctcagcgcaagccaaattgtacaacgcttcggagtttggatgcatgctgctgtagctttttttttcccgactttttgcagaggtatattcttactacagctgaggcaatagcagcaggtgcttgctgtgttaattttgccgccaattcagacgactctccttttttttcttcttgtgttgttagatttagtaaacccatgcatgaatcgatgatgatcacgagcttacgaagatcgaaaatactaggggaactagccaccagcttgagagtggcctgtttatcttactcgttgctcatctaaaacggcgctcgatcggtggaacgccgccgccgagaccaccaacgccaagcactgccgctgcgactaaacacgggctcctgctcccccgcgcattatttccgggatgcatcatgcatggtgggatgggacttgggagttcgcttggccaatggggactctccactccacccttctaaaaaatagcgcgcgttcagctctcaaggacgagaaagatgggcggggcgggctgctgatggcctggaaccgtgattagtagtatactcgatctgcaagtattctttctgcagtgtctgtgtgtgtgacgatgaatgcaataataggcggagaactaggctagcttgcagagtgtgggcgagccggccgccggagtagccacggagagcgaggtgataaatgaatgggcgcgggtcatgtcatgggatgaacgcgcgcgagaaccggtgccttgaaaggcaccaaaagagcgtcgccagagcgggggacaagcaccgggctagatgacagaatgtccccgcaccaggcggccgcgacccctcgcccctcggcgcgtcacaccagccgcgcaaaagtgcaaaaaccgcacctctccgatacctcgctgtcgctgcaacgtgggcctcccttacacagttcgaacgtgctggga

SEQ ID NO: 1961 - DNA, 2412 bp, Zea mays
  misc_feature (1)..(100): optimal_loci_650_G1, chr1:3438490..3440901, Cluster 11
aaacgaaatatcctgtgaccttgctttcagtcatccaatagcagcgggaagcagagtgaccttgaaggtggtgagcagaacagaaccattgtagcggaaggtgaccttgatcgagcatctggatcgccacgtcgcggcgtcgacgtctcgccgtgcctgctgtggcgcatgcatgctttcgtcggcccgggcgggcggcattgaaatccaccgtactgtacgtgcgtggctgcgattccctgctgctgcaactgtgtgcgatgcgaggctgctgcatgcatggtagtagtagctagtaggtagcctgcttgtagcctccagctgctgcctggacacagagtctgtctagggtactgtgtccagtggcgtacgttgtagccatgcagtgcaggtaaggtagagtggtgcaggacggagacgacgacgacgacatgcagcttgctggagaagtaaggctccactccagggccagggtgcacagcacagacgcttttttgacttttcatgcacccacgtgggcgccgctgcccggccagcggcggcgacatggaatggaaattaagcaagctatcctagaacactggctgccgcatgcccgcgcgctccagctagctgcatccggcttcgaactctggtggtggatgggacgagacacgcagacaagacgacgacgacgacgacacgggatggagacggtggagtactacgtactctgtctgcacccttgtctcttgtccctgcactgcactgcatgcgatccctcctccgtaccgccgcatgcattatcttgcgacgacacacacaggcacagcccacagccacgtacgtacggcaggttgtttccttgtacggcactgtaacttaacacacagcagcacatcgagcgaacaccatgcaccatcgtcgtcgtcgagttcgaaggccacgagtgaattaagcctgcggcctctggcctttttcttcttaacactgagatcgatgagatagatgatggtgctgggaacagccactggtggttggtcgggtttgcattgcagttgcaggtaccacccagctgctgctgagcaatgactatataagtggcacgtacgccctggtgcgtgtctgatggtgtgtggtggtctgctgctgcctgtgacataatcacgcaggactactactgggtgtgtgtggtcaatgctggctagctgccggcgcggacacgggcattgaattggattactgctgcgctccttgggatgggggacgagtagccgtagccgactagggaggggcggaggaggacgacgacaaccgatacagcagagggatcggagggaggacccgaggccatagaggtcggcggatgcagctgatgctgctgccatgggctagaggctagcaggtagtacgtagctggagtacctagactctgtgtctacctagcagagaccctagctactatcatcaacctgcagctccattgatgcccctgccgcgccggccgccatgcattttactctcttttttttacttgcatccgccgcccgcttcatccgaacccggccgcccggtgctcgatgacggaaaagctttgtaaaatgctgtccaggcaggcgtactgccggtggttagagagcgtgatgttgtgctgagctcatcagaacgcccgcgatcaagctgctaaaatcaccgtgcccgtgcggggactgactcgtccatctcatcctcgccgcgcttccttctccggtagccgtgccaccgcgtggggatgcggaccgagaaataaagctcctgggtcccgccgccgaatgcacttgcagcaccagccagcagcgacgagttccatctggctagtattcccttccctttggtccgcccaagctgcagcccggtgggtgaattgactgaattccatctcgcacgctgtgggcagtgggcgccacgagcacgccagtcgacgcacgaggacgaggacgagagagaagccatcccgtctcttcatgttccgtgccactgctctcgtcttctctctctcctcccgtcctcatcgtcctccacatgatatggcacgcttcacgaggcttgtatgctcacactgtctccacactttttagcctatcttaacataccgtataaatggtcgtacaagatactagtaatgttttatattgtaggcttcatttaaaaccaaagtatttgggaaccacagttttcaaatatcatagtttatattgtcatgacacgaatactataattttatataccatagtcggtttggttactatgtatttggttgaaatagagagtctgtcggagatagtcttagagctcaaagttggccgtgccggtcaggcacggctctggcccatcatcattcggactatttcatgcaagcacaacatgaaataattttgatcccgacatatcgtg

SEQ ID NO: 1962 - DNA, 2842 bp, Zea mays
  misc_feature (1)..(100): optimal_loci_6603_G1, chr1:33842296..33845137, Cluster 11
ggcatattccttccttgcagctaggtagtgcagtggcccaagtggccagagtatcgatctctcgaacgaaaacgtgattcaaggcaggccagccatgcatcgtgttcgtctcgccacagtgccgccccctcctcagtcctctgcattgtattctcgctcggattcgcatcgcgtggaacgcgacgaatctaataaccgccaaacgaacttgttcgacaaaaaagtcctctttcccccctgaatctatcaaagtccgcctggaattccaggagcaccactactgtatagttccgtgcaggtgggagtgggaggaagacgcttcacccctcggcaaacacagacaggagggccacgacgcacgcgaacaggccatgcacgagaatgcgaccgtggcgacaggcacgaactgccatgccaccagcgcaagcgcaagcgacagggacggacgacggagcggagacgacttggttggtgaacgaacaaccaccagctgcttggcctggcgtgatcgacctggattctctgaccaccacgaggccccgcaaagcaaaaaaaaaaagcggttgttcgtccagctgagctggccgacatcaccgacgtaaccgacagtaagcacggaccagccctcgcccagtgttaagatgttgctaaaacaaatagtgcaaggacgagggtgtcggtcgctaacctcagaatcattagcaacccagcacgtacgcatcaggttccttaatcatcagaaaaccatatactactggtataagggccgctagtaccagtagtgcaaccgagtatatataagcaatggttttaactgaacagaatttacagcgaccattagtatttatgatattttttaagacctcaagcatctaactatccacgtgctagacttcgatacttcatgagaaagccagccttagattacgaaaaggtcatggaaatctgaagccggttgttaatcggtactgatgcgtcttttttattctagtggttggctcctgccgagttcagatggcggtgtggggaaacgaatttgcgtgagcgaagcacggcgatatatgatcatcttgctctcggtgacaaattagtacgaacgcgatccggtgaaacaagcgcatatggaaagaatttcttttttttaaaaaaaaaggcacggggcatggaaagaggtgagggcgggcccgaggcacgcacatgcgcgcggtgccgcgacgtgcagcggcacgacgaccagccgcgttcggccgtggtctggtatccctcggcgtgagcgtgatacgatgtccgcggtttcgggcagcctagcgacccgtcggcctcggactggcgcgcggtgcgttgcacgtctcgcgctcacggttccctgcccccgaccgccatcacatgccccgtcgctggcgctcgggccggcacatggcgcgccgcgccgcgcctcgggcgccggctcacgtgatcacgtcgtggggacatggacacgttcgtgcgttgcttggccctttttccctgagccgaggccgagccgcgctgccccaggcgccgtcccgtatccgcctccggagtcagaggagaggaggcaccacgcggccacggtgaccaatcggggagcgccacgccacgcacaacaatgcactggacgtccatgcgtctcctatcggtctgctcatgcccttctcctccccggcgaaggggatagtaataaataacgccgggtgcggcactaacatagtaacatgccgtgcttttccgtctccccggcgatcttatcagctttttttcccacgtccactccactttcggcaaaaaacaaaacgggtgaagtaattaataataataacacgcacgccctcgcaggccggcaattaataaaaaaggatcctctgttccggtctgatttgtgctggcacaggcacaggcacaggacacaaatcgtgcccaactgacgatcagaacaatggaacgatgtgtgtgtgcgctgtagcagctaagctttgccataacggtcacgtgcgatgttcctcatcatgagccacaaagtcgcgaccaaacctgaaacgatccgcaaggacgggagaaaaaaaaattgtgcaagtgaagtggggggaaaaaaaaaagggggccatgcgcggaaaggacgtccggcccgtcattacgactagatctgcggcgggtcacgctgcttgatgaattgcttcggttatgatctctctccagatttctcctacctgctgctgcccccatatggcaaagtgccctgtgcttcacttgcaagcaaatccagctgggaaactgttacccaagagttcggctcgaatcgatcgatggaaagactgccggacaggcacgggcacctggactggacgacgcccgacggcgcatcgcaaggaaaaactccgccagttcgctctccgcagggttgtgccaacaaaaacgccgttgctggatggactggaccaccagctaaccctccaacgatcaacgccgacacatcctcctttttttcccgcgaaaataacttgcgggagagcccctgtatcctttgaattctttaattttccatggtgatgaccaagggtagtagtctctttatccttggaatacttcacctgtttagtcttttctaatgtgctaacgctctgacggttttatctgaccgagtgaaatccccccttctttcgttggtctagctatatatatattgggtattttgtcgggtgttagggcatttaatattgcgtcttttaaaatgttttaaaggttaaataaaaaaacacaagagacatgcttttagaatagtcatctctacacgattcttcctatatgttatcttttaactgtaatt

SEQ ID NO: 1963 - DNA, 3090 bp, Zea mays
  misc_feature (1)..(100): optimal_loci_7497_G1, chr1:39253318..39256407, Cluster 11
taaaaataactgatataattttttatttttcctgatcagaaaaatacatgaaaaagaaaggagatgctcttaacggtgatgggaaagcccgatttaaggtcaccttgtcaaagtgtttgaaataagcggaaattcatcgcggcccctttcgcgagcagcgtggaagaaggtcaaacatccaggccgtacgtacagcattttgtggttcaaatcacattacccgttgaagtagcccataagttccttggtattggtggcccatgcaatccattgaaagaaagtcagccactcagcctactcaaagacatcaagctagttccccaagatttcctgtctcttcgccgctgtactcgactcgacatcatgtcattactttatatatactagtatgcactagtagtataagtgatttcttgccccagattttttttacgaagacctcgatcaaaaagggaatatatacgtgtcgcactacaacagtgcccgtgctcttactttttgtacctgatatttttcgctgaacctgtactcatcgtcgtcgtcgatacgaatacacgtaaatatcaacactttgaaatccagctatatatacgtgacacttttttagaagtaccacggaccggtccttgttccgagagggaggaaagtcaaaactcacaacgcacaatcgtgctcatatgcatgaatgcggccaaggagcaatgcaacttgcattggccacctgtatatggagaatttttcagaacttgtttgaagaacaagtccacggatcagaacttcaccgaagaagaagaagacgacgacgaagacagcacgcatgtggataggcacgagctcggtgaaatttgaagccacatgatagagcgcgcggccagactcgagttccggagttgcggttcgacatctcggcgtcgttggactcgacgccgcgccagttgcgcggtcgccgtcacgcagcgtaaccgctgacgcaatcgcgtgcaccctctgcagtcctctacgcaatgcaccgcggccgtacatgaaatgcgctggtgcttgtccatgtccagtgcagtgcgttgctacgaaaggccatgacggccgggccaacagagagcaatatgcaaggcgaggaaaaaaagaaaaaaatgacttcgcagcgcgcgcgcgcacacacacacaaagtctagtgctgtacgtgcgccgtgagccggccgcaccgctatacctccgacggcggcgcgagcaagatagactcggccggcggctccatcatgtgtccatccatgcatgcatgcatgccgacgtcgtcggcggggtgcctgtcgtcaaacctcgtgtgctcctttgcttcgattgcaagagaagcaacgaatcatatatggattcttctatcgtgccggctcaaccactacagctcgaggcagaaaggtagagctagagttcacattattattattcttctcaggtgcggaacgaaaaattcggagacagacaggaatggggtggctacaggctactagcctggatttagtggagagagaagataactattttgacaattgacatgctccatggagacctaataggtgacatctaaaaaagaaggggaaaaaagatacacacctacacagtgtagatgggagtgagcgtgaagcatctctctgatggcaattatagcctactttctgcgtaacagcggaggctaatcgctctgcagctgttcatcatcgacggggacggccgttgagtcaccgtcgtccggtcgagaaaacaagggccgggcgggcgcgagcctccaacaattaaagttcgcgaggcgacgtcgacgacccaaacagagcgcgcgctgctgcgagtcaagatcgaccgagacgtcacgtcgagaggggtggattgcaggattgggcatcgtcgtcggattaggctggcgggacgagggaggccgcgtgcattgtacttggcgcgatcgatcgacggcgtcgagcgaggggtgcgggcgcgggctctgtgctggcctgtgctgcgctgcagacacggcccgcgccggtcgctgtcggcgatcgcaacgcgccagcggccatcgcgtctgttttggccatgcgatgcgacgcagtgaccggcacgaaagctgcggcggcgtacgttgttttgtcataccaaccctagaccattaggctgagagccaatcagtagcttgattggattgggttggattgctagctaggttatttatctaccctgctgagcttatagtataagacttcggttacacatccagcagctggtctagaatgatcgctctggttgattagtactttcatcactagtatacataaaatatatgccagtagaacgatgttaaatggggggaattaagtggaaaactaaaggagtcgactgagtttgtcctctcactcctcagtgtgtccggtcatctgtaaccttcatggctggtcttcgtatagtaataaaaaataacatcagggctgttttttcttaaaaaaagaaagaaacaaagcgcgacaagagcgggtggcgcgaagcatgaatgcagaggcatgtaccggtatgcgagtcccgaccatgctgatcatcattattatatttgtttctgcctcatcctttcgtcaggaagcagggaccaccggcggaccgggagttgtaatcgaaatgttcgtgccattgtggtccaatttcatgtaaaaagagattggactgcgaacttcaatgtcgtggtccttgtacaaatatcgcacgtggtacatgtagtttggcggtggtaggatgagcgattatcgactgatctctaatttgaacctccaaaccgactgtttagacattcataataggtacagatctttaacatattccttcttttttcttatgtcgccacatcagcactatacaaccagatcgcaagggataaccgataaccttctctcgtcgtgtcgcctaggtccacttcgtggacatgatacgcgtagctgcattgctcattagacaaggccgttgatagattaaatatggattcgatccatgttttttttaactaaatcaaataacatgtagatatttattgaatgctacgatgcattatagtttaaa

SEQ ID NO: 1964 - DNA, 2816 bp, Zea mays
  misc_feature (1)..(100): optimal_loci_7697_G1, chr1:40231363..40234178, Cluster 11
aatggaaaaggcagatgttagagtagattgtgcacccatagggacaagatcctcccccccccctccccgaaggcaaggcagccaccaagaagaagccccttttgatgataagcatgtgaccagcccgctggagctcacacctgccatgtgagccctcttcacttgttaaaacctctcaagaaccccctcctaccccaatgatccaatgcctcatttccactataaacattcaggagaaataaactaagctactagaaaagaagaagaaaaaaacagatgggcagcatgcatgtttcctcccccagtcccccgtctctcttgtcttagtcaggaagttggtgagagcgtggcatcagctacttctccacagggtagacagccaatgtgatgcacgcctcattattcccctttcctcccccatgggatggggccctaattagagggcgaggaggaatctcttaatgattgcccaatttgttactaatactttctggcagtaccatgggatctgcggtcagtactggtgatgctctagaggctctccgatctcttacctcccacataaaagcgcccttgtactactaagagcagtttcaatgctctgaatttccgatggcagtttcagtgctctgaatttcatcgttggagtctgaaccacccggacctggttcgctataatgcggctactagagcgcagatgattttcaacatggtcgttgcattattttggagtggccatagcattgattctctcccttttttatttggggacgaagattggcaaccaccaccagccggttctgaccatccatccatccaaacaggtgggctgtcaattagagctgacattattattgttgttgttgttgttgttactatgcaagcacagatctggactggacctttcctattttctgaagcgttgtattctatgattgcggttagacgatgaaacatactcgacgcgcaattacatacgtggaagagaacatactcatcacaaggatgcatgcatgtgggagctactagcttagttccccctcctccctaacgcgtaactttgttcggcatctggtgctattgctctcttgctattgaacgtggatggagcgtcaagcatgtgatcggttcagatttgttatcacacatgcatggtaacatgattagcgcgcgagctcctttctgttctctatacaactgtccaccggatatgtggtggagagagagagagagagagagagggttggcgtggccgtggagtatgttgcgaggtccactttgagaaggttaaccaatcacagaagcaagggaaggtggtcctaaagcacacttgaatacatacatggtttagagtatcggagcaagagaggcccctgcatctgaagaattggtagtagcagtatgtactacgcgtcgacagtgaccgggcatttaggcccaacgctttcaaagcgctgccggttcacgcacacccctggaactggaatgggaatggaatggggtcgcattcccggtgtgggcgttcgccgttttccgggggctccggcgcgtgcggaagttgcccggtttcgcccgcgaacggacgcctttccggggcgctctcgctttctccgtccctggccctggccctggcccttgcctcgtggaaagaattttatcgtttcccgtttcctgtggatgagctcaggatgcggttgggacggtcgcagctggctctcccttgtgtgaccggagggagggaagggtaggaatggtttgaaggcatgcatgggcgttcgtggtcttcatgttgttcagctaaccgcgcctctgtagcggtagtagcatccatgcatctggctctaccggtgccaatgatcgatatgactagaataaaaaacgagctgattatctatctactactaccatcaagtgaagtgaacctatacgtgtactacgacgtacttagcatgcagtccatcattactgtcccccatgggccatggaccacaggtaagcgtaattctctcttcgttgggcgtcttggggaaaataaactcagattcaaaccggccggtgagattcatcctcatccacatgcaaacttgaatataatataataaatggtgatggagatacgaattaagggaaacagcgctgcctagctaggttgggcgatgcgaacgaaggatgcggtatagtaatgaagggggcacatggccagcctgaaatgtgaaatgttgcccccccaccacagtttggtgagggcgcgaggggagggatccaggggaaagacgaccgacggcggcgacgaatgaaacagggctgaagcctcggtgcagtgcagcacgccagcaccgagctagcccgcagccgcaacttgcgcgcggccggcacgcgctccctccccccgttcgaatcgagcccgcgcgcactgcaacaagtgcaatgcaagcaggcgccgctggctgctacgttgctcgccttacacgtcaagcaatgaagcaagcctcccgcgtggtcgtcttctcggtctcccccacgttcccccaggccactacccctagccggccgcgtcggtgaaaccaaaccaatgggtgaacaatgcacatgtctggatgatctgaacggaacagttccgtgacaggacggtaaagggctggatatttgaccctgtgacttcaagccggccggtggctgccgtgaattctatcaacaaggataaaaaaggatggtgcttgctggatgcaacctactactgcttgatataattcaaatgttttattagttgacatcacgttttagaaaacgtgtctccccaccctaccagtacggtg

SEQ ID NO: 1965 - DNA, 2022 bp, Zea mays
  misc_feature (1)..(100): optimal_loci_7748_G1, chr1:40435464..40437485, Cluster 11
ctattccttgtgtttaagtacaatatgtgtgcacatgatactagtaataacacgggacgaccggtgtggcatatggtatacagcactggacatgaaatttatggaagactacaaaatatttagggatatccacgagacaccaaatattccaccacatggtacttaaaagggagctactacaccataggagattggagagagcaataaggcaccgggcgtgtcgtctagtgaagtatagaccaaaacatcgataccgaatctgttgataacttttttttttttttgcaaataaatcgatattgaatttgtctgattttccaacactggtggggcaatacgggcgcgcctggcgtccgccggccgagatgagtcagtggctgccccaccggagttgctttcaggcaggaggaggacagggatggacgagcaccggctcgccacaagcgtacagtacaggtacaaatccatatggaaagcgggaaattctgctactactgctggtggtatacgtcgtttgacccttccccgtaccgatgcagagatcaccgagctgacgcattccatttgcgcgtcatgtatctcgaggatacatattcgtgtcaagtacacgtactgacgtacctgatgttctaccagcagtacgcttggctgaaagcgcagggttgtcgtcgatcgaatccatatcagattcatcttcacttcttcagacactagaggattttgattttgcgcagcgtcagcgaccatgcgttacatccatcttcagagtcatgacagtcgttggtgatgatctacgagcctatgataacaaggatcgtccaaaggacacttaagttggtgacggtatggtgtgtgtggctgtgagaatgtagcagagcgcaccacaaaaaagcaggacaacgaggcagttttgactcgctcttggagagagagagcgcctatggcaacgacaggtgacggcaacgcttctccttaccagagagggcatcgcccaccgttgactcgtgcactgcccgtctgcccctgcacggcatgcaaatgcatattcctggataaaacagacactacagtagagacttggaaatcggcaaggcccgtcggaaccattggcccaaaataacacgctactgggccttcagatttcgcttcggctttgggctaacttccagtggaccggagcgacgcatgacgcatgggataattatcttcaaattcgattttaaatattcggcccatgcatcctcgctgtgcgtcgtgcagtgcacagcccacggtgcagggcgtgacagaagccgatagaaaagtggacggcacggccgcagcggcttggcatggcaattggcaggtgcgtgcgcggacctcgctcggacggaggcgtcacgcggcgaggggcgcagacgcgcaggcaccccggccccgggtcatttgttggcgacggaatgggcagccgccttgcgttgcgtgtgtccggggtgcggcgcagacccgcagtcactcaggccgtcaggcgggactgcgcgggagacccgacgcttgtgtcgtcactgtggccgatgcggcgatgcccgatggcagcttgccagttttcgtgggattggcacgtctcctccggcctgcgcggcctcgttggtttgacttcagttcagccccaaggatcacactccgcacgcccacatgtgcagcggtgtagatcgtcgagcacctctcgcgacctcttggcggatttcctagccgtgtttagccaggcaccgcgtgcttagtttattaatcttggaggacatcgatcgcttagtttgttgcgtatgctctgcgcatttatttgtaccctctctcgtcgaatatttcagacggcctgcatgcttgaagtatatgggagtggttccagtcctctgctcgtgtagctgcaagttggtttggttggtcatgccaccaatggaatttaaaccaggctactggtcacgtcattttgcttcaggcacacagcagcggagccacatacggaacgactgcacactactccag

SEQ ID NO: 1966 - DNA, 1452 bp, Zea mays
  misc_feature (1)..(100): optimal_loci_83691_G1, chr2:191110176..191111627, Cluster 11
cctaatcacatgcagggctggccccgaggatacgcagggtccctcagagcccgtaaattagatagggccctatttatccagcttatgtccaaatacatattgcaacgaaagcctactacaatccctcgactctgcatttttcacacgcagattgtggtgtgcttgataacaattgattccttttttgtaaatttagctacggaagaatagtagtagtagcaggaggagggcaacatgatgatgcagggagataagagttgaggagctacgcaatcatcactccgagcaggtacggacggtgcaaaaggctgggcgccatgcatcatctgcatgatggaaggaaggcgggtgcaagcttgttctcagagtcagcagatggcaaattgctagcggcatagcgctgcgctgcgctgcacagcagcagccagccagccagccccgagcgagcacagcgcgcgttgagcagttttgttacagcgcagcagcaccggcaccggcaccggcatgcaactggaagcggctggggccggtggagctagagaacgaggaggaaacaaacaactgggagtggccttttgctgctcttctagttctgaagatctgacgcttccatcatccgcatgcagcgcgcccccacgcacaggcacaggcacagtcgtcgcggcaccccatcgccactttccccggtttgcctggggcctgtgccgccgtggcccggtcgctagtctcgccacagtgacagcgctgtccctgtcctgaccattccatggcgtttggcgctgccggctcctgcggtcctgctgcatatgcttctgctctgctgtaatatattattttttctcttcatacatgttcgagacttctcgtaaacgagagtatgagacgatgacaataataataaaatccccatatgcgttttttgtttgcactatttgcatggcgctgtttttggttagcctatacccggccgaactgcgcacagcgatggatggagggtctgtttggtttgcgttgcaccagacctacctggcccaggcacaactcccaggcgttcaatttcgatcgcctggggctagctatgatcatttgcctggcaggtaaatgcctacgtacgctcttcgatgtttgtggttgagtacattggattctgtaggagttgttgttccgtcgatggacaagccaacctgtttgttgcttcaagcaactacgacatcgaacctggtcaggcttcttctagaatttcaacgcctgaaactgttgctttggcgccaaaacagatttcttaggtaaacagctgatattattgtgaaccttattttgaaggatattgagaaagcttataattaagcttgttgcttcacctcaaggcggaagagaccttatcgaagaacgcgtggctgtccaaatttggcctcttcgacgaggttgggctcccattcgattccacttgac

SEQ ID NO: 1967 - DNA, 1645 bp, Zea mays
  misc_feature (1)..(100): optimal_loci_84193_G1, chr2:194490125..194491769, Cluster 11
tgacagtactaggtcggctctatcctccggtagaggtgtttgcatgagagctagttgtcgtcttgccaggttgcttgacagacaagttggtcggtagtcctgattcgctgggttactctgcaatatttgtttagtgggcgagttgatcgaaaatcatgcatcgccgagttactcgtcggacaagttgttcagcttgatggaccatcatcaagaggccttttggaccttgtttggataccctattctcatgtacccaacaaatagtattgacttggctcaacaatatgttacatcattgctaacgtatgggtgctcagaccgtcaacgaggcaacgaagcagcaagagggggtcgtcgtcccgactgaacggccgggcggcgtctggattgcgatgagttgactctcactttttgtgtggcctataataataacacgcccattttcgatgaccacagcctcgcgagttgaattcaacgtaaattattaatactgtctgccagaagaagaataaaaaaagtcagaatcttctcggtcaggcctgtgttgcgaccatgggactctgctgcgtgagagtgagagatgtacggggtttagatgtcaacggagaagactttggtagaatgtcaacggtgacgactgatgaagtgggactgccgaagagcctgcgtcaggcattacatcgggcgatcgtctgcctcgacgctgacggcagcattgcggcacggccatggcactctcgccgctacgggaggcatgtcaggctaggcagcgggcggcactactatgcacagtccagtcgctgtcgcccactgtgttatgacatcaccgtcgctttctcgcttcaaaatactactagtcgcacaacgtagagagacacacgctggcgtatcgtatttcacgatcgaaaatcagagcattcccagatgtacgagctcgttgggccgctcattttgctatgactacttcgggttacctgtgcatcaaccacccgacgccgacgatcagcccacgtttgaaaaagttattgggctccaacgtcacggtatcggccatgtctgggtggtgtaggtaggggtcaaaccgctaccgtcaagctgtgttttgctattgggccttggtagcttgaaaccgagtataggtagtatttgggcctacttagggccgatttggtacaaacgttaaaaaaggccccaagttcactaatgtagtcttcaatttatatttatcatattttttttctagcatggccgatgagagttaacatagaggctcattcgagtctttcaataacggtaagataagattttttttcataatgatagaggcagatagtttttatagtgaataatattagatccaactattatggacaacggtaattagagtccactaaattaaagactacatgtttctaactaagtaattatcatgagttttttttaacaaaaattataccatgtctatttggaacaaacctctgacaggtaaaaataagatgatgtcattatagcgtgtatcgtggtacctcaactatacatagtagattatcattaatcaacacgattcacaagtatattctcaattgtctcacccccacccaatttataagggatgtttcgtactctgatagcggtaatgatacct

SEQ ID NO: 1968 - DNA, 2299 bp, Zea mays
  misc_feature (1)..(100): optimal_loci_84521_G1, chr2:196238000..196240298, Cluster 11
  modified_base (31)..(31): a, c, g, or t
  modified_base (32)..(32): a, c, g, or t
  modified_base (33)..(33): a, c, g, or t
  modified_base (34)..(34): a, c, g, or t
  modified_base (35)..(35): a, c, g, or t
  modified_base (36)..(36): a, c, g, or t
  modified_base (37)..(37): a, c, g, or t
  modified_base (38)..(38): a, c, g, or t
  modified_base (39)..(39): a, c, g, or t
  modified_base (40)..(40): a, c, g, or t
  modified_base (41)..(41): a, c, g, or t
  modified_base (42)..(42): a, c, g, or t
  modified_base (43)..(43): a, c, g, or t
  modified_base (44)..(44): a, c, g, or t
  modified_base (45)..(45): a, c, g, or t
  modified_base (46)..(46): a, c, g, or t
  modified_base (47)..(47): a, c, g, or t
  modified_base (48)..(48): a, c, g, or t
  modified_base (49)..(49): a, c, g, or t
  modified_base (50)..(50): a, c, g, or t
  modified_base (51)..(51): a, c, g, or t
  modified_base (52)..(52): a, c, g, or t
  modified_base (53)..(53): a, c, g, or t
  modified_base (54)..(54): a, c, g, or t
  modified_base (55)..(55): a, c, g, or t
  modified_base (56)..(56): a, c, g, or t
  modified_base (57)..(57): a, c, g, or t
  modified_base (58)..(58): a, c, g, or t
  modified_base (59)..(59): a, c, g, or t
  modified_base (60)..(60): a, c, g, or t
  modified_base (61)..(61): a, c, g, or t
  modified_base (62)..(62): a, c, g, or t
  modified_base (63)..(63): a, c, g, or t
  modified_base (64)..(64): a, c, g, or t
  modified_base (65)..(65): a, c, g, or t
  modified_base (66)..(66): a, c, g, or t
  modified_base (67)..(67): a, c, g, or t
  modified_base (68)..(68): a, c, g, or t
  modified_base (69)..(69): a, c, g, or t
  modified_base (70)..(70): a, c, g, or t
  modified_base (71)..(71): a, c, g, or t
  modified_base (72)..(72): a, c, g, or t
  modified_base (73)..(73): a, c, g, or t
  modified_base (74)..(74): a, c, g, or t
  modified_base (75)..(75): a, c, g, or t
  modified_base (76)..(76): a, c, g, or t
  modified_base (77)..(77): a, c, g, or t
  modified_base (78)..(78): a, c, g, or t
  modified_base (79)..(79): a, c, g, or t
  modified_base (80)..(80): a, c, g, or t
  modified_base (81)..(81): a, c, g, or t
  modified_base (82)..(82): a, c, g, or t
  modified_base (83)..(83): a, c, g, or t
  modified_base (84)..(84): a, c, g, or t
  modified_base (85)..(85): a, c, g, or t
  modified_base (86)..(86): a, c, g, or t
  modified_base (87)..(87): a, c, g, or t
  modified_base (88)..(88): a, c, g, or t
  modified_base (89)..(89): a, c, g, or t
  modified_base (90)..(90): a, c, g, or t
  modified_base (91)..(91): a, c, g, or t
  modified_base (92)..(92): a, c, g, or t
  modified_base (93)..(93): a, c, g, or t
  modified_base (94)..(94): a, c, g, or t
  modified_base (95)..(95): a, c, g, or t
  modified_base (96)..(96): a, c, g, or t
  modified_base (97)..(97): a, c, g, or t
  modified_base (98)..(98): a, c, g, or t
  modified_base (99)..(99): a, c, g, or t
  modified_base (100)..(100): a, c, g, or t
  modified_base (101)..(101): a, c, g, or t
  misc_feature (101)..(130): n is a, c, g, or t
  modified_base (102)..(102): a, c, g, or t
  modified_base (103)..(103): a, c, g, or t
  modified_base (104)..(104): a, c, g, or t
  modified_base (105)..(105): a, c, g, or t
  modified_base (106)..(106): a, c, g, or t
  modified_base (107)..(107): a, c, g, or t
  modified_base (108)..(108): a, c, g, or t
  modified_base (109)..(109): a, c, g, or t
  modified_base (110)..(110): a, c, g, or t
  modified_base (111)..(111): a, c, g, or t
  modified_base (112)..(112): a, c, g, or t
  modified_base (113)..(113): a, c, g, or t
  modified_base (114)..(114): a, c, g, or t
  modified_base (115)..(115): a, c, g, or t
  modified_base (116)..(116): a, c, g, or t
  modified_base (117)..(117): a, c, g, or t
  modified_base (118)..(118): a, c, g, or t
  modified_base (119)..(119): a, c, g, or t
  modified_base (120)..(120): a, c, g, or t
  modified_base (121)..(121): a, c, g, or t
  modified_base (122)..(122): a, c, g, or t
  modified_base (123)..(123): a, c, g, or t
  modified_base (124)..(124): a, c, g, or t
  modified_base (125)..(125): a, c, g, or t
  modified_base (126)..(126): a, c, g, or t
  modified_base (127)..(127): a, c, g, or t
  modified_base (128)..(128): a, c, g, or t
  modified_base (129)..(129): a, c, g, or t
  modified_base (130)..(130): a, c, g, or t
cctgcccccccttcaaccccaaaccaacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcgacatgcacgcaggcgcagcaagctgaataaattcagcactcagcgtacgtatagggtccgagcttccacgagcacaaacaacatcacgttacgtgccgcagtcagtcgcgccgccgacggacaactaccggagaggtcgttttccggtctcgtgaaggcccgggcgttccatttccatgcatgtagatgtagagagcagcaagggataagagcggagtagtgattgtgcgcagcgcacgtacgcgctgatgggtggtcgttgcgttcccggtccggccggcactgccgctgccgctctgctagtggacactgatgtgagccgctgtgcgcaagatatctgcgatcgagtggcacttgaacttctctttctgccgagcgagcacgaactggtgccgagcatgcacacgtcgctgcccccgatgaactttttttttctcccttgccaaatggcaccgtggggtacttttcctctgccgagacgcgggtagatattttgctgatgagccccgcgcgggtggcgttccccctggccctggcccgccggccaccaccaccgccgtcaccttcctcccttttcttttcttgacgctgatcgatgtaccatgtgcagatctgatgcgctctcgctctctattccacgaccaccaaggatgcaacgtgatattttatctttatgattttaaatttaactattacaagcacaccttatagctaatctaatagtatttattttaatatcgtaaatctttatagttcttaatctataatcaactaaactttaaaagatattaaagcatgacatcgtacgtgccacgggcaactttgctggaggttggcaatccagctccgccttaacatgttgctgtcgataacgacggcggcatacagcgggcgataccaactataatgcattattaaagtatctcttgttgattgtagattttacaaaataataattatgtctatgagaacgtcactagatcttcaggtaaagcgaaaagcagggccaaaccgctgtgcaattagcttctcgtacggttatcatgcaatcgaactactaaatatcatggaaagctatgagaaaactatagttgtattttattatatgctttgccgaaatatcaaattctaattcattctacgctactgtaagagagagagagagaaaatgtactactactcctgtcctgcgtgcggcagtagtagtagtacacgacatcccaagttccaaggaacagatcgagcattcaacgcatgccctgctggatatgatccacccggaaagatggaaatggttggatgaccgaatgattggcaagcaacagaacaggtcgatcttcttcttggacgttcaagtccacgcatgcatgcatcccggtttctcctgcacactgtcacgctctcgtagctcactgacaggaacagaacagaacagaacaaacagtgttgcatgccctgtgacaaaaagagcagtgacggtgtccctctccgcccgttccgatggacgatgggggagtaaaaactaaaaagagagatgaatgggcccctggactttttgctctcggcaaccgctgcatcgatcctccaccaccatagccatggcccatggccatggcattggcagctgacctgccccgcattcgattttggacctccctatccgcttccccgttggacggctcaccctgcgcattctaagctttttctctctcgccacttgtcaatgttggcgtacgatcagaaccaaccaacatcgcacaatgttattttctgctaaactttttgctcacgtcatcagcataaataaagcaagatataaaactgacgaacagaccaaatttgattacaccagaggttatgggcaagctagagaaccaactacctcacaaccaacaccaaataccaagcacagcaataaaaaccgagccgtactccagcagctgggagcttttgttttgcgtggcacccaccataggattcgatcttgctcgcaggtcaggtcggcatcacactggcacagagggacgtttagtgagcgtactaggacattacctacggagttcatactgatcaactaccagaacatctttttctctttaatgtatccttcaataggttcatactgatcaactaccgtagatacctaccatggcgcgtgtactaa

SEQ ID NO: 1969 - DNA, 1565 bp, Zea mays
  misc_feature (1)..(100): optimal_loci_85600_G1, chr2:203611005..203612569, Cluster 11
ttctatcctcgacttttaaattctccataggtagatcattcatatcgatggaggaaagggggtggaggcccgtgaagtgaactttgtaatagagtttaatttgtaaaaagagagataaacctatcataccattccagccaggctcagcggcggcccggccgcggccggccggcgaggtgtccggtctccggtgttgtgtgacgattatggctgggccgaaagagaccgtctaacatgcagacgacgacgagacacatgtccactccaaagatcgtccgtcatcatcattaacaaacaagcggcaaacggatcggaggcatccaacttccaaccccactagcgccaaacaaagggcacgtatgtaatgtaatgtcgtgtacgcgtgtggcccctgcaggccgtgccgtgccttgccgtgagtgcgtgcgtgcgtgcatggccgggccgcgcgcaaccacaaaccagccgcggccggtggcccggtgcctaacttgccgaagcaagcgctcataaagctctctggccgatgatggccggtgctaaacctgcatgattgggggcagtactgtgcccgtgtcgttattcccttgttgcgagattgcgaatgaacagaaccaccggttgcattggacgcgcaggcgctggagcatcggtggtcttgttgtgaccaagcaagcagctagctctccgcctagctatcttttcatgccgctgttgtgtgaccatgcatgagtacaagtagtgatgtgcttcaagggaaggcaaagtgtgtccaccgatcgagatcgagagagaaaagctaatcctttagtttacttgattccacttgtcttggccgcttttgatttgtgcgctttactatatatctgatgctctttcggtagtggtatagtgctagctgtcaagtaagaattagttaacataagggtacgcacaaccccattagttaaggagtatcatgataggcctctaagaggtcaagtaaaaaaaacaagagatgtcgagtctgtctcttcttcagaactttttatacatatttatacatattctattaactgtatttatgatctagcggccgatgattatatcattatatagtttttatctatttcttatacttaaaaaactgatccaatagccctagattatacacgctctgagcgtagcacttctgtaaagcgaggatgcgtgctgcactgctgcctgccattgttgcattcaaggctgctaagaaatcttctgccggttgccggctgctggttagtttagtttagttggtgcatgcatgcgtacgtttgtttcgtggtggcactgtgtggcttgagtcgtgtcggcactgaaccatccaagcacttgtttgtttactttccttgttgattgattcatggatcgtcacgttttttttttttgttgactagttagttagttaacacggtacgtacatgcatgtatgagtgtagtggatacagagtacacatatacatggcacgtctcatatatatgctagtactaattccatccataccatacagtctagactctagagctagctacatacatatata

SEQ ID NO: 1970 - DNA, 2230 bp, Zea mays
  misc_feature (1)..(100): optimal_loci_85742_G1, chr2:204258071..204260300, Cluster 11
tggccttcgcccttagcgaacaacatttggcccgacacagctcgacactgttgtgtgtatatcatattgttctattgtcgctcttacttagtctgtatttgtgtgtgtgtgttttcaaaacaaatatttgacttagtctgtatttgtgtgtgtgtgttttttcaaaacaaatatttgactatttgctagactagttatagatcaagtgggcccacttgatctaggttcctctacaaatacagctatatatactatctttataagcatctatacgaaaccataggtgtgcagtatatactttacgtatttggtgtggtaacttgatgaaacttaaaatcatctgggtaaattatactagaatctaggtacgtgtacgtacgagtacgacctacaaaatggcacgtgtgggataccaaatgtaatcatacgtcttgcacggtgggccatgctatttgtgtaacatataacaaaggtgtagattgtttattaaactagtactagtatggtattgaaaaaagtacatacctgataaattaatatacacgccatgatggcatcggagaaaaaaaacgtggcgcggggaagagggcggcgcgcgatggataattggataggcagacgatggcgactgctacgcgagcgaggccacgatccgttcggattccatcccccaagatatgctcgggcgggatcggatctgaactatagtatctgacatctcatctgatcggctcgatcgacatgtatgcagtctgcacgtgtggacgcgcacgccaccgcacgggcgacggggcgagcgacccggctcggtgctctcccacgatgacgcaaaggaaaaaaaaaggtgctggtggaatcggcctgcatggttttgctgcacacgaagacgagcgcatgcatgtttgttgtctgtccctaaggcccaaggcaccaccatcgtccagactcaggtaagtggtgagctttgtggttaatggcaaggagagcagtttaaccgtggaacaaatttgaacgttaggacaccagcgaaggcaaaacgcagcaggcgacggctggctggacgcgggaacaacaaacaagttggataatcgctgacgcgggccggccatggggtggggatgagatgtgcgcgcacgtcattggcctcgccgcgtgtgtctccgcgtaagctatatacccccggtgacgatatacacagtgtacgtacgcaaaactatttttttaacactagaaaaacaaagaggaaatgggaccaaaagcgacagtacgaggcaacagtcgttagttggatgatggcaaacacactacgtatatatatataataatatatagccgcacgaggctatgattcggccggccccatggccatgatgcatgaccatttcagggaccacgtacccgtacattgattgatccgatgaaccaggtctccatgcaatggcgagatagctagccacgtgcactacttcgcgcaggcgcaacacacacacatctcagcttggctgctagtagtaccatatgagtatatgacatagcgtgtgtataatcccagtggagtactctggttctcgttcgatttccttccttggagtgtcagggggggtccgcatctgcatgcggcaggcaccaggcagcgccgcattagtttatctgtggcatgaacagcgcgtgtttttcgtgggcagatcagaggcaccggccattcaaccacctcgatcgatggtcacgccacgtatgtacgctgtcagctgtttgattattgatagatcgagccatcagtggattccattcattgtgctcacccacttattactcgtactcgatacgatgcctgctgttggtttctattaaacaatacatgtagttaaagaatttgatccattgttttttttatacgaacgagctctcgcaaacacacgctaaattaaatctaaatcactaactctccccatccatgcactctcgttcacccccagtcgtcaatccagcatactatttatactcgatatagtaatgattgctgcgcgggccagcaacaaaaaaaaccatagttgttgacagcaagcactagcgaaaagccaatgcgcgcaggtcattttcagaccgagttggcaaaatgattcgcatgtttacacattataaatatacatcgatcctcacgtagcgagaggtacggtgctaccaattctctactactctatatgaaggtactgtaggcgtgcacaatacg

SEQ ID NO: 1971 - DNA, 1464 bp, Zea mays
  misc_feature (1)..(100): optimal_loci_86996_G1, chr2:210661266..210662729, Cluster 11
acagtctggaagagaggcttctgaatttctggtcagatttctgccagccagcgcgcgacgtggctcgggagaagacaaaaaaaacgagtttttgctgtctcgattcgaatcctgcggcagcaggccggccggtagcgatatggttaggtgcaaggatcggtcgctgtggattgaagggagtccgccgttagggtttcccgccaggtacattacatacagtacactcgccgatcgttgtcaggggaggggaggcacccgattcccttcccgccaacgcaaccggacgcgagttcgacgaactatgcatgcagcacgccaccctcttgtccctctgcgtgcagctgcaggtccaactgcagccttcctttgttggcgtgcagcagccaccccggccaacagctagcgcgacagcgacgtggtggcatgcagtgcgctgcatctcgatcgatcggcgtacgtttaaccgacgtacgtactgtacgtacgttgcaatgaatggaagctcccggccgtgtctccgtcttgggcgcggggtcgcagtccctgcccgaggcgcgggcaggcagggtcgctgccgtcgcagctgggctagctgcgggcagacgacacggcgcatgcatgcagctgcacctataggctatagcgtcgacgtccctcctctgctcgctcgcagcgcattcatgttcgcatcacgccacgatgttgcctgcactgcactgcgctctcccacgtttgctggccactggccagtcagtcactcctctgcatatgcatgctgcgtgcggcaacgtacgtgggggagtgagctgagcgctgagctgccagaggcaacgtgcgcgcgtgcagtgctgtgacagtgagcgcgtgagccagtgagcgaccagagcatgcatgctcatcgtccattcgtcctatcctaccagcagctgttagcctacgcctctagatgccaaccaaccgttgagacttccggagtaaaaacaagtgccaccagccggtatagtagcccagtactgtactagaaaaacaaaacccagcaccagcaacaatcgttcaaattctttggcacgagattctctctgattctgacagtgccgcagagattaattaattaaaacaagggacggttatcttgggcctgtcagtagtaggtgtgccgacacttaccgacgcgacatgttgcaagatcttactgacgaagtggcgccactcttttgttttattttttttcgtcagaaactagtaatgtaatacgagagagagaatctggcctgcaggtgacaaggagctagccatagatcactcaacacctgggggaaaaaattccactatacgtactgttgctatggaatattcggttaatccaacaagtcaaggtctgtccatcgcatcaccccatctcgcagtcgcagcagacacatgcatggatgcatcgctgggccggcccgtgcagtgcgtgcgttc

SEQ ID NO: 1972 - DNA, 1817 bp, Zea mays
  misc_feature (1)..(100): optimal_loci_86998_G1, chr2:210663278..210665094, Cluster 11
gagccagggtggttgttaaaatgattatatgggacgagaaagaaagtacaccttgcgttgcacctcgactcgaggatcagagagagagagacacgagccttctagtacggaaccatagaaggtttgttgaaacatcggagtgggagccgaagccctacaccaaaatccaatcacgtagtcttaaaaactctctctccaaccattccgctatatacatcttcgattcctttatatgtactttctattatcttttattacattctctaaaagcaagattccctctacacatactgtacgcgccttcaatcattcgaaatatacatcttcccttatactataacttagttatctaatttttcatttatcactttttttttttgaaaatttaaaatatcatacgatatttgcatgcactatcataatacacattatatgttatcatgttacgtgactcaaacaaaattaatatcgcaaagaaacaactaagcatactgtaacacccaaattttcaacttgagaattaaataaatctctctaaagtatttatttgagttagtgttttttatacggattttacatttagaagaatattttttttttaaaaaaaataaatattttgattgtgcattgcataatgatggtggagcagctagcattgtttttgattgattgagttcaaattcgaatttttaaatttggatttgacttgagttggaatttgacgcagccaaccaaacatcggcacaaaacagtctggccctacagagaaactgcatccaaacaataaggtcatgtatcaatcgaaccaggttcagcaggtgagtctggtgctgctcctcactccatcctgaccatgttacggtaaccaatcacaccccaaaatcagactctgacctagctaggtaggccatagtaggcacgtaagaaggggcgggtcccttccaagtggggacggtgagtcgacggcaagtggcaagtgcgcaaatggttggtggataaggatgacccgtggcgacagcaggcagaaagatggtggagcacgagcgcacacaccggaccgtggcaggcaccccacgtgcgcggggcggagagagaggccggcgtggcggcgtgggcgcctgcgccaccatgtcctgcacctgcacctgcacggctgcacctgcacctgcaggcaggcagcagaatctccccatctatccgcttgggcgtacgcctccggcggtccaatcctctctggctctcccctccgcgcacggaggctgcctgcaggattctctgcagtttattcgtgcgaggttgccgtgcttcgtcagagagccgccccccgccatccgccaaggcgcccgagtttgcttcgagcgagaggaggagcattggcattgccaacgccaacctgtgatattatagataatagtaattgagcacgggaaaacctagtatgcagcgctatgcattgcacgcataggcagcgcccgccgagacaggaacaggacggcaaccaacgcaaagctacccaaccagtgcagtgcatgtgcatgcattgcaaggtcccttttaaacagcatgcatgcgtacgtacagaggccgccggtcgcagcacatgacgtgccgcgcccgcgccatgcacgcatcgccggtcggcagcctagctctagctagctagctactccggccctacatgatgcgtcactgcgtggcttcaaccaacgaccggaccggcccaccgactcctgcgccccacagccacagctgagctatagcgagatcgaccgagagcgctagctcggccggccatggaccatggcgtgatgggccgg

SEQ ID NO: 1973 - DNA, 1762 bp, Zea mays
  misc_feature (1)..(100): optimal_loci_8885_G1, chr1:46846918..46848679, Cluster 11
cgcatagcaaatcctcacatcacagcttcacacacactaacagagtgttggtctcagtaaccaaacaattctaaatcagatggtacacgatgagtttgttcccttaaaaccggcagaatagttttattcaccatactgttataaattatgagcatacgagaaatgacgtgactaagcatcagtttcataaactgcaaataaaataaagagttagaagacgatgtactatatttttgaaccaaacgtcctaaaataccatgacgaatctcaatacatattacttacgacgatgctgaaggaagggacaaattcaaggtatagctaaatacattttttttgttcattctgtggcattggttatttttggtgccttgtgcgtggtgagatttgttggcatttgtggttttgttcttgttaaacaattaaggactagaccaaatggatctacctacctagctagaccgatagtctacggggttgtctaaagttttttttcttctccttcctccatgaaccctaaaagccggactccagcggatcccgagcgcggccgcgaaaagcaccaggccgcgtcgcagaaacaggcgtgagttccagcagctcgcgtaaagagggggagaagagagaagatacagtggtttgtgggagagaggaaggtgatgcctctatttcgcatctgcatccagtatctgctggacggcgctacagtggcgctcgctgcgaaaacaacgtatttgcgacacgtttcgcgtcctgctggactcagcctaagatcaacggtgatagaactcatcgcatgataccacggaggttgcgcaacgataggtctaccgatcatagatccataaagtgttggcacatgatggcttcacagttcacactagcagaggacgttgagaatcgattcagtgagcaagaccgaaccatcctactacaactgaggagccgtttggatgatagaaacgttttatagattcttaaatgggtctttggaggaaaaattgcggtgataaaaaaacaacttcctccatctgggtctactaatcattaaaatatgcaggagagattgagagaagcaggattctttcgcttatagcttaccagagagaggatacgtgcatgggccttgaggtgagcgaggtgtggctgtattttctgggccagcccatacgccggctggcataagaacggcccggagaaagacgaccccgacaggtcactggtccgtctatatatgcgtgaaatgaaatggcaacgcatccacaccagagaccagacaccagaacgtttagcaaagcgccgaagccctcctttgattggttgaaccgttagccgtgccgtctagtctgtgtccgcagtcagtttcgctggaatcgtggcctctcgtagacgaaaacaagtggccaggcccaccgctacgacatccgccagatttcccgagcgacacgccctccctcagtcccaccacacacacgcacgagtacacgacacacctccctacgagacaaacaagtcgccacctgtgtcgtgaactgcagccccatctgttccggacaaactctgcctgcgtccctagcgctcgttttcctcccgctttcaggcacaaaaaacatgcactcttgacgttttccctgtgggtcgatgcaggctaacccccttggtataaattggggtgcaagcgcaactgcactagtacgccggatgatgcaattgagagcggcgtgtttgtgcagggtggagaagcaggacacgtgagcgacca

SEQ ID NO: 1974 - DNA, 1759 bp, Zea mays
  misc_feature (1)..(100): optimal_loci_9234_G1, chr1:48640824..48642582, Cluster 11
ggaaacgtgtatgctacattgctacctacatatgtaccacatcgaactatgatagcatgcgagtagagaatcatgggtccacgttcaaccaagatagcatgttgtaaatagagaatcgtagatcattagggctagacgcgtagcgcaggtgaaaaaaacgcaccgatcgtcgttgctacacaaaaacagacatgtcggaagtcgttagtaacttccgacggcctgtccagagtttgatggttaagtattccctggtgccagaaataaatctgaacaatatttggaggatgaacaaaaacatacttattacattaaaaaaaactgaacgtgagttttcactcgagaaacagagaaatagacaggctatatccgggatctcatcagaagaaaccaggctacgagatggctactagtatatatggaacgctgaggcgcacactcggcactgagccaattttatattcgagctgaggcgactagaataatagggcgtgcaaaacaaacacactgtttggaatagacgcaacatttgacaaacactagctgcaggaatcctgttgggctagctaggcaggcagcagcagcatcctgggggcagcgccagacaggcggtctccctccccggtgagacggggggtgaagagcggcggccccagggtcaatgcgtcgcggaaagtttgcgcgagaacaatctgcttagctaggcttccgagcccgtgacagccagcctactcgagcttggttaatcaaaccccaggtagcttactagcttgtccatactactagctagctagctagctagctccaccatgctcctgctcgtctcgactatgattaaagccgggcagcagctttcttgtgatcttgcgtgtacgtcgccccttttacccacttgtcgcgcggttctcgctagcgctgtgcgggccatgcggcctctctctttcggggtccctcctccacctttgccttgtcgatcgtctcagcactgaatcactgacctggccatacatatacatggcatggcatggatggtcgatctacctgaacatcgatctatgtgcagctgcgcgccatcagtatacatatatgccatgtatgcagtgaacgacgctatatatgatccgctgggttctcgctacggcatgggtacaactgtagaagccagcacggcacgcctttttgtttccgtgtgtggcagtgcaccgtacccagaggccagatagatggaagtgtgtgcgcgcaccaacgaaatcaatacgcatggaggcagaagcaggtaccgtacggcaacggcatgcgttgcatcgggtcgggggtcagggaggggcttggtacgaaacaccgtgcatgcaatgcatgcatgggaactgggaagaaggggaatccatgcactgctgatcctgcgtagtacgctcgctgcgagttttaatggccgtgcatgccatgcaatatgcaatgcatcgatcggccccggtcgacaagagtggcgcggcgcgatgtgatcggccggtcgaattgaaggacgtgcatgtgtgcctgcagcaggttgcagcgacgatggtgcatgcatggtggtcacctgagactgacaataagatcgaatctatcaaaccgagctccaagctggtccggtcgcttctcgatccgacgcacgagccggcattgaatgccctcacgccgccggcgctatgttgttggacacgggacgggcggtaacgtagccgtgcagtgactgactgcataatggcccgcccgggtg

SEQ ID NO: 1975 - DNA, 2366 bp, Zea mays
  misc_feature (1)..(100): optimal_loci_9235_G1, chr1:48648101..48650466, Cluster 11
gcccgggtgagtgtgcatgcggctcgtcgtctcgtactcctatataacgatgcaatcagccagtgtatatatagtactaatacaagcgtcaaactacacatgctaattaaataaaaggtaaggttgcatatcgaccaccgaccgaccaacatgggcgcgtgttcctgttcccactaacacgatgtctgtgtacatcatgcgcaaccactttctaccgcaaattaacgcgcctcgccgtgcaactgtgcaagcgaaaataaagctggacggacgagtaacgaacgggaataagcggccaagcagccggatacgagacgagccatgccagaccaagcgctagcgaacaaaacaaccaggccggccgctttattacttcggcacagcgaatctcgcacagtatctatcgcgtatcgtcgtcagcacagtaaatgttaaacatgaggggtgagcgcagtgctcgttgcccatgctcttcagtgacgtcctttgtagctagagtacatgccagcaccagcagggactatatatgcgttgcacgtaccggccgtacggtcttgtaacacacggcgcgcggggtcgcacactacccggtggcggagctaagcaccgtgcgtccgtgcctgcacgtctgacgaggccgccggccggcatgcatgcacgcagcacaggggattagcacaagggcacaggacggcgtacgggcacagtcacctcactgtacggcgtccgccagcggcagtacgtacgacgcgtccaatattgaacggccccctgtggggtggggacgatgtggcccgcctgccgggcgcgcgccgcggcggccctggaacgagcacgagagagcacagcgcgcggcgctagcgtacgtgcaccggccgcaaggcattgcaattggcatggcatggcatggtgcgcgagcccgcgacgttgtaggagcacgtacaccgtacacgcgtgtctggcgctgggttgtgccatgcatgcatgggagcaaataaactggtcttgtggtggcgattcattcaagcacgcaacgtgtgctgtcgcgtgtacgccttacacgcgttcttgtcgccggcatgcatgcatggacccatcgtcggcgtgtccggccgatcgatccgtcctctatatatatacgtattccgctacggctcacacgaagtcacgaccggctgatcgagattcgagagtcctcgtactcatatcgaaccagcctatatataaagtatacacgcatcatggttggtgcacatggatggacgatcgggctctctttcgttcgttatgtggtgtatatttcatatatggcagagggaggaaatcaattaaacaacaatcgtcatttactcgtttgtcgtaactatataactaaccggtggtctgccacatgcatgcatgcacgaaatgttggtgccctgccaccaccaaaggacttcttcactttggagcttcgatccatgcctgagaggctggaatggcacatgcatcatcatcgaccttttgttgacgtcgtcgcgtcgctgtctcgttgccaccttcgatctgtgaatcattccagaaagtatttactgttaatgacctgcatccgatctccttctgccaaacacagagcgatgtggatgctacccagcaggcccctgtacatacggtacgcaggtacgtacgtacgcatagcaacgactgtcagatccgagcagcgtagtagtatacgcacggcacgcagggacgacgggtgggtgctttgctttgccaggaagcgttaattacctagactaggctagattctctgcactagctagtgtcgtaaggtgtacgcccctgggccttattggtcgtggtgcacgtagtataatacaagtgttgttgggaattgatgcgcgcgtctcggatcggctcctgtctgtcatgaagcttgcagatcgagacggcccgcagttatttatatccctgtcggtcgtcttcatcaccctgcgatccttgttttcctgcactggtttagcagcgtcttgattattgtatcattcattgagcctcgcctctttccgccgtgtcatgcatgcacattcatgtgtgcgtgcatggccgagcgaggcggcgtttatttcttgtgagccgccgatgcatggatggatgggcggagcgccatgacgttcgtcggaggaggatgcaatgcatgcatgcatgtaaatgcaaggcgtccgtttcgttacagggggtcatgcgcaagatgcagcgtacccgtcccgcacacatatgtagcgctgcctgcctgcctggatcatgcgtacgtgttggtgaatggtgatggcatgtaggccggctccccttgtgacgctcacgttcttttgctccgcggagcagcg

SEQ ID NO: 1976 - DNA, 1670 bp, Zea mays
  misc_feature (1)..(100): optimal_loci_93296_G1, chr3:5947182..5948851, Cluster 11
agaatgaatataatgtcgcatatatatatatatcatccggccggatcgagagatgtgatctggacacagctgcttcaaatcaacggtccacggatcgagcagataaaacatcaagacatgggacgacacaaccatcatcatctgactttttattcctttgtcttttgcaaattaaacagtgtggcgattaaattagggcacgtacgaacgtacgcagcctgctttctcgccttttggaagtagtggatcggaaaagcctgcagggaggcagatggagaaaggttggtatgatttccctgggggagatgagatgcatgcatgatgggctctcgatttattcgttccattccatacattatattagtatcgtctacactatacactacagttgttaaggagagaagaaagaaaggtgagtgtgagtgccccagctagtggtaatacactactaagcgaaaaggtctggcttttggcgcttacacacatacgtgtgattggcccatgatgcccatggattattggtaagctcctctcctctccttctcctttcgaacacacacacacacacacaggaggctgctgctttgttactgcacccgagtacgtacgtacctgctggatcgagaagacgttttcctggacgatgaatgtgtgcaccgtgagtcagtgacaaaaggtcagctgataacaccatgaagccgtgcgggagatggatggaagaggaggaagaaggggaggggaaatgggcaaataatagtacatggtacggctgagccgcgcgcgccccaagaagcggcaaagcgatcgagcagctttggctggccttggcaatgtggcggcgatgtcaatgcagcagcatggctttagccctggcatggcatggccagcccaagctagctacgtactactgggacgaggtggtgagagtgagactagcgtgagcgcctgcgtgcgtgcatgcatgcagcaggcgcggaagataacaaaacaaaacaacaaggaagcaacacattttgatgcaatggcgagcgcaaagcacccagtaattaaagcctgatcgcctgctgcctgacggaaatggacaggcggggccgggggcccgctagtccgctactagcaacgaaagcaaccatctgatggatccctttagtttgctgcatgcagtggcgagagctagcaacgaaagcaaccatctgatgcagatgcagaggggcgagagcgagctagctagtcaggctcaggctcaggttgttcagcgagcgagcatgctagctagcttctcccgtccttgtgcagctcatgtgcagtgtagttccattcaacccatatcgcgcaatgattttttcccctctattcccccgttttctgtcgctgttcggggcccctctgtgtcacttagtggcagctaatcatctgccacacgcgcatcgtctgtgtgtaagcctgcattcatttgctttatttctcccctaaattccaaaaaactgttctgcagtgtgcaggtacgatggacggaacgcacgatatggggatcgttttcgaccgcccgcgtgatcatggcccctatgctgtccggaatccgatgttgggtaatactaccgtctaatgatgagggcttgcaatggcattgaggcatttttttctctctcggagagaaacgcgtcccctct

SEQ ID NO: 1977 - DNA, 2228 bp, Zea mays
  misc_feature (1)..(100): optimal_loci_93409_G1, chr3:6425895..6428122, Cluster 11
atattatgtgtgagaccagttactaattgttaaataaattactatttttatcctccttcctgttcctgatctatatcagctagctatttaagatagttattgcggacgcgccaaagggcccatgaagcctggttcccctcgggacctcgggtcgaggaggcagccggcgggacgccactgggtctccaactggtacgaagccagccgacgcgcggcggccgagctgagttgcgaacagtactgtatcattgtagacttgtagtccaactgggacaacggcgcacgacgacacgcgcgggccgcgcgcgttcctttcacctcggtcgccgttcgcgcggcgagagaatttgacgccgccgcgcggcgcgccagtcatgcatgacgcagctggtgcggcacgccgcatcacgacctacacgctgctttgcattgcatggtcgcttttgccatcgttaattctgttggggaaagaaaaggctacggctcttttctttttgtcacaaaaaggttttgactttggttacggccgagacggcgacgcacagtgtatgtcgacggtgactttgcttagccgactgcagcgtttgcactgactgtgaccatctatctgcagctggcgcggcctgctgaactaatctggtttgcgctatgctagctgtggtcaaaaagaaaaggcgcacacgtgtacgtgtgcgtagctataggctgcttgacatatgcatgccctccaagctcactgaccacactagccgacagctaatttgactgcagatcatgtatgttcagttccttccatgctttgcagtccctactgatgcacgcgcgcacgacgcaaggactttgtgtcaccaccaccagaagcagccgcgcgctataagctacagctgctgcaagttgtagttgtagctctcgtttttggttggtgcagctaagctaccagtaccagatctcttttgtatagccgtgccaatctcctgctgacatttatctgagcgtgacacactgatgcctgcttaaatttatcgatgagcacgtatacagtgcccctaccaccgtggagcgagagagcacctaaccgatctctcgtatctcataaaatacgaaggcgatgagattgcatatgacccaaagggagctctcgatcgtgatttgatgccgtgcacagttggatgaagactcttagctaggtagctagctagctccatcattcggagcgagctagtagcctcacctcaccagctcacctaccacagacgccacgcatgtttgatttgattcccgttctgaggcagggagatgtgtgtgttctaggcagctagtagcacaaagagaattgatgtctgatcccgggctaatccacgtccccatgatcctaaaccctacacacacggatatccgcctaaaaagctgccctcgatctccttcgaataaacaacgatctcctgctgtgaccgctttaattttaagagcacccctctgattaattgaacgcgcgcatgcaattaatggactcggtcggatgattattatgcgtgcaattgacctgcggcggcgtactagctaccttgtttaatttgagaccatatactcattgagcagcctgctggtaattatgcaattgacattttcagtcttctctaatcaaagactagagcacgcagttttagataacacaacaacagaaacgtcaattaaacaataacaagtggacgattgttccaaccggtatttttttttccggacctatagctagcggtgtggtatgtagtatatatgcacatctgttcattccgtcgtctatccatttttagtcaaactttaacaaattctatggagaaatttgcaaacatctatgccttgaaaaaattgctgcataaaaaatataaggacacttattccgtaatataaccgttactattttagtcatatgtattcggattcaatcatatttgttacaaacctttttttttctcattctagaccaataatagatggtcataattaaacctaacagtgttagtattagtggagtcctggctcacaatgggagaatgggagagacaggctgagcctactacgtacctgtcattggaagggagactacacactgcaaaatcactttctactttcagttaattagctacacactactatatacatggatagttcgatttgtagtggtggataaatagcatagctgccttttaaattgcacgtgttggttataa

SEQ ID NO: 1978 - DNA, 2780 bp, Zea mays
  misc_feature (1)..(100): optimal_loci_96380_G1, chr3:22725907..22728686, Cluster 11
atgccttgccgttctcgactgcggctagcctaaaccctgacgaagagacgctgacaagcaccatgctccctcggcgcgagcctgcatcccgcacagcgcaagggccggcgtgaggcgcgccgaaaagctatcgtatcgccgcagaatccgtgcagtcctcggccagactctgcagctccgctagaaaaaaggcctttgccacagtttattttttaaaaaaagtcacgtcgcgtgggcagtgggtcctccttcgcaacacgagatgatcgcagtgcggaggccaggcctgcagttgcactgggctcccgtctgtctgtctgtctgtctccgaggcctgcagttgcactgtgcgtcgtgggcctcgttctgacgacaccaatccgtccacaaaaaagtgtgacgagaaaagaggcgccgtcccgtaccgtaatgaaatgaaatgaaatcgagccgcggcagcgcatgcacaccacgtcgcaggcctgcttcccctcccgcgtgccgcgcctgacctgacctgacccagcagccttttcgtctccgcgatcgagatccggggctgatattggtacagttcctgtcggcgacgacccatcatcaacgctcgcttcaaaagcggtgcagctgcctgcggaaaccgatctttacagcctgggtgcatcagcgtgtcttgggcagaggctcgtactgtacttgtttattttgtcgccgcatgagcgagcgtgtccgatagtttttcatctttttttttaccgtggggaaaactgctactcctccattggaatgaagggtgcggggacgtactaggggccgtgcagtttccgtctctttttttttctgacgcacgataaatccgtgaaccgtgaaggcgatcgatccgtcttttcgatcctggcagggccgggctcgcatgacgccaagcggtcggcctgtccgtccgtccacgcacgcaaccgcaaccagagtccgaaccaatcccgagcggcgtggcgctctgtagtctgtactgcacgggctggcactgcggccgcgcggcgttgtcccgtcccgtcgccatcaccaatcccagaacccgtctccttcctccttggcagcgtcgccgagggtgacggactggcggcggccggcgcacgagaggatgggcggcaacccaggtaggtggctggtcgcgtggctcccccaccggccacgtcgcggccttgctgccgactgccgcgctccctctcgtacccgatccccgccgcacacccgtcacgtgaccgcggcccgtggtccaccaccgcgccagccgagaaagctttggcgcgcccgaccgcgccagccggccgcggctgtcgtagcgcccgtgggctgcctgcctgcctgtgcctgcccagcggcccgcgtacctgacagtgggggcgcgcggtacgtgccagggatttccttttcggcgccagacgagacggtcgtagcagcagcgagctggacagcgccgtttgtggctgcttgcgctggcaaggcgcgccgaaccgggggtccgtacgcgacggggcgcgggggtgatcactcgtactagagtgactaccagccttgccgacactgcgggtttgtcgtcgtgcggcagacgaccttgggctgtgcctgacgtctcgcggatatggggatggcatgatccggatcctgggaaggatggatgccgaccgtctcgtgcgtacggttcgaaagatcagtttctggtgcggccccaccccctttgcttatcctctgcctgccgcatctcatcggaaggaacggtcctcgaaagataagccgatgtgatgatactcctctgccatgccaaggaggtcgacatgctgttctactcgtggttggcttcaggatccttccgagaatgatttcctggcactggctgtccccgcaatagattatagatgagctgtatagtcctatctattccccgccgctacgggcatgggaaattagctggaaaaaagggctgcgcaatctccgccggaacactcccgttcgcccgctaatgattggcaacagctcagacaagaaccgaacaaacgaccgaatcatcactgacccaccggccgttcgatcacctcccatcccaccgggccaccaccatggctccagcagctgccagtctggtagagtagtagtactagactttgtttaatgcaatgcaagtcaaaggaccatgagccagccggccagtccccagccggtccgtaaaagcgaaggccggccgggtcacgagatgtcctcatgctcacggatcgcgcatccaagtgcggccgcctacgcccaaacaagttgagctaccgacccggccgacagcccaacattcgactgcgagctagcaagcgagacacatcaactggcgctgccactggcagggtagtagtacacgttgaggtggaccgccgtccttctcgtgtgccgctcgccgcaccggcgcaccctctcctctcccgagtccctggtttttaaaaatagcggaaggataagctagtcactgtgtattaaaaaaaagctataacctggttttttagaaaccagggtccaacacactctcaaccagctttgttttataaaccaacttctagagaccggagatataaactgatttatacgagatgtttcataagattttacaacataaaagtaaaattgaaacgaacaatctttaaatggttctagggtaaggattaatcaaacaagctacgacgtcagcgagcaccgaaatcgtagagacagcgcctgtaaacactgcttgcccccaaatacga

SEQ ID NO: 1979 - DNA, 3508 bp, Zea mays
  misc_feature (1)..(100): optimal_loci_989_G1, chr1:5054533..5058040, Cluster 11
tacatgaccagaattggaaaagccaaaatcatatctgaccaaaaaaaaaacaggttgaatgcttgatatccagtagttgctcgatagtataattttcaaggcttcattgtcggaaacagtgcggatgtcttcatctcgtgaaattgccaccatctctgatctattctataccatatcagtctgtttaatgccatgaaactcacgtagccttaaaaaaaactctgacgtaaacactgcaaagagttcaaggttttggcggttaagtcctcgcaaaccatttgtgtcttaaaaaaaatagaacaggtggacgacgtcctgtgtgttctccaatctccattgtatatggaaaccaatcaacagcgggcaatattgcctagaagatcgttgcagaaaaccagttccacgcttcacacttcgttcaaagcagttccgtgggtttttacccaacagatgtactagctttggcctccttggaaattccggttcatcagcggttggtcaagcacgcgcctgatgattaataaaaggaaaaaggaaaaacaaagcagatcttctcgatgggtcaacaggacggagcgagctttccggatggccagtaatcttcatgaccaaggagggaagatggctttgacttgttccttctagaacaccggaatttctggcatcctgcgtgtactcaaagcgagagcctgtagaggcgcgtgctagtgacgttgtgtttcgtcagcgattcagatggaccgaattcgcacaaaacaagttgtagatgggcctggcccaagcacttcagactcagaagcctagatttcaggcccagttgtacctgggccaaattcgcacaacaagattagtgcggtagcaagcaaggagcagaactgtatttatatacagaaaaaaggttcgatttgatttgacagtggacatgctggacgggcgagtgaaaacactgaaagaagcatcgactccatgtccaatctggacatgcttgacgttttcagttccatcttgaaagatacacgtaccgattgcggttgcggttcatggcccgtccaaaatcacatcacctgtttcgtcgtgatcctgtctttcaccctcagaattctgacctgaccgatgtgaaaccgatgccagcaatggaaaaaaaaagaacagggcatgcaacgagctcgccgccagctgcctgagcgtgcgctacaacctacagtgagagtgagcacacagctagctgcacaggcactcgcgagccatgcgtcatatcgttaggtgttgtcaaactagtggcctcctgttgacttgcgcagcttgatccgctcaacaagtctcgcacgcatgtgtgtgtgtgtgtgtgtgtgatgagtccgtcaaagcagcggctccagtctcgatcgcaatcatcatggttcgaattgacggtgtgatgataagcgatagctaatagtaggctaccgtcgaacaatgtccgtgtctgatctgcttggcatgatgcgcatgcgcatgcagcttggacggacagagagatcagatcgtgctcgtccgtcggcaaggcctatagaagcaagcacgcaggcatgccatagagagatcgtgtgctggtcgcgcgcggcgcgccaacagccgctcgcgagtagtggtgtacgtactacgcatggcttgatcaggcgtggatccgtggttgtcggagctctatagctacctgacgaggatcctttctttcattcgtcggcaattgccatgctgcaaatatgccacgcgcgcgtgtcgcggccgcgcccgcgcccagctagcagcaccgatccagctatcgggcgggtagcgaggcggtgtcgcgcgaaaggcgcggtgccggcgagtgtccccccggggctcgcacatacatgatggccgcgtgaaccggggcatgtgaggccgctgtccgccgagctgggcactgtgcgtgcgtcgtctccgcgcgcccgccgatggcgacgccgcccgcgcacgcgctcgccagggttctctcacgcacaccttgcactcctctagcctctctccaggcatgaacagttcgcctcatcgtagcattattatttgcatgcagttgcaacacgtacgtagtcaagtcacgtatccgcgcatgaacgacgccgcgcagggtgggagttgggacagcagctgcaccatgagaaattggttgagcccaattcaatctgacctgttaattaaagcgcacgcatcattcttctattattggtaaactaactaactgctagtaaagccggcaaaggggcctgcagcagcccgccatttgttattttgtcactctcgattgttgatttctctattttatcatcattcgtataaattatagatataaatagtctcacaaattattatagatatagagtgacataatagccgaaagcccactgcaagtgacagcaggtcgcggcggctagcgtcccgcgcgcattcgcatccaacgacgtgtttcctccggggacatgcgagtcgtcgtcgccgtcgtcgcgccgccggacgacgagcactaggccgcaccgcaggcaagttggcgcgctccgccggcggtcggcgtcgcgcgcgggccctggaccgaccgggccacgtctggacccagcgagcgtcgtcgcgcgattagcgttattattgctgacccggtcggctgctctcgctcgcccccatcttgttggggacggggtcggtcgtcgcgtggaaaattcagcggcggccgcgacgagcccggtcagtcactgtgtttagttgtgtatatttgctggtgattacaatgagctggtatttggttgttgtgagtcatggtctatggtgaggtatatgtttgattacctgcgtgtagatatagagccagcctcgcatgatatttaaagcatcctggatcaggttgtacgggttgtatctctgaagccagactccagtcaatctggcttatacagtaaggctacagagagaagacaaccaaacatgcggttaattctgttacccgcccaggcgaagcggaactcgcatcagggcactagttcatcccggagacaagagcggcatgccccctgcagaatccatctgccctgatatcaaaaggatccatctgccgcggcgtgactgttgcttccttctcctcggaggatcgacgacgaccctgcgacgcaaccatgacgtgcgttcatttcatttgatatgacacagcaaactagctagcgtcttttgattcctccgatccgcgcctgaggcgttttggattattacgcggtcaccgattaaattagcatttggtgacacgaaacgggcgaaaagtttccggagaaagtgacgtacggggggaattggagcatctgcagggaagaactagacattgaaaaagactaatagctatacctatatatatactatatacacggagcagctaatcataacaccaccagctggctggctgtggtggattactcaatttactagtacgtgccggatgctaaaacgaggaaacaacaacagagac

SEQ ID NO: 1980 - DNA, 1441 bp, Zea mays
  misc_feature (1)..(100): optimal_loci_60209_G1, chr2:47513705..47515145, Cluster 12
ctagggctgcctagctgactgatcactgactaggggcgcgtcagcgtgttcctcgccgacccggcatgcaaccgcgccccccaccaagaagagaaagccagcccagcagccgtcacgttgcggcaggcaagccggcaaggcaaagcgtgcccgcctcttttctctcccgcgtccgcggccctgtccaacagcaacagccaacaggcgagccaggcagccagcccccagccaattcccccgtgtcgtgggaacgggcgcgcgcgcgcgcagcgccatgcgcccatgtggtgccatgtggtgtgtgaaagcctgagcggtgttgcggttctagtacagtccaacaaagcagccggcgctcctgtttagtagctacgttaccataccactcgtagtagtatagtatgcttttgctccggcggcaccacctttatttaaagtctatttcagtggtaaaaaaacaggcatcggtcgacatgacggagaaaatgctggcaaggaacgagtctcgtctcgtctcgtctcgtctccccccatcgaaatttcgcccacgatctcccccaacgtacctggtactgtacgtactgtagtgccgaatatgcagagctcctttacttactcgatcgacatgaatgaatccacggaaacggtctctggcagcagcaattaatgtggtcgagaaatacgaggggtgactggggagtggggacggacgacggagtagtaggagaaagggagaaaaagaaaaaggagtggtggaagggaacatgtgacagtgccatagtgggcgcaggccgcagggagcgcgtcgctgtcgactggaccccccacagcaacgccctcgggctcggcctcgcggtgcttcgcgtgcgtttcctttcctctaccgcccgcctgccgatcgattcccgggcagaaaacgagagcgagcgcgacggcttgttcacaggtttgtttggttttgtcggcggtcgtgggttgctgcccccccccccccccccccctcccctcgcccgcctcatcatcaataatatcggcaagacaagcccgggcgcagggcgccgcttaccaactttcgtcatgtgtgaggactgagtttgtgtggccctgacgtggcgtctgctatgaggacagtacgcatgtggccggtaataactggggggctagcaaagttactgcagccagccatgtataatagtggtagtttaaccacacacaccaggcaagctgccgtgacagacagccagccagccagccaggcgaggatacttgcagaggaaccaaaagtaatccccaagtcgtcagagaacgtggatcctggtcacgagtcgagtgcggagagaagctttgggcattacaatacacccgcgccaattagctggtagctttgcctccaagccgtcgtccgtcccgcgattagttttaaactaatccttcccgacta

SEQ ID NO: 1981 - DNA, 2220 bp, Zea mays
  misc_feature (1)..(100): optimal_loci_10033_G1, chr1:53416795..53419014, Cluster 12
gacatgaccgtgagtgcacagcacgaggctttcatctagaacatcacgagagacacggacgagtgtggtgccggtgggtcctccaagcccgtttggcttttggcctctggtgctgggggagatctagtatctgttttcttgtactccaagactggaccaaccaatcggaggagaccggtcggggccacggcggcaacgcgacgttgccctggcacgcgcccaagcgcgttcgacgtcgcgcccaagagggcgacgcgggcagcagcggattgaactggcccgtcaggccgtcatcatgtacaggggcgaccagagcgagcaatgagcaggggattttttgcagtcgtttctgatgccacgccacttgtactaggccatcatattttatgcagtcacgcactgagggggaaaaaacttcatagtttcgtgcaaaagttataacatgaggccgttcaaattcatgagaaaacaacaaactgaaaaattacaacatttgaatttatggattataatctgactagattatataatccaacaaattttgagctaaaatgatactcattccaagtgctactagatatttatattaaacgcgcgtgtttgcatccttgcaacagaacttagcgcgctgctagaatatcattcttctatctagaaaaaaaaacaacaacgtctttggatagcataaatcaagcggacagcgacagagcgtgtgcgcgcaaacacagattgtcagcagcgagggttccaggctttatgatcataaaggggggttttcgctgggatccctttccagaaaagcatttgggatcatatcaccaccggccaatatatccatttggttcgttcgtgtctctcttgcaggagtcctactcgaggagcacacaaaaaggttgcacacacagctgtcgaaaaatgcagcagctagcggtgtactgtaacgtaaacggccacttgctgttgagctctgtgttttctggaagagcacgcgtgtcgccctctgggcggctctggcgcgaaagaagcaaagggcagagaagagagaaggccgcaagcgatggaggagacggatcggagcacagtagcacacctcctcccggcgaattgtaacgcacatgagccgcgcatccacgggcttgtggagatcttcgagcgaggcgttagaattcgcatatgtcaaaactcctcttcgcctgcagactgcagttggtgaccggtcgccactgaccaggtggacctcggcgcacctaatgataatagtaataaatatcacgaacatgtcgtcctgatacgttacgaacatagcatcagtcaccgaccagtgacaagtagcctgctcgttccgctctagagtccatgtccggaaccggccaagcattggaagattccgttctgatgcaggaaaagaaaaaggctctgggagactcctgcggtgctgcctcctatgccgggttagctagtagccgtcacgtccgcgcgaacagggccctggcatctattccggtgatgcagagaagaaagcctcgggagcaagcgtttaaacaacattatctaatgcgtgctagtgggccggccgtagacgacgacgacgacgacgtcaataatccccgggtaagtccctacaaaatccgcgccctaatcaccagacttaaagcaacctgcatctggacatcacgtccaattaattaacctagtctcccgtgaccaagagtattgatttagcgcgggaacaagcacgcggcgctagaaaagagatccggtccggatcacacacgagctttgctaacacgtccacggtccctatatcatctagaacctagcgagaaatataccgccccgcctggttggttgggtgagtgaacgtggcctgacttgtgcgaacttcgtccgctagaaacgagaaaggaaaggacgacgagcactagagtctagagtactagtataattttttttgtagtaataattagagctgagtgccaacgagcgggagcctaaagttgtgacgtcacacgatgtaatgacttggacagttcgatccgacccaatcgaaaccacccaatggtagcggtcaggtgaccagctactgccggtgccggagtcgtttttgcgtcactcccggtcccgacgccctcgtagcctgggcagcgagaatagagaggagaatattcgcgctagctcgtttgtcagaggctcagagcgaactagaatgatccttatatg

SEQ ID NO: 1982 - DNA, 1523 bp, Zea mays
  misc_feature (1)..(100): optimal_loci_10082_G1, chr1:53630113..53631635, Cluster 12
ctaaagcaccttaagtttacctaaaattataaaaaaaatacatataatattaaatagatatgctataaaaatataatcaataaggagtcaacttttgattatttggtattttaactattatttgattatgtaaatttgatctagtttagatacttttactcttaaaaaatagaataatttattattcgaaagagtaggacacatgaaacacacactaatcagcatgcatgtctgcggagttctctgacggtgtggaattgaaccacgagtcctgaactgacaggatgggcttggcacggcccacgatgtcattatttcacaagaacgtggcccaacgtggaatatgttaggtggagattgatcatgaaagcatggcccgaaaatgatataatatgtagccgtttgcagaaagatttcgggcccaagtgacattttgtccacatcgatctctccctcccgcgctcctcttttcgagtagagtgtagaggcggcggcaaggcgcagtccactgagagatcaacagatgttcctatggcccgacagtctattttacagagcaaatcgtccaaagacacttgatatcatgcccatatcctttccacatgggctcgtcacagtcacgtgttcttcttcgtatcctgccaaccgtatcctggtcaaggctactagaaagccaagtttggaacaccacgtccgctaataacaagtaataaattcagcatcacgaaaggcacattcagtcggccactactgctataccaccaccactcatgaattgaataacacactggactgaagaaaaggtgatgcgaacaatgatgaagtagataagttcagctccaaagataacatatcatatgcgctgcaccagcgtcaaaagcggctctcctttccgtctgcttctctcagtttctttctttcgtctccggggcctggatcgagtagcacccccctggaaggacgacgaaccttctccacgccagccagcagcgctcctcgtcacccctgaaggctgctcaacagtaaaatactcctgaacttgtagcacctggtcttgtccggacgatggaaatgcttgctttggctgctaatggagcatgagtgaattaatacgggtgcacgtcaggtggccactggccagtagattgcagatacgtgagagacgggtatccgtctcagctgtgggagcgcctagctagcagcctgcccaaacgggaaagcagcgaggtgaggtgaggccgcaaggaatatacgctgaatctacggtgccagatggtttaaactactcggcgggttcgttgtcccttgttcgttccatctctcctcgggagagattcctggggttctctacacctgcttctaaagcttatctgcatgggggagataaagcacgagctggaatggctgtttttttttaaaaaaaaaactccggttaataatttggacggagactcattggtaagttaattagtttgacgtgctacttcggttgcgtgcgtgcaaggtagggaaagttttttttt

SEQ ID NO: 1983 - DNA, 1425 bp, Zea mays
  misc_feature (1)..(100): optimal_loci_10537_G1, chr1:56579049..56580473, Cluster 12
attcattacccattacgttacaaatatgtaaaccaaacggcacccgattagttttcaaacagcgcacagacatatgttcatgaactagtagtgtcatgctgcaagggtggtccaggactccaaacctagctagtttgcttgcgtacaatgcaaataattaagcccacctcattccctatagcaggcagtagctggattgttatatactttattcacaccactgcaccagcacgcatgcatgttcattcccccaccgctagcgatcgaacaaaaggaatggaagcccccacccccacgcacggcgccggcagcacattttatcactagactagatagctaggtactactatagctagctagttaggttggccatcgagcgtacagtacgtacgcacgacggcacgagtactacggccccggccggccggcctcttcatctctagcttgggtggcgcggcggcggccggcggctcaacttttggttgcgacgagccagtgcgcgtttgcatgcatgcggatgtgcgcgcacgcgtgcatgcatgtgcatccgcatcgagcccggccgccgcgcgccacacccaacactactaccggccggcccttgcaacttggagcctgcctgcactgcgcttcgatcatctgccactgcctgcagatgtgttctcgtcgagccgtcgaccggccgccgccgccgccgccgcgccctggccgacagcgcttttgacgccgcacatgagtagtagttgtgagttgtgactcgtgacgacgtcgccgcgcaggcacgacgacagcagagatgttaaattatgatatggacatatgtagctcaattttttattccattacactaaactaattttgggcaagtatttatatatgtttgggatttttacgggcctttagggtcctaatttagaggctctaaaattctttggagagcatccgattctgagccattcgaacaagcggcggagccagagcacggccagactaggcacgtgtttaggctccgccgttagccactgctgcatgctgcctccgcacttgtctaaagtagggaagttgagttgcctgccgctttcgcctccacactacatggaagaggttagtgatggatataaaggatgatcaagtgctcaacatgaaaagagaaaggagaaatgcaaaggcttaaggcaaccgtgggcattttattttactcatcaagatcgggtttatgatagatcatcgtactattaagaggagggtctaatcagacaactaggacatctactataccactaggtgtcggaatcatatgcattacttataggcccaagtgacacgcgtgagagcaagcgaaaacgttttttgaaaacgcttccaaaggtacactgctctaatatctttggcaaaatattttagagttagcatgcttcaaaagag

SEQ ID NO: 1984 - DNA, 2722 bp, Zea mays
  misc_feature (1)..(100): optimal_loci_117894_G1, chr3:159868714..159871435, Cluster 12
cagcacaggcagccgcgtctgaatcgtcgggggaggggcctgcgtaatcggctttattatccagtgcttgcttgcttgcttggagacgatggaagaggatgcatgcagcgcgacgacatgcgcagtgcaagtaatggagtttaatgcaaatctcgtctcgtggtggccggccggtggggctttttaatcatccaatggcttggctgctctcgagatgtagtagtactgctaatcatccaagtttccttttattttgaaaaaataaaaaatttatttaagaagataaataatagacgagttacttctagtactgccaccatgcacagcagctgctgcctatagcattatagctcacagcgtgcaatgcaaggcctctgcattgttggctgttgccttggattcgggttccggcaggcaggcaggcaggccgaccaaccaactccgaccaccacatgcgtggggtggggttggaccggccgcgaactctcgccggtggctccggtgtggcgcgcgcgcgcgcggcggtggattagagcgcacggaaccggccggtcgatgatgggtagtgagggcagatcagctgcctcttttagcgttttgtgcatgcatgcccccgacgagatcccaatcatccgtgccgcctgcgatctagtactagctagctagctagggttccggttggtgctactacgcaagctgctctccgattgcggacaagagaatcgctggcatgcatgcactggcactggcactgcacgcacacccgcccgccgcggcttcgtcatttgccctggacttggaattgtgctgtgtcacgggtaggaaactggaagccgggttaattagggtggcgtggtgcttattctctatctatgcagtgcagctagctaatataacgatccaatccggggtgaaacgaacgtcgactttgccctaacgatcgacctgattttgcctagcctgctggaggattcaactcgatcggtgtggtgtatgcaattacgcacacgtactgctgccctaccgccgggaagcaaaaaattaaagccgcctgcgctgtcacagatcttaatttcaattctacaacaacaataagaagaggaaaacaagcagaaatggccttctcgtctctgcggccgcatgcatgctggggcatcgcatgtggtgtgaggcgggaggacacacgcacacgccgcagcggctagctagctagcatcaagtccaaaagtggcgccgagggttggttgggggcggtttgtgccacctaacagacagggtagcctagctagtggccggtggtgacagggagagcagattgttgttgttgttgttagtgagtgagtgagtcctagctatatggcaaaggctgtacgttgttgttcatcaggatgggccccaaatgcaattatgcaactgatgagagtagaacacaacacgcacagagagaagaacactcaagtcaaggggcgcgcatgtacccctgttgctgtccagttaatcatcgtccttgctaatctcagccaaaagcaagccggccggcaggcagctgtacgtggaggggaaagaagaccgcaactgaaggaaaggggagccggccggtgccccggtccacatgcaacatgcatccatgatcccatgaaccaaacgccgtcgctagctgctgcccggccggccgggccaccggcatgcctgcctgccacctttgcttgttagtaaatgttaacgactctacacatgtgcttgcattgcttgcttacaagtgcgtggcttcgcgtttcagggaagagatcgagggaacgcgcgcgcgcgcgcacacacacacagagattggagttaaatcattaatcatgcttgcacggccggccgtccaaaaaggccgcggcggcctcacctctgcatgcatgcaagcttgcttgcttgcagtggcagctgcagctggcctgatggacggatgggtggatccttcacactactgtctcattgagtggaacggagcgagacgaaatgatggcgcccctctcacatgcgctgcaactgtcatttgtgtcaagatccacagttaataccactattgttgcctgctgcccagtgctgtgctgctgctgctgctgctggggccttggggagccagggcagatggatggatggatggatgatgatgactgtggtgtggactactgtgtgactgtggtgtggccggcggtggcgtttgtcgctgccctggatttgattggtgcagcagggcaaacaacagcagtccatagtgccatactgccatgtaggactagcgggcatcttcactgctatagtgtcacgttgatcggctcagcccaccagtcaccagagctacctagcagtcaccttcggtcacgtctcgtctctctctctctctcactgtgctgaggctcccacacagacgacacatacagtagagccaacgggaaaaagggaaccccgcggtaacaacgtactagcagcgcagcgtggagtcgtggagaactctgtacgtactctctctctctactagcgttggacgatgttgcatgcaaaaggtaggcagccttttacgtccagctcaagcctcaaggaaccaaccttggcccctcggggtcggggctcggctggctgggagttgggactccccctcttggcctcttgcatgcatgcattatagtcacgcaagagtttatctatcccgtgccgttaacaaacagttcagtcc

SEQ ID NO: 1985 - DNA, 1611 bp, Zea mays
  misc_feature (1)..(100): optimal_loci_118122_G1, chr3:161638068..161639678, Cluster 12
ctgatcataacttttacatatgaaatcggatgaatataacttatttgtaattttaggttgacgctacaataaaccctaaaacaaaacacgtgtcgaagtgtgtgtcaaagacgtgcattgttcaccgctctcgctatctggaggtgctgcctgtggttgctggtggatcgcctgatgttgcccggagggccggcgggcggggcgagcgagcccgtgatcgcggcagagagccatgggggcctagggagctctgacgttgacggcttgacgctgagctgagctttctcgcatgcgcattgacctgtacccaaaggtggggccgtcgtgggcgaggagagcacgccaagggaccgaacgggttcccgatccgtttccttcggacgggagacggacatggtggtccggcgggcacggtaggagtaggaccagagagaggagaagggtgggtagcacggcacggcggcgaccgatctcatgatgtggctggcacgggatcggattgggtcatgctctggcaacgaccatgctcgtctcatacggctcgcttgctcagagcagctttgttctcccttttggagttttgactgcgactggacctgcttgcttcgtcttgatagatagtactcctttttgttgccctgactgagcacacatgattggtcgttcctcttcatcagtcctctcctctctgggtcccctcccctttgtgaggcaagaactctctactacaagtgcttccaaactctaaccagctgcaagcctgcaacttttgggaaattactagcatccctctccctgtctctgccgccgctgccgtgcctggctggctggctggtttttgcgtgctccgctccacctgaacgctttggcccatacaccacgcagtcgggcgggcgggcaggctgggtgccctgcccgctgggctcacggctcagctccagagcctagtcaacgcctcgcctcgcctcgcgcatgtgtagactgtagagtgcacaaagctacggcgcatggagttggagtggacggagtagtagctgaattctgctggtccgggggattggacttgtgccgtgccctagatgtagctcgtctcgtgtcatggcgacgccgacgggactgcagagtctcgtgtgtctttatggcgaaaagctgctaccaccactgcggggggccacgggagttctgctgcgtggagtgcagtacagtgcaagctgtgcagggcgccggcacggaaggaacctgtgccctgtggcactggcaccacccctcctcggtcctcacgcagcgccgcaggccacagcgacaggacccaggggagggagtccggcaccggcaggccgcctgggactgggagtgggagaatctctttatctgccacgtctttgtgcggtgccgtcacacaatgtaaaggatacataatagatatgataatgctaaaatctccgaggaaaattgctatcacataccttcatcaatccaaaaaagacaacctcactggctatcactcgcatccaatggtgttggatcactagtacccacaaagattaatcatcaatcaaaataacacattacacaaacataacagattttgtcctaatccaaacacatatc

SEQ ID NO: 1986 - DNA, 3181 bp, Zea mays
  misc_feature (1)..(100): optimal_loci_118157_G1, chr3:161957190..161960370, Cluster 12
tgatgggctgctcatgtcgtctgctccatgtttctttttccgccatgctgggctcgtgacggtggtagcagtataacgcttgagcactgttcgccgttgctgcgtgctgtaacgctgcatttcaactcaactgtgaactgctgctacagagtcatcatctataatatcaggacagcatatatatataaatagctgaacgaaaaaacaaaatactacaaagcggtattgttagtgccacagcccacacgtacgtaccagaacgctgctgactgaaaggggcgcggttcatcttcagctaacacgctggcgcgaagcgggaggatggttggtccatcttgaattcccctcggatttgcactacaatgacagcaacggttgcgcgtacgtaggatcatcacaccgagcgacgttcctctctggccctcgaccacagtgcaagcccctgcgcgttcaatgctcaactgggactgtgctcctacttgacgtttgtacgcagcctagtacagcatctctgctgggctcagcccctgctccgcgtcgtgccgctggccaggcgatcacagtcacagagcccggacgggagcgcgcggtcgagcggaggcggaggtgcggtgcacagccgagcaccagggcagagagcctgccttgttgcttgcttcactgagtagtagtggcgctggagagccgagtgctccgtgctcactgatgaggatagcggctcctgatgcacggtgctgatttttactgggacgggactgggagtgggagaatgtcagctgcaaggacccaaggctggctgcgagcgccgagcagacgagcagtcactgatggggggtggggctctgggtcacagtcacagttactcctcctcgtcctcctccagcggtcctgctcttcaccatctaaacgaccggtccacgacagcggccacagcgctgcctcctgcagcggaacaagaaccaatggcgcccgtgtccaattacagtttaggacacaggaatcacgccatcacctcgcctctgcgccttgtctcgatggaccgaccgtacggtgatcccgaccgtaatttttttttaccctgcgttcagacgctcgcgccgtggctttaccgcaattttttttaatctctttgtctgtttgtctctgcggcagttaccctaccctacccgataggtctagctgtactggtactgcttgctacggctacagatacggagcaacaggcaacgaccgcatcagctgcagtggatactacccctctcccgtcagctcaatgattggaaggccatgttaccgaggaggagcatggcaggcagcgagccgggtgggaaaagatgcctgccacgggcagaggcaggcaccggtaaaaaaggcggcagctttctcgtccccgcccgcctccctccacatcatcaccagtggagttggagtggccgggtagtaccgtaggagaggagggaggaggaccacgacgacgatgactgcacgtacacgcgcacgcactgcaccgcaccagctacggtgcgtgtagtactctagtagtggcactcctagcaacaaacaaacacaacaactaggccaacttttaatgcagccgagatcgatgacgcggtcgctcgaaaagacagcgtcggatcatccagctcgaacgccacggacgaactggcgcgatggaccaccaccaagaaggcgtcccatagcacatactagcaagtacgtcgggagattagcgggtggggtggggccccgcgtgcataatataccctagtcgcaggcagtattctgacgcggggcgcgcggggaaggtggtggccatggcgattagcgagcggtggttagatcttgaccggccggccgggcgccacacggccacgatgaatggagagagagaaagagagccagccagccagccagcgaccagcgattatattagccgcatccccacatggcggcggggataaactaacccagcccccgcccatgggacgacgagaagccgggccgggggcacggttggccgaccgggcgttgtttgtttagttaatccatcaaggaagggctgggatgggcgcggcgcggatgccgaggcaatcattgacagggagggggattagatgccccccggccagccagtcagaggctcgcgctcgctgcgcggtgattccgtccgtacgcggcctgcggttagtaatttggaggagcgccgatctatctactagtgtacttacagtgtacgtaccagtaattcctatcattggcagcgctaaagtataagtaaagctggcacgacttttttttctctcatctctgctccatggcacggaatcattgtcgacttcgtgcgctgcgctgcgctgcgctgtgcctgctgccagccaggcgccagcgcggcaatccgtcacgtcagaaaccggaagcggcctgctggcctctcgtgccgatgcacagcacagtgccacactactcgtcgttctggtagcagtgtctcctctacgacgacgaaagcacgtacgtacgtacgtaccaccagttcaaacgtccacgctcacacggccacgaataacatgaagacgatagatgctgccacatatacacataacaattgctttgaaaaaacaactcctggattccaaacccgtcctagctacataggattaataaaacacgcagtatgtagacctttttcgtttttgttttatgtgtgtgacctgtctttgttttcctcttcattagcccgcgattagtgctgatgtcgctgacacacagggcacgcacgaagacaacaaagctgcacgcacgacgcgtcatggatcagcatcaaacacctccacaagactcgtctaattagtgtaaacgctcccagcggatcatcgcccgcctggcctctgcgcttagatcgacaaaaggcccgatcgagggaatggttgaagcaagcaatatacaagctagtacattaaacttgacgtggatctagcgcatattttatttgttagatcgagaacaggtcataaggctcccctatttaaatattaattgtattaccatttagttttatatatgggatgttattaactgagcgcatactttagatgtgctctgtctacctatctttgagaagttgagaaaggttgaaaccacgccaccagcgtgcccccaccgtcgcagagccgaggttgagtcg

SEQ ID NO: 1987 - DNA, 1883 bp, Zea mays
  misc_feature (1)..(100): optimal_loci_118791_G1, chr3:165878143..165880025, Cluster 12
tattttaatcaccgaaaatgaccggcggcatgcagcagcactaatcagccgcccatcgtctgaatcccccaccgtgcaagcatgagatgagaacacgacgagatagagacgaatctggcaggaggcgagcccattggccaggaagcaaaggcaaggcgttgtagggccgcggcgctgcgtggcctcaccgtccgccccactaattccagcgcccataggccggcctcgcccccacccccaccccactccgccgtgcgggggggcttaaaagccctcaggcttttcggcagcacactcatcatcagacgacgcccaagtacgtacaaccatctgatcgcattattgacgcccgagcccgagccccacttcgggtccggggacgtacgaagcggtcttctgattcgctcctcctctcccagctacgacgtactacctacgagcgagcccgggacggacgaagcgaacgaaaccaaccaaggaaagaacattcccatgcccactcgctcacatattttacgagcccggtgcgggctttccacgttgggcgcgcaccggcaccgggctagctagctttccagtccttgatagctcgtgctgcccggcccggcctcgggtcccccacccacccacccaccggccaccgggcctgctgccagtgccagccgcaagcgaagcgagcgccctcctctcgctcgccggcgccggcgcggcacgtgtgcggaggggcatcaccgccctgtctcttgtgcattggctggcccggcccggccgccttttttgtgcggcgcgcggccgggcatctggctctgccgtcgtaaaagccgcgcggcctgcctcctcccgtagtatggcccccgcaacgcaagctccaagctgctaccgcttgtactgtacgtgctacgtggtgcaagggcgcgagattcgttcgctggtactggtaggaggagcacgtatatacgcaccagcggccgaccgtgccggtgctcagctagtcagctcagcgcgagagtgccaccactcccttcgcctctccggccggccggacggctggcggcggaactgaacggcgacggcgacggccacgtcgcgtcctgtgtccgcgccgcgcgcgcctgtgagagaccacgcaggttccggattcctgcgcgcctcagcgcgcgcgacagccaccgccaccagctgtctccgacgggtacggctccacgtagggcgccggcgcggaataattaatctatctcgcgctcgcgccaccaaaaaggttcctcggccggtgccagagtgacagccggggcggcatcgaccgggcgatgcgtgccgcccctcttccgctgcctgctgctggccatgaacgatgtgtgcaatgcaacggcgccggggtagacgctacacgctagtacggagtacttgttcgtccgatgtgagcgggcgcggctttcccaggtcaggtcaccaatattgcaggtgtgattcgaggcgcgcgtggcggtaccggtgggggtatagccacggtccgaccgcacaggtttctcttgtcgggcaaaattctcgtctcgcctgacaagactgccagataccgcaccagggctaggggtgcatgatggacatcaggacatggacgcataatagaggattcgaggggaaaggaaacatgaactacagacggaataatagcacctgtttgttgctcaaacgtgcgtgcttcgacatgaaatatctatttatataatgcaataatttctctaatgcaataatttctctgatgcaataatttctctgtattgttatttttctcgtacacctcgccctacattatacatgtcgtcgagcttatattatgattgttttgactccacattcacacccacataacgaatagaatacaa

SEQ ID NO: 1988 - DNA, 1612 bp, Zea mays
  misc_feature (1)..(100): optimal_loci_119035_G1, chr3:167375677..167377288, Cluster 12
actactcgcttggagcaaagcaggaaaccgccgtgctaattaaacgcgagcacacggctgtggtgatcacactcgagtcagctctcgagatcgtcggcaacctcgaggcgcgatggtgatcacgcttcaaatcaaacgccaaacgtgcttggaaacatagtatattataaattcatggtacgtgtgtagtactgttgaggacactgatttgcatatgtacaccgtactctctccggctccacgcgtgccacgcacgtacgtatggagccgcgcccttgggagttgagaccacgtgcgtgcgtacggcacggcaccccgcatccgtcgttcctgcaaacaggagggggggggggggggtgtgtcagcgcgtggacgttgtgcattggccactgggctgctttgtctgtccgttgtccaaatcccgatgagacaaaaaaaagttcagcttcagcatgccatgcacgcaacaggtagacccgcggtacaagtcagaattcaggaaaggaggaatgatcccagcccagccctgcactgcactgcactacagtacagtgcacttccgctgtgagcccgccacgccaacggaatcttccttgttggatgccgcacttccatatcctacagggctactgcaggtctgctgcagcagacagacgctttgagaagacggagaccgagatggattggtagttaaaaaatagctcacagaaatccatgcagggccgcgccttggagtctaggtcaggcaaaggagttcccgttgtcagaggcgcagagcactgcaagttaataagtgaaaccccccctggcgcggcggtcaccgaccacggcgtgtctctactagctcaccgcgcgcgcctgtgcgcctgtgtctctacggctcaggagagagcacggtgcccgcgtgccaacatccgtccacgtacgtttaccccgatccggtttgcgagtggtcgtcgtaagtctgatgacacatacccccacccccccccccccccccccccacggactgttacaccagtttaccaatatcaaggcggtgggcgcgattagttaatccgctgccgaccgatggatggatctgcatgcatgcatgttaatgacgtcaagactaaggcccggacaaaacccgtagtagacgctgcctagtaccagttaactatccccgtcaggtcagtgatcgcgcgctgctatgcagcagtacagtcatccggcctggaatggatcaacgcgttaaaactggctgtggatgtgtgagcccacaggggcagagccacgcgtgctgcaggggagatgcatggaacgttcgccgaacgtccttgctgcctctgctccaggcatgaccacgaggcatcacactgtgctgcaacgggcaaatgaaaacggccttgttcttgttcggaacacaaagcgcaggagagagtagtttcactttcaccgcaccgcctttatctctggccgactggcccccacatgtcaccgagaagcaaagcgccaacggtcgtgacagtcctcctactcaaagtaaagtgttttaataacggagaagcaacagcagcaacaacgaagaaaaaaaatgattgggacggaagccaactgttacgctctattg

SEQ ID NO: 1989 - DNA, 1635 bp, Zea mays
  misc_feature (1)..(100): optimal_loci_119742_G1, chr3:171754468..171756102, Cluster 12
ttgttcttatccttcatccgtctttggcgcgatacatgttcaggtcaggcgggaaccactgcatgcgcgcgctagctggtccaaaccagcgactgtgctgagcacggccgcggaatggtagagtagaggaggccacagtcagcattcttgatgtaccggagcttggagcccccactcatcaaaggctaatcggaatctggctaccgccgtctcagtgtgcagcgagcgctgcgcagcaggatcgatcgttttcagctcctgtccaaaggccgctacgcacaatcatttcgtccttcaaacgcgtctgtctcgtcgattaaactcccgttccgtttggcacttcggcaagaccctctcgactctcagtctccggcttgctgcggtttcttacaagcagcaaagggccctgtcgaaaggccatcaatcaaaagacactagctacgacagtgattttgcaagtagctgggtcgtaaattacgtggcgtcttctggtttccctctcatagaatagacctaacacaaacctccactccatggatgagatgagaccaggaccgtaccatcggccgcgcgcgaatccagaatactaatctactagaacgataagatgccgcccgccagtacatacgtgcatcgatcgcttgtgtgcccggcccggacaaaagccagggggggggggttcatcgatcgcggtccatctgatggcgctctgcgttggcggcatgcagccaaaccagggacgggcgacgacggtgtgcgtcactgcgtcagtgcgtgcgcggcggtggggatggctggctggtcgctggacatgtatcgtcggatatacatcatgtgtggcatcgtaatgctgcacgccttgccaacccagcgattcgacgtcttatcctccacatgcgatgcacagagaggctcgcatcgcatcgcattgcattgcattgcaggcccagacggatagcctttcggttttgtttggctctctccgtggcatatgtgcgtttgattgatggatgcaaaagggtcgtgtcatgcagttcggcgtgtctttcagcgctttattccccccaccttgcataaacaaggctgtcgctctgaaaaggaatggccttttgttcggaccagatattttttttccttcgtcggggatagcgggatcccctaattaatggtccgtagtcctcgctgtacctttaattcgttttcgttggataacatttaacaatatgctctccctgctgcttcgcttgtcagtatgtactaacacgggtacttagtttgtttagccattaggccttttatgtttacaaaaataatgcctatctgtttactgtaactattcatttttttaactctacgtatcatccaaatattttgctaaaagtccctttttattttttttaatttcactgggatttggtggcatgcagtgtattttctagtatggcaagacggtggtatcctttacttatttcctgaggtagatacaattattgtttaaaatgttaacaaaattttgcattttccttcgtcttataaatttgtattttaaataactgtctgccttaactatttagactagatttctcgactatcatgattatatttttaaataatggagatgggtcctacgtctcc

SEQ ID NO: 1990 - DNA, 1731 bp, Zea mays
  misc_feature (1)..(100): optimal_loci_119989_G1, chr3:173515291..173517021, Cluster 12
gcaaatgctctccccactcgatcgactgggactcgtcctcatccataccacctctcgtgcatgattggacgattttccgtgggggctggacgggccacgcagccccagaaagaagcggcggaggcacagctgcggcggcagcagctgtgtggcatgttgagttggcgagcccctgacgccgccgtgaccagcttttcggcggcgggcgtgcgtgcgagatggtctgcggaggtagagagagattcattggaagacacaactagatagatatcgatgcgtggcgtggcgaccggtgggaacgtggaaggcggttccgggtgggtacacggatcaatcgcccggggacgtcacgggtcacgaccgcggggcgtaggctagctgtgcgtagctatggcatccaagcgcgcgaaagccttgagcgcgagcgcgacggcggcactgtcgcagctctgctctgcttccgtcacgttgtcgcccgtgcccaactgacccgcacgcgcacggatcgctgccccgtacgcgatgacggcggcatggtagacaagcgggcaggcggggaaggaaagcctccgccaacttgctgtcgagcttgtggtggtggtggcgaggggggcgagggagataggccgccgcacggcacaagcaaccttccgtccagcccggaagcgtgaggtttgtggaattgatccgcacgcacgcacgcacggaccccgcgaccgcgaacgaggagggagaaaaaaaaaacggtttggtagggggacttgtccgcgaagttacaggtaacggaatctgtcgctgccacacgagtatctgtgttccggtgggcaaggtacggaacccagagagagcgaagccaactccacggcgcggcgcggctaaaatggaaccccgattggtcacgcgcaattatctactccatgtgttgcaagcaaccaagccatgcatgtaaacgctcctcgactaaattactttagagacaaagaaacccaatgattacaaagaaaaactcgcggtgcattccacctggagagagggagagagagagagagagttcacattgtagccgtcaagaacacgtcgaagtaccatagttcggcagatcatctgggtggcccggcgagctctccctctccgctgtctagcttgtaacaacagcacggcaagactggctggtcagagactcacaggatcgacggcgtacgtgcggtaggcacggcaataatttatcctctgacgacctcttcaaatattcctgttccaagtatgatggccgatgcatcgaattctgaccttgcgcgcgtgtgcaggaataatacggtgggggacccgttaaccccccgagcttctcacatgcttcaggtgtttcgcggtaacaaaaaaaaaaaatcccacttggacgacgttcaggtaggtaggtacgtacaggcataccagcatgctgtaagcgcagtactgcgtgacgcggaaccgaaatgtcaagggctttgaaaattgttggcgcacgcgctgagtaaacaaagcctgtcaggtgaaagtttaagcctagtattagcacattttatccgtggttcacgtccaactagcctgcaaacaaaaaaaaactctctcgttcgtggtttctcaagaggataagaacttactccaatttccaggctgacaatgcatgtggtggtagttggaaagcacagaggtagaagaatattctgatgggaactaatctcctttttcgtt

SEQ ID NO: 1991 - DNA, 1857 bp, Zea mays
  misc_feature (1)..(100): optimal_loci_120724_G1, chr3:178132085..178133941, Cluster 12
taacatcagtccggctaggctagacttttgtattgggctgtatctccataaacggcccaaactaataccatggcccataaaacttattgggtttgtcgcctattcaggttttcccccgaaccacactgatgttgatgtgggctattaagtttgttctctgaaaagtgttcgaacctaattgtgtgttttccctctgaatattacctcggtgtttgattgcagtgtttactattcattccagtttattcggcagtaagagcttttcctatctgagcgtgtatcttaattataatacgttcagttcgtcatcttcctaaaccctgcacccagtcttgcagacccagagtggcctcagccctcaactgaaggaaaagatcagatcctttgtggttggtggtggcaatggcagataccggacgccgacagcacacgcggacatgcctctatataatatatatcgacttcaataaaccgataagctttgattcatttggcaaggagccaaggaacaagaagacgccattcctcagtacatggtgctagctggtagtacctcacagggttcgttagacgtagacatggaagttgggactcttgggagaactgaagctagaatcaggcacatttcagtccttgcccatgtcagctaaaaccgccactatttcagcgcagcaaattgtcgttgctagtttcttaattaaaaaaaagataccgttcagattctaagatcagtcaccataaccacagttctgttcaaggacatgcaggcagtgcaagagatgattatgtctaaacagattatcgtcgatcaccatcagaaaaaggtatcagaacgcgaactgacagctgaccatagcttggttggtttgaaaaaaaatctacccattatggataacagctttagctagcatcaatatgaaagttgtgaaccaaacttcatcgtggatttttcctcttggaaacgaccgcaagctccggatcctagttaggtcaggggacacagcagaacaatccacagagacgggaccgcaccaccgcttgatctccacgcgatcaagaacagtcggctccgaataagttcaggcacaagcttacacaccacaggtggcgaagccagccgggcatgtggcacaatgcgggctcgatcatgccccgtagccttcaacacagtgcgcaacgacagaagactgagtgagtgactggccccgtaggccgcatccattcacagacacatcttgatcggagccgcatagattctcagcactgttcctgatgaggtgacatgagttcgaccccaaggacttgtagttctcgtccgcactgggcatggcccttccggctttggctgctcgtctttggcgagttcagtcggttggtatttggttcgtgtccagcgtggcgcttgacagcaagtgatgaagaccatcacgcatcagaaggacgatcgacgaatagtatgtgtccgtagaaaaggacgttaccactgaaaattctgttgtgtgctctggcctctaagagggagggacactggcagacgggatggcttaccggatcgccatgcagattgttagttcttactttattaaaactaaaagaagaagaagaaaaagaaaggaaaggaatccggctgtcctctttctttccctcttgtgcttacaaaaaggtttatatacacgaaatgatccatatggaaaaggtgtggttttttcctctctccttaatatatttatgcagacatattctctgcttttctttttttaaaacatttgaaacctgttattgggtacaggcgtacagcattactacgtagacttaggtgctaaggaacatgaatgtttccattaacgaccaaacgat

SEQ ID NO: 1992 - DNA, 1651 bp, Zea mays
  misc_feature (1)..(100): optimal_loci_120961_G1, chr3:179261756..179263406, Cluster 12
cataggatgtaactggtggtactgtgtgcggggccatgaggcacaagtggggacgaggagtcgcacgactcgcgaacgcaggagttgagaaggagtgtgacggcgggaggagcgggaaggagaaacgacttgggaatatgaaggaataccggagccacaaaactgacattgtgttacgtgtaaatatcgagtcggctcgggccatctaggcgtgcctgacttgcatcgcatatgcatagttctatgcatcaggctgaactagtctagatccatgatacactcgttccaataggttgcaagctccggatacatgtgaaattgagaaccgggaaacgctgaagaagaaaaatgtgctccgtcggggtttttttattacagacatactttgattaataatatctactctaacactgttctatttatgtggtaatacgtaagcatatttcaatgcgaatattaattataccaatttagtgcctcaaaaaacacacgaacagattaactgtggaccaaagacggactaattgaacgatgtaatttcaaagtagaagcaacagtattttggtgccagctgtgctggcggagcagctgatggcaattggcagcggttgaccttccgttagtttaggttgagtacacctggtcgtagaggaggaaataagtacactactccaattggcagtgacaaagtaggcgcgaaccgtccaatcgtctcgcctcaattcaaaattgcttaggtagttgtcggcgggcagggtagggttggtgctgggttgctctgctggtcgctggccacgtgaacatgacgtacttgtatagttgcagtagcaaatcaatgatagcgagaaattccgtatatgactttttttgtaaggatttaatcattgttatatactttaatatttagtagaaaacaggctagaattagacggctgtatttttaaagtgtacaaatacgtttaccagagacggagggaatagtaatcttagttggcttttgtcttggaagaccgacgactggctggggtgtatatatatgctttcgccaactgcaaacgatgagcgcgccgtggccatttcgaattccctgacaatcgcatcgcatgcttctctgctggtggctggtgggtgctgctcctctcggacaattttgaacttcgtagtagtaccatatactagcatccatccacccgctcagttcaaacaaacaaacaaaaaaaagaagcagcagcagcggaatccacctagtacccgccagatattttagaattgtgtgctgtacccttttggttttagtttatttattatgtataccgcagtactataccagtagggcgccacccacgtcctactccgtagattcagaggcattggattcaaatactcctatgctggtacatggtactacgtattgtggctagtagtggcctagtgcacgcaagcaggagtggaaggatttgtgaggcaacacgggcacggaagagcaagctactagcacagacagacagagtgcaaccggcgtgacagcgagccgagacgagacgactggtgtggcgtgccaccaccatccgtccgctggataggctcccggaacatgacggccacatgggcacaaaacaagaacctcgccacgccactgccagattcatca

SEQ ID NO: 1993 - DNA, 1976 bp, Zea mays
  misc_feature (1)..(100): optimal_loci_121967_G1, chr3:184367686..184369661, Cluster 12
atcccaaaaattagcattgccacaaaaaaacgcatttcagtagtttcgctctttgtccctcagaaaaggaaacggcttatctttattctgtagataaacaaaagtacaaagaaaaaacaggatggagctgtgcacgtccgggcaccgacgacgatgtgatggctgcacgagggagtgagaggggaagccatgtggggagcacgccggaaatagatcgcaaaatcgccccacgacagcgaccggagctccgaaactcgtcgggtcgaaaagaggtttctgtaaattcggggccgggagaaggctacgagctgccgactgtgtctgtactagagagaatcccatagcaggacactactactaccttaggatccccttgccattgccgaacccccgctctcgacatgccgtgaggcagtcccattcttagcggttggggggagggcgcatgccatgccatgccatgccatgcccggctgctcatgaaccatgattgcgcgggaggagggagaatcatggtcgcttcagcttggggcgttaggtttagagtacataccacaagtgcatgcaggcgtcctgccactcactcaaaagccatcaaggaaagagcgtaccaacggcgagccaggcaagaaaagcgcgatcaaaacgacagcgacggcgcgcgcactcccggcctggcctgtcatgccatgtcatgcatgtggcgcgcggcctgggctaacgaccgaaccgggccttccgttcgttaatggcgggagaggtcccggcccccaaccgaaccgacgtgcccgcgcgcatggccgcttcctgccgctcccgcgtcgctctccggcgcctgccgctcgccgaggcttgtggctctcgtcccgtcgcgcgccagttccccgtgccggtgggtagttgccgcctgcacgttacctatctatccatcacgcgggcggccgcgcgcgacaagtcccattcgttcgtcctctcccgagggcggggtcgccgttgcgcggctgttgctgccatgtgcccgcggcgcgtgccgaagcgacaccaccgtcgtcgtcgggtcaggcgtcgctgactgctgtggaggccgctgggaccctgggaggggagggaggcgtggccggtggcctgtccgtcttggtaccgtgccggttctgctacgcgcgatcgtgcgccgcgagcgcgcgcggggtttctgttacaaatacggagcacatataaaatgcactcatgtcacactctttatctaaattgaaatcggctgaatataatactatgttgtgtcttaaaacaaaaaaaacgagtactcaatcttagccaaccatctaaaactggatttacttaaattgggttccgacgtggtgtgttagtgtgtataacatctcgtgttgaattggatctacggtgtgcgctaaccgacgcgcaaagacttttccactgccagcttcacccttgttgtgttgcgcggaataacaaaaaacatttacacctggtccaagaaatcttcgaaaacggcccaactacgtatagactaggggcttttctgggctcgggcgtgtacgaatagaaatctggagagcagtgggccagctgggcagttggcaggccctagcgccataggctgcagcccaatgcgcactcgggcccagtcgttgtaataaaagggccatgtgtggctgcaaactcaatgcgtagctcaaaatcgaagccagcaaccaacatgttacatgtcgctactccagattccagaaaaaggattttggttgacaactgttaaacggaattgtttcttgtgagacattatccagcaccagcatgatctctgtcaatggtgtggtgttttggctctcagtcctcgacccggcctcaatttagacctcggtcaaaatccggcgactactgatgaaaattcgggtgatgtgggcatggcttcctcgcagaaaagcacacgtcctctgtttctggatcctgatacgcag

SEQ ID NO: 1994 - DNA, 1935 bp, Zea mays
  misc_feature (1)..(100): optimal_loci_124192_G1, chr3:195967943..195969877, Cluster 12
atacgtagaaaaaaacatgtttttttgaacggaatgaaaattgaaaagttaccaggtaaaccttgatggactggactttgttaatctccatggagtcaaaccgagttcatcacaagcctgcctggcggctgcttggttactactcatgctatgatttctcctgacgagcggatttttcggggttgaaaccagagatttgagcagcactaggccaccagccacctacgcgacactcactgatggcttgtgcattcgttttagaaagccagcattggcaagagtctaaagactcaacactcgtgcaaaggccgtcgggatggaccacctgaaggctgcaaaaacggccggctaaaaacgtgtggagttttcacaagcaaaggcatccaaaagcgcacccatttacacgcgtgtatgttttcactgtcacagcgcgatgctgcagaaacgcagaactgcagaagcaatggaagggctttttggttggtccacacgacactagatctgaaaaagactcgtgggtgggggcatgattcatgaatgatccagtaggttgctcgagaaaaagacgattagggactgtcgtcgactaacattagctaatcatggacaaaatccatgcaagatcgcgcgcagagctgctagcggtaggaggagggggtgccgtacaccgtgcagcagcatgtgtgcatgcactgcacgcgttgccttggctttttcccctgccacgcctgcgtcttttgttggcactgggtagcctcgtcgctcgtcggccaggcttctccctccttgtggaagcttgcagcatgcgtcctccgcgcactgtggcccctcctcctccctcacgctcatcgcgggaccgggggaaaaaaaggcgaaagcgaagcatgcagaggggtgcagatcgtgcagtgcgacgcaaagcgcgcgcagagcacagtcgggcggcccggcagccggcaccctacttttgcccgtcgcgacgcgtgcggtggcgcggggccacagcggcatgtcgcttgctgtttggcgccctgcaggctgcagcccaggggccccgcgaacgtactacgcgcgcccgccagcccgccatggtcctctcgtctatcttctcgtctgatgagctcgacgacgtgtctggactctggaccctgggggcctggacgcgacccgtccccgcgctgttgccattgatcattgatgaggacagcatgctccggctcagggctgtcgcgtcgcatgcattgcctcccgagctcagtccacagggtcaggctggccagccaagcctagccaggccatactgccgctgctgccgccatcttgacctgttcgagttcgagttcgactgctcgttcgtcacggtgccatggactccggtctctctctcattcgcggtgccatactgctatgatggcatctacgggcgcgccgcgacggcgatcaggatcgacgtggcgccgccaagacccgccggccggtgggcgcgaacgcgtcactgcgtcagatgagatgagtacggggcgggctggagcgaatcgtgttggcgctagcgttttaccctacttgcgctttattaccggcgtcgtggaggccggtaagcttgcctggtggttgcgcgctttattggcgccgcatgtgtctttgtcccttcatgcatgtggtgtgcccggcctgggatcgatgagctccgctcccggttccgctcttcatcgaagttccggcgatatccgtaggtaccacggtgagctagcaatctagtttgttgatgtcctcgtcgtcgtcccggccccgttcatgtctgtacgaacgccagattgtgatttcctagcacgacaggtccacgacagcgccacgttcatgcaatgtgtgtgttgttatcgcacagatcgaagatgtagtaaatcacgcacgcatcaccgggatctgaacattctg

SEQ ID NO: 1995 - DNA, 1524 bp, Zea mays
  misc_feature (1)..(100): optimal_loci_124792_G1, chr3:199610847..199612370, Cluster 12
tagaatcctaggcgcgaagaggggactccggaatccaatactacttctagtatagtctacagcagagcggtggatgtggatctgggagcagtgtacaccaaagtttgcagtcagatagattgcaagttgcaacggttttaacgggccgggggcacacgcagccggacgggccgaggggggatcgcggagcagggcaccgagatccgcagcgggatacgcctgtctcgtcagctcgccgctcatgccatgcgccccgtcctcgagggccccgcgcgtgggggtggccgactggcaagtgctgcccgagtaggacgggggtgggctcgctcgatcgcctcgatcggcatgtgcgggtgcgccgtgtgcgttctggttggcgcagcgcaggtacgcgcgcgctgggcatgcatgtgccccgcgccgcttctttgacccgcgatggatcgggcgggtgccgctgccggctgccggccggacggcatcttggaccggtggctgcggctcggcgtgcgtgcgtggcggttggggggctcaggcggatgggccggcgggtggtggtcgaggtgccctatttacaccggtggttcgcggtcgatccggtgcaggattccgggagccttgatgcaggatgtgtggacggcacgggcacacggctacgctctactatacgtatcctttgatcagctgggctaagcaaacgagaagcacaaaggaggaatatggcgagcgaattgttgctgccgggtttgcaattgatcgtgcctgcatgcatacatccacgtactactgtctggttaaacttttagctccctaaacctatctgctatatatttgatttgaacggcagacgaggatcggaacctggattcgtttttgcccttgcgttgcccttgctgtcaccctgctgcagcctgcagagcaaacacgtgcagcaagttctagaaacccggctgccatttgtacaaacagtcgtctgccatttgtgcccaacaaatcggcaataatgactgtaaaatgtgccatcctgcacaacttgcaggtcacgcgcaggataaacaaacaacaagttgggttgggccactggaataaaaaccatcgcatcgtgggccttctgtactggtgcatggtgcagtgcatcacgattttaggcatatatcatctgtcgcagaaaccaagatataccatataggttaatgtagtttttttcttttttttttgaaaaaaaataaaagatctgcacccgtgtgtctagtgtaaccgggtacgatgcacccaacaggccacccagaacgcaagaaaactattagtaccatctcagtgatctcactgctcattaagtttcatcccattcttttttaaaaaaaaaagagcagcagtaactattagtactgtctgtgcatcaatgtatagtttgagttagcagcgaataaataaagcacacatgctgctgttcatgttcgtttctactttcacataactagatggtttgaatgcttggaatattagattagaggtaatcggtaa

SEQ ID NO: 1996 - DNA, 1642 bp, Zea mays
  misc_feature (1)..(100): optimal_loci_125805_G1, chr3:204639594..204641235, Cluster 12
taacaaactgacaaaattggcaaggggctcagctcagagagagagagagaatgaatactgaacagtaggtgcaacctaacacatagaaactgcgctgccgtgggatggtgggtgggaccggtaacggatgcttcttaatcaacgaaaccaccgcacaaagtatcgtaacacgccgagccaatccgacgcgttacttttttttttctctctcccttcaatttctgcggcggcggttctgagaccccgtgactttgctcgatctgtccggctcctgtggcgccagcacagcacaggagacgaacccacccacttctgctgctgctgctgagcgctcaccggtgagaattctatccggacacttgtcgggtcgccggagaacagaggaagcgaagcctttcgattcgcgctacagtggttcgacacacccagcgtactgtacgacacgcacgcgaacgggagcggaccggacccccttgaaaggctgccggttcggtttgctggcacgtcgcatctgagggatccatcgtcccgagtcccgacgccgcctttgatgcatgatcggcagatcccaccctgacgccggcgccggcgccgccccggccccagtcctgcccggtcacgtcgtatcgcctctgcccatcagccgtccgtacgcgcctgtccgacgtctattcgcgcggcgtcgcttcgctcggaagctgccgcctgccgctgcgacacgtcctgccaaagcgtaggaagggccgtcacgcaaaatatacacgcctgtgcaatacacccttaattaaactggagtaccgattttctctctctcgaaagaatagttttcagagatagtaatagactaatagtgatttctacagtcataacggctccggattacacattcaataaattctagtacctccaatgctcaataaacaactactacatgatctaaaaaaacatagctttgaccttctttttatcataatatatatgaccatctgaacaaaaatatatttttgaacaaagttcttcttgtcaatcgataagtataaaggattgatttttttctctaattaaacgctttcgtggttggaagtaaacgaggctttacaagtttgcgctcaatcttattcatggtgttgtcaactatttacatatgagagggagtatctctatgcatattcatattctatttctactctttgagcccctttaaatgatggtcgacattaaggatactctcaatctaaaaccatatatgcctttatagcattaaaattcatgttatgtcaccgtctttataatgtggaagccgggtcaagagaaaaagagacgaaagtgagtgaaaaccgtttctcatctgagaagcctgaacatctcgtgcaaagaaacgagtcatttggcgttgaggaattagcggattgggatcatcgctagtcgactgctcttacacgtcgacgccgagagaccccacatgtctgcctcccggcagtcgactgcgcgaacgcgaggatccgggtccggaatttgcatcgtttctatccccaaatgagcatatagtttctctatcataaaatagttatcgttcatgctttttgaagagtcaatcatctttttactttgatcaaatatgtaaaaaatattaataattttg

SEQ ID NO: 1997 - DNA, 4830 bp, Zea mays
  misc_feature (1)..(100): optimal_loci_126218_G1, chr3:206603297..206608126, Cluster 12
caccttgtcctgttgtgttttgtttatgtgtgtatttattttaatcaccgtctgctggtcgcggttttgcagcacgcacaagggcgcgtcaagatgttcgggcatgtgcaacacattggcttcgaaaccaaacaaaatcacattgcttggcgagccgacgatgcgagtcccatgctgctcagcgagcgagggagggtgggcatcatcggaatctatctggtcggcgcccgcctcgatccgaaacatacagcagtacaaccttgcgttggaggctcaagctcgccggttcgaccatcagcaggagagattgtcggcaactgatagagatcgatcaatggtgtagatagtgcagtcctgtcgtcctaggctagccaacggatttgtggaacaattaaagccgccacgtacgccacgaggcggtttgccactcttttagaagtatatcccatcattgcatgctggttagctatgatgccagctgccagctagtacttatactacgtccaaaattgatgagcacaggcaggacaggttcgtactacaactacactcatacatccagtatatatgcgctgcgcccatatccgacgagcgattattgggcacgcgcatgagaacaagcagagatcacacgcacaccgtctcccgggtctgtccgcgcctcgtcaccaacagatggggtagagacgcggcggggcacggctcttgagagagaccagggggggcctcgctctcggcgatcggagtactatagtacagcaataatctgcacgcagcaaccgtggggacaagttgcacaggtgaagcgggtgccgtacccctatctcctgcgtggcctcgcctaatcgccttggcttggcttggcttgccatgccggcctaaaatattgttgctgcagactgtatgtaggctgtagagcacacaacacaaacagagccaccggtggaccgccggctgcatgcacagcagggcgagagcgaggaagcttgctaccgacgcccacttcccacttgcattgcaagttttggctggagcgtgtgacccagaggggtccaaggactaggactagcattagctaatgtagctgctactagccagcctgcgaccacgacgacggcgtggagagttacccttgggtgaaagcttaacgagacggaagagtaggtccagaatgtgtgtgtggtgcagtgcagtgcagtgcagtgcactgtatgcagtcgacgtgattggctggctgctgcgtggtttcttccgctcgtcgtcctccctctgctcctcgcaacaagcaaccacgtggcacagcgcacaggacacgtcctgcgcatgcgctgcagtttttccgatggggggaaacgaccagcgtgtctgcactgcgcatgcgcccgccatgtggtttttcacattcccttaacagcaatgcagcaatgcaagtacggcagctgcacagcaccagtatcgtcacgctcttgctcatctacaggtacagcactggtcatcagccgtcagcacccacagtggttgtttggaagcaaggatacggggagagattagaagggctaaaatcgattttgctatttaaatttgaatagaataagtccagtattcttacttctaaacaagaccaccgtactaagtactattgtaaaagtccgtaaatctgtaatgatgttggttctacatacgaacgatctttttaggatggagtgagtgtataacagcctaacaggcaagtacgtaccagtagtctagtagtatgtgtgcgtgagtgagagagtcagccagtcaggatgggtggcggagggcccaagaacgacaatgacgcaagtctagcctagccaaaacttgggcagcttttgttgcatgccacgccatggaaaacctgaattgatgctgcctttcgacaagaagctagctttaccgcctgccgtcgaaacagcccaggcccaggaccaggaccccacgctttaattcgtgtctctctcgtcacaaagtcaagcaccccaggcagcgccgctcagttcccggaagtttctcaccgcgtcgaagcatgcacgcatgcatcgggccggactgaaaccctcgtgtcgtcgtgatgattcctgaagtcgtcgcgaggtccggcggtccgttgccgtggcccgtggcagtgctgccgctactgttacagactttttacggtgtgtgggtgtgtggcggtggcgcgcgcacacagctgcactgcacagcgaaaggatcggaggcagcaccgcaggccagcagccgcccggccggtctactgcatggctggggccaggttggttaaggatagagatagacaccaccacgccaggaacaggacgcgacacccgggcagtacaaaacagccagccaagggccaggggggcagcgcgactttggagacccatcggttcctcggccgcagagccagccagagccgccgacgtggacgcagacggagcgtgtggaccgcttctggcaagtggcgactggcgacggtaggctgcgcagagtgcagcagccgtgttttttctttgctccggcagcggtgtggctgccgggtggccacatgcagcggagcgtgtcgcccgctgcgtgccaccctcctctgtgtctgtgttagggcatgtggaggaggaggaccaaatcggtgtgtggagtaggcggtcttgtatggcagtgcttctatagcgagtcaacgctgcgctttgttatgcatatatatatgaggaggagcagtaggtcgttttctcccggcaggttgcatgcgatcgagaggtccgtctagctgcacgttacgccttttctccctcccgcactcgtcgcattcttctattctatctgtacctctgtgcgtggcgtggcgtaatatggccagctggtgtataagacagaaacaaggactctggaatatactgtacgtttcgtaacagctagctagctggtcttccttcctcgattagctgtgtatctgcaagtgggtgtgtatactcgcactctcgcggtattcgtagtcagcagactggattcatcgttaaggaaggtacagctcatgcatacatatagatccaattttcgcgcccttgacggagtcgacggcgagccacagctggacgagcgaggcagtgaagatgaacgagtctgggaccaggcatcgaggtcacgcttttctacggactgcggaaatctaacgtactaattagtactgcagatttgtcatctcgtttgcctggtctggtcgttctcttcttccctgggcaggctaggctggccacagatggccaaatttcaaacgattgacaaaacgcgaaacgagggggggatgaagcaccggcaccgctactgttgtgaatccgacaacgcaagttgggcggacctgttgttatttactagtcctactagtctgttacggagtacagctttccggatcaagaagcaaccgaacccaacgcggagaagatattcattcattcgcctgcccaaatggatcgatccatccgcgcgcgcgcgcctgcttgtgtggcctgtgggctgtggctctcctcggggagcacacccgcgacgccattggcgggctggacaccggtcaaaccacccacatgtgccccgcgtagctagctagcgtgcctaatcgcggattaagtaatcggctaataatagccggcaagttgtgctcaggagggtcgcgctcgcgcgagcgcatcggaagcaagctgctaagctttgccttgctggtcaagtccatcacgcgcgaatgtacttgcttgcacacatatataattataaaagggttagtatatggattcgagtggtagtgatgctagtttatttagtgtacgtggatggatggcttgcactcccacttgtgacaagcaccgtttcaaaagatacggctctgccgctgcccatctctctccactcaactcaactcaacaccggtctgtctgtccgcgagcgagccgttttccttgaccagctctagctcctgtaggtaactcaacccaaaagcaccgagcccatgcaaatttaatcacgtcgccgcgatcgagtcgtgctcgtacgtacgtaacccactactctctcttctctccgcccgtcgtcgccgagacgcgacgatctgccatatatgcgcacgttgccgatcggattattatatacgtaattcgggggctccccgcgcgcttctgcagacacgcatctcgacacaggcccgggccctagcactcctgattaattagccacataatacattatgaccaactcgtactagtgttagctgtaggagtaggacggtaggagtaggagattccttccctcctgcatctttctttcgttgaacttggctcatcgatcgtctccgattcatctgcccattgatcctgctgccgcctgccgcctgccgccggtcctcgtgttccttgcaagttgcgagcgctagcactctgtacagacattgtgcacaattaagcccaggaatccaatgcgaccgacgcatatgaatcttgctgccccaaaagattaagcacatgttcatacacctgtcctctagaaaagaggtgcgggggaaggacagacgtgtgtgtccttgtgaggtgaaggtctggcccggtaagactgacaccacaagaagccgataaggtcctgtcctcctgctagtaatctgaaaaaactggaatggaggaggacagatatgtttgtggttagctggtgcaggtgcaggtacaccacaccactacaacttctgctgccgtttgtgccagcagctaataagattcatgttttgaggcagccgcccgtgggcccgggacgtgtccacatactactactatcgtt

SEQ ID NO: 1998 - DNA, 1991 bp, Zea mays
  misc_feature (1)..(100): optimal_loci_127644_G1, chr3:213793954..213795944, Cluster 12
ctgcccgcggccgtcctcgcttggaagtgtgacgtgcatgccgccgtgaatgcgtcgcatatgcagcctggaggaacgtaacaatacattggtctcgtcctgtttccgccaactgggccgtggatggtatggtacgcgaggaacagagaagggtgctgtgtagccttgagccaccacagacctgagggtacaacgtacacaagaggaggacacggcgtggatgagtggaattcattgcgcagatggtatcgacggtggtagcggtggatcagggggagacgacgaccgcggcagctctccccatcaatgcggatgctgcatctcagatccgtcaacgtggtggcgcccccatgcatctcgatcggtagacgcattgctcgcgtgcgtgccagccccacgcaaccgtaatcctgacctacctgaaatccgttctggcgaggctgacacgtcgggctcctcttccacgcgtcccggagtgaagccctcgtccgtccgtagcagggttcgatgagcgtggctctgacgagtcagcaggagacgagagaagcgccaaggacgacggatcgatgctcgtttcttatgcaactgtaaggacaagttcatcgctggtaaaagccgtagtatgcggaagcggacatgccgcgcggctagctctggcttaagaagttaagagcccttgtattgtacacacactactactcccagcagcaggctgcaggccagccagccgcccgggccggggtccgcctcagcctcatcaccattcaccatcatcaatgaatgcatcgccgagcaacgcgcgcaatcgccgggctgtccgcttgccacgaccaacgagctccaccggacgaaaccgcgcttgctgctggcagtggacggtcggcttcacacctatgcgtctgtagatagatgaccttggttgggtgctctgtagaccgtagtccgtatgccatgccatgagagagggtcagagggagcccccaagataataaaagccgtgtgctgctcgtgtcgtgccatgcatggccacagcccccaagatggcgcagcatcgtacgctgtccagcccagtgggcgcggccgccgtccttgggctgggcccccggcaaagatgctctcagcgcgctgccaacggacccagaaaggcggaagcagacaccaggggcaatccgacaccaccacaccaggcgcagccgggcaccggcacgacacgaacaatccatccccaaatggctgcatataaccgagaccgagacgccgtttgtttgtttgtttgtttgttagaggaggttctacagccctgaacgcgcgcctgatgccgagatcgatggcataaataaaggagagcggagagtttgagtttgggggcgcttggccaggttcaatccgatacgatttggtgcaactgattctgaatctctgacgtgtccatccaccggtttttagggtttagggttcattgcttgcaaactgtgcgtctgaacatgtgcatgcattgccttcttggattgaggtccgagagtcataagactgtcaggtaggcgtccaaaatcggacgaggctgtccggcccacgaatccttatcaggatgcgaaaggagctgcaatgctgcatcatatgttggtgacgttgagataatactacgactagccagaaaataaaaatcaaaacattccaagttgttattggtccagctcgcttcagcccaatattgttgatcaaagggtatgctgtgggctcgagagcccaatatattggtgggcctttattatcgtctagtatttcagccaaaaaatagagcaataatgtggggccatgtttcaatgatgagatgattttgatggaaacttttcgaatttgaaacaatctgagtcaaattgattccggactctgctccaaatattcaaaatattgtcattgacccttcggcgtaaaccacctaagggcctaatcggggttttttcccatgtggattggattagattgaggcc

SEQ ID NO: 1999 - DNA, 1517 bp, Zea mays
  misc_feature (1)..(100): optimal_loci_129270_G1, chr3:221693806..221695322, Cluster 12
gtacaatgatagttcaagttgactgccagctgataatggataggtaatggagatctctctctttttttcagaggcctggtgtaaaatgcagaaatgctgccgccaatttgcagccactgtggtgaagtgattcgcgacttaattttgtgagggaaccaagaagaaatggttcgttgcatcttatagttgtacaagaggaagtgtttcattgtatcttacaattgtactgtgaacttatgaactttgggccggtttttgttggttcagtatattgtataacctaatgtataggttgtctctaaacatgctatgactcaatttgaagaaggccaactttaattctagccagttcaccgactcgagtacatgtgtgtttcgaaaccaatcctaccctatctagtttatgctccacacctagttagcttcccaatcacaatgctctacagatatggattgaaattcctgctacagctgaatgcattcatcatatattggttactggttagtgtctcgaaccgatattaattagttcatcatatgttgatgacacggcaattaaaactgttattcgatatcggttgtaaatgaatcggtattaaagtcccagaacgggagccccgtcgttcatcatatgttgtggttgtagcgcgcgtgatacttgtggaggttgtggaggcgtgaggtgcagccacccccagcctggatctctgctgtgcaaatgaaccaacagaaactcacgagcgggtgcttaattttcaacgggggtacggggtaacatttcggttcgagaacactttttatcgtttcgtgttcgtcctactgctactctctcttgacctgaaaactgcattgcaggatgtgttttgggttgaacccgatcaagagagagagtaccttgtttgtttggttgcagctgaatgcacaagagctgtgctgatcgatcttgtgcccgcccgaggcatggaaacggtcgcctggctcttcattgttagcgtgacatgtatgttcagggcctgtctagaagaacggtgctatgcgctgcgtgtttccggcgtcacataacaacggaaacagattcagaggaatacaatactcatgaatgaatcagctaggccggccggcggcagcagcagcaatagaggaacatgagaacgtggccgccctgcaaagccgccgcgccgcgtgtaaaaaaagcttggaagcgcggatgaaatgtcctggacacgcagcacgcgtgtgcgcatgtatgctgagctgagctgagctgagcagatacagagttgacctccgcctatatattcattcattatttatatatgtacacatgcatgcaccacgtcggcataaccaaccgcaagacggcaagaggttgaaatccccgtggcggtgatgcatcggatatctcacttttaattttctcttgccgcctctcgcccccacactttttatcatgagtttaaacctaagttttgctacgtcgtagcgccactcctccgatcctctaaaactaaaaataa

SEQ ID NO: 2000 - DNA, 2115 bp, Zea mays
  misc_feature (1)..(100): optimal_loci_130317_G1, chr3:226961658..226963772, Cluster 12
tgatgtgaccaggtttttttttttgtcagactagacagttacccgttgttaattagcgcgcagttacatgtgcagcgtcaaattaaatctctacatgtatgtactaagataatatatatagacataattctctctctctcggcaatgcgtgtaaagctacgaaatactatacacatcatatatatataccataccatacgtagtcattctcctcatgatctatctgactatctcgtgtgggaactgaatcgttcttctccaatgcgattcaattcattcccagatgttccgagcagcatgcaagctcttgcaaatcactctcaccagacatctccatcgatctacccatcagctagggatcaaggaacaatataatgttgcagcaataatggaggtcgggagggaccaaggcgggaggaggaggacccgacccggccaagagataaggagaggtcaacaaggacccaccggccggcccacctcgatcgaaattccatgcccacgcacgcacgcacattgcaagctcagctacatacacaagatgcgaagccaaattaagtgagcgccattgttcatggcctgcaggtggagcgcccctgatcgatcgagagtgtgcagtacgcagttgcagctgcagctgcagtgtgtggatttgatcggttgattactactatgatcttgcttgcaatgcaagtgggcatcccattccagtccaaaaagccggcgggaggagcgctcagctccgtcgggccggccggggcatctcgctttagtttccacgttatattatgccattaataattacgtactacttacagtactaacaactcctgttcaccgtcaaactaaccaattgcattgtacggtcgtcactgttcgaatatgttcacgcagtctaaaatatttactgtatttcgtctatatttgtcgaacggctctgaggttcttcacattttccacctcgctctagctcagccgtcactgttcgaatatgtttaactttttctatatattatgaattggggataaacatgccaaatatatagtatgctagtctttttaagatatataggagtatcatttatgaaacagtagtgtttcttttcatcttttgtgctctccaagcatgcatctccgatcagccgcatcacatgctctcgaaagccacacacacacctttgaaccttaatgaataaatcaaatcggagaacaatctgtctttcatgcacccatgtatagcccgacaggcgcgcgcgcgggaatctgcatgagtgctaatgagaatttgacaggtggtgcgcctcatcggctgtgtgcttgtgccatctgctactccctaagatcttcaaatctctcacctgtccttcatgtcatgtgtcgttcacccaaccagaactaaaggcacatggctaaatcgggattgatccaatgctaagcagcaacgctaacccttagctaacattactattgtaacagttagatgcgatcagcgtccacctgcctctgaatcaatgcctttgttaataatctagtttttagatgtggtgttaattcggaaaatcacataaaagacagtcctaggtgtctaaacaaaacagggcgctcagacctcaaccagatcgttagggtgtcaccatgacatcaatcagatggctaacatcgctcttatgtccctactgtcacgccaactacgtccatgacacaacgtctatgaaagagaggagtgagagcgaggttgagaggagagaaatataagagaaatggcaatgccaaactgtcggctcacctcaagaagcatccccagatccatcttactctagatctaggatctggctaggcgcggtgaagaaatggctccttacctcaccagatccaactttccacaatgaagatctacaagaggtagagtgtgagggagttttggagaggatagagagatagaaagaggagctcacctcattggtcctacccatgcccaagatgtaatgtttggtacaacctactcgtcgtggactgcaacgtcctcacacactgagaccttttagtgtgcctccctccttatcccggttgcaccaccaccgaatcatcccactcgcgtcgtcactgcatcgcatt

SEQ ID NO: 2001 - DNA, 1662 bp, Zea mays
  misc_feature (1)..(100): optimal_loci_134861_G1, chr4:16166194..16167855, Cluster 12
tctcggaagtctgtttctgagtcacgccatgagtctgtgtgccatacttaacggaaacaattgtcgctctgtcttgatctccaagtcttcccgccgtccttgggcctgagatgatcaatcgacccacaaaatcagtcgcctgacccacttaggccctccaactggccttgtatagtatccgtgccatgaggacccaagagatatttatcccccataggttggtcccctcattgtatttgccaatgtgggtcgacggtcaaaaccacttagtcacatgtattgtggtctagaatgccatggatcaaagtggttatagctcggaatcccctcccattagtcatgatgtgggaaacgatcaccttactcatgcgtgttgctttgccttgatggtgccccacatgtcctggtcttctctaatctagtaacacagaagtggtcggtctgagttgggcttgcctcactactcccattagggatttcctccacttgtccttggtgatctcaactacttgtagaatttttgccaccattgctaccacatgggcatgcatatcgaagcagtccccttttggttatattgtcatcaaggatagccttgaagtgtcattgtagcaatgatacaccaggctttctacctgctacttgagggcagtgttgagaacacactgagcatctcattatttcttatttaccttcaggattagcacatgtcagagatgtcgcctaggtggcacacaacaaccaccatgttgtatgtcgctcaaggaaggcacaacaggttgacacccctagtgtggttgttaaattcatgttgaatggtgttctttggagagcaccgattattcaagtgctttgctagaactcctctatccttctggagcttagagcacttgacctcgaggtaggcctaccaagcattgatgttcttagccttctcctagaggtaggtagaatgactgattagacttaggtctaggtatgtgttgtcaaggttgtcaatggctaattgtcccgcatggaggtaaaagcactctcattccctaggataatgattagcctcgttggagtcacactttgggccaaccctagagagtatcccaaggaaggtgcacaactaatggatgttggtcccatggtgcctacaagggcaacattatgtggtgcctttcatctcgtgatgtgctctagtttgagccaaaaataaagcaacattccatatctcatatgggagatcttagcgaatgttctagaaatggtagtctaatggtagctcgcctctagtaatgatctagtggcaaacattcaccaatgggtagaacatctagtgacacttcaacatggtgggtttgtggaccaaaccaaggaggctttgtcatgacaacaactctagggccgcgagaggaggcatatctaaggacattgttggggtttcactatcctctaatgaagtttcctcaaagagattgagttcactgttatggtcaacaatgttgtccagactcccaaagttgagagcctagccaggggagaagggatatcagtggatgtcatctcgctggagaagcacatgttgcctttgtgggtcatgactctagcaataacaaggttggtggatcaatacaccaagaggtggtgaccacataggacatgcccctgactaga

SEQ ID NO: 2002 - DNA, 1973 bp, Zea mays
  misc_feature (1)..(100): optimal_loci_14034_G1, chr1:77140951..77142923, Cluster 12
ttccaccctggccgcagacgaggatggaaagttgcaggtgcggtgggggggagagggaggtaggtgccagggctgcggcatgtggacacggcctggacatggccggaggtgcgcgtaggcacggcgagatgtgcgcgggggacggcaggagttgtcggtgctgcggccgtggggggcatggtgaggctaatgtggacgttaatgtagagtagtagggatttacttgtctactccaatgcttcgtggtaaagcaaacccgtagctgcagcgtgcggcggctgcgtgaccagacgaaaatgacatgccagcaacgacgctgaccttgatgcacgttgtcttcggtggacagcaacgtccccggaaggcgaagcagaaacggaaacaggtacaggaaggcggaagccgacccacgctgcgtgggcaccctcgtcacgtgccggcggcacatggcccgagatgccgacgcgtgcacgctccccaggggcgctggggactggccgcagcggcgaggcgattcccgcccacgtgaacgaaaacgtgacgggctgacagggagagagagagagtgtgtgtgcctcggtctcgctgtcgcaggtgcaggtgcatgcaccgagcgcgggaggggcctccagcatccaggggccgaatcggacgagaccacgtcgcttcccagccgcacgctgacagcggccgccgtccccacctcggggcgcggaccggtcgaggtcgaggtcgaggtcgaaccatctcgcgacgcggtcagcaaattcggcgccgaaacgcgccggccgccgtggcctcggcacggcacggcacggcaggcacacgtgaatggccacgccagcaggtcaggtcgctaggctcgggcacagcatccgcgcgcatggtgcggtgtttcccgccccagaccggtccaccggacctgatgatgacgtgacgagacgagaggaggcttaggagacaatcgcatgctcgatctgctagatcgttgccactggcaagtggcaacacacgccagcacggcctccgttatggaaaaaacgagggcttaacagaatacttttgctgggatggaaacctgcctccgtgtgctgcttggacaagggctctcgagtaggtgtggtccgtgtggacgtagaacgggcgtcagtcgtatcgtatcagggaacagagcaccggggggcagcaggagcggagtcgaatgcacgtccacttgttgttccgtgtgatgtaagtagcaagcacactgggagtgggagctgccggccggccgagaggagcgggcgacaaaagccaagaccggatggcgtcccatcgcaccccaccccttggctgcggcggagggccgcgccgcgcggcgggccccgcatctcctggaccacgggggtgaggggggacgcgacgcgacgaaacttcctcccgccgccccctccacaccacatccacatccgatctcgttcgttcctcggcgaaacgctttcaccggcacgcacgtggcggagcgtacgacggccgaccccacccctcaggttcgcactcccacaccgcagctgcggagggcggcgccccgcgcgtgcgtccttctcgtcgagccaacttgcgcccgtgtgcgacaggaaactctctctaggcgcccttttctcgccccggggccgcccggccggccgattcgtggtggatggaagcgacagatgcggccgcaccaggcggtggcggtgcagctggtgatcgccgcgccggttcgtggtgggtcccggcgccaggacgcaagttgcggtgcgcgcgtctgacgacgggacagccggccctctcatctccgcgcgtgtactttttgtccggccgtgcgcctcgccgcgcacccgagagcctttcgctgttccgcgcccaggcggaccccgccgcggcgtcgtctcgcaacaacttgcggatggatcatggatggatggggctctcacacagtgcgcggaatatcg

SEQ ID NO: 2003 - DNA, 2390 bp, Zea mays
  misc_feature (1)..(100): optimal_loci_152337_G1, chr4:130033092..130035481, Cluster 12
ttaacacaccccttcactttattagtgtcggtcctcggatcaatgcgtgcgcacgagaacgacaagtgaacgcacatgttgacatgtaggagtactactagaagctagcagcaggaggtgcagcaagcaaaggacgtaggaggagtataggacagcaagatacgtccaaaagctcgtctccacgaacgaggagaggcatgcatgtggtactagtagtacgcatgcagattgaggttgacgaacaccatatgattgatttgcgcgctcatcaacgaacacacagttcattgcaaacagctcgtctactctagatgctctccatctcagggtcaaccctagctagctactaagtagcaacaatgcaaagcaacaagcatgcatgcatggctgcatgcgcgcgctagctagcacaggagcgcgcacaggccggccgggagcgaagaagatgatcgagcagcctccggctagagctaggcatgccgcagctcgctctgctctcatcctcgacgagacgacgagagagagagagctttgtctctcgactctctcctcataaattgaggctagctgctgtgctttggcgccttccccttgttgttttttacatgcgtgctgcagccgtgtactcatatatgctgtagcactgcaccgttcatgcatggcgctcactggagaacgagagaccctctcggcgcgcggcaccctcggtttcctctcctgctctatctctctctctgcagcgccgccgccgtgcaccgggaagcgagacgaggggacaaggagatgaaggctttgtccccatgcacgtcccaaaggccggggacggaagccgaagccctctgccctcatgcatcatggtcggctctgcctgcctcagcctctctgccaagcaaaaggccagctttctctagctatctcgcctactccagctccagtacagtacagtaccatcccggaagcttttccatatctgtgaacccgatcggtccgctatccgatgatcccggccggtcgattcgcacactcctccgtcctctccttgttttgtatacactcggtttgagtgtttgacctggtggtggcgcgccacgccacgccatgcatggttggtttggttgtgagtagctagtagtacaacatgtcagcaaatgtcgaaaaagcctaggactagggactactacgcgcgcggcctgcttggcgcaaagcgtcggcgtgcgattcgtacgtgcggcggccggctctcgtttggaaggtggtggctggtgggatgggaggggagtgtaataaatggcgtggtgggatcgcgagctgctaatgatgaggcgattaatggccagaaacagctactacgaagcatcgcgctgcattggccgcccggcagcggcttggccggctacgactgcagctcagctctcgtctcgtctcgtctccatcgaccgtcgcgctgcatgcatgcggcgcggtattcattcccacccatgcataaattacactccatagtagacgtaccgcgcgcgagcgtgtaattacagtcacagaagacgcttccttccactaataactacccgcgcttgtattgtggtgtggggttcaggccggatcgtccggatggcagggggtctctgtatgccttgtttctggaaaggagcatgtatgcatgcatcaaccatgcaggtttgcatgatcgtacaatgtcccattgctcttcaataattcccctgtgtgctagcttagagttgtgtcactactgtattgctccgtccgtaccgtcgagggaaggagagtgcatatggttgccggccggggaagaggcacgtcgtcggcctccgaaggagaaggccaggagcgcagccgtctagctagcatgcagagctataggcatgccggccgcgtggcgcgtgcaacacttgagaagaggaaagcggaaactggaaacagtggtcgtggcaaatgaaagggggcgcgtagtgagtgcaatcggcagcgacattagcggtagggttttggtttagattcatagagttgtttccagttttttttcttatcaaagggatccaaattaaataaagagttgctaaattatagacgtctggttttttttttctctttacttttaggcgataaataacagccatctaatctaaatccaacgattacaacttattctcaaacttaggacggaatcacggaacacctttacttccaggcacctgctgtagggtagaaaatatgaaatttgtttttttttcagcctctctcacagccacagttttcaggcaaaactggaaatatagtttctctcaattctctcttatcttgtctctacaaagttattttacaaattgttttataaaacaactttatcttattggtgtgtatatatatatata

SEQ ID NO: 2004 - DNA, 1594 bp, Zea mays
  misc_feature (1)..(100): optimal_loci_158063_G1, chr4:163399238..163400831, Cluster 12
cccgccttgactaatcatgcctgtccatcgaaccatgcgacagttgcaccggccacgttgagcaggtacaacgtcctccccaaggggggcggcgtgtcattccgatcgccgtcgtggcatttgcgatcgaggaggccgacggccggagctagcagggaggcagcagccacacacggtgagggcgtgggaccgcccggtgtagctagcaaccagctgtccaactcccagagctcccctccacatgctcgctcggcgtcggcagcatctcgccgcgtccgctcgctcgctcgcggtcgcggtcgcggctgcccgtgtcgacctgccgaggcatgcaggagcagaacgcacggtgttggccggccttggggggtctcgtagtcgtcttcgtctacctcggtgagcgtttagtttcgcgcgcggctagctacactacactgcagcaggttcacgtgtctcgtcgaccgtcttttttacaatttagtccttttctacactacacgcgcgaaatcattccttagaattctctgttattgcgttgggaacgcgtctcgtgcggtctgctgttctgaaaaacgtacacgtacgtactagaccgagtgcttaattattaccagctactatcaggccgcagcagctagcggccggcaaggcacgactgtgaaccaacagctggtctgagctcgccgcaggtatcgtcgtcgtcgtcgtcccaggaacgtgaagagcatggcaaccgttgttttcgcgttcataattaaccaaaaaagatatttgcgcacaaggagtcaaggagatgacctccaactgcgctcagaaatcacggtcaagcactcaagctaccaggctaagttacattacatggcagtggcaggacagctggatagtttcaaacaaacagacctttatattagttacttacacgacacgaccgttctttttgtgttcttatgtagtacgtataaacccctgctaatatatatatgtcaagctttcgtacagactagagaacacacacttgtgccccgtgatttcgttcgtctcacgatcgagccacgaactcgaggatccggacacattccgggcccgtttcgtgtggctgataacaggggctagctgactgatgaacacgtacgacgacgattctgcgtgctcattgattttttttattttattttcgggtgaaaacggttcgctctacttccttttcagcaatgatacagttgttacccgtttcatcttctcttgtgtggagaacggtagctagctgggagagggagcccacacgatgtgacacgtcattactcaccttgaatgcgcgagagatgattaaacgaggagaaatcatttggtggggcctctcgtgtgcgtgatagatggatgactctggccatgttgatatcatcagtagaagacattattgggtaaaccatctggattgttcggacatacgccctcgggcctcgggtttgaattacatgttgttgtttttatttgtcctaaatcaaatttctctagtttttgctaatttttttaagtgaaggtactgtagagagaacctacggtaattttattgactcaaaaaagaaatagtgca

SEQ ID NO: 2005 - DNA, 1945 bp, Zea mays
  misc_feature (1)..(100): optimal_loci_158723_G1, chr4:166905856..166907800, Cluster 12
tgaggtacttaataatcaggagaaagctacggagacgatggattggccgccgagcataaaaatggagtgctgggaattgggatgggcagggaggatgaggtacttaataatcaggagaaatggagcacggggccgacccccccggcagatggatctcatcgcacctaaacccactaccgctatgtgtacgaatggcgccgtgacccatgacatgatgatgctgcctgccgcttggctgcacatgatagggcgcgcacgctttggggtctcagtctcagctgatcggctcagccacatcgtcgcgcgagcgcgggcggggccagtgccgatggcacggtctcgcgttgcgtacgatggcgtttgcatatcggctggggccattgcgtggtgcggatcgatcggcagggttctgctgtcacatctcgcgggccggggcggcgggcgcgcgctccgctccgagactccacgcgtcggctccggtctttttttttacgtactttccgcctgcggccaaaaaaactccttgccgaccgtcacatccgtcgaccacagtgccggtggttcgctcggaaatgctgcgcgaaaaaaccgcacctgcggctgcggtcgacccagcacccgcgctgccgtggacagctcgggttgaaagcagattccatccccgggcccgcgctggccttggctacgccccgcctacgcgttcttcatcccggtctgtgggggcaaaaatgcatatatctacctcaaaaaggtcgaatgcacgctcgcgctagggtctttgtcctcttttcgtagtagtagtagtgatcttcgcttggtttcatttagctggcactacggccacgcgccaggagtagaatgatagtagtacttagtgcattggatcgtataaaataggaatacgatactgtagacaacaatatttaacattatttatatctggagattatcttttatatttagcgatggatgatgagcgtgggggcgcgccgcggggccgggccaccactgcgtaacaaagaataataagatggcggtggcggcgccggcacctttctctgtgggcgtcgggatggccgcggtgcatgcaacagcgcacgcttccactcaatgcaaggcaactaaaaccctgtggcagcagagcaccaggcgcgagaccgagagcgcgcgcgaggccgcctcctcgtcgccgtcgtgtgcgtggaccgtgggtccatgcgtccgggcacggcgagatccgagttcgttgtcccatcattgcaatccgcagcgcctgactgacacatgccccccgcctcgctttggcttgcgcttgcccccggaaaaacaaaaacaaaaggcaccgtcatttcgggccatcgcggcacgatcggcccgaaagcctttttcgtcgtcccgtcgaccccccgcgcgcgcgcgtccccgtccccgtcccagggcgggaaaaaaaaggggagaaagcgcgacgaggtccacgcgtgcgtacgtacgtacgttcgctcgcggccagacacttggggctccgccggcctcgccacgtctcgccagcgccagcgccaccgccaccaccaccaccggctccgaccgatccgtcgctagctgcatgctgcgctgcacaacctgcaccgcacatcatgtgtcgtggccgtggttgatgagcgacattcgtagctagcttttcccttggccgccatcatgggtaggggtgtggccgccctgcactttacaggtagtacgagatttgcatgcacgctattactcgctaggcgtgtcactataatgcaccgtatttatacatatatacgtacgtacctacgtacgtgtcatcggagccagttcgcaaaacaagtagtagtgacgtgtcgagctctggtacgtgcacctgcaccccaggtatttgttggcggccggtgaatgttctgttgaacagagaaggggataatcg

SEQ ID NO: 2006 - DNA, 1900 bp, Zea mays
  misc_feature (1)..(100): optimal_loci_159965_G1, chr4:174958065..174959964, Cluster 12
gaaaggagccgctgctctgcacctgcacgcatggagaaaaggaggtttggttgcatccgcgcatcggatcgtcggttggctggttggttcgctggctcgcggtgacggcgacgggcatgtgatgtgagcgttgcatgccgcgcgcaccagcatcagtgcaccatgggcgtgctccctcctgcttgtgtgtggaattctggcaggatggctttctcctcttcagaagcggcaacgcaagcgtaggaagcttcgcttataatttattgctgattgaattggtaagatagagtgacaataaaaagtaaaattatgcttaaataacgaaccatctggctctccaaaatcttccaaactgagctgcttttagttgctccatctcaactcgctccgggaccaaacaaatacactcgctcagctctcaacagagattctctcctctgctattctgagtgccagtatatacattttaacaggcaaaatcctgatttccttttcctggatcaaatgattcaaaggtactcctagtgcaagtagaacacacttgtgattgtaagctgggcttcatttcaggatttcaggtagtaattaattgccttttatgcgtgcgattgaaacggggtcagtcagtcagcaggagaactggtccagtggctcaaccaatgacaaggtgttctgtccctgtcatcatccgaaccaaagttcatggacgctggtgagctgttttttcccatcaccaccactagtggcaatcagaaacggtggagtccttcaggtgatcaggtcacaccgtcacagactgttccaacggacagttaatgcacttcctactgctgggtgaagaatagatagatctcggcgtctcgctttgttaactattccacttttgagcaaaagcggtggttgatgcaagcacgccaggcgcagcgaatcaagtcaaacgcatctaacccacgttttacccatgattaaccccccatgctttttgcagagcttgggcaaaaaaaaaaaaatccttagaactagggccaggtatttatttgggccgggccgtgggacgggatcgcgagatggtatttattggtttggactgcatggcaatggaggacctcatagactgggcctcgacatgcctatgtgggccctcctcaatctaagggcctatattcattgattaggtctgtacgctgcaaatgggcctgagccccccgcctattgctcagctctccgtttatcgttggtaggttaatcctgagagcccattaggcagctctgtagtagttgccaagctggagtgccctggcatggcaccatacccccacttgttccaactctcaagattataaatggtcacataccacatactaataaaattaaaagcatgtagtttttttttcatgtagaaggattcttacagcacatttacgtccattctaaatcataaaccgttttctgtttttttctaattaaatagttgtatgcaggaaactgcaaaaggctagaacatttttttgcttccataataataataaaacgtacaaggaacaaaaggtgtgttatagctgttgtttttttttatggcgaagggagaaccgcatttacgatttgcttattagtttatttaaacctgtctctagtccaaataaaatgatagacgatggactgtttacgtccagctgcacgcttacgggtcgacgattattagcctttttgtcgcttgccaataagcgagaaggcatcatcttcctctcggggggaaaaaaaaaatagtacgcaacgcacaccatgcaagggtatggatatggaagcaataagccacgcacacctttttttttcctttcttttggcaacgaatatgctcttccgatcgtccactagaagagacagtacgagaggaatcaac

SEQ ID NO: 2007 - DNA, 2509 bp, Zea mays
  misc_feature (1)..(100): optimal_loci_160604_G1, chr4:178655568..178658076, Cluster 12
ccagcggtactgaaatttcggaggaccctcgtcgcctgcattgcgtatttgcgtacgacgcccgcgtccgcgtgtctacaagcaatgcatggcccagctcaccgaatttcaggacagcacgattattcagtagcagtacggtttcataatgtttagggccgatgtcgaaatcgctatcatggtcgtgtccagatttcgtttgccactaccactagtactatgcataagattattaatcctttatagaccatgcaataattgtggtccggatcaatctgccaataatctagcggccgggtctatatacaccaataatataatgcaagaacaagaggctaagctagccttttcctgcattcccagaggtggtggagtacaaagcttccgatccatgggaggcctgagactgaagctagggagagtgattggcaaggttccaattccaaggcgcacgcacggtccctttcctcgctcgcgcatggtgatccaccaccaccaccatgcggcacagaaccatgcatgccgggtgactgtgcgagaccgtgccggacatagcgggtttgaagaaggctcggttcatgaaccgaataccagccaaggaacaagaaggccgtacacgccgacggtgcagaggtgtaggccggtggtagctttctactagttcttggcgtggtcgtggatcagggaccagctgctcctctctcctactggctgtggctggttctgatctgagaacccgagactgacgacgaagaccacatcagatgagatgggcccagcagagaacgaaagcgaccgtcattagaagcaaacagatatgctgttcagcgagaaagcgacccagggggtaaccctgccatcaaaacaagcagagtacaacaaggggccaagcaacggatcatatcgggaaagcttggcagtcagtcctagatgtcaaaaaggggagtgtgtacactcctatacatgattcagaaatctgctgaagacatccattaagatggatggggttttaaacacggcagggtgtcagtggcagctaatatcaaaacgaacacaagcaaacatagggacggggatcggaggaggttttgtgactgaatcatttgattgattggcacaccttgacgaccggtcgatctgttatacaagcctcctgcgtgagctggcaacgtcgacctctctcggaataggaccatgcatgtgatgatccccaagaaccaccctctccccgtttcggttccacctctccatgaccatgaccatgaccaggcaatgatagatagatagcacagaccaacctggtctttgtgtgccacacaagcgacaacggaccagtcaaagggttcttgtttgttcccttgtaggtgcgtgctggtacgatttgcaataaaatcacaacagcggcccctgttggaaatacgacccagtttaagcaccacaccaatggcctttcaggattctataccatgcacctcgcgccattggaacacgtggtggtaacttgtggagtgatctttaattggctgctcgatcatgagggaatattcattctatcaagggactctcacaagttagcgtgcatggagacccgggagtacgtacgtggtcaagtcaaaccgacacagagtttaggcgagggcattgcgatcagcacccaccatgtgagcacatgaacatcacaattcttttcttcttcttttctccacatgtgagggatggtgcctcatcgtgacccccccgactccctttgatcctctacagatctcaggagaaaaaagaaacaaacaccaacaatcaatcaccccacccccaccgccctcacacagttcagatctcaatggcatggcaccctacacagggaaaataaaagaagaagtgcgattgtagttttgcttttctaattcaaccgatctgaaatttgacaaaattttttttgctaatatatggttgaactaaatactgttagtaaatataaatactgatactattttctataaacttgaatcaacgatgaaaactgactgcactttcttttgttgggacagagagatggggcatatgagatgccaaaagcactcccttcctaccgtaaaagaatggcttcttcaccctgaattgctgaatcgcacgctaagaattaacggattcgtaatcgccaaggctacttgacctgaccacgccaacagggtgcgtagagcagtgctgatttcgagcttttaggctaattaactgaaagtgtgtggctgtcacccacatggacagaggcttcaatgaaggacagctggagatgaaagcggatcatccaagtggccggtttagttgtttgtcggaacggcatgcttaaatccaccagttggtctcctctccatagtgcagatctcactttttctgaaccttttttttgcgcagcccgctacacgccgatcgccgactgaaacttttggacgggagagcttaagagggtacagctacaacccccaagaccatgtgcagatgtatgcagtactac

SEQ ID NO: 2008 - DNA, 1944 bp, Zea mays
  misc_feature (1)..(100): optimal_loci_160614_G1, chr4:178738236..178740179, Cluster 12
ttagaggcaaactggactgcaaacaaatgctggtgtttcgatctttagcggacttcatggacgtctgtctccattaagccagactcatcaccgcatcatataaataaaataaaataaaaataaaatacggagcaaccacatattttaattaatagatatattatataactttacgggaaaaaaagaactggcaaatggcatgttttttctgctacccggccgctaaggctaattaactccaacaacgggcagctatattgcgcagccatttcacagtttactctatattgctaagccatttcacagtttacatgccctcactgttatacctggccagcgataaccttctgttttgaacgaagcaggcaaactggttgtggccttggttcaattcgttttggcgtgcggagaccagctactttgccggttttatttccttgcatctaatttgcctgggctctatagctggctctttggagccgctataaataaattggctttacatggccaaatacctgccccagcctgcgaccccgacttatacagtgaaataaaaagcctcccatggcattgtaatggaacccataacgagtcacggaggatatgtctcatcaacaacagcgcaccgcaaggcgtgctacaataatgtaatgtcgtcatatatgaagaaacagcaacgatccatgacaaaaaaaaaaacaataataacaagaaccgatgattggttgaggactgaagactgatgaatagcttagctcgagacaaacacacatcgcaggtcctgagacgactgtagaagaacctggagcgttattacctctgaatgcattctctttacccatgtctatctgaaacgctgggctagggcacactgttgccacggcggaaccacgtggaacctacgccggctatctcttggtggaatttgcaccggagagatcttggcatgcgcccccctgtctcaagcatgcaatgcaagaccaccagatcatgcaggtatgtaacaactaacaataacatatataatagcagtagtattaattactgttaaccgatggttgatagggctgtaattagaagattcgaaacatgcgatcaatccagcgactgcacagatcgtcaacgaacgcggaacttgaccaaatgagcaagacgattatattttgcgtaaggagtttcactgtgtgctactttgcatgcgacgttcacatcacacaattaactttttgttcgcttcgagagcagctcttggctgggttcgcagctagctacctttgtttgcgatgtcagtcaacaaaattatggagcaggccatgcgtctcgatccagagagagagagagagagaccatcgtccaacattgcgttgcgcgtagctagcaggcctgtggacatcgaccggtggcggggcacccgcacaccggttggtcttatcggcgacgcaatgcaaggccaacgcgacagtattaccacgtacacatgcatggccgcccggtcgcaatgatcgatgctggccggccccgatccatgtcccggtgagaggccgtccgtccgtccacggtccgcccgacctaacgcgccaattcggtcgcgagcaatcaacagtcccgacccgtgccctgtgcgcgttatgttacacagctgggactgggagccagtaaagcgacggcgcgcgcggcgggcgggaccgtacgcgtcagcgtcagcgtcaccgccgagagggcgcggctcggatgagcatgagctcgggcgaccgttccagtgcagccagacgcggtgggcacgccgcacacgaggtgaccgtgtgatcggcatcggcaccggcagaccgcgaccccgcacgccccgtccgctcgcctgggatctgcaaacgcaccacgcaccggccccgcgagcgccaaacgtaaaggagccaatttttctttggcagggctgtcttcttatat

SEQ ID NO: 2009 - DNA, 1692 bp, Zea mays
  misc_feature (1)..(100): optimal_loci_160710_G1, chr4:179613487..179615178, Cluster 12
caggagtacgtctgcccctgtccgatcaatgcgcgtgcatacgcgtcgccgcagaccgcagtgcgcggacggcgccgccgagcaggctaggagacggtggcgcgaggagttgaatgagaaagatacgctagtagcctaggatggtccggccggacccggggcgtggcaccgtgtgccggcgccactgcgctgcgcgcttgtatggccggatcggaggtgggcgtagcgtagcgtacgtgctgggtgctggccccatccctcccagtcccagggcggctcggcggtgggcaatgaagacagacagacggccgcggtcggcgcattgaaacccggcttcctgatcgcctcgccggttcgttcgctgccgttgacaagggttctcggcttgctgctcggtcaaatgaaaaaaaggttacatttactacatcgcgcggtcgtagtctattctactttaccctggtcagtttcccctaacgatgcatgggactcgggagctacggataatctaatgtatccgcgtcgggattagcgacggagcagctagctagtagcagcctagcacacgtacgtacgaacgacacgacgcccgccaccgctcaccgcccatggacaaggacggcggcgaaggggtcgagccgaaccggcccaggcgagccgtgtggcggtcatcgctcgtctgcaatccaaccgtgcaggacagacagggggcggccggagacgttagaatctgactcggccactcgggacacctgccgatccctttgcgtcttttgctttggccggccggggcaccagcgacaacgcacgcaccgagaggagccgaggccaattttcctgcatgctggccaccattcgccgtcggtgcgatacgcatctttcacataccaataccaccgccaccaccaccgagacgcgtacgcgatcgcccggcgagctagttggtggagatctgagtctgcagatctttgggggtggggtgggggggacaccgcgcatgtgtgccgcccctgtcctcctcgccctggcggccttagtttactcgagagccttttttgaggccaggccatggccatggccaccacagccgcagcgtgcggtgccggtgccgcccgcccgcttggatttcctcccggtccctttttaatactgtgtgctgttttcccctctcgacgcgatgtcggttcttacttagcctagccctatagtacgagtgagtaatacagtaggtaaacctgtgtgtggccgatcgcagcagccactgtgcgcggcacgttcgggcggcgacgcgacggggaggggatcagattcgaagcatccgccgctgccatctgcctctcgcggatgctggcgaaacgagaacaaaaacaaaagcacgcacagcagcagcaggcagatcggtgacggcagagcctacgtacccgcgcgcggcatgttctgctgccgctttggatctgccggatttggactgttttccacccgtttcttgcgtctaggcctagcgatccgtgcgccacgtacggggaacaggtagccagacgttccgaagcgtctgatcaacgtaacgctaaacccgcgatggatcgtccatcggtgtgcggatccatcactgatggcccggcttgccgttgagccgatcggtctgccgcgccgccgtgcgccgtgcacgcacgcgggcgagtggtacgttagatg

SEQ ID NO: 2010 - DNA, 1471 bp, Zea mays
  misc_feature (1)..(100): optimal_loci_161065_G1, chr4:181875974..181877444, Cluster 12
tagtatttcctaatagtatttcggcccatgaatcccaagaacgctgctaccacggccagggcgaaagaaaaatgaagcaggtccgaggtccagggtggaggtgcagcaggcctaaatcggatggacacaggccggttcagaaaagagaggagtcctgttgggacgctgggagtgggagggcctagctattcgccggttgccggtcccctacggaaaacagccacgtctgggcaggcgtagcgtaggtgcctgctgccatcaaccactaccgcgtccaggtccattccaaaagacagcctgtcgtcgagttcatcggagacaggcaggcctaaaaggctagtaagggcctgggactaaccagaccaggtcgtccaacacgctaggcagcccatcaagttggttctcctccacgccgacgccgctatgattttttcccttgcaaaacccatgctcgctaatgatggaaccgagaaaagaaccacagcgttctgactgagacacctgggcaatgagttgagatgattttttccagacagaaacctgctgcgcccacttgaactcgtaggatggtggctacggtctctacctgtagtagcctgtcaacctcgacccaatcgggttccttaacgtacaccatcttctcccgggctgttgtaaactgtactaactactaatataggcaggctgtagccatgaatgagaaggatagctgcctggagtacgtcctccaccagattagagactactcctgcagtcctgctataggtcagtgcagctagcggacaccgcaattatttgcgacaacgagaacgtaacaccaaccgataatattgcatggccgcccccggacccccttttcgtcgtatgggagcaacttttttgttgttgttgttgttgtcgtcgtcgtgcaacgcactgtggctccggctgtacgtgacagggatgtttttttttggatggagggagcgtggttgctgctgcaatcacgccatggtgtgtccccatggcaaaaactaacttgtgcctctgtgatcatgtcccctgtcccatgcatacacgaccgggacagacaaactttcaccagctaccaagcgcgttttcagatggcggtctcaattttcaagcgggagcagcactgatcaacacagcggccgcacagggcaggcgatcgcggcaaagctgggagcaggaaacaccaagcagtagtagtagtagctcacgtgccgtaacggaagcaattataaaagacacggccgggtgagcgcgaggccggttgcgccatctagaggtgacggccaatggttttggatcgtcagttggtggtgatcagctgttactaaacagccgggaaacgacccccgcgcggggttggctcataacgcgggaaggtacgcgtgtaaagcaagcagccggtttgtctggttctggcttattacttgtcacctcagtggagtgctcggggtttgtagaa

SEQ ID NO: 2011 - DNA, 3499 bp, Zea mays
  misc_feature (1)..(100): optimal_loci_161067_G1, chr4:181878859..181882357, Cluster 12
aataacaatctgtaagttgcgacctctcttcaaacgtacaaataagttgtactctcactacagacaccaagatctgactagagtgaatacaaggccactgtcgtactctaccagagccgccatcaacatagaaaacaaacttcgaccttcacatgacgaaccctcaaaattataaccctaaaacgtctccgttctacttttccggttaagattacgtggtaagatcctgttcgttttagattaaagtcggctatttaaactgttgtagctgtaattgagaaaaggcgagccaaatagtatgtattaataatataacgacacgcggagatacaccaggagggcgtgactcccgtgagcagcaaattaacgtgcgcttttcgtaaagcgaccgagtaaaggattcagatggtggcgcggtgagaagagaatcttaccgtcgttgagttgagttgggcctactcatagataagtttgcttctttcaataccctcacgtgaaaggccactgtgtgattggccgaatcggtgaacggggagtgctgccactctcccggttcgcttgtccctatccgccgagttgggggaggttggcgtggagcgcgggcccgccactttgggtaaccatccccttctagtagatcgggaaaagcacgacggcaaagcggagaaaggaaggggaaaaaaaatgcacttgtccaaaagccaactaccagatgcgtggccgcattggccagcaagtaagcccgcccagccgcgcgaagtggatcggagaaccgccggactgacgcgctcggcctcggcctcggcccgtgccgccgcccgctggctggttgatcgctgccgctagtctgtggcggcagagcgatcgcgaggaaaacgcgccgccgctgccgctgccgccgcccgtgtgatttcaattcccacgacggcgccagcccgggcgggcgagtccggttggccagccaggcgcccaggcatgcccgcgacgcgtggtccaagtccaacgagcgtgtgcgtgcgtgcgtgtcccgctccatgccgttgaacgggccaccggttgccgtatcgggaaagaagtgctacagccttttcccatttgcgccggccgccagcagcagcccttctcccaatctcccgtttcaacggcggtcgtggtgcgcgtgcatgggcagcggatcgccgtgcgggagttcttctcccccggccccgggcgcggagtgcgttgcgtgttcgctactcggtcctggttgggcgggtgggtggaagactggaaggacgtccgcgaatgactgggccggctcggggtggtagatactgacgcgtcggaggcgtttccgcgcttgacaaatggaccgcccgagtcccgaccgactcggcgcgcggtgacggtggacgcgccgcgccggcgccgcgccgcctctgtgctctcgagtctcgtctcggtcttgctgcccactcccgtcgcggcggttgaaccggtcgtaccccaatcccaaccgtcgtgtacgcgtgcgctcaattcaaacttggaataatcgatcctgtccgtatgacacaagtggtatggtgtgttttcgatcagatacgacatcgcgagccgtgcggcgcgtagagggatggataatacgttcctggcgcgtacgaacgtgaggagccagtccggggcgtcaaagcagccacgtcgcggatcatcgcatggcctacttgcgctcaccagctgattgtcctgctcgggactctctcatcattcagcgagcgaagttgtcgcattgagacggcaagaacacaggacgaaatatataatcggaggcaggaggatggaagaatccaagctcttctttgggttcgcccgcatgtcacagctatcaatctgactgacacgctgatggtagatgccttctgctgtttcaaccccacgtgtttactgaaacacagacggagacggtatggcgtatgtactttgtggtttagggtccagtagtgcatgcgtgggtggtcattgcgaaaagtggaatttgcgaaccaatgttccataactaacatcataagtagattattaggatacggagatgccattacccgctctgacattactctcttctagttctaagaaggtgacgtggtattgtgtatagggagctgatgatcagttgagatgcaccgtcacagcttgccctttgtgcatttatctgaaagcatagtagatattaaaaaatcctcattattcactattactttacgacacaattttcaactgccaactttaactaccagtttgtggactatcaacaacgtgcgtgcgtgtgctccgaatgaaagcgttattcttccctttgacgtttgacccgagctatttaatttccagttggaccaatctcttgaacagactgccgtgctgcacacatctttacacggatgaaattattaatccagaattgacaattagtggcaaactcaacttaaaacaactagtatagacctgtctttttgtcagctcaccccaataatgatctgctggtcaacgaaaaaacaaaggcgcatatatacaatctcttccgcttgctcctaacagcatacggccggccttttttcttcttcttcttttctttgtgcccgtccatgtgattgtcaccttgttccaatcagaatgagcacagccaagcagctgccctgttgtcgataaagaatgagcagagccttcgctattcttacatgcagttctttgtatgatatcggatctaaaattaagggatccgtacaaaaccaatcgtttatcatacggtcgaacaagtctttgctgacaaatgacccaatcagacacatatttatcatgtacttttgacaccaacacaagcgacgatggagagagaccacggctttttcaaaatgaaattttggtttttggcggttggtaagccataatctatgtgttctagtacaaatgtccacatcacaaactggacgacgtttccctttttaaaaaaatggacctcgaattattcgtttgccttagcaaatttataatcgggtgtagcaaagatggatcaagactcgtctagaacaattttttggtgcttcgtgatcaacgtagttatttagattaacgttatttgctaatgcttttagatatagtttgaagaatatacacatgtaaacttagactaagacagaagagtgaccaacgcctcaaacaagacattagaatatatgtacgttaaagatatataccaggttatccaagaccaattcaagaagaaggctatgagcctatgacattggcatgtggatccatagactcaaccaagatgtctaggaatcctacccgcaaggaagtttcagaaagaatgaaatataaaagatgacaatattgtccaccttgtgggtagagacaacttatatatagtcaacattgttctcctttcatctaattttttaactctattctccattaagttcttgctctgctgctcttggtctacagttcgagctccttgcgacct

SEQ ID NO: 2012 - DNA, 1426 bp, Zea mays
  misc_feature (1)..(100): optimal_loci_163992_G1, chr4:197043013..197044438, Cluster 12
ctggaaccacatcccccgtgaaggcgaggaggggccagcagcagtagggtagggtggaactggaactcaaagctgatacttcttccctagtctcctcggcgggcgacacgctcggatcgatccccgccgccgcagcctccctcaccctctccaatccaatccgcagctacccaatggcgacggagctgctccccgtggtggacctgcgcgtgctctcacagcccgacctggacgcgctcgccgccgcctccgcgcacgccctggcgccgcggacctgccccgacgccgacccgctcccgcctctcaagatcgaccgcgccgtcttcaacgagagcgccggttcccggaagcagaccttctcccgccgccgcctcgccgcctcgccctcgtccgcccgtcactcctcctccgcgcagacgtccaccgggcggaagaacgaccccgagggcgacctcgtcgcgtaccacctccgccgtctcttcgtccccgatgacccctcgctcccgccccctccagaaccgcaaaccctagccctactacaagagccctccccccctccgccgccggcccccgaccccgaccgggagaccaccaacgccaagggggtctccgttgaccttctcgggcttgcggcgatgccggagccctacgatgccgagctgcacaggcggacggccggtatggcctccggtaccgacctgcagggtttcatcgacagcctcgcaggggagtgggtaagccagaagaagcggaggaagaatgtggacgcgtccttcttcggggatcacctccctcgcgggtggaagctgcagctcgggctcaagcgaaacagtggatccatctgggtgcgctgcttcagctacgtgaggtttgcctcttttgccctgccctgccattctttcttcataaacgattatatgctagtggtagtatctggaatggaactatgctgtgataccttacctgatgcgatgtatacttgttcagagatgctctggtagtgtgcctggtagggtatatccacactataagtggtggattgggtttaaggatacatgttgatagtgatacctctggcagtatatctgctttggaaatcatctggtgtggatgtttttgtttgagcgaatggatgcattttttagatgttaattaataatgtcattacatcactagggtgagatgtttgctaagtataacattgggttttctgggtttgcaaatacagtcttggtgttcgccatggtgtagctgcatttgatgctgttatttaagtatctatcaacagtgtttatgccttttagatagtttgtttccatgtacccttcaatgcatgcatagtatagccagcactacctggccatgtgtccatggctgtatgattcttattagaaatttattttattttccttattattgttggtgg

SEQ ID NO: 2013 - DNA, 1486 bp, Zea mays
  misc_feature (1)..(100): optimal_loci_16549_G1, chr1:91872470..91873955, Cluster 12
cgctggccctcctcatcagtgcaggtagcatgcgcacgtggtttgcaactggaccgtcctcaccccgtgaggccgtgacgacgtggcgcataccatccccgcccatgcccatcccttgttttcttcagttctattctagtgatgccgaccaacctccattatatatatctttttatcttcattcagttgttcaaacattccgtccgtctgccatgtcaagtactacaaggaacgaagctagcttgcttgctgctagcacgaataaccaacgaacacctgaaatccggccccgattctctggctactaccgatccgaacgtacgctatcatattgagcgcatacgtgcggcggcaacttgtcccttatcattatcatcgaccgtaatccgggcacgatatcgtggcgtgccataaaagtttccttactgcttatagtcaattaatcacgcgatcgcggcaaaatcacacacacccatgacccatgcctcaatcatccgtcgtacgcagcaactagccgtgtagagctcagaacagaagcccgtgcgtgcgtgcgcgcgcgcgcggccgcaacagcttgctcgatcggtcgggccccaaaaccccaagacgtggcaccccacgccacgagacaaacgggggagaagagggccgagagaggtgatagctcagttcgggagacggcgccggcacacgggcgggtcccccccggagatctcctgcgcgcgcggcgtctttgcgtgccgggacagcggccctccggccgccggcgccaccagagcggttgctctcgcggtgggcgcccgcacctcacatgcgcgcgacgcgagagcgagaccgcgccgtcggcgtccggcatttcgcgctccccgcacatgcagctcaaaccaagcccaattaacttgccccgtcccgtcgcggtccttggctccatcacctatcgtcgcgtcgccgctccgacaagaagagataaaaaatggtgggggctcaaaggccgaataatgcctggtaggcaagatttgcgtatctccagtttatccgtgcaagcaaaagtgtgcgtgcaaatactacagctagcggatacagtttgattggtggatttgcaaaaagcgttatttgcctacagctacagccagccgatgggattttattttccgcgacctgagcatgttttcatggaagaattttagaaacgtcgtttcatgctacgtgatccgttcgttttaatctcaatccatgtgaatgagataggattgattgcgagtttaaatctctccctactaatcccttaccgtcctctccaaccccaaatggaacggaaataaccccatcaaattttgtctttatggcattgaaatagagcctgatgtcaagattattttgtagagataaaagttgatatgcaaaatggcgactattccctccaaacggttttaagtccatccatgtcaccatgttcatgtgtattccgagaatcatggctcattaa

SEQ ID NO: 2014 - DNA, 1596 bp, Zea mays
  misc_feature (1)..(100): optimal_loci_171615_G1, chr4:236402015..236403610, Cluster 12
aatcgccatgcgcctgcgctctggcactggatcgccgcaggcgccaggcggggcggacgtcgtcggcgcctgcgcgctgacgcgacacgcgccatgcctatgcctcgggcaggcagctgatgcgcccctgcagtctgcactgcttgcatgcgcacccccccccccaatcccatgcccatcatccaccctgtcctggtgccctgccatccatccggatacgatacgacgactgatgaaggccagaccgtccgcacctgatctgaaacaaacaggcctgcgcgcccatgggttcagctgccacgttggtgctcgtccgtgttcaattctcggttcatcggatgtggacggcccacagcccactggaaagtaaacataagccgttgatacgcaaagttacataatggtctcagtcaaggattcactgagattctaaccatcattttcgtacgtaaaaaaatacaagacaagcaacagagtggtacaactatgctctctccccgctgccaacgcaaagatcctgcacgcgaacggagctagagatcgccatggctccgcgcgcttgcatttattactcggcaggagtggtaggccgccaggcggggcggcgcaggaggggcagcaaagcgtggcgacgtgacgcgtccacgcacgcacctgtcgcggggtcgggcccggtctcgccgcgccattcagaatccagctgcttggtccgccatggatacctacgcaagaagcttgggccgtgggcctcgaaccgccgcggcgacagcgtcttgggcctgatcctagtcctgggtactgaccggtgaccgcaacgtaaagcacgagcctttttgttcaaggaagccaacgcactcccgtgcacgtcgtcgtacgtccaagtaaatcccacctttgtggatcttgttgttgatccgggccggccggcctcctcatcgatctgctttgctttcaccaaccacatgtctacgtacgtttgcttgctgccgttagtagagagatcgtttccttcgattaaccgccgcctgtgaaaattaaacgtttctaccagttgatctggaaaaaaaaaaaacattagtacaaatagataaaaaaacacttctatattgcttatttgcaggacttctatattgtttctttgcaggagagccacaggccacgtgataccgtttccgtgtagtctcgaccggtgtacctgcagaaaaaacaaaactggagaacattcccttgttctccccacgggagaaaggccccaagcactacaagccatgatatgatagccatgcacgcgttgcgccagcaaggcagcaaccatccatccatcgccagctacagctacagcggcggcggatgtgcgtatggatcaaaacacaacagcgcaacgcaagcagggtctctaagctaactagatgcactcatgcaccatgcacgcatgcatgcagctttaccctgtcgcgtgcatgtaggccagcatggccgtttttttataataataattcagagggtggtcggttatcctggccaaagcttggttcgtgacaaaccggaattaacaattacaaacattaaatgtagttaaattacaaaagaattaac

SEQ ID NO: 2015 - DNA, 1631 bp, Zea mays
  misc_feature (1)..(100): optimal_loci_173389_G1, chr5:5897432..5899062, Cluster 12
taagcgatcgtcgattggggtctcgggtgaatcgtgactcatactttcgtgagctcgaggaatgtgttttgcggtagtttaggggttaagtgtaattaggagtgtgacctaccctagttacgataccggacaaaatctaacgtgtagtagctccttactagagagaggatagtacgacgcacaaaaggcgcatgcagagaggcttcaaaggctatggttacacctcggcactacgacaaccttggctttggcttgtactggcagctggtgccaagtgccaacagctcttcaggggtggaaactggaaagtatctatacgtcgttctgggtggaccttggcctgctttcattcgtctgctgtttcgaacttgtacaggcattggtcgtagccgtagaacttgtggttcatctcatcaggttgcagaaatcaaagggggaatctatgcctcgttttaatttagcccggacgcaaaaagcacacgacaggccttcagcttgagaaaaccctacgggcatggcttgcttcagctttctcaaaagtcgatctcaaagcattggagctcgcgcgagaaaggttaaggtcaaggctcactcaacaagaacaaaatctcgtcagaattgttttttctctatcatccaaatgcctgtagctctgcactaccttcctccgggcattatattgatggctcagagtttgtcctgtccgcgtgacggtgattcgtgtcatcttcagaccagaatagtccgtgcccatcatcagcttgcaagccacaacaagccgctatagatctattcctttcgttcgtgtgtttccatcgcacacgtacgcacaacaaagagaacgtcggaatagatccgatgttccttgaaaaacggggaaaacaaggaggcatttatgagtgaaatacagtttcgacggacatcgatgaggatgctggaaatcttggcgagaggcaggacatggggggcgccaccagcaagcagtacctagtggcgcaccagctttgccaaacgtttgcgggtcatttcatgcgttcctggtccaatcctgcgctttcccccgatctttatgcaatgagtgtgcatgcccagctggtacaatacaactcgagtaatataatctttgcattgacgagatggagttctttagatttcgcctttatatatatgcagtttttttttccctgtctttgtttgccaagagttcagctcttctcggtcctagtctgaggctctgaggcctgagctggagcctgttcagaaatgggattgcctccaatgaatttgaagaagtggcctggatcgaagtaccagctaacgtactacgggagagcaaagtcctgcaattgcagtgccgatttgctgctcatctgaaacattgtactacgggagcccatcagtaccggcggcggaagaacgaacacaacgacaagcatgcaagctaggaacgaactagtcttatgccgtgggcggggcccgccggcagagaaaaattaaggctaaacattccgctacagaatgttacagcagtaagtgtacatcgcaagggacaaaggtggcgcgagactaaacaaattaaggcaaccaccagcaattccatcaattaacaactctatagcatgctttcgtac

SEQ ID NO: 2016 - DNA, 1500 bp, Zea mays
  misc_feature (1)..(100): optimal_loci_173455_G1, chr5:6304632..6306131, Cluster 12
ccaaaatgaaatggctgccttgcaagttgctagtctggtccaggcttgttgggccgaagcggaatgaaagaacatacttacttgggccaagtttgcggttatgacggttatcagttagttgctttccagagttttttccccgtgcgagagattcgagagaaagagagcgcgttctcgtctgtcttgaaaaagaagcaaaactttagctgccaagaacggagaaaaagagcaaggacggactgtgctttacgatcagcggtagctggtacggtggtactacccttgaactaacccaaaccatttcctgccaccggtcgcgcttatagctagctagactagacaagcgaagccaagccgggtaggcaggcgctttctccattaaaaactggatcaagccaaccgcgccaaccaccacgagattcccgttgagatttgccaccggggcctcgtgggggcaccgagcgccaggccacccggtgccgcgaccaccacctgtgatgagaaccagcgtgacgccatgtcatttctctccgcgcgcaaccagccggcggaaacgcacggctgttgctgttgcggccgccacgccactaacgagcatagtgccatagtgggtactgtcgtactgagaagtgaccaccagccagagctagctcccaacgaccaaacacggctgcaggcaggcaggcgattaggccgccggccgccctctcgcaccgctgtactaataactcgattaggtccgtgtacttgcgtgcgtacgtcctcgtcgagacggcgagaggcgcaaggaacacgtggggggcgacggagtggaacggccggccgggcacgcagacgcacacgcacccccggccactggggcagggagacggggccggccgacgccgggacgtgtcacttgccgagttgccccgctcagccgcgaattgcgcggacgctgagtgacgccggcgccggcgagccgtgcaccgaagaccgaaccgaggacccggccggggtgaaaccggactggccgccaaaatagaagatttgcagggggcggacggaccaagggcggactctgctcttcgcagccaatcaaaccagggtggagcggcgacgcagctcggccgccggccgaacagataaaccgtcactttgctttgtccaacgcatgtggcgacctgctaatccaaatccgacttttttatgcgagcagacaagcaacgtgttaggcgtggtatacgacgtgactgacagcagagggaacgacgcgcatgtgccatgtgtgttagtagtattatttaccgacggcatagagggctgttattcttatctattagtgctgtggtggtgctggtggtagtcttttaattgaccacgtgaggtttcgcaaggattacagtcacgttgccatcatgcattagcacgtcttataagttttatatatatgctcatcgaaaaaggcatcgctcggagatcttttttaaagaaaagaaaaaaacagtatattgttgggag

SEQ ID NO: 2017 - DNA, 2227 bp, Zea mays
  misc_feature (1)..(100): optimal_loci_173533_G1, chr5:6607051..6609277, Cluster 12
taatatatggtaaattatctagactattgaggaggaaaaaaatcttatgtgcttttcaccatttatttattaaatgatatatcatatttataccggtatatatactcaagcatacagagtacctatttttttgggccggatctgccgctgatgggctccgatgaccatgaggcttgtgttcccaatcccaacgatgatacttctcctcataggaaaacaatgggctccggtgagagtaccaggcaatcgtagtagtagtagtactcctagtaatgaagtggagacgaatgatcaacgtgccgtgacatcggatgtcatataggccaactttttctaatcccggaccggaccgaaccgaacgagtgcattgaactggttggtactcaacaatcatcggcgttaccccagtcaaaaggacgagccagcgcatcggattccacatcccttccagagggtggaactcgaaggtggatatgcgtcgcgtcgcgtcgcgtcgtcgcgtgccgctggacaacgaacgggtcaaaaaaacagcaagcaacaacgtcggcgcgagatctggacgtcccctgggcgggcccggggcgcaccagacgctccgcagaagatccgcaggaccgtatcgccgtctgcatccagcttgctgctgagcccgcgctgattttcttaaaatatctgtgagattctacgtccactcgattcgcagacgccgctgcggacgtgaaacggaaggaaacacgggacgggacgggacgcgctctcccctcgcgcctcacgtgggccgcgtcgatacggcgatccatccagccgtccggtcggcggccacacggccggcgccggcgggcacccgattcgattcgaaccaaccaaggacatgcggagaagcggggccagacctcacgaacgcccagaagggagaaagcaggatcggggatctcgtgcgggaaacgacggcgtgggacgtcggggaggtgaaagtgaaacacacacagagacccagctggttgctttcacgtagaaaaaaaaagaaacgtcattttttcgtatcaccgagaaatcgcaacgctcgcttttaaagcttcttcttttttttacgtttataagtagtagtagtcgtcgccattaaagctcacccggcaccggcagcgagatggaatggaagcggacaagaagcgcgatctaagcaaagcagctggagctgggcctgggccctggcccctgggcggttcggccggcgcccccatgctacgactacgagccacgacacgcgtacaccggaacaagtgggcagcatctgggcgggcggggccagcgcccagcgccaagccaggctccagaccagtccagacgagttggttgctttcgctgaggcatctgtgcgacacgagctgacgagcgcacatatacatacgtgcacagacatacgagggcggggctgccagtggacgtggaccctgcgcgcagggaccatggctagaggagccgaagccgagcgttcctgccctgcggtggccatccctggccatcaaggcaggacaggacagcgctgtggttcgtctggtctccatgtttcttttttggttggatgagaaaaataattaaatggctaacaaggtaggtgcacgagtccatgactagtttttattgtaaataatcgaaccaaactcaggtcatcgttggaatgaagaacgagctagttagtatatttggcaaaatctaaaatggtacatgagtacttgcgtgtacaagattagttgatttcgtatccattacttaaacagcgatgacctggttactttataacatcgacggtattcgtatccaagggggaagaaaaattgataaggtcgtaattttaagaaagaatgaaaaaacagcggtggcggtatgctttaagaaagaatgaaaaatattattgtatcactaaatggaactgactcgacgttggttgttattgcgatgctattgctcagactaggaaaggcaaacttggttagaggttgaccaactgtacgtacgtctagtcgtactgctggtaccgccgcgtggtcctgctgctactgaaagcatgcacgtcgtaattgtatttgtatatacaggcacatgcgtcggagaaccaaactactacgtatctggaaaatatggcagcatgcatcgatgcgcatattacttttacctactacccatcactgcaaccgggccgggcgacgacagcagttcggctgtg

SEQ ID NO: 2018 - DNA, 1726 bp, Zea mays
  misc_feature (1)..(100): optimal_loci_174689_G1, chr5:13737641..13739366, Cluster 12
tgcaaacatttaaattttaactgaatatatacatgaaaattatattttgacctgccaacagctgtcagatctgccaagctgtgctaaaaatgacgtatattttgagatggcacggaattcattttaagtaccgcttaaaaaggaatatcaattatgcctgcctattataggcaaaatccatgcctctcacgcatcagatcgcaaagcaaccaatcacctccgggccccacctcggttatgaattctgatgcagcccactgcccccagtccacccattgagctgtgtgtctccatcatgcatctatcatcgtctgcggctcctcggaacttcagctaggactaggaggctgctgctataaattttcgccagcggaaaaaggccccccaacgaacgcccggaaggcagcagcgaagcgaagcagagacgctggcacagtgccactggtagctcacagtcacaggtttcgtttcatggccttcgtctcgcaaaagttcgctgcagggagcgctgcgctatcatttgcaaagagctaatggagcaggctgcagtagccaactagccgtggagcccctccagtcctcgtcgtcccgcgtcctggactgcgcgtgctgtgctgtgctgtgctgtgctgtgctgtgccgtgcaagaaaaaagatgctaggcggctgctgctggctgctgctgctagggagccggtgctcgtgggcactgctgcctgtgctgaagcttaactgtgggaggctgaccgtgaccgtgagctcctccggacatgcatgccctgcgctgcgcctgcagcaaaaagccggcaggggcgtgcatgcgagtgcagcactgttagcactagtagtttgtctgcaaacacactgacgagcatatatgggcctcatcctcctcgctcgaattaaactccgggcattagaaaatgttgacctggggtttgaattcctggacttccactgcctcactcactagacggcacccaccaccaaaagcttgcgcggaaccggcagtggcagccgcccatatatgcattttcgacgggcaaaaaagcctggcgtccggcggcgattcactgagggcgcccgctgcccaagtgccaaggcagtgaaggcacccacccagccgagcccagccttgccattgccatttgccaacctgtggctgtgcctgtgcctgtgcgcgtttcgttggagctaggtagggatggcgatggcgcctgtctgtcgctggactctggccacgtctctaggttttctgaattcctgatgcatcttcaggtggcatgtaatgatccacagttgacttcgctgcttcaggtcgaggcaggcagcgatagtaactgcgagactgggcgcaccaagctgtagttgcggcatcctgcttccttccacagccaccggtcggtttcgttcgtatgctaacgagtttctcctagtaaattgtaaaaaaaaaaaattgcaccaactgtgtcttttaaaaattaaaatattcaacatggtctacacacccgttgaaaataaagaattgcttttagacagagatattcagttgcccctcccacaccacaactcacctgaattttattaacatgactggcactcttgcttgacgaatcctgtattttgactggcactcttgcttgacactcttcggaatcctgtattttgtagcgacgtggtgatctagggcttgggtgtgttgcatcccaatttgaacccataaaat

SEQ ID NO: 2019 - DNA, 1583 bp, Zea mays
  misc_feature (1)..(100): optimal_loci_174916_G1, chr5:14838795..14840377, Cluster 12
ataaacaaattctaaccacacaattgttcattcacagctacatacaagtctcattcacaaaagtacacaaaacataagctgatggctggtggcgtgtctaagagcctgtgtgactgtgtcatgtgtgggcgcgtggccatgtccggtggggtggcgggttggaatgtgcatgtaaacttgctaagtgctacttctaacgttgttttgtgggctctaatgggtatagtttttgcctccttgactgtcttgtgggtcttgaaaatacaggaaaataccgatttttctcgagaaatttgaaaacagacgataaatatttcttgccgtttaccgtatcgttttttaaacgatatatcccgttttcgcaccccttttttcatatatcccgaaaaatttgaaagctctttctgctgcagggcgaccggacggacatgctgctcctgtcgattgttttgttgggccgggcgggcgctgggctgctggcgactgttttgtggtcggccccccttgacggcaatgtcatccttcgccgccgtcttggaaggggaccagctctgctccagctccggctgcgccgcccgcacgtacgcacgcggcaggttgttctcccctttgtcgtccaacacggaacacgccgtgagaaaagcccgccacgtgccactgactttaccgacctccagtcatggacgtggtcctactactactaccactactcatcgccattttcatcttttttttcgccaagaagactagtgctcctatgacgtgactgtgatgagcacagacgatggaccaccgaagacacttcggagaataaataaatgtttccatgttctacgtaactgactactagtaccaccttgctacttgctatgcaaacctaacacgaaaggttttcttaccccccgaaaactagaacattggtccggccggctacctccaaatccagcggcataccagttggtcaccgcacacagcagcagtctgcatcaacagcctgagaaaaaacaagggcagcagaaccggtcaggggaagcaaaaaaaaaaaaaagggcaaatatatagggtccgattgattatatagttttagggcacggcgaataactaacctcgattctgaaaatgactcacaggaaagcgacagttattcacagttggtggcttggtgcatttccaccgctcagacagccagactctgacgctgacggctcgaaattagtagtaactcattaccggctaaactgggtggaagaacgcgtggtccgtggccccggaatggcgcctgacgcgctgctcgcgaggaattccgagacgctaagcctaccacgtccggccggtgactgaccgatactacctcctcgcatgtcacgagaatagcatggctcggctgggtcatcccctcctgaacccgcccaaacggaagtgcaagttcacacaaaatcagcgcttgagctagcgcaaacgcatgcttccgttcgttccggggcccagcccaccacgcaacgcatcccaggctcccccaaaccagtgagactgcctccaacggagcagctaaaagggtatgcaaagctattatgactactcat

SEQ ID NO: 2020 - DNA, 2538 bp, Zea mays
  misc_feature (1)..(100): optimal_loci_174917_G1, chr5:14849421..14851958, Cluster 12
gcaaataagcaatttgcgttgacttagtgatgtcctcaattttacatgccagcaacgtaagctgtgcagttgggcaattttgagctatacggtgaggggggccgggggacctgaaatttttagaaagaaaaatgtttggtgctaaagaagtcaacatagatttattttttaaagcaagccgggccgccgtcacatgcttgcgcgtgaaagccgagcaaatatctttattcttgggcgcggttgtggtgctctttggtgaaagacgacggcaggttgacatgcaagtagcgctaatcgctagtaatatactaatatgcttggcggtcctctcatagaatactgtggatttttggccgctaatcgatggctgatacattctcctgctatattatttatattacactgttgtcatcacgagatcttctggaccggaagggccgcaatcagcatagcgcgaccgacgagatgattctcgttgaaacacagtggtcgaaatagtagattagattagactagaaagatagttataggttgtcacttgtctgattctcgtttttttcctttcccaaggactgatttagtgagcagcaggggtcaccaaatccgcccccaaaagtccaggccgtctccgtcacgcagggttcgtggtagcagggggagacttgacacttgagccctcgcgactcgggcttggtacagggccatgccgtgcagcgtaggtacgtgcagtccagtttccacgggcgctcaaccgactctaccgtgggtgtcgacgccatacaacgtgggtccaggccgtctcaattaataattagtaataatataagaataagtttattttaataaatttggagaataaacttacgatgaactatatcatctaaaatatattgattcttcgaatcaaatacgcccaccccaagtcgaggtcaagtttctctgcgtgctattcgtcggtcacccaacaacaggggcgaatggaatgggatgatggtcggaccacaaagttccacatgctttctttgggtttttattttaatagccaggcactcacgctgacaagctggacctgtagcactgaccggttccactctttggaaaaaacagcccacctctgacccctgttgcgtggggagtctagaccccactagccatgtgattattcgaatcgcgctctacgccacctccctttgctctacgattccaaatccctccgctccgttccctcagcagaaaggttctagttctagctgtttccaagcgaaaacactggtccgcccccacccgcttgcctgcaatacagcaagagtctctcctcctgctgctgcttcgtcttcacgcgtgtcgccctcgcgttccaacgacctctggccctgacgccgtccacgtttcagacgaacctcgcgaaagcgatggatgggtccccctggccctgcgtacaccaggagctcggaagccatctcaggttaccatatatctccctgaaactgtgaaagatatgacctaatgaatcagattagaaacgccaatggtttataaccactggaagcttagtgatttctaacgtcgaccttggggggcaataattattattatggctaccgcgtgtagaccagtagtgggagaactaacgagataattgctgaacaagtcgcattggcacagcctaaaacaaacccagtgtgacctgctcagaaaacagagtcaaaacaccactagtgcatgatggagcactaagacccagtcgtcgtcgatcttgttgtttgcgttgtgccgtgacagggacacttaaacaggcaacaccttgcagctcagcaaatggcagcagacgcgacgcggggccccgattagctagcgagacccggactggcgccgcaggagcacacgcaatgctgtcgtcccttaaagctccgcaagtcttggccactggaagtgcagtgcagggcagggcagagtggcgcctttcagctctgccgatctctccagtctcttggacatcagatctgcgctagctgagtgcggaagctttacgggaatgggcatgcgtggtgccatggccgggttagctacagtttgtcaccgggaaaaccaatgcggttcgcgtgacagtgaaacagaggaaattttcagcagaagacaaccacatctttctctcctgggccctcaaacccttcatttatatgggcctttagaccttacgacgaatggctacgatccaccactcgtccactcatatatggtctatgagattaccggcttagttcttaaaggttactcttagaattacgcttgatagaatctaagatatgtcctttaatttgatagaatctaagggactgtttggtagagctttgttccatagttctctaccccagctgattctagtagagttatttcgaataattctttagcttgagtgaatctatttgaccaaaaacatttgacaaaaaagtctgtaaagtgattcctgaggaatttgaaagtggggaacaagttgggagtgtcggggatcattttttctctctcccactctctagt

SEQ ID NO: 2021 - DNA, 1422 bp, Zea mays
  misc_feature (1)..(100): optimal_loci_18450_G1, chr1:102945832..102947253, Cluster 12
accatctctagctgcagctgcagcagccagccagacgtgtggcgaccagttaccatgggccacaacagatggcacacatatcatatgcacggctgcaacctgtcgctggctcgctgttgctccggcccttctggcgcctggttgtcacgagcaacctgccaggcagccggcggcttgctccagtgacccgttccaggcggcggcccttgagaagtttgagatgacaagcagccagccatcactctcatcattccggcgccccactcaggcagacgagacgcacaaggctggcacgtctcaagggctcaagtcttctgcaaaaacagaggctggactgaagatatcattaaacatggatgcatacagtccgtagcagaggaaaacaacaaaaaaaaattatcctgtggattcccagcacccttttccccatcgtgatgtgcttttctagttcctatcgaatccagattaaaattataatcagtaaagatcacacagattaggactgacttttaagtattcgatgctaaattttacttgcaggttccgccaaacaaagcagagggcgtcgctgccatcgcctctccggtctcttttggaagtgccctctgaattctaccggagaacaaagggaaaaagaaaagaaaaaaggcgacgaggtactccgccggtaaacaagtgcagtaaacgagtgatgacgcgaccatgacaggcactcaggctacttttctcggaccattagtgccagatcaacagatagacaggtctgctcggtaaccagaggacggtcgatggtttcagatttcgttgaccagtgaccagatccagtgacacaaggagccagagcatcactgctctccagctccgtgcaagtcaacggtctgtgggggacgacacgacacgataaaggaaagcagaagaaaattgcattgcgtttagatggaacatgccagatcacttcagttccttgcttggctgtagaaacctgtacctaatttcccaagctttcggctgacttgctggttctgcacgcgggcacgccactatgtacacaaggaaaaaaaataatcaattgtcacactcgtttttttatcttctccgagggcgtagcttgcattgcgagccaaataaaacaaggaggtgacgaagggtgagagaacatttcaagcatatccataccattctcaatgcttgtaagtcatccatgataacggggacatgggacacatgcttgccaatcaccaaatcccgtggaagttcggattttgtttatacagatcaaatcaacaaatgccaacacaccataaaaaacatttcagaaaaaaatgtccagaattggtctccatccgttaccaccaccaactggaggtgagcacaaacttcaggaggagaccatccagagtgcataatgtttacgaatcttta

SEQ ID NO: 2022 - DNA, 1466 bp, Zea mays
  misc_feature (1)..(100): optimal_loci_185181_G1, chr5:78392091..78393556, Cluster 12
acctcatatactcctgccatgcacatgcacttgtacatacatttatcagttatcaccggtctttgactccggccatgggtctatggttgacattcttaatgtgaaaaatgagcgaaattctatatgcatttcgcacgtgtggaagtgactcggatcttgagtcttgtactcctgccgtgctcaccatcgccccccacgttcgctcgctccgtgatccccgggaattgatgtatgttattcgtagaatcccgccggactggcatcgcccgccgtcggctctcctccaccggtttccctcagcctctgcgctccgccaggggtcgcagcgctgctcgtcgacgtcgagtcccggccaggctaagccaaaggtgagtcgcgcaaccgcctgtggatcttttggttggggttgggggccatgtcggccatggtcaacaggcggtggttgcagttcagaagcacgtacaggcacagcgcgtggtgccagcatgcatgatcctcggcccagtgcaggagacgacgatggcgccgcgccgtccgagcccgccgccgccgcatgggcatggccaagcaccttcggtcgcgacgactcgacgacctctactctacgctgggcgcggccgggtgcaccgtgcagtcgtgcacctccccgctctgacaggacagccaaagtcggtgcccgcgactagtgcctggccggccacactggcgatggcgtccaggctcgcaacgctgccgtgccgtgccgtgcgggcggtaccgatcgagctcgccgcgccggcgccggcaccggcaccgaccggggatgcggacaacggcgccactctttcgtcttcgaccagagaagcccagcagccgtgctgtacgtccacgtccacggcggggaccgagctggcagcgccgcgcgcggccgtccaccgagcgtgccatctgccgacacatgactgcacgagccgaccagcagtctgctacggcttgcactacacaaccctcctgccaccggccggccgtcactgtccttgcagtcttatgagcacagtcgattttactgtgcatgggccagtcgtcgaaaaaaaaaattaagctcctattgggattagaaaagggcgatttggcatgtgaattagtaggatcagcgtatgattgcgtggttggttgcattgggatgtttttaaggtatccgttccattccaattccatccggtggcagtggcatagcaagcaacgacgaacgagggaggaagaggagggccgacatgtccagctacgtgagcctgtcatacagggacagcccgccggaccgtcagattctcctcggcaaccaccgcaccatcgtctctcatctctctctctccagtctacaccctgtcttgacacggtttgcgttataagcagaaacagagccttttccataaaactcacaaagaaagtacaataatccggagattttttttaaaaaaaaaactaaa

SEQ ID NO: 2023 - DNA, 1739 bp, Zea mays
  misc_feature (1)..(100): optimal_loci_186646_G1, chr5:87107507..87109245, Cluster 12
gttgatacttgatatgttctgcactcaaaatataggagacaacaacaacaaaaaacaaacctaggcagtactggactagcgagtggaacgccggccgtactgcttggtttgcttgggctgatgggcttctccgctcacaagcgctcagtctggcccgttttgggtgccacatctcgtcgctcgctctgacagtctctggtctctgccaacctgccgactgccggttgctcatgtcatgcacgcgcatctgcctctcgcggtctcgcctcgccatccctgctagccgagctgcactgcatccatccggtctcctgcgcccagtcactgccacgcacgcacgcacggccgccgagccgtgttgcagtgcagggcaggggcgaaggaaacttaaccgataaacaaagcgggggttccgcttccgttcgcgttccggcgaggtttggttaagtgggggcgtgcggcgcggccggcgctgggggacagcgcgcgcaagcggacaacgccgccaactctggccaagtgcgtcacctgactcggacgtgcccctcccgtcgcgaacggatcgtctgcgcccgccctcccccaccgtcacgtcgcgcgcttccccaagccaaacagctcctcccccgcgcgtggcggcgccgtagcggtcactgcggccgcaacacgtgtgggccgcagcggctggccctcgcgccacagcggcgcagaggatcacggtacgatgacgcggacggggatttccttctccttttccgttccatgggtggcagtggcagtggcaggccacgcgccggtacccccggcccaccgacgcggctgccccacgtcgcggggcccacgagtcggtggaacggccggtgcgaggtccggcagcgggaggggcgatgttggccgctgcgtcccctacgggtacggcccgacccgagaggtcggtgcggatccgaatcagctgccattactagtggcccgaaatgcccttgcgagacggttccttcgcgctggtgctggttggctggttgcctggctctgggagcggccgaacggaggggacctcctcgtgcggtaaggctcggccacgtcagccgttgggcatgggcccttggcgacgcgaggccgcgaaatgcatgttcccggaaacgccccgccgtatctttgattccctggatggatgcttctagagatgcctttcgtgtctcgcgatcagtcctgccacgagcagtcattgttagaacgataataataatgaactaagtcacgccatttaatttgattactagcgatacttttgttttcaagttaactcgaaaaatacgactatccggctggcagtagtagcttaaaagaatcacagttcgtttagcggctaaatatttcttttcagattaaagtccttctatggttcttttaaaagtaggattagcctcgttaaaaataactcggcaataaaaatataaggaaaaaaatgttatgccgtcaaagctaacgtataactatactttattatttttttgctctaaaagtatataaaatattaaattataatccatcatgtgtttagagatatagaaaaatgtctaagataggatttttctctttttttgtataggacaatttagagcttcaaatgtggtatgttagtagaataaacaataatatgaggagaaaaaacactgcagcctccctaagcccgcgcgcgcgcacacacatcttgctgtagcagtgtagctgcaaccaac

SEQ ID NO: 2024 - DNA, 1507 bp, Zea mays
  misc_feature (1)..(100): optimal_loci_19073_G1, chr1:107182199..107183705, Cluster 12
aaggaaaaaaaaattgcagcgagtgagccgaccgcaatagctagcacggagggcgacggcttaccacgcagacgcaggcgtggggccggggattttatttgaagaccagggtgcatcaatctgtctagccctcttgaatgtcccctcgtgaccaagggacgcagaggccagagcgcgagatctcagatcccaggccgcgcggccaccgacagacagatcggtgggtttgcatgcatgcacccacgcatgcaggcgcagaggatccgttccaggtagaagcagaggcaggcacaggcacagcagcgccccacctcactccaatggcggtgcttgacaggcaggcacaaaaggcagctacactagagcctagaggctgcatccatccaaggctccaagcagagatcacgtgcttccgttttcggcgcggcgcggcggtgcgtgcagcgtgcatgtcgcctgtgtgcgtggcggcggccggcgtgctccctccgccaatgcgcacatgggctgggacgaagcccgctcgccatgagtctcagtgtcctcagtcctcacggtgaacgccttagatacagccgagtggttttgggacggacaaacgcaacgcaagacaacagcagcgatataccaaaagttaccaatataattggattgagtacaatcttcatgtcctaaaccaagtcacggatctagcaatggtatggaactagatactcttatctttctctatgtcgtcatcatcattattatatatatccatgcatgtgccatgtcttgtaaccacataagcaataaggacctcctcaaccaataataatttcggttgttgtcagttgtcacgtacacgcggtacagtgtctcgtccatcggtaaaatggtcccggtggaccgacataaccatgcgttcgttatatgcatgaacacaacctgccacagccaaattatgtcaagtgaataggaaccttagactaaaacatgtgggggggtgaaactttgagctctcatatgatgaaattcctagagtttcattccctagcaaacagggtcagatgggttccgtctttttcaggggaatcaaaacacatcttcctctactgcatgtgatatggcattgtaataaataagtttttataacaaataactttacattaaactaagaacaacggacatgaagtatgtccaaagggacctagatacattagagattccactctcccttttctttgctagggtgtgagctgtggaggtctgtcttcttgagatttttgtagatacggtgtgcacactctgagcggagggatttgagctcttcctgaaatggaaaaaaggtctccaaggtggcacttgagtaggctcgatctgactgagccatcgtttggtttggatcactgtttggtacagagactttaccaatttactaatttagtctatctccagctacactaaatttcatcatttaagagaaaatgttttatattttttataacacactttaaaaatttttgtt

SEQ ID NO: 2025 - DNA, 1636 bp, Zea mays
  misc_feature (1)..(100): optimal_loci_202266_G1, chr5:186960028..186961663, Cluster 12
gggggacctgatctatctgactttgccaatttcactcgagggcgaatatcttctcttctcttgtatctcttacacgaaggagaacatatccgcccgatcaggtagcaatcattacactaaaccgagctgcagaaccagattctcgtgcttaatgatgcgccttatctctctgcacaacgcactaacaagcagcacccccttgtgatctgatcggtaaccaataaccacccccctgcaacgaggatattgctattttttcccccggcttatgcagtgcgcaccgaggtgctttaccggctgtgcatccaatccggcgcgcggccgggcaacgcctgacgacgccaccctgcgcgggacgaaagcctcacccacccacccacccacccacccatccactcgtgcgtgcggcctacgtggcgcgaccaccgcaccgggccaccggccgtgcgcactcgcccgccgacagatctcagcccagggcgctctggcaaccgggccggccgttcgccgcacccgcacgacgggcggtcactccacgctcagcgtcgcttgaccaccggcgcgccgttaggacacactggcaggaggaggccaggcgtcgagagcgcgacgcgggggccccctccggccgtcgtccgtggccacagcgggctagggaggccgtggtggctttatttcgctgtcactacctaaccaccacaaggctccgtcaaaggagcccatcccatccagggcagcgtagaaagcgcggtgcgccgtggcttttgcccggccggtgcaagaagcatcggtcagggacgggactagtagtagatcgggtgtaggcaaagcattaggtcgctttaatttaatttgggccgggtgctgtggccgatccatctggtttgccgttgcgtgactcctcgtttcggtggacttgtactcatgcttggatacggccacattaattttgtgtgactaatatatgtctgcgtgcagagtacatagcttgaacgatcagcatgtagtggagaacctatgtagacaaaaggatccggcacatgaacgccgagagacggtgaatagctagctagctagccaattaaaaaaaaaggtaaattgttcaagtagtactactagctagcttgcccttctagacacttgtaccgcaattgtctctcaagaagaagacctggccggccggctggggtgaagcggaggtcgacctacttaaagagctaaagtgcagtccaacatggcagcttgtggacaatatataatctactggccaaaatacacacacgagtgctgcatgcaccgtttcttcagtggtggcggtaactagctggtaaagaggccggcgccactaactagctacaactacgacttgagtgatgctgcaactgtgacagatcgagagctgcatttagcgaaacgaaagggtcggtgtagtgggggtggcatgcatgtctgccgcccgatatttacccagctacttgtcccggccgctagctgcctagcagaatcgattggtcggttcgcacagtccgaatggcactagtattgctgtcacgtcaaacatcgatcgtcgacctacgcatcattcagtaacgaaaacacgtagatataattggaaaaaatattttatttaatatta

SEQ ID NO: 2026 - DNA, 1425 bp, Zea mays
  misc_feature (1)..(100): optimal_loci_202513_G1, chr5:188476668..188478092, Cluster 12
aatgaagttaaaacaacaataaataagcaactcaaaacagctccaccaaggcggaccatatctacacgtgtaataatagtgacctaaagccacacacacccaaaaaagaccagaaaagaaaacagaaatgtgaaggaccaataaggattcagagatatcatgcttcagcatttggaatgcaagaattacttgacaatagcatggtcaacgtcttgaatgaattgaccgtcgatatttttaaaaagcacgtagtaggttttgcacggaggtcgtggtggtggtggtgcgcaacaacatgctcaagcctctagagagaaagagagggactataacagggaatagacgacgcgtttgcaactgcatcctcgcaatctgaaagctggcatgcaaatgtgttcccggattaacacagaatccagagagcgcttatagcaacataaacatgcattgacaaaagtcagtaagattaacaaaatctgcagcaaccatttttggagaaattccaggagcccccgattgaacaaaaccggtcgcgcgctggagtgtctggcccccgctagatccgcatcgaatccaaggactgtcgctgcaaagaaagcatggcatggtgacagctcgtcgacgaggcggtgcagtggagccctacaccgccggtggggcagcagaggcaccgtcacgagttcggccgccgggggccctctcccatctcgtcggccccgtcgctttatatgggcggccacggaggaccggcccactcgcacgcgtcgcaccggcaccgagtcagacgcccgtggcaatggcatgccatgccagccatggtttgctgctggagatcgagtaccgagagcagagcaggccagcagggcagtgcccagtgcatgcatttggtcgctcggtggtggtgcggttgcatacttgcatcgcaacaagctgtttttttcctctcctttcgctattgcttcatttttgtccccttttgctcttgtgttttttttctctctcttctttatacaagtgacatttcttttttttttcctccccctgtcgtgtaaagcttgatgttggatcatgcacttacgtggatgggatccttttccaacaggtttgttgagcattcctttgcaacacatgctcggaagaactgtttgtttgtttggagtagttgagaacattcgagtaacctacctacctaatatgtcgtagactgaccgactatattccaatttttttataatatctctgattgtttggtacggtgcatgcagttgtgtttgtgtacaagactgcgctgcgcagctcctcccggccgctgaggctgccagaaggtcgtcgacggcggcgaccgagagagagacgagacctttctttccttttggctagctagctagcgtacagctggtcctaccatgcatgtcgttggcgaat

SEQ ID NO: 2027 - DNA, 1914 bp, Zea mays
  misc_feature (1)..(100): optimal_loci_202616_G1, chr5:188822901..188824814, Cluster 12
aaggaattctttactcaacatgcgtccgcacgttggaatgccacacaatgacacaacaccacagagtgcccgtacaacagataagatgaaagcatacatatctaactaatgatgcataggtttattctcgtgtcctgatcttcatcaataatctctattttaaattctaatatatttagattttttagatacattagtttaactgttgcgtactgcgtagtctatatcaaagtatatataaaaactatatatctaaaaatggataatgtcttgtaatttaaaaagaggaaatggtgtatatatgtggagctaaacctatgcattttattaggttatttaaaataaagtaatcatgtaacatggaaaacacagttaattaataaaaaataatatggaatgcaatataccacaatactttgcaaaacataacatcatatttagaccttggttcgaacctctagagcaaatatttagttgctaattaactaacttagagctaagtattagtttattagctttccaatttagagactaaattctgcaaatattcttgaagatgttgttatttgagcattttgggtttgtgcaccacactctgtactacgaacacgagcattccttgcgctccgtacgaacgaagggccggtattatcgccctgtgtgtccaaaggcgtttgcagatcgggggagctagtgctacgaaagggaggagacaccgtgcctcttttgagcacagccggctcctgcggtgccgcaagcacgccaaaagccgctgcacccgttcatcaccgccgcactattttcatctttccgaacgaaaaaagaagaagaagaaaaaaaagaagggaaccgccgcttctctgtctccttgacccgacccagcaattgaggcatcccgtcggctgctgtggaaacccgtcacaattctgaattcacacgaaatagtcaaataccgtctcatctcggaactcggataatttaaaagaaaaacaacgccatggatgagtcttcgagtgtgtccaccaccaggtcgagacatctacttttatcatgtggatgcacgcacacatcaggctcacagtcacagtcacagtcacagtcacaggcagggccagggatcgatctcgagctagccgcccgttgcaggcggtgcatccgtgctgtggaggagaaaagaacgtgccgggcacgtacggcgcgaatggacggactcacgcggtgggccctccttcgtggtgtcgtcttctctaagaaaggcaaagccctctcgccacagttcgcagtcgaccgtctcgcgtcgtccttgcggagtttttaatcaagggagctcagctgcctgaacaacctcgccgctgtcgcatttaactctcccttattattggcgtcgagaaaccttaacttaaccgtgcctgcaatgcaaagcaacgcaacgcaacgcaaggaagcagaggtagcaggcaagcgcagaggatccggaaacggaggcgacgtgctggcgtttttccagaagcttgggagtttatgggggagctttcactttcaggcagctcgacgatggcgttggcgtggtcctgctgcctgtggatgcgcgcgggaggacgcagccttgagcctttggtttgtgccgcgttgttctgggttctgacggtacctttgacagcaagttactgacaggcaggagtagtacacgcgcaccagcaccagcaccagctgccgtgcatcgcccgtctggcgtagtaactgccgaagttccctttgtgtcgggtcgaatgaacggcatgcagagcggttgcccggcccgaaaatatgtgcttttgtttggacgtgtggccatctctgcccacaaatgaaacgcagtagcatggtgtattggtgtgccgggaagaaactgcaacgcgttcgtcagaaaccagc

SEQ ID NO: 2028 - DNA, 1714 bp, Zea mays
  misc_feature (1)..(100): optimal_loci_202987_G1, chr5:190741984..190743697, Cluster 12
tccccagccgggaaaaaggcgtctcgctcggctcggctcgccctcgccgcgtgtgggggatcaccgaatcacgggccgacaccgccgccctgggctcctgctacccccactttccacggcagccgctcccatcgcgggaggcggaaaacgatggatcgggcggggggcgggggcgcccacatgcggtgagcgcggatcggatggtcggtgtcgcggcgcggtacgcctcgtgtggcgagagcgagggcgcccgcgcgggagggcgcagcctttgtgtgaggtcgccgcgaccgaccggcgtgtcgggccggtgcctggggggcatgggacgggacgggattgggatgtgatgatgcgtacgtctgcccggatcggagtgccggtgcgccggggctggcaggcaagctgctggaacggcatgttcgggtcagagggccccgtgcttcgagtagtatgggctttgtgtgcttggagcggcatatttggatggatcggaggactgtagcccgtaacgacaaggaaatgtggctactttgaatctttactactataaatcttttgcgcataaaaagtctactagttattacatatgtgtcgctgattctagcgaagctgtcgtcgctgcgtcgtggtcacgactccaataattcttacttcactggccacggaaccgggtaaacgtaaatctctaccgaacggaggagctttgattcgcaggcctaggttaggtcacatatcgatgttgaccacacctacatctcgatcgatatatacattattattattatatttcgatagagtgcgctcgctccgcaacgtgtgttccgaaagattctcgctaccggctgagtcatctagggcacagacagcatcgcacatgcaaggcagatgcgcccgcctaggtgtggccgcagtacgtgtgcaagtgcagcgcaccacggcaccgggtcactgttctccccgaggcgtggccgcgtgggaagcggcgaagcgcttcctttttttccctcctccatgcatgcatgccaccgacgtatcggttcgtgcttagcgatcagagagaaccatttcaaatcccaggcaccctggactggagctggtgcagtggagataccaccgctggatcggtggacagtcgggatccacgaaaatggagcagcgtcagcgtgcagcgatctccaagtcctgactgaagctgcccctgagcatgtctatatattgtgcagtcactcaggcagatgttgggccgccaactctatggtccatgggcctcggcaacttttttgttttagtacaaaaagaaccgatccgtcaattactgggaaacagaaccgaactgccccctccatcttctgccgtctccctccctccgtctttcgttgagcttcccctcctgtaattccagagccctcagccctctagttcgttcgacttcagtgccttcttggtgctggactactggttactggtggaggcagcgtaaccggctgttaacaccagatagccagagacgctatggaacagctaagagcccgtttggtagccttccggctctggcttttctattaaagaaaagagctcaccaaacatcattttttaaagcggtgtactgccaaaaaaaaactcctaaaaccagtagtgttggtgttttgtatctcgctccaaagtaaatttattatacgcgttttgagctccggagggtgtgcgcggaggg

SEQ ID NO: 2029 - DNA, 1902 bp, Zea mays
  misc_feature (1)..(100): optimal_loci_203012_G1, chr5:190955237..190957138, Cluster 12
gatttaatccatatctaatcaaaattgaataggaagagatcaaatctcccttaaccccttacactcccatgtaaatgaatatggccttaaggcttagtttggatactatagaattgagatggattttaatctattagagatttaaagactccaatccatctaaaccgtttcaattcaagagtactcaaactagatcgtaaatagctgagctatctatccctagtaggtaattaaatccgtgcattgcgaagtctagtgtgtgcatataagctaataaagatgagaaacatggacacccacgtgaaaatgattaaaatcttctcaccaaacattttttttcgtgctagtgatcaccgagcaattgccacgacacggacgtgctagtaccgcactcgaagctgatggcgcaggccacgcctctggaaaaaggggcgggatccaggacacaagcggccgggcaaacagaagagcggtgccaacgtgacatgccgggcggttggtgggtgagaggcgcctggcggacagcggactacaggcaggactgcaggaggggttcgcgctcgcgccatcaccgcgaggcgatggatggacccggggacgccgggccgacgaacggaaaagtgatggggatgccagagtacgacgtcgctcgagtacggcgccagcctcaccgccgggccgccaccctctcgtgtcgcttcggatgcacgccatgcggcgtgggaattgggatgggatcgtgtcatcatgggacatgcggctgggactgggagggatcctgccgcgcgggcgcgcgccattggatcgatcattggatgagtgcgctgtacgcaaggaatccgtcggagctgctctgccggcgacggcgaggcggctcatggtgggtcgcatgcacgcgcagattcaagcgtttcacactttcgcagcacaggttgtgtgccaaaaaaaacagtagagtctgcttcttggccgttgagcgaagggcaggtcgggtgaagccgttggagcggtgcgtgccatgcctgttctgttcattatattggggataattaagctgtcgttttcgctgatgatgatgaaaggcgatttcagcctgatttctcgctccggcctggcgcatgcacataaattggcggagcaaggtgtggttggacgggccatggcgccatgatgcggccgtgtggagccgtgacaacgctaagcacgactgaggtgctaggattagtgctctgcgcgcggtctggaccatgagcccatgagttcaggtctatatatatggcgctagagatttacgctgcaaaactcaatgctagtcttccgtgctcagggtaggggtggaaatatcttctttttttttcatcgctttttatgcctctcagtcgcctgactgctcaggattcgtctataataacgtgagtccgtgactattctgaaccctgctagtagtgatcatatccaatccaccagtatcccggtgactatcctctaacctctattgcctgaaaaggaagagagatttcagacgtctgttaaataccaatttcattttttttatggggtagaaattgtattatttcgtatctaataaaactttaatatagatatatagataaaatacctcacaggtgaatgcctcatctagactgaccataggagaaaaaaggcctcaccggtgaaggcaataaatctctggatcacaaccgagaggcagccactggctctgtagtaggatcctccgccaggagagagggtggaaaggagcaaagcaccaccgccggtataaggaccgaccgccaatgaccgcctgacgaacttgatgagcccacgaggaaatcaatatgttcagaattcccgatagccagaaaacatgcgactttcctttttctaattttaatatatgat

SEQ ID NO: 2030 - DNA, 3826 bp, Zea mays
  misc_feature (1)..(100): optimal_loci_203075_G1, chr5:191370802..191374627, Cluster 12
taaatttgcaatctttttgcgtacgtgatgtcactgtcacacaagggtccacgtactagcagcagccagaaaccggccagtgtggatgtatgtacatgtggatttcccgcggcgcgtactgtcctatagcggcagccggcactcaccggcggaagccgaagcagccatgcgaatatgcgatcgatccctttcccctgcatgcgatgccgacgacgcagctgccgcggcggcgtgcctagccgctggcggctggccacctgtggcgtaccctctccgtgcaccgtacgcgcggggacctagcgagcgacgcgtgtgtacagtgtaccggtcgaggccgaaaacaggacaggtgccccccgaccgcgagcgagcgggcgcggcgcatggaatgagctggaacagcagcagctgaccagcgcggctctgctatctctggctgtgattgccccggcagcactggcgcgcagcgaggcggttcctagctacagcgactcgcgcgcgtcggccctcggcacacagatgccagatggcctgctcgttttctaaatggtctcgcagagggggcaaagtcgtcgcgcgcgtccgtgtgaatcaccaccgtcggatcacaggagccggccggccggaaccggcctagctagctagcgctccaggccaggcgggcgtgtgtacggggtgacctgcgcatgaaatgtgattgccattaataaatgatctcgcaagctctcgcttgcgcagtgctgtgcacaatgcactgctattcgccgcgcgcgtcgacggagaacgattgatcgatgcttgccgaccgatccgcatcaccggaatggtatccagccccccgcctctctctggctcgccgtccggccgccgtcgctgttcgttctacctgctcaagactttggagcggctgactttttttttgcggtgaaactatggttgaaagcatgcgtcgacgtcgtcgtcgttgtcttgcgtatagatgctcgctcatcctgtcaccgaacttcatgtgactgtctctgttggcctggctagctggatttagatggagaagacgctatcgtctttttgggaatttctgaatacaactatccggacacgtacgtctgcaaatctggtggcctgagagtttttgaaacccacataacaattccgaccaaattttttttttctgtagcagcacatactccgtcaacagagagggtcaatttactttgaataaaaagtaaacggtttacttgaatttatttgtctctttcgggacagcgggggtgtgtggatagtaaacgggcatgaagacagtgaaatatattaagtagaatgagtaaacaaatatgctaaaaacatgagggcctcggtttactttgaatacaaagcataaaaaggatttgctagaaacgctgaacagcagctagctgggacaaaagctgccatcaacgctagctaacacggtttcgtccgcgtcgaaagagacaagatcgaggagcttaagtcagagccttactagtcgggccggggtattagtcagctggactagccgggcactgttttatggacactggtcgtcggccgtttacactccaacctgcagacactacgtacgttgacagcggaccccgcgtccacgatcagccctgatgatgcaaaaaaagtcagcccttgaatcattcgtgaaaacgcagttaataatagtcccgatcgacatgcatcgtcgtcattcgttcgtcagccaccctagctgtgccgtggctccggcctccggcgttcatctgttgatctgcctgcctgctatgctaccagtcgtgcgcagcgtgcccgacaagttctctgaccttttgcacagttcgaacacagaaaagagagccgccagctgcctggataaggagattggaatgcaggcccgcattcattgcgatgagctacagctagcttgcaaagcggttagcagctccctccggcgccctcgtcacttttgacctggaccatcaattgaagccggttcgttcatcctctcgtggcattggtttgcagcacaccaccacgatatgatgtccagttttcttcttctgatgatgatgatgatgacaagagcgcggcttacgatggccagccgaaacggagaaagatggctgtagctgcatgctgaactgagtacgtctgggatcgttcgcactccgttgatccgttccggtgctttttttccccccatccgtgtagcggaggctgactttgtttcgatcattcaaaccacgactgctgaacatcgcatggatgtgtcctgcacatggctgagctgacctgtccatatcggggccacgaaacggagcccccggcttgtggattctaaacccgcgcgccactaattgcctgacgcgcgagagacacatgtgctccgagatatatacgtactagctcctagttttcagtggattgatgaagcgccatgaatgaattgaatcaactgcggcattcagcttttactttgaatccaccattccacgagctgtcctgaccgtgtactactacccattccttcttttctgctccccaagtgcatacaatgcgatgctatatatgctttgaaaaaaaagatttaacctactggtcaaaaaaggccgtatgaaatcgccttgctaccccctatccagcgccaaccaaccaaacctctcctctcctggttcctgcgatgtggctgtggtcctttaacgaactgcgacgacgccagccagagccagcctcggtgctgctgcctatgctaccatggagaggctggaggtggaccgggccggacaagacaacgtcgtcgtagcgtagcgccctgttggccacgcccagtaacaaaccgcagcttgacccgcgaccggccggctgacctcgggatgccaaacttcctcgctcgttgacgccacttgctttgcgctttcgtaaacccgagacgagtaagtttttgcggcttttcatttcacctgcatcgtccagcaccagcagcgacctgctatgctaggccgtatcttggcctagctggacgtgctgcgtacgcccgcttgttttaatttacagatgctttaaaagacgtagcatctatacagctttctttcgtggaatggaatggaattgcccctcgatcgtcgtctacgagactgacagggttgtagggtagggttttttttgtggcgcatgtttggctgcgctccatgatacatttagagccagagtgtctgccattttgtggaccatgttgctactggtgtactacgtgtagtagagtttaattagggaagatatccgagcgccatcagccaaaaataccgttcagaacgcaattactatgacacggcaagcattcgaagctgaaattttaaacgggttttcgtcaccgcgcgcgtagactgcgtcatgaattaaccgagagattaaaaaatccctttttagtactattagtttagacttctcgccatctcaacggtgtgactctcacggtctctgatgacactagacattcatttctctccttaacgagaactgctgacgtacggaagccgtttgtctctccgttgaacgcagatgtcttaaacccgtcttaaaattctaaccggcgatccaaggagagacgcattccattcactgcctgcctagctttgatccattctgcgatttgagcttgcttgctgaacatgcggcgcgacgactgatttaccggccggcccgaaagcgaaaccacgcacggaaggcactccttgcttagacacaaaattatataggttcggaactgtagaacaaacagtctatcgtacgtctagtctgatccataaggagatccggacga

SEQ ID NO: 2031 - DNA, 1879 bp, Zea mays
  misc_feature (1)..(100): optimal_loci_203173_G1, chr5:191898988..191900866, Cluster 12
ttgattttctcctccacgacacgcagggcgctctcatggcctcagtctcactcacctcactcacccatctccgtctgcttcatgagagagagagagagaggggagaacaaagtgaagtgcgagcgtgtggtgtgggtgtgtggccggccgctagctgccgggggtaagtgcaacgggtttgccacgacagtctcactgcacctaccagcggaaggagaggcccgtgtctgtgtgagtggagtgcttgctcggctccatccagtactagccaatagcaacaggcaagggggcgggcagcgtcgtgacgcacgcataattgcgatcaggaacgaactgaactcgaacgcggcgcccctagttacgatgatatgattcatgcatgcgcgcgctaccgctcggctggacgaccgcggcggccgatcgtgaccggccggcgtagcgtagctagcccggccagccgatccagtgcttgccgtcttagactcgataggcccaccatgcaccccacgcggttggtaggagcgggagcgggtccgccggcgactgttcgccggctcgcggcgctgctgcgtgctgctacgagacgggttcgagggatgaacgtgaaagggagagtaggggacggggcctttaaatgcctgtggagcatggctagctagctggacgcgtgctggtccggagtagtacgccggagggaaacaggactgggtgccgcctcggtgcgcgcggcaatcaatactgtagctggatgctggagcaaggaggaggaccacgtactactaccgtctaccgaccagcgagtcaacccaacctcgctcccgcacagtgctccaagacgattctggatggagggtttatttccgtgggaaagtgttttttttgacgatttgaccaacgtggaacacgaaccggagatccaagcgaaagaggattttttgcagcacaattctcatttagcgcacgttaattcccagcaaaacaggtggtgcgcagctggtacacgagcctgaactgaatgaatgaatgaatgggcagacagccgcacaccgtgtgggcagcaagcaaactactgttagagggtcaaacaaaaataaataaaaacgggacgtccgtgcattcgttcattcatttccaatggggcatggcgaatttgcgatgcctgcgcctttcatgccatggctggcccatctggccgtcgagtcgagaccaaccgcaccccagcaccacgcccaagttcaccgtgaatgaatggatggcatgcatgcacgatccatcccagtggtgagagacgctcagatgcagatcatatatccaggcgcctccagtctgcaatcaataccaggcagcatcactgaatgacatgactctcgagcgcgtgtactactactctactagcagcatggcagaggcaaaaaaggagctgcagtctttaccaacctgtctccacagaggaacaacaaagacacaccatcaatgagctactagtatgtgccgcccgtaaatgaatggagcctgtaaaaaagggtcaggaattacaaacgggcccgtccaaagatccccccatgattactctcgatgcacatggacatggtagcgtagtacagtacacggctgagatatttttcagccggcgataagccacaaataccaccgggtgaagatataaacttaattcaacttaaatttaattcagtatgttctagatctagaattgtaattttttagagggtctagggagtactgtataagaaacttagctctcgaagtttgtaggccaccacgcgaacaccgagcattttactctaatctcactatctagcgaaccgggaaaaaactaggctacgacgatactggtctctccccatggctggtgtccaaa

SEQ ID NO: 2032 - DNA, 1990 bp, Zea mays
  misc_feature (1)..(100): optimal_loci_203200_G1, chr5:192164126..192166115, Cluster 12
tctggaactctggaccaggtttgcttgtaaccttgggaagcagcctataccaggcacctatgccaggcccaagcttaagaaatcgctatgttgatggatgcggcgaatacatatcaagctcatcagtcgagcatgacactcctccctctcctcacacaaacaagtgatgttctagatttgtctctgaaacatgatactgttttttttaaaaaaaaccacaacgttagtcacgattgccagaaaaaaaaactttggaactatatcttgtgtcataataaggtgtcatttcacattatcatatgaataaatgtgtgaactccatcgcatgtggcaatatgggaggctgactgtctgaatatacatttgccatttatatagtacctgccgtgcaaacacgattcgcatatgaaattcaggacgtgattcacgctctgccttctatttttttaaagttaccgttccagtactcgaccgtcgtttgagctctgagtctctgactgacaaaaaaaagggagcggtggtatgaaagagacaaacacatgtccctgaagcacgacgctcctccgcacctgcactgcactgcatggcgagggcgactgacgccgatcgaaggggacgctacctggtcgccgtcgggatcgccatgtgctacagacacgggccacgagctaataatttcccgcaacggcgttactccaactccagtagccgatggacgcagccacggatgagcgcatgcacgtgttctgcgccccgccctctgtctcggacggagaccgacggacctgtaaaaagccaagccgttcggttggtgtgtaaacgtcactgaccgaggcgagcagctgcgcggccaccaccaaccggtcgagccgtggcccgtggatgtagctggggccggtgtggggagcatgcatatggcggctcggcgcgaccgccgtgccaagccggccgttccctcgccgcgcatgtgagggcagatcccggcggatgcgaggccgaaagcgaccagcacatgcacgcgccacactcccagtccccggccccgccgtacgttagctattccggcggtcaaaacttgcttaacatgtcacttggcgccatccagtccagtctatccatgtacctgcccagcccagtagagtagtaccaccacatcgaccgttacgtttcacaccgacggctgcacgctgaatattgctggcgccaccgcgggcgcgagggctgttggataaataaataaattctcgaacgtgttgtaatttgtaaactgcggcagcgtgtcggagcgatttgcgtcgcctaatgtgcgtaacgccagacgccgacaaagattggcagcagcagatcccagacagcggcagaggttcttccgagcaggctcacatgccgggggcgattttctacggtctctacccccttgtgctcttggagtgtcggcgtcggcgtgtccgcacgcgcacgtcgatggcgcgcgccaatcaatttaccggcgggtataccgcgccgatcccggccgatcacgcacgccggtatcctgtatcgctctgccgcccggcgcggtgcccgtgggccaacgccggcggttggaggagctgcctgtgtggtaggcgtaggcactagtacgtgttgcgcgaccgagcgacgcgggaccacccataactgtaacaacagtcgactttgatccttttccggcttttgtcctctggcccccatcgtcccctgccattgcggtgcgccggtgcccctgcccccaccatccccatgtgagtcgagtaaaaactagcggacaagtggcggggtttcgtcccggtccatgtcacgccgcgccggcgtttggctgcgaccggcgggggccgctctcctgccaccggcggtgcagtggcagtggcaccggcaccggtagatctgtagctgtagctttggagtttgaactgccgggttctggaagacacggcgggggccggcgtccgagagaatataattactgcag

SEQ ID NO: 2033 - DNA, 3948 bp, Zea mays
  misc_feature (1)..(100): optimal_loci_203704_G1, chr5:194836270..194840217, Cluster 12
gaactacggctaagtacgatacggagtacggatcctttacacatgccttcgcacgcgctagccgagcgacccgtgttcacatgacaaccatcggccactctcttgacgttccgttccgtcctccatcgtcgtcaaaaaggcctcgcgaaaacccgcggctactggtgcgcgcggtgccgggggtggtgaggaaggaaggcgcagggcgtggaacggaagaaggcccacagcggcagctccctcccaagccaaacccccaaccacggccacggggccggtggctggcctggcctggccgcacggagggagatcgcactcaccacaccacccatcgggccatcatcgccgaacgcctgggtccctccgccccgacaagcgcaaaagtggccgcgcacacctgcggtctgcgtggccgcccacccgggccccgccccattcgctagtgcgggggtggggtcggtcgggggtgcggtgcggtgcgggtgggagggagggactgactggcaactgctcctgctccgtcaggctgctgctgctcccctcgcccgctcggccgcgcgcgaggccctgggccctggtgtggtgggggcgcctggccgcggccgccgaacgaacgcgccaacgccctgagtggtggtggtggtggggcgcatgatggccacgtaccattattgtcggggcgggcggctgccaacggcgatccatcgaaattccttcgccgtgtccccattcacctacaactgcgtctgggcatctgcgtgcatcatcaggagagcccacctttggtaatgcttttgcaggcttccgccggcgtccgttcgttgatctaccatccatccgcatgatctgcccgctcgctgcgaaaagcacggccttgtgcgcttctactgtagcaggccaccaccgggggcctcaggcctcagcgctgcgagaagaaaagaaggcagtatgggtaggtaggtttggaaaagggacgatatgacactcctggggtaaaagacaccaaaataattaaacctagctttgccctagatcatcatccgagctcatcagttctgctgcgcccctttcgtctctctccctcttttcgctgtcttttctgcgagctagctccatccatcacgatcgctgatcatcgtccgctttgtcagccgcgcacgtcgtcgataaggcgccgacgaccggaacaaacgccgcgcaaagccagctgtcgtcgtaataatcaactgcgcctgcgcgcgcttctcggccgggcaagtacgagggtgggtgatcgaggtcgcgctcgaccattaacctagtcgtagcttttgtcaaaagcttgagatggcgagcagaaaccgcgcgcgcgctagcttttggagaagtagccgtcgacgatcgcaggttatcctcgctcgctttgagacggaacacggatggcctgcaatgcatgcgctcagccagtgccgctgccgcatagatagagtaacataaactaaagctccgtttaaaactcctagacaactaatagttaaccagctaataatttatcattagctggtctaatgaactaattgtttgttttgaggtagatagtaattagctgtggtattaactgagggtgtttggaatcaacaactaatatatttagtagctaactactattagttatagacgttgtaaaagtgtagcagtatttaaatgggatgcatgcgtgagtttagtcgcaaaggcggtgactggtctgaagggaataaagctgccgccgattacgcggttgctttatttgggtgacttgagacccccggcccctcttctgttgagaggataagctacatttaagtatttaaccgcatcggccggccggctctcgttcatttccatcatgactcttgattgtgctgtgccgtcgtctatttggcgcaggacggttctctttttggagtagcttgagcctagcctagggcactaggatatctgttaggtcatcgattagttaatacgtacagtagcttttgccgccttgaaaatttctctacgtacgtacttgtacatacgtggcccaaacaggttctgttttttatctctataaattacaaccggaacaattcaatggctttaatccagccgcagcgaacatgctttgagtccgctcgggtcccaacaactctgttgagctcccaactgagtagtaatactttacctggttctcgtttcgcgtctgcagaagtcgcaccgtacagattgcgcggcgatctttgttgtgctcgcgagtcactcatgcgcttgttgcgctgttgcattgggattggattaagtggtgtggtgggttgagcggggtggtgaacgcgcaccacgttcgttccatgccgccgttcgtacgccttattacaagtgacgtacgcccatgcgctccctcctgatcgcgcgtggacggacggcgcagcgcaaaccaaaaaaaaaaaaggcgaatcgcagtgtgctccgccctggagcgagcggcaacgaggtccacacagcaaccgacaaggctggcgaactttcctgcctacccacgagacaaactactactactatacgctaacgctacgcgagagagtcgttgatgccgtatatatatgatctcttgcccccttctccccctgcttggcagcacatgcagcaacgacgtactcgatcgatattgtactgtagactgctggccgccggtttgctttctgctgctgctactaatttatgaccgcggcatggcggggaaggcagcacacagcgcggctggccggcagccagctgtgtcccggacacactgcggccggcaggaaagccatggcaggacaggagggaaatggatcatgcatgcatagctcggtggcgctggcgctggcgccgcgcaaaggtccggcggcagggcgcgtgcactgatttccactatgccggggcagagggggatcggacggaccatcgtcggaacggagagagcccaagcgccgctgacatctttacgaattgaatgaagcctgctgccacgcgagccaaaagcttctcttcctttttattgttgttgtgtggtggtagaacaagtagccaaccctagggcggctttctactgcaggctatcatcgcgccacgaccgaccgaaccgcccgccgatagtggcctaccgggctacttactactgctgtggcggctacgcgggcgggcgcgcgcaactctagtgtaggcgtgtctctgtgcgcctgtgtctgcggagtgcggacctgtcgcagctccggccgatcctcgccgcgcccacggcccacccggcagcgtgcatgcgtgcacgtgatgctcatgcgccaccgaggctcaggtcggtatcgttcattttatgctgccgaaggctacacgacaacagtcttctacgtgcagcagctttggcctgctaggttaggaccgctgtcgctagctagagaggcgtcggctggtccaactcgtgcaccataccaagagtgtacccaggttaccatggattgatgtgccgcctggcatgattattctgatcaaatgaaccagatcataatttttttttcataaattatatagtattctatttgaagcgttgcagctgatgcgcttgctgttttcatccactgttgttcgtctcccacacttgcagttatatatagatgagtgcagctacacaaagctcatagagggttgttcatttattcacattcaccaaagatgaatctatcggttctctcatgtcctctcccctgcaaattaaatccacggtttcagggtgcccactgtatagctattgcaaacacactgtcatgtctacactcgatattccctcgctcgatagctattacaatgagttaaataactattacacttcataattcatgtagattaataaagaaatacaaagaataatggaactcacacctgataccaaatatttagacataaattccattttac

SEQ ID NO: 2034 - DNA, 1906 bp, Zea mays
  misc_feature (1)..(100): optimal_loci_204246_G1, chr5:197788812..197790717, Cluster 12
tttgaacgggggattatcattagtaacaatgcaacaaacaagttacctccttgcattgtactactagtactaaacgtatttgatagaaaaaaaatttgttgttgctttccggtttggttctttcctatagcctgcagcaacacacacacgcgcgcatagcttaactgccaagtactagcaagcattggcgtgcgtaggacccaaagcggacgcaggcagagttcattgaccagtagcacgtacgttctagttgcgagttgattgggatttggtaaacatcattaggacaagtagaacaagcctctccctcctccccctcacctttcagctaggagctagcatggcgattgaagcaagaagtggggacatacaaaggcagaggaaaaaaagaaagaaaaaaaaaatctatcgctgcccacccccacctccacccccactcccagaatatttctcgagaccgaaagatggaatgcaaaagagagacggccggctggctggctggctagctagcctaagctagagaaagaatcaaatgctggccatctttgttcccaagggtggctgtcagctgatgcagcgctgcatctaccttccttgcaaacaacctcgctccgattgttttgttttgccgtctcatttatttgttgggcgtgctttttttctttctttctttctttctttcgtgtctctgcatgcgtcgtcgtcctcctcgctcctcgacgatgcatccgcacgtgactgtgactgcttctaggttttgcacttgtacggccatgatctggagagcgtaataaagtaatataagcgtcatcagcggtgatgacggaaagggcaaataatactatccttgttgggtgggcatagggttattagctacctctggcttaattaggctagctaccggctgctttactaccatctctggagagcgcgcgcgaccgtttggcgaattagagaggacggagaaaaggttagactagaaacagtgcccctctctccctcgcgcgcgcgaggcgcgatgcgtgctagctaatccgtgacctaaattacacgtatgcatggctagctagctagtacgtacacccgtgtccacacgcgagcgagaggtagtagtactcgatgatggactggaaacgcgcgcagcatggtcaaatccaatgtgtgtttgggttgtcaatcaccacgccaaaacacctcatctcagctcgcataggacaaaggcttgagcgttgccatgcgatgcgcgtagtattcttcagcagctggtagtagccaattagccatttagccgttgcgtacacacatgcatgcatgcgcggagacggagcagctaggcgtgcgtgcgtgcgtgtttcctcatcaacccattcctgcgtttgccgattattattattgttgttgttgttaggtttaggcaccaggccggctccacccgtgccgtgaacggccggtcaaatccggcgcgcacgcacacggttcaaacgcgcgcgacgacacaccacacgggacagtttcgccatcgggcggtgacgtgcgtacgtacggtggtgattattgagcgggccgcgcgggagggacaaggtcgcatgatgcaaggcacggcagcttcgtaccgtacgcccgccccgcccgtccccatccccaacacgcattaagtgcggccgaaggaaaggcgcgagcgagcgagcgaggcggagtggtgcccggaattaattggatcgagaactctactctactactggtggcagatgccatgccgatgccgtgcgtgcctgcgctgcgctcccggccccatgatggcatcacaagtatttccccccggcccggcggttggggttgggttgggcgggcgtggcatgtgaacctatcctcctctctttttttttctttttttttttcaaaacgc

SEQ ID NO: 2035 - DNA, 4044 bp, Zea mays
  misc_feature (1)..(100): optimal_loci_204612_G1, chr5:200117168..200121211, Cluster 12
cgctcctggtttagggtttatgatttagatttggggctataattttgtattaatgggatttacaaattgttaaccaatgtataccaaaatttgaattatacctattgtccggactgtattgtgtcctaccattttgtattactggttcaaatgggggcacaaaaactctgcctttggcaatacggcatatggtgcggtcgatcaagttcgatctgcatagcccctcgagaggctttgcgaaaagaagcgttggcaatggcaacgttaggcccgagcgcagaaaaaagctaaagggcaaaaactaaagcgatcgagttgcggtggctgcatgatagtttcttgagaacacacacacacacataaaagcaggtcgccatggcatcgagggacgggcatcggcacttgcccctgccggctgctggcgctgcatccacgaatggccgaggggacagtcggacacacacagcatggacacgatagcatggtcagtagacagtagtagctagacagggaagctcggttcagaaaatagtaggagtgcacgcagattatctgctgcgtgccactgccacgccacggcaccctgaggtcacagaccatgcatgggtagctaggaggcgtaggctgcttgaccaccgctagctagctggctgcttcgacaaagcataaaacatcactagtacacgtacgctcggccggtgtctgcctgccgcgaacgacacaccactcttggttagcatggtctcgcaatgatgcctttccgttccaccaccacatgttttgccggcacggcggtaatcaccggcgcaaacggcaatcattcggcgacagctagcccgcccgcgctgtctttaatctgctcggttatttttagagtactactagatgaagcggaaaaaggcagctgatagatacaaccgatctatggctgggatgcaaacggctacgtatactacactacactgccggagggacagacagggagtcgatccagcgaagaatctattcaaaaacacttggggggagctagctagttattaattagcagtagtagagtagcagacggtcgctgctgcttcgcgagtgcatgcagcgatgtccacaggctcccatcccagcagacgttactagttccctgatcccaaggcgcatcgcatctctcgcaaagaaagcagattcccgctgcaacagggtcagggggagagagagcagggagcacaggccacaggggcagcaaaggtgttggcttggctgtcgtccggcgggcgggcgccaactttgttgcaggcgacgacgaggggggcaaccacggtccgcaggtacaggatgccgttttgtttatagccgtgcgcgcttccttgcgtgcactgcacacgcatcccacgcggggcggtcaaagaggcgcatcgagcgcgttgcttctgtacgggccgcgcgcagccttcttgtgaactgggctctcgctcgcgcttgcacggccagccttccggtcccagaacgatcatgacgaccgaactggcttggagaaacggagccgactgcagttcaaatccctcggtactgtctgtacgccttctgaagttctgatcgacattggatttataccgacaaccatcgtcgtcttttagccggtggaaattgggaggaaggaatgttcgagtgcggctgctgaaccaaccagacggttcctagtacaacgcatgctccgtcttttgacgcatggagaagagatgtgggtagtagtcacgtagtacgatcgcgagccgttctgtctgttgccggccccaaaggcctcctcctactcggctgagatgagctgagctgagcgagcacaggtcagaatcagatgactgggatcctaattccgaagggcgttggatactgtgccaggatgccactagcactactaccagcagtagagtagtagcagctgctttcgttgcccatctcgccatgcacggaaacggccaagcactccattttggcccctccgatgcgcgcgccccggggagcggggaacccctccgcgcgcctttacgccggatggagtacgctgctgcccccggtgcctggccgttccgacgtttagccgagcccgccgcgtgctcgctggcgctggccccgtcgaaaacgacgggacgccggctccgccgctgcgctgcgctccctgtggcgccgcccgcaggccgcagcggacagatcgaggttttccaggaggaataaaagcagagcgcagggcgcgcagatctttcacgaaaggggggaggggcgaggcgagcgggcaccgggcacgagagcggatcaggtcatcaggatggctagcccggcgcaaagacggccgcgaactaaaggcggtacggcgccggatgcgtatgcgatcgcgtcgggttgggttgggttgggtccgtgggcagcctttggggaaaggccactccaactcgaataagtactccatgctactccgtatagtttctggccgctgttgcttggcgagcgcgcggctgcctcactgtccccactcctcagcgtcctgtagctgtaggggctgctttgggccaagaaagggacggtgtgctctgtgcagctgaaagcctagcccatcccggcccaccgaagcagacagcacacagcagaggcctaataaaagacccgcatcagtcaccgtttttttcggctgctcgctgttagtaccaaccaaccaagcatgtctcagaaagaaaacgtgctgtgccttctgtggcgcagtgctctcacagtagacagtagtagtacacactctgcgtcaatcgattgcgcgacggacatggaagtatggacgaggtgatggtcgtgtgcacagaacacgaacaaatggagcgaacgatcatgcgatccgggcgacgcgtctctttctcttcggtcggccgattagacggttcgctctcgattgatgatcccgcgcgcttgactcagccgtcacgtcggccgcgccgtttttgagggttctgaggagctttgacacgaacggggcgcggcgaccacgggtggtcgcgagacgcggccgcgccacgcggccggcccccccgtgaacgaaagcatctgtgtgcgcaggacacgcacgcacctgcgctcgctcctctcgctttcgctgaaatccactgcgccgcgccatcggcattgccgccgccgtccctcggtgcccactgcccactgctttctctcgctccgagccgatgaccagccccatccatgccatgcacgcgtgcttcaaagggcatcggcgtctactccagccatcttatcatcgctctgcagtgcagtgcagtgcgtggaccgcagcctgtcgcgaatgctttcgatcacaaaaactctggaggcgacagaaaaagtagctaggagggatttagaggcgtgctatactactcaaaacgcactgggtgtgggtgttttgtgcctcgctttcaactttcggagccgttgatctggctctgaccgagaggcaaggcaatatacactggagtgctggacaaaatggtttgcgcgtagatcggtcatgatgcagcgctgatacgatcagacagacgctccgagctccgcaaagacgtccgtcctcaggtgccgagagcaaacacctgaaaacgagatgacgtctgtcgcctactaggtgtaccgctgtggcgcgacagttgcgtcacgctcttcacaccgaaagagtacagggaaagtatggcatgagcatgacactgacttggtagcaggaatccactactcctattccgtcctggaagtggaactgtgtacctccgtaccagaataaccacgtctttgcttttttgatgaattaaaacttttaaattttgaatatgtctattgaaaaacatcaacaacggttgtgtcttcgaatatgtttgtcatgaagatatatatatatatatatattaaacaagatgtacaatcattttgatacggagaggaggattagaaggtgcgccgaaggatgaaggagtcgaccaagccggcagagggcagcctgctgcagcactggcgcgagcgcggacgaccagg

SEQ ID NO: 2036 - DNA, 2246 bp, Zea mays
  misc_feature (1)..(100): optimal_loci_205453_G1, chr5:205036356..205038601, Cluster 12
gtgcatcaaatttagatatgatggattgcatatcatgactagatggaaaatacttaggccgacacgacgtaagtgagacacgaattatagaaaactagcgtttaaatgtttaaatggttatttcattctattttttatatgttcacaaaagttatacaaaagttatagaaaatattaatttctctttctcatataatttttagtctatagtaaaattatggatattagctcgaagcatgatggcttgggccgtgcctgacctaagttccagctctagccatgcgctcgtggttccaggggcgggaaggcgacaccgacacttgtgcctgcggtctgcgtacgatggtgcacaccaggccaccagcagccgcagctgctccatgtgaccatgtcagtgtagcgcgccttcactactgtgctagactattggtactagcgttacggactacaggaccgttgcggtaaacatgtttcgagatttctcgagcactcccatctgtctatccgaaacgtaggaatttcatatagattattcagaaatttgcagaagtcagtctatttttacgcaaaaaagatctacgtccgacggttattcggttgttccacctatctatcacactctatattttaaatttaacatacaaacagtataatctatctataatacgaaaccgaagcctaaatggcctaacctgcctgttcctgtcgcggaagagcatgtgaagcaacgcgggaagtcaccgaacgttgagtccaccgggaccccgggagggattcggccggtctccactcctcatctactcctaccgttggcggaggtttcctaggacggaataatggcagtgccagtgcgcccgtttgtgctcgtggagtcctgtgcgtggttccgaccgttggtcgcatccggccggcgcgtggcgtggcaataaaacccagtcacgagagcagagaggacagaggcgagagctgtcgaacgttcggaaacgggcttcaatctactactactcgtggtcttggacagaacactctacaacgaacacagcagctagagctagccagcggttacccgtcgtcgcctttcgcgacctcactgccccgcaaccgccggtcacctgaaaagcggcggagcacgcacgcagacgcagacgcagcgaccattcccgagcagcatgcaggtgcacacacccacagctaaaagccgcggctgccgtgcccgtgccgtgcatgccgaccaaagtgtgcagccccccctgggccgtctttcgagtgcgagcagtcgcgcatgcagacgcagctagcattaagcaatcgtgaatcgaccacgttttgtcgaggatccaaggctttgtttgatgacgaggggcatgcatggctgggcctggctcgcgtgcataacggccagcatgcgcgtttaacggcgtaacctgctgctggatgatgatcccttgatttctagtcacgcaaacgcaagcgaagcagcaggggtccgcccgccttttggccctttgcgagcccgtccgtcgcttcgctttgggacgcccggttattttgtcccgtgggcgtgggctggtgaatggcgaccgtacgctttaacggctccccccgtcccatcccctccgtgagtgagtctcggcctactggcctagccatcgacgggacctattcacctatcccattcccaccaggccaccaccccacgacacccaacggtctcatttaacaaaacccggcggatctccgggcagcaaggaaacgtcggctggatcgccgtgccgtgatgctgcatgcaatgcacgggggcccgcctcggatgtcattttgttagtacgccgccgaatcctcattagtagtaattgttcgttcataactacggtagtgttttttttgggtacaaacccggggaagtcagcgaagcaacgagctactgccgtctgtctaccagcaccgggaacactgtaaaagcaaatggcctggcctgaatgaacagcagtggccggcgcagcacgagacgagcacagggaccactacactacagtgtttactgctacctgtgtctgtgcggcagcgtcatctactgtacacttaaccaatgcaaatgcgagccgtcgtcgcgtcgcacggaaccaaaaaaaactgccccgaaattccatacgacgaagaaatggctctgctattagctcgctgctgcttgttttacaccaccactaatcctggccgctcgtgccgccgaaactcgtgagaaagga

SEQ ID NO: 2037 - DNA, 1706 bp, Zea mays
  misc_feature (1)..(100): optimal_loci_205643_G1, chr5:205773760..205775465, Cluster 12
ttggtttcgatggagcagtcgaacagcggttgggggcgggttgtcaaaccccgagccttaacgcgaaaggaagagaaatgtcgcgggaacatcgtatgcttgtcaactactactagtagggaggagaatactaataactggccacaactacatcgagccggatgatggggacgggcggtctcgatcgccagagaacacggtgaatcttggggaaaaaaaaggctttgggtttatttcaatttcaactcgcagacatagacagacggcgaccgcgtctgaactctcaaggaaggaaagaagaactccaacgcgcctggtgggcaggaagggcctggccgccacggctagctctaccatccatgtacgtgacagcagatggcggcggcgccggcgatgagtagaacgttgccgcgtagcgtaggggatgggatgggatgggatgggatgggatgggatgggatggaacaggaacgttcttcgtttctcttcctgttgtcgcgcgtccccttccgctctgtttggacgtgaaaaaaaacgaagggcggtcgtcggggtgggctcgcgccggggccatgccatccaggaactcgcagtcgtggggatggtgctggtgtcctcgtggcagtggcaccccggttgaagctattgactgcttccaattatgcgccgcgtccgcgtgcgctgcgagtccgcgcgcgcgcgtgtgctcgattcgtgcgtccacgatatccttttttttttattcgttttgattggtggagaatattatgctctgcatactttttggcttctctcctgcttctaatcagccaacgtccttggatttcatcaagaactggttagttgtgttgtgcatagagagaggtctcgagactcgagagtatgtcctgctttgcacgtaggtcctttgcaccgacacagtccgtcagcgtgcttcctagtggcaaccgggcaggagggccctcccgaggctcgaggcgccacgggctctctagagtagagtagcagtgacaccagcatggcgtcatctccggtccacgcgacgcgcgaaccaatgggcgccggacacgcgagatcggccggctcgtcacacgtgtcgccgaggcgccccaccatgccggtaccacggccgcgcgccgggactcggtcggcggtcgggatcgtcggggtcacggtcacgggcgggggatcgtctctgacgtctttctcgcggactaactactgggtcaagcagcccaagtcgcgtacagcggcggccacgtaccggcgtacgtacgcacacgacaccgcgcgctttcccttcgcttttttctgagcgctcccgagggcccatccgccttcgcgtctcgtcagcttacgtgttgtgccgctggccgccttctgacagtgacagaagtcacagaaccaccagcgatcagcggggatggatgcctgtcgagtttgaagcggtcccgcgacgcggtgcccggcgccggcggcggtaacgtcgagtcgatctgatttcgcgactcgctgactcgcgtgctgcttctgacggcagcccaacggctactttctacttgcgcctctacgcgtggcagaaggaggggatcttgggaaggtcacagttggtactccgtatatatgattttcagacaagaagtagttggctagctatctaaataccccgttacaaaagagcaatgtattggccgatgacagagtta

SEQ ID NO: 2038 - DNA, 1874 bp, Zea mays
  misc_feature (1)..(100): optimal_loci_205795_G1, chr5:206722069..206723942, Cluster 12
tgtaatagagaaacataggaatattctgaactggagtatccaacaataatagaaaaatttaagggaaaaagagagatcgacgcggaagaacatgcacacatgatcatcacgcccacggcctcgatctcgtgggtgatgagacgagcgagcgtgtgcaacacgtttatctacgtttccaacttcacaaatagtatatatagaattcaactaataagttggttagaatctctcttaaatttaactggttatctctttcacatcacgtctttctttataattagataatctattgaattaatttagactattcacatttaaatgcaacatgtgctttcatgtttgaaagaaaaatgcacgtatgaccgtccagagatactacctgctatgcatatttttttatatgtataaaaagcaacaactaacggaaacgcatggagaaagtagaaacgtttgcccgacaaagaaaaggagcgcgggagggggacggagacacgaaactgagccacctagaaattcttttggcaaacaacatgggccttcatatctacgtgggctttttttaagtatctcagcctcgtataagtgttagcccttcggggctacgaaatgataacaggatgggccgttcggggtggcagcctaaaaaaaaaaactgcttgccggatcttctctgtttgcatttcctagagcttctttgtagttgtagttgtagggacgagaaaaatgtacagtctactttcaaagaagacgacgacgtacagttcaggtcttcaaggactacatacacgttcattggtatcactacactacaagcgtggtttttccacacctgaagtctgaactcaactcatcttgcattactcctgatcagcaacagtggcgcggctggaaagcgagcgggcggcgatacccaaggacgatcgggagaccgagttctccgatgcgaaggaagctcgccgcctggtcctggaaagaaaaagatgctcctccgttctatcaacatgtgcctgccgcgctagcagcgatcaccgacgatggatcatgatcgttgttagcaaatcatccgcgccgcttttggtgccgccggacgccttttcccaccctccccgccacgccaggaccacaggtccagaggcgcgcgacgagcaagtggtgtgtgtgcgtgtggtccgctgcggcgcgacgtcgaggccgagagcactccatcgtacacgtactgctggagtgctgggaccgccagaagtagaaccagaagcggatcgttcagagaagagaactcgtgcccgctgctgctctcaaggcgcgagcgctggtcccccctggttagcggcgaacaggacgaggtttgaccagtctagccccgtgataaacccaggccggtcacggtcacggacaggagcacatgtgaggtccgttgggaaccacaggtactggctgcattggttgattcattaagcaggtcgatccagacgagcaacgactgctcactgccaactaccatcgggagggacgactggccaagcggggaggcgcaccaacacaggtgtcgcgctcgcgcccatgggccgattccctggctgggcctccggcgcatcgtggtccggcccaccctccgctttcgcagatcacggatgcctacgggaacggcgggatccgtctcctctgtcttcgcgacatggtgtttctgatcgattcgagaggtgagcgtgtcgcggctcgcgggaagcccatgccgtggatctccctcccccctcgccgcagagaaactgtgcccggaaaggcatggtgggtggttgagtccaccgtggacggacgctttgcttcggtcgcatcgcatcgcatcgcatctcgcttgcatgctccatccagttgga

SEQ ID NO: 2039 - DNA, 1537 bp, Zea mays
  misc_feature (1)..(100): optimal_loci_205831_G1, chr5:206927838..206929374, Cluster 12
ctttggtacgctccaataacttagggacgagtttaggaagaagtcaaatatgttgcatacatcagggatccaccatgcttgacgacctacatgtgggttacaagtttcaacttcaaatgcggatagaacaagattagtactagttcgcacgcgggtccagcgcatgaatggaaagtgcagagatagagatgcactgcactcgcattggcccgatgactaacagcaaggtcgtgacggtaacgacaatatgtcactgctgcctggtacagtttgctcgttgcgtccgagagtgctacgttacgtacctttccatggagttggagatcgtcgtccgagacagcgagttggtagtaccaatggagcacgtacgacgacgaccccccggcgaatggcgagaagttgaccgagtcatgatggcctggacgacgggcaagaatccttctgcaagtcagctagcttagctcgccgtctttgtggataatacatggaaatgtttatgttccctgcattaacgtcgcagaatatcaagttgttgcagacttgaccactgcccctctgataaatgtaggagatcgatgggacgatctgcgctggagaaaaaaagcggcaattgaagtcaatgcgaggacgacagtcacgacaaaaggtagtaagtaacatctgctgcaacctccgtccaaacgaatatgacagttctagatttgggttttaagtcaaaccattctgaaattaattgaatttataaaaaatcacccggggcgtgcgtgtggaaaggcacgctttttgctctgcccaggtgctaccgtgtgctagctagttccggtgtcgtttgaaagaatcgtccgtctcccggagccttttaaccttcctatctagtgctttatcgatgcgatgagctggcggcacggcacctcaccggcgccgacatccgaaagacgacgccacacccccacctcgcccgccggcgccgatggtgcacggccgggtcgccgtccgcttcgaccgcgcaagcgagccgaagacggcccacgcggacaagcgagatctccgcgagccgaaagcagagcccgaccgccgacccgcacccgccatgccggccgctttccggtcgaggtgtagtcaggtaacgggcagtgtcaggctagctatcagtgagacgcgcgcgccacatgatcgaccggtcgctcggtctgcatgctggtgcctggtctggtggtcatcaccaggcgccttttgatccgtcaggcaacttttttgacggatctttggagagaagctagcgatggcgacgtcgcgacgatgctgtgcgatcactggcgcactaccggccggaagtccggccgggtagagatccagcgtcgcttacaggatgccacacacgtatgcaaaaggttacagggatcttttcttcctacgaccgaggtggaggacgctcgaccagtggtggtctggaatctggatgggatccgggatgatcttacacggaatgatgatctgttcactttcattgctgaaagatcagcttttatctaagcct

SEQ ID NO: 2040 - DNA, 2932 bp, Zea mays
  misc_feature (1)..(100): optimal_loci_205987_G1, chr5:207500205..207503136, Cluster 12
tggaagcgagacctgtcaccaaagatgggtccgttggtgaatctggtccatgcaacctataaggtcttgggccggaccgcaggccgcagggcctaaaatcacatgacgatggagtggcggactgcagatggccacgctatcaccttgaggcctcagcgacgcatgcggatgcggctctgacctctgacaaaaacttttgctattttttggctggagggagccccacagacagagaacgcagaaacgcggctgtgagttctttttcaactgaaaccaaaatggttgcaaccgtgtttttagtcagatttttttgcttaatttcctaataagggtctgaaaacacacactcggtctcttgcttccactgttgtcagtataatttcgtttggtgtcttggtggtcactccctctgtttcggtcggccaacgaaaaaaaaaacacgcagagaagctgcgggacagtttggttcgtccaggccacatgtcgctgctggcggcatctacggatggaaacgggcggggaaaccggccggaagtcaaaagggatcgtgcggaagcagccgcaggacgcagcagcccgctgcccgcgggccgcccatgaccggctgctcgctcccccccgcggcgtgctgcagcctgcagtgaagcgaacccagggcgaggcacgggaaaggggcaagagagagcagagaagctgtggcctgcctgcctggcacctgctcagttccagaacgagagtcctccgagtcctctgccgtgtgttttccgatcgtcgggctcgggcacgagcacgacacggtcaaagatctccctcctcgggccgatctcccctggcgccggacctgacacccggatctcccgagaagcggtcacgccgaggctgcggttgggcgggcagcagggcatggaacttccagaccgttgccgttgcagggcatggggtgctgtgacaagcgaggcacaagagaacgtgacatgacatctactactactactactcatcagcgtactgttgtcgacgacgagcgcttgaccgctcgaccccgccgtagcctctcggagaagacatcggacactgcatgtgcagggacgaattgcgcgctttctagttctcgctgtacgcacgcaggacatgcagctagttttttagcagtaccgtaccggtgcggcccgtacgtgcaaatctgtacgcgttggttctcctcctgctactacagcagaacttttatcaagtgtagcctttcgtaccggacggacccactaggctgctaggtacgctcgcgatcgcgtcagcgccactgccgcgcgctagttttttttttttttgttttccactggtcgttcaggctctccggttcgcggttccgcccctagggagtagggagtgctagtgcggcgtactagcctttttaccgatgctgttgccgcaccgggtaggggcggccccgtcattgcgcgcctcaacctgtcaatcaaccaaacctgcgcggacgcgagcctggaggcctggagcctcgccctacctgcagcctttcttttttaaccgtcgcccgctcgctgccgtacacggcgcagggccccggcggtggtttctggttggccgcaggggctgccggccgttagacgagtcccctccgcccgccggcgtgggcccgccgaaagcgcccggtccttctcccccacttccttccagtcccagcccaggacgctgcgcctgcggagcgccgggccggccgcttccacgaaaccgcagccgcgggccggggggacggccgcgtacacccactgccgcggcacatgccgctgtccttgccctccgatggagtactaggatatatatcgcgcctgtgacgcgcggtgcggtggacgacgatccaccgcgcgcgcccccgcacattttccacaggcgggcgggcacgcgacacgacacacccatgcagcagctgcacggctgcgataccacgtacatgcatgatcaccaggtacactgtacacaggtcgtcgcagttttgtcactgcgaaccagggatcggaggccgacggattcgtgcggcgatcgagtggctttgctagtagtgccgtgttgggtcaaagaacgggcaatcatttctactagttggaaagctgcagggggatagctggccgccgagacttttgggcacaagtgcatgtgtcaggaatatcgttcgcgcgcggatgcaagcggattccgatccatcggtacatgacgcacacgcaacacgcaaacatgcaacaacgggtgtctgtctccatcgagccggccaccaccacccaccaccagtcttcgtttctcgctatcacataaaagctgtgagcctgtgaccaagaaaataacctctgcgggccgcctgaaatttttttttcacggaggcacacggcaactgatgcgcgcaacacatgatttatgatggagtagagtaggctggtccagacctaaaaaaagtgccggacagagattttactatgccactttctcatgtgaaaagatgcctctgccagtcgttagctagctttcagtggtcagatcttgactagggtgcagcagaggaaagagcagtgcatgtcctcgcatttttttgaccgcgcgcccgtactacgcgcgcaggaccgatatttttattattagtagtatgttagtattattcacacgacggttggctggtgcagctacctgctactgctgcccgtggatcagacggccactgatgaattggaggatggacctcttctggctcctgcctttcgcagtgctagttactgcaccgctccctagctcgctgctagcctctgcttagatcgaccaaacgcaaagtactccctaggtttagcttgtaccgtacctaggttcaactaacactgcaataaaaaagaaatcatagaatacatatttgggagagctctaaacccttttg

SEQ ID NO: 2041 - DNA, 2036 bp, Zea mays
  misc_feature (1)..(100): optimal_loci_206075_G1, chr5:208168349..208170384, Cluster 12
ccctagtggataacaggacaagtcgtcctcggcctgtgctaaactgttcgtaattagatgcccaggcgccagcgtagccccaaatttatattcttgtcagaaactatggtcatcgtgctaagcaacttagatggagtttaggcttaaaaaggtgagtgttcaatctagtagtaaactagtagtgatggttgaagtggcggcttagcccttttttgggatgataatgcattggtgatcggtatattgatgtgccagtgttaggtatattgatgtgtcggtgtctatatatatccaaattctttttacttggcgcgtgactttgtttgatggtgagccacgggaagaaaatcgacagcgcatgtgggatactttgcagagttggaaagcccgggtccagagagtcatgctggtttactactgggtattttaatgagactctttggcaatttcagcatttttcagccactagaagaggggagaaacaaataatggaagctttcagggaaactttaaatttctgtgacttgcacgatattggttttatatgctttgccatggatctacgacaattgtcagcatggggttcataatgttagagtggtacggtgctggatagaggtgtcgggtccgaagccagagctggatgggtttgtttcgtaaaggtacgggtgactcagtttggacttgccctgaccattggcctctattgctgcagacatcgcaggttgcggctgctgatgggcgccagaaaaaacgtgtcttttacgagatcatgtgcgagaacaggagccttccattgatgaacgagtacagggtacctggggatggtctcagctgtactccccgcgagtaaaaagagatggactgatggagtaaaaagaagttcagctcagtactgtgacaagtgtgatgagtgatgaccaaggggagtagtgcacggataatgcaggtatggcaaatattcatctagaagatgaacggagatacatgcaagcctcttcggcaaaacccagattggttataggccttcgcggaaggattattggaaaattatattcaggtggtgggatgaccataaacaatggggttagcgacgcaacagaataaacgtcacaggaacctgttcatcagatgaggaacagctcctaagcgtggacagctagcttgcttttcttgtgcacacatgctagtcttctttactgttctacgactgcagcagccgctgcgagcgagacgagaaatgcattgcggccggtcggactgacctgcaagctgatgcctagatcgatatcaattcggtaactaaagtcgaactaggatcctactcaccagaccaagaaatacaaagcgcatttgttctggccgttttgtttttggggtaaaaaaaagacgcttttcatctgctggtgcaaactaaagaaggaaaaaaaaggcagcaacaaataaaaagcaggaaagacgctgatgggtactttggtgggggacgcggaaagcggccgcgtagtttttacacgacgatggttttgccatccccaagctttttctctctctccctcttttccccccggcccgccgcgcactagcgagctcggcccgatcgcgacgggcctgaaaaatctctggtgccgaccgagcccacgagcagataaaaaaaattcatttcgaactttccatctgaaatacgcatggcgcgcagcaattaatgtttgcgagctgactgacatgacagcaaccgttcatcaggtaatgatatttctacgcatttttatagacgagcagtctgacctacctatccccccatctttccgaccatgaacacgacgatttaactaattatatgctgtacgtgtcgctgcaactgcaagtacgcgcacggaaagccggcggctcgtcgagtccatcacgatggaaaagtatatttggtagcagcagttgctcggtttgttgttccgactggctgttgttattgttgttgttgctgctgctgccaccaagaacgatgatgcggggtgtgtttttccgtttattaatttggc

SEQ ID NO: 2042 - DNA, 2134 bp, Zea mays
  misc_feature (1)..(100): optimal_loci_206570_G1, chr5:210769007..210771140, Cluster 12
  modified_base (68)..(68): a, c, g, or t
  modified_base (69)..(69): a, c, g, or t
  modified_base (70)..(70): a, c, g, or t
  modified_base (71)..(71): a, c, g, or t
  modified_base (72)..(72): a, c, g, or t
  modified_base (73)..(73): a, c, g, or t
  modified_base (74)..(74): a, c, g, or t
  modified_base (75)..(75): a, c, g, or t
  modified_base (76)..(76): a, c, g, or t
  modified_base (77)..(77): a, c, g, or t
  modified_base (78)..(78): a, c, g, or t
  modified_base (79)..(79): a, c, g, or t
  modified_base (80)..(80): a, c, g, or t
  modified_base (81)..(81): a, c, g, or t
  modified_base (82)..(82): a, c, g, or t
  modified_base (83)..(83): a, c, g, or t
  modified_base (84)..(84): a, c, g, or t
  modified_base (85)..(85): a, c, g, or t
  modified_base (86)..(86): a, c, g, or t
  modified_base (87)..(87): a, c, g, or t
  modified_base (88)..(88): a, c, g, or t
  modified_base (89)..(89): a, c, g, or t
  modified_base (90)..(90): a, c, g, or t
  modified_base (91)..(91): a, c, g, or t
  modified_base (92)..(92): a, c, g, or t
  modified_base (93)..(93): a, c, g, or t
  modified_base (94)..(94): a, c, g, or t
  modified_base (95)..(95): a, c, g, or t
  modified_base (96)..(96): a, c, g, or t
  modified_base (97)..(97): a, c, g, or t
  modified_base (98)..(98): a, c, g, or t
  modified_base (99)..(99): a, c, g, or t
  modified_base (100)..(100): a, c, g, or t
  modified_base (101)..(101): a, c, g, or t
  misc_feature (101)..(167): n is a, c, g, or t
  modified_base (102)..(102): a, c, g, or t
  modified_base (103)..(103): a, c, g, or t
  modified_base (104)..(104): a, c, g, or t
  modified_base (105)..(105): a, c, g, or t
  modified_base (106)..(106): a, c, g, or t
  modified_base (107)..(107): a, c, g, or t
  modified_base (108)..(108): a, c, g, or t
  modified_base (109)..(109): a, c, g, or t
  modified_base (110)..(110): a, c, g, or t
  modified_base (111)..(111): a, c, g, or t
  modified_base (112)..(112): a, c, g, or t
  modified_base (113)..(113): a, c, g, or t
  modified_base (114)..(114): a, c, g, or t
  modified_base (115)..(115): a, c, g, or t
  modified_base (116)..(116): a, c, g, or t
  modified_base (117)..(117): a, c, g, or t
  modified_base (118)..(118): a, c, g, or t
  modified_base (119)..(119): a, c, g, or t
  modified_base (120)..(120): a, c, g, or t
  modified_base (121)..(121): a, c, g, or t
  modified_base (122)..(122): a, c, g, or t
  modified_base (123)..(123): a, c, g, or t
  modified_base (124)..(124): a, c, g, or t
  modified_base (125)..(125): a, c, g, or t
  modified_base (126)..(126): a, c, g, or t
  modified_base (127)..(127): a, c, g, or t
  modified_base (128)..(128): a, c, g, or t
  modified_base (129)..(129): a, c, g, or t
  modified_base (130)..(130): a, c, g, or t
  modified_base (131)..(131): a, c, g, or t
  modified_base (132)..(132): a, c, g, or t
  modified_base (133)..(133): a, c, g, or t
  modified_base (134)..(134): a, c, g, or t
  modified_base (135)..(135): a, c, g, or t
  modified_base (136)..(136): a, c, g, or t
  modified_base (137)..(137): a, c, g, or t
  modified_base (138)..(138): a, c, g, or t
  modified_base (139)..(139): a, c, g, or t
  modified_base (140)..(140): a, c, g, or t
  modified_base (141)..(141): a, c, g, or t
  modified_base (142)..(142): a, c, g, or t
  modified_base (143)..(143): a, c, g, or t
  modified_base (144)..(144): a, c, g, or t
  modified_base (145)..(145): a, c, g, or t
  modified_base (146)..(146): a, c, g, or t
  modified_base (147)..(147): a, c, g, or t
  modified_base (148)..(148): a, c, g, or t
  modified_base (149)..(149): a, c, g, or t
  modified_base (150)..(150): a, c, g, or t
  modified_base (151)..(151): a, c, g, or t
  modified_base (152)..(152): a, c, g, or t
  modified_base (153)..(153): a, c, g, or t
  modified_base (154)..(154): a, c, g, or t
  modified_base (155)..(155): a, c, g, or t
  modified_base (156)..(156): a, c, g, or t
  modified_base (157)..(157): a, c, g, or t
  modified_base (158)..(158): a, c, g, or t
  modified_base (159)..(159): a, c, g, or t
  modified_base (160)..(160): a, c, g, or t
  modified_base (161)..(161): a, c, g, or t
  modified_base (162)..(162): a, c, g, or t
  modified_base (163)..(163): a, c, g, or t
  modified_base (164)..(164): a, c, g, or t
  modified_base (165)..(165): a, c, g, or t
  modified_base (166)..(166): a, c, g, or t
  modified_base (167)..(167): a, c, g, or t
gagtcctgcattgcacaggtctcacctacgtacgtacccacaagtgtcacatggtttcatgacgacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggaatcttagagattcgtccatggtttctgacgacgtgacagagactggtgatgccctagagaaaaaacagccacgcggttgcacgttccggacgccgatgacagccgggcccccaatcggctcccatcatcatcgcgctacccatgccctccatccatgtgcaagaaaacggcaggggcgattaggttaatgaattgcatgcgaccaggttgcctcgttttcagagccctcgtgctaccccgtccctactcgacataaattcaatgacaatattatttgaatgttctccttccatcatctcggtagaattgtagcattatcatgagctatatactagtatcaataaggccatcaagtttagtccatgatcggtagatcggtaagattagctatcaataagttaactgcccgttctttcttttgggacttgatgcttaggctgctatatatattactgttgacacgatcgagttgagattttctgatttgagatcagcaggtacgtcagggttcgaaagtgacctgactccccctccgctctggattaaagtgtagctacataaagcgcccctgtaaaaagccagattaaagcgtgtgtgtgtgttccctatcgccatcaacgaaacacgtcctgttatactacttcactgcagcagctagcagcgcaagctcgtgaagagaacttcgtagccaaggcgccggctagtataggccagtgaatttggttcttaattaagatgtaagttgtagtccacgtcaagtgcctcgcttcctttctccttctcaggaattcttggtagagagattcggcgaggagcacagatgcaattaatagtttgtgcgagcaacgtatatagcatgcgtatccaaggtagcaaccagtccagccaggatacatgcatagacaatgctgagattattcccgcactagttaacaagagggggtaacatacagcacaatacagaaagacagagagagcagtgcttatccaaatggaatgaataataaacgggagcctaccactgtacgtgtaggataaaattctgctttaattttctgtaaagctagatctgtcccggaaagaggccggaaaattcgtgcctggctcgcttacgcttaggggatgcccgaagtttaaggttgtgcgatccgggaaggccaatggcagggctgggtgatgtactaggctagattcccgtgtctgctgctggtgcaagtgttcatccaaaagacaggtaccgcaccggaaagcacgcacgttccttcctccgagatcgcacaatctgaatactctctcacgtgtgccgatgccgttgcctccaacggaaggcggctacaggtaggatgctggcgctggcgctggcgcattgctcgatcgctcactcacgttctgggccgaccacctgactgtaaagagcactcgccgcccctccgcgccatcgatcgtgcgtgccgtacgtggcagagcgcgagtgcatgcacgtacgtactgcgctttcgcgttccggcacgagagattctcctggtttcagatgagctcaacaagttgagcatgcacgtacgcctctttccagtgcgagtagtggtggctgcatgtactgtacgactagcagccaaactgcacgtgaaaaagtgtctaggtagcgctacatttataaagtgcagcgaaaggaagcaggcgatcgagaacgcaacgtagttgttcatgctcgccgacaaacacagcggctccgtttctactgcatgcgtgcgatttttctgtaaaataaagcagcagcagctagctagcgcgtcgtcgtgtcgtatgaacgatcggcgtcgtcggcacgtactgctgctacggccagttgatcgatctctgtcgatcgggggacggcgacggcacggcacactctcgcggttccattccatccacagaaccttctcgacgcagtgacgactgcggaatgggctcgggactgctc

SEQ ID NO: 2043 - DNA, 1438 bp, Zea mays
  misc_feature (1)..(100): optimal_loci_207053_G1, chr5:212865158..212866595, Cluster 12
tgtgtgtatgcgctactacttggtaaagtagtcgacacgtacgacaacatcgcgcctttcaagtagtatatagtaggaatgatgccgagctatcttgtcacataattcaaaaattttccatcctcgccttttcacactcttttttttctctctctctctctcttgacgaaaactaaccacggcgcccggcctatctgtgcgtgcgtgcgtgcgcgcgtaattattgggggaaaaggtgaaaaaaaggagaggaaagggtgaatcgcaatcgagcgtgcatgattcctgtacgcgccagccaataatttaaagcggcagccgggctatgttatgtagcagcgtggtttatcgtttatgcttattaggcagcatgcatgcctgtagtgtttgtaacaacacaagtgtacgacgtacgtaggagtaacctttttttctccctttttccctccatgtccgtgcgtagtaagtagtctttcagtggacggcactttggtggtgaaatcatgcccattcattccatgcgccatgccatggattctgggttgctgcttaagttacctgtctgctagctgctgcacagctcaaagtagagcatgatgatcgaggaggaataataatgagctgccctgccctgcctgccgcctgcccgtgtgccaatccttagcttcaagaaacaaagttggtgcaaagtggtaaaaaagagatcgatcgagaggcgcaaatcgcatcgggccatcatagtccacgcaccgtacccaccacccacaacgcaccgcaccacaccacaccaccacctaaaaataaagctctcgcgccttttaaccgccatcattagctctatcaagcctttttaatcaggcagtacagtagtgctgctatatatagctttattgatcattatagtattagtatatatatgccgcatgcatgcagtagagagctagctagctagcttagtgacgatgcatgcagtgcagtgcagggttatgtatgctaagcatgcaatggagcggagtgaaaaacagtgtccagctcatgcatggccaccacaccacaccagtaaagctggcaagctttataattgattgcccatcgagagcctcatctccgtgtctgtcttgcactcttgcctttggttccggaaggaaggcacctggtggagtggagtggagtggaggtcttgcattgacaggcgaggcgaccaaagaggatgatgctctcctggtcccactcccacacggcatggatggatggtgtgcggcaaaaaagacggcacggccatgcccccttttggggaaaggggaaaaaaaaagggggcggggccaggggagtttgagacaccaatgaaaggaagagaaaggattagccgctttgagggcagaaagattgcactagtagctagggcggggggagagagagagagagagaagaaaaaaaa

SEQ ID NO: 2044 - DNA, 3935 bp, Zea mays
  misc_feature (1)..(100): optimal_loci_207078_G1, chr5:213049120..213053054, Cluster 12
taagtgtttgactgtttgtactcaacagcttctaacatagtaacatcattatataattaccatccgtaacgaataacaatagagggtgagtggccggattaccatgatagtacattacgtgccattgataaccattcattcgatggtcgatgcacctgctttcagtttcaacgctacacacacaagttgcaacgcggcacggcacggcctggcctggcgggcgagcatatatactcagattaccataggcgtgaagatatataactagacgaggtcacgcgcacgcggtcgtgcccccacatccacactggcgataaagaaaaagtggcctgtaccaccctggccggagagaactacggtgtacgtgttcggtgctaagcgtttccacgcgcaaaaaaaaaaaaatctgggaacatgagctgccgccaaaccttctccaccaggcaaaggctgctggctgccggcggcctgcagtgcttgcatgcatggtcctttgaactcccacggtcgcaccatcctcgaccggatccgatccgatccgatcctatccactcgacgagatacgcgaattgcttccacttgataagtacatctaagacgatgggagggacacgacacgatggtcccttttagccgcgtgctcaaagccagtacgcagtggtcagtggaagcgattagattagcagcaggcagaacgtcaagtcaaaacccacacacaaagcaagcaatcccggcacccggccgaaaaatccgaaagaaagcaaaagcagcgcgctcgcccagcatatcctcctcgttatcctcgagctacagctactactaatcttgcgccgttcagaatccgattcggaccggcgccataatccttatcccccagcgccggatgcgatcgatcattcattcatttgaccaccgatgaggcaaccccgccgccgccggtccctgtagttgcgtgcggtcataggccggaggaaggaaaccgagacggggacggaagccgagcattctcgagtgctggcgaaaaaaaggttgtcggcctcgacacttggaagtggcatccaacctcggaaatctaccgtgtcgctcgctcgctgcatcccggttcgttgcagaggattgttggagtcaaagacacgtaggtggcccaacaacatgcgcatctatcagtgcgattttggtcgctggccaaggtaggttacacgtgggcgaccagcggttcgccgctgggctcccgtgctgtgctccgtgcatcagtcacgatccatccatccatccattccatgcgaccgagccaaccacgggacgcgcggcgggctaagggcagggccaacgcaacgcaaccccgcgcgccccaagtttcctcgtggaccgagcgcgttcccgcgccgctgacttgtcggcacggcggtttcccggcacgagggcatgcaagaaagatgcaccagcaccacactaggacgcgcgcgcggggggagctagcgagtgggtcgtcgcgtcgtcaagacgggacagacaggccgggatgtgaaaaccggttcagcgtttagtcagtggctgagcgacgttaacgcctagtagtagtcgcctagtgggctgtggtttgtacagcacatcctccagccaatatgtagctacgcctacggtcaatctttgccggtcgcacacacaaggcaaggcaaatccaattagtatcatccaacccttgacgtttcattccgggcaaatccaggccgggccctcgtggacatattgccgttgagagacgcaaacgaccctctcgtctcgtacctaactcgatcaccgaggccaagaccaggccctactctcctagctactctactctctctctctctttcctttctctatgtcagcagcagcatgtaggcatggcgagttgtagattgcactaatccccgaaagttgttgatccacccagtgcagccagtgcgtgcaaatcgcagcgcttatgataatgtacagtatatgttatccgggtcgtcctaggatttccttttttatgccgtactttattacttccagccagaccgaggatctggatggattggatttcgcatgcggcatagtatgccactctggcagccaccggactggaccggacggcgtcattgtcactccctgtcacctctggatctctcacacctcgcagcacaggagctgaagctgaacacagaggcgacgacgagcaagttgcagccagtaacatggggtcggcacaggcaggcggcaaagggaggacgatggtatcgtccccgcacaggaacgttagctgtttggataggaatagtaggaggaggggtagtagggtcggcaagttgcggcatggagaatgcagtgcgtccgtacggccgcgggcccatgcatccgggttccaatgagtgccatgctactgctgatactcctgtttctacgattgggaggttggggtagggtgggggagggtcccacgctttccctgggcctcctgctgtcgttctccctccccttcgaggctagacaaatggataggatcaaggagggatagcccggatatacggcccatgatgttttatacgctttccttttagtagatacgataaacttttacgtactgtttttttgttatgacccatgaagcagctcagctacagacgcgcgggtaggagtagagtaggaccgaacgaagggatttcatttcattctcgatatctctcctgggttcctttcggtttcccgaaatttcagaaaggcacagattcaaagttgggtctggacggttggcgcagcctctatggaccatggacatgctttgcctgtccttctgtgcaaaaacatgctcgctacagcttatttaggctgcgggtgcatgtgttgctagtcatagctagtacagtacagtacagacgcgagctgcagtcagatctgcttgtttgcccgcgtgatttccgttccatactccctccctccctcggtccctcccctgcagctgcccagatccgatgcccatggcctcctgctaaatagcttgttgtgcgtgcctcacctcacggccgtagctagatcatatggactacaactacaagcatagccagtctgccaatgctccgtcgcgtcgtctctggcaacgtatatgccggaatagtaataatgctccaacagacgcgtggattagttggtaggaggatagcgtctggagtctggttgccatagctacccccttagatattttctgtgcgcatggcatggaacgcaccagtgcaccatcgcttgcctggaaaagtctggcagagttgtgatacacgtgcatacacgtctgagcgcgcccccagccacggccttcctgcccaagtcggcaactcgccagcgatgaccttcctggttcctggagcggggtgccggctgggctctttgcacgttgcacgcgacttcaggcctcagctgcctcgtggcaaccgcgggggcgacaccgcgagagaggctttgcgcgggtgaccggcagtgaccgcgggaacgtgcatccgcagtcactccgtttacagctgtgcaaaacagggcctcgtggcaaaacaatgcgatagactttcacacaaaaaataaacttcaaaataaattgaatcttctcaaaaaataaatttaaaattaaagtagacatatgtcacagatatcatatattaaactacagattcttcgcttcatcttagccaaaaaaaggcgagaataaactttggaacaacacaagtgattcaaataaggattaatacaagagaacttttagagaagtgtacaggaaaacaaatcgcaaccaatcaattccaatgaatatcaatgcaaaataacttttagggggtgagaggacaacaaattgcaagcgatcaaacacaaagacacgatgatcctacgagttgttttgtgtccgaatctgaacccaataggttaga

SEQ ID NO: 2045 - DNA, 1692 bp, Zea mays
  misc_feature (1)..(100): optimal_loci_207293_G1, chr5:214117788..214119479, Cluster 12
agtgctggagctgatccgagtcagatcccctcggtcgtcaggaaagacctcgctctgaactctggctttatgcgcctgacgtgtctgtctgtcatctccagtccggtctccaagcctgacgagttgccatgcacgcaacgcaattggcggctggatgaccagggcgcgccctgaaaaagctcgctcttcctgcatctccttcatccgcccgcgcaatcagcagtgtgggttgcacaggctgtcccgacggctcagtgtgcactttcttctctcctgtctccaccacgggccggggtcggcagcattcggcaacgaacgagcctagccgcactgaatgcgcgcacccgtcgtggggccgagccggcggcatcgccgtcgcccggcgtccgtcagataccgatgcatgcacgaggggccgggcgtcatgggcacgcctcgccagaccacctgacctgcattcatcctccgttcgttcatacggcgatcaatggataccccatcgccggagatcgtatcgtatcgtatctacgtcttgatatacccaccgacggacgagggcgccgcggaagaacggtgcgtcgataacggaggagctagcgctgcacaggagccgtgcgctgcttgggctccagagtccagagaaccgctgtgtcgatcgcctcctcaccgccatgtcacagcacccggcccggcggcttgctgtcgccggcaggactcttctccgcattgaacacatgatccagacgctcggtctctctctccgattcttttccagtgtgggccctgacttctctggccgactaaacatatgaacaggctacataaaatgctgggttttctactctctcgccttcatgcatgggctccactgaaaggcgtcgactttaataaataaaatctccagttcagagttaggcgcaatgcagttctgatcctggtcctactcgctcgacttcacctgaacagactgctcagatgatgtatctgaatctcttttggcttaaccaaagttcaataatctgtttcgagctaacattaattaccacttctcatgaacgaagatcaaacagatcagtcgaggaggaagaggagaagcccggtaggtctttgcctgatcactactaactagctcccgcgtagctgcagagttttcttctgtctatatctggtagcagttaatccactgaagaggtctgcagggtgctcttctctcctttcttcggattagtcctcgttcactgcttgtttactaatgcgtatacagttggtgcggtgtgagtcatttcgcagcgaacagatcgaaccctctcctttgcctagagtccagtgatccgtgctgctcttctattatctaatatactccgtatctatcacactagaaaagctagcagagagtggcccttggaggccacacgggtcacatcttttgccgatgtatctaaaggctttaactctgagcaaatctgactgattcttccttcccttgtaaatatcctctcttgatataagacaagcaaaaaaaaaaaaagatcgtacctactgcgatgcttctaaccggcgagaaagctactgatgattagtttagcattgttatcatcttacaaaaaaaaaggctgccgatctgtgccatgatttgtgaaactgtttccatctttcacagacgaacagttgatatcgaccagcccacagata

SEQ ID NO: 2046 - DNA, 2368 bp, Zea mays
  misc_feature (1)..(100): optimal_loci_207365_G1, chr5:214520648..214523015, Cluster 12
agcgtatgcgacaagctcccttcccttcatggtctcgatgcatgtcgccacttgtcctggacccctcgaccaccatgttctctagtgtcatccaccatcttaaattggtcaacacggtctactcctacctatactagccccgcgcttatcgatgtctctagatgtcaacgttcatgatcattccacaaatgggaagacgcggaactagagccactacgtccagaagcctggttaaacgagccctaaaatgtgcatgcatgagatcgcgcgcgggactatttggcgaaaaggcaggtagtagctgtgcgtgcgtggagaattggagatagactgcatgccactacgatcgcctcccgatgcgaatcgatcacctgacacctgtcgcgtcactcatccgttgcgtcgatcgtgtcgtgaagtcaggggttctgatgcgtcgtcgttgtgcatgtgtgtacagcagcaacacgtagatacaagctagcaaccgttttgagctgctgctgctgatgcggcttgcatcgtggcggcgttgtgcgctagctgctgctgcatctagtggactcgaaatccaggtgagactgagcttgcagccacatgcatgggctatagctgcgtcgtcgtccgatccggcgtgggggatcatatgactgcacatgactagcctcaccagtcaccactgctgctgacccatgcatcactaccactactatgttacagaagtagcttaacaattgcaagttcaccccagcagttctagctcatggttggtggttgttcacaattaattacacgcagcgccccatcgtaggcgtcgagctgatgacccggccggtgtttactgactgctcgtgcccggaccccggaggacgctagatatgggggttgatccactcaccaccacagtagcaatagcaacgcgtgcatgttaccggggcacgttcagcaaccaccccacagtactccgtccagcgaggatagggggggggggggggcgctagctgccgtgttgcgagcggtggttgggcggatcacggtcatggggtggtggtgatcgcccaccgccggttcaccacacaccgccaccgtattatatgtacggcacacacatggcgctgtccaccatagacatatatgctagtaagtttttgctttttttttcactcctccgttcacttaataattagaggggagaatctccggcctgcaattgaatagtaatgtcgcgcaggcaggcaggcaggccgcatgttgagcaatcatatatagtcggcacggcctcgggatcggcgcggcgagttctattctactatatggcagcgttgtcagagatggatcgtccgcttcatgcttttcactgccagcggattatatactgtaaagcagcaccagcagcaagcatctcgcggctagcctaatctacctcggacggactggacccgttcacccgtgacagggggggcctgtgggctgggctggctggtgcatccatccatctcggcgccggtcataaagcgccgcgcgcggccgatggagctctgccgccagcaatgcggaccggacactgttccagggtaccagcggcggctttcgttctcaggtctctgctccggttgggtggttgcggtcgtgctgctttgcttgcttgctgggagtgcaatgcaagcgacgatctgtctgtctgtcgtgtccatctagatggcagcggcattttggattggattggattggatgcctgcgctgcgtacgtaccagtgatccgacaccaacaaaccgagacagacacagtcatccatcggcaagcccggccggtcagccggacctcctcgctctgacagacacagtctcagcagctagtactagctaccattttggcacgaacgaacgctacacacgccagcgcgggtttggtggcgcccggctgattgatgcctctgtcgctgctccgtcggtggccaacatatcacgttcacgaaacaaggaacgccgagatgtttggcctagctcgtcgtcaggcagccccgatcgagcccttgttgccttttgcctggccacgcaaaaaaacggcagcggcaaccgcagctaccaagggagcagaagacgacggctgggttcgggttcaggtgttgcaaggtggatggaattggaatggatgcgatggccgcgccctgcctgcctgcctgcctgcccagctggctgggctagctacgggtgtcatcactgaccagagtgtgtgtggccatgtccagcgagaggaagtgagtgaaaaggggggggggggggagcagtaaagctcaaggcatggttgcggcggcaagcaaggagtgcaacccaagttttcgtctagttaacgctgcaaaagctccga

SEQ ID NO: 2047 - DNA, 1851 bp, Zea mays
  misc_feature (1)..(100): optimal_loci_2183_G1, chr1:11472166..11474016, Cluster 12
gcatgaggtggcgaaacaaaaagaggattcatggacccgaaacccaagcatgtggtcaaggacccaccccaaaaggcaggaacggtctttgtttccttgctccgttcatgtcttttgataggttcccttgtcgtgatcccatgtcattttttcttttcataaccgtaagacttttttatttgcaaaaaaaaaaaaaagagggcgagcaaatggaacaaaagccgagaggcgaaagataaacgaaaggctggtcagcacaaagctttggcttttcgtctgggcgggagtttacacgggccgccaagtcatgctctgcaaatggccggtcctgctgtagcatcacagggccaccagctctccagccgtccaatccgattatgcatacctccaacggccaacaattggcatgtgccgcggcccggaactaatacagtccacatcgctgacgacagcgtttcgtttctggtgctcctctgatgcgtgtttctttcgtgcatttggcacccgtaccgtacgtctcgccgacgatacagcagcagcagcagcagcagcgaatggataggggttattgaaaggctactgcattattatacatcgatttattggttatactgtacaatatagagcatatagccggccgggcgtttgcgattgcgaatggatatgggagggcgggcgggcgcgtggtctcttacgttgcacgccggattaaaaaacgcttccgaaggtctgcacgctcacgctacccccacgtaacgtccacgcctgaaaagccccggtccaagtccacgcattccgtcgccgtttttgctttgttggtttgtttactttactattccgtcgcgatggacgagcgcgagacgggcgaacaggaggagtatccgagccaccaggccccgtctgagagggctgtctgccgtgttcgctggacatggtttggtggtggtggtcgtgcctgagcctgaaggcatgaaaaacgcgcgcgtgcgaaaagcgcacgcgcgaatgcattctccttctccctgccatgccagtcgtcgcttcggttggttcaaaaccaatgttcatcactgaccttagctgctgctgcttcttcttcttctacccgctagtcgcagtagtaggtagtttttgaaggaaaaaaaaatacatatgtctcccttcattgctggtgggggtcatcgaacgtgaaaagggacgtgaaccacgtaaaacgacggcacgacccaacaagcccccaaggcttcggagtgtcattatctgccaagattttgttttacctgtctgcgatgatgatctattgctagatcaccatccagaccagagcagagagatccaagacgacgatatcgaaaagcagtctgcatcatatctatcgtcgtccgtctccaagagccagcggacttcgcaaggagacgcagatatatggcacgcaagcgcgcacgacgaattttgtaaaccctctccctctctctgtccttcagtccttctcggctccacgtcggattggagcagagacgagaccaggtgtgcacgcacgagcacgatgcgatggactattggactcccactcccaggcatagcatagcacacgacgccggtagcatgactatttaattcgttgtcaaccaagaaccgcacacgcaataatggactttgtctagctgtccgattaatcgccgatgaaaccgaacgccatgacttggatttacgatcgaaacggcggctactactacggccacaaaaccagtccactcgctgacgcaatgtacgatctcggtcaccaaacggagggtgtctctaacagacaagaatccaaccaacgtatagacaattacaagaagaagaaga

SEQ ID NO: 2048 - DNA, 2413 bp, Zea mays
  misc_feature (1)..(100): optimal_loci_222629_G1, chr6:96564503..96566915, Cluster 12
gtttggatgggcctaacgcaggtgggttggctagatttgtcgacccatgcacatatataaatcacgtgatcttgagtaatgttacttagagcaagagcaattgggaaagtatacagcatagacagaggcatagagtgtttttggttgatttatgacttttcaaagagtaggcgttagttgtaggatgtgggaaaaaattgttgtgaagtttcggttgtgagaaagccaaaagttgttggattgagcagttgtggctttctcaaaaaattgttattcttaccccacatgtcatctatagaccttcccatcacttcctctctcaccaaagagtgaattccacttgttagacttttctctcatccctcttcttctggtccatgcatggggaggagcctacgacctaggttcgtcggatgagaaatccgcgacaaagctgtgaacacttgctcgctcgctcgccatgatggaatcctgctcagttagcctaagttgtctaattaaactcgcctcttaaaagtatgactgtctattttaaatctgatcacacaccctatttcatcttgatcggtaaaaaaacgaaaggtcctactttatgcctttgtcttgagtcattttatttcggttttcttcttcctgtttcaatgttgagtatttgatcatcctttctagcaatcatcatccttttctatggttgctaaccttgctcaaatttttgtttgtgggtttaatcatctatcttagtcaaaatacttaagtagaggttaatgcattacttgtctcaattactaaaacacatattgagatttaagccgcggtggagctgctcatatgtcgagaaggtcaggacaacacctctctcccgacaccatacctttggttggccttcgcgtcctcccccgaggccccgatagggtacgtgcctttgggcgtcgacgaggccgcgcgcctttgggccagcattgatgggcatcgatcgacaggaccacaccgtcgaggccgccggtgagaagatgggctccggtggtggcaggacgataagagagaaatagtattggaaaaaaaagaagagtgatatctttcatgaccggtgtcaaatgtgtatttttttgtttaaaaaaaaagttgcccaccttcacgacatgatgtgaaagcaagggaagggggtgtgctaggttttgcactatagtaaaaacagttttagcctcaaagtagatataaattggcattcccttattttttgttttgttttggaaaaggataaaataggttgaaagtgggggtataaaaaaagatcatgatctgcccatgttctcgtcgttacactatcactgcaggccccatgccgagtgccgcagaccaggtttgacctcactttggtaggtcagcgtcaggtcgccgtacgtgctgttccacggcgagtcggcgacggcgcatccacgtaaaacgtccgagaccgaccgatcgtaagtgcctgccttttccttttccaaccgcggtcgacagtacaagaatccttgcacgtttccgacgctagctttgttggacggccggccggcctcgcagtcgccgtcgccgcaaccgcaaactggagttccgttcgatggtccggctagcagatcacgtacgtgcgtaggcgccgaaagcgaagcaacgggcgggccagccaggaaaccaaccgtgtccgagggccagggaggaaagcacccgctgcggcatcgatgcgaacgcgggcggctagctgggaaccggatgctagctcctccggcgagacatcatcggacggcggaggcgaggcgggaggccagccgtgaggggatcgggtcgacgccgccccccgctgcttccttttgcagcagcgactgctctggtcggcccgggataccgtcgtctcctccatgtgcggccgacgttgggtgggtgggtgaggactgacgcggcatcgatcgctttgttgtgcgtgcctgtgggctctacagccattgacggcgcacagcagttgtgcggaaaagcaagattatcagatagacaaggtcgatcatcgtgtgactcatgcatgcatgcattgatcaaacgataacattccaccggatcaccgagaagattatcggatatctattctcattctttatcatcatcagatagtataatatatatagagtatatatataacacggtcgagaaggtaaggatcgattcaaattccatcccgtcgtgcctaatgaggtagctagctagctagtgataatatagtaaatggtccatcgtcgtcgcacactcagtgctcaacgatctttcctttcggttttcagacatagaagcggtactctgattgcattgcacttttgatgacgccccaaaggtcgtacacttcaaacagagagtaacgctcgtttgccaggctctgactattctt

SEQ ID NO: 2049 - DNA, 1539 bp, Zea mays
  misc_feature (1)..(100): optimal_loci_224846_G1, chr6:108062373..108063911, Cluster 12
caggaaaacacgcgctactagaaagtctcgatcggggggggggggggggcggcattcttgtccgtcacgtacgggtcacggctctgcactggcgcgtaaacgaacgtcgtgctcgtgcatgctggcaggtgacatcacgcggaggtggccaacgtacgagtgcgtcgaggttgcaacgcttttttttatatatattaggagttgatgtttatgagctgtcgaagaagaaatctttttttttccaacgctttcaaattttttttgtgatacttggactttgcaatatcagctgcgtggacaagaaatgacgacatatatagccgccaaaaagcaggcgtggtttgaatgaataaaccgaaggggaagcacttgaagcaaaaacagacgattggcccactcacacgcccatattgccccgccgtcgggtgactcggatgatttgcttttgaacggagcggtagcacgatacagtgtgatcataatcgtcgtagaccaagtcatgagcgaagccttcgtgagaaaggaacgcgtaatgaacgaggctttttttgtgttaatgttgtgctgtaactttaaaaaaagattaataaacgagggctctatctagcctgtttggttctacagaaccagctagggcaggacgctgacccagtcgatcgagcacaaaattaaatacaacgcaacttagatctatttactttttttcccgttattattatatactcttacgtagtacttgtaatacttattagatctctatttacttattattttgtaacctgccaaatgaggaggcgtccgcaaggcaagatccttttgacgtggagcgagtgcacctgggcatgagaatcgcacccgtcccgtggttcacttctccctcacgagaactaagatgacaattattattataaaaaacgatcgatctacgtctgctacagtgtgtttttgtgtttgtaagcggcttcgttatatgatgatgatgatcgtcactgctgactgcatggctttatagaccatgcatgagttccatgcatgaccatggagagtgagcaaacgacgagatgacgcgacgcgatcaccaatgcatcacgctttggttgtctctgtgagtgtcggccgaggagagccgtgccacgttcggtttttttattatttacatcatacatatagtctgttggtccagcagcttccattaccatccatgacgcgagacgtgcatccatgaaacgggacgggcgtggtccgacgatcgacgtgtctctcgatctcatccatcgagtttgagggacgggtaagtttcgaggaagcattcctgagccctcgcgcgcgtctgtgtattctagtttgggcattttggcttcttgcgaaaattcgtccaacttgcgcggaacaaactgttcagtccagtgggattgggagcttttcgctcgagaggttccgtgtgtcgtcgtctgtgcttggctgcttgctttgcattgcatgtctggttcgagtgactagtaccgaccaggataaggagattcgagtgtactatctgat

SEQ ID NO: 2050 - DNA, 1503 bp, Zea mays
  misc_feature (1)..(100): optimal_loci_229575_G1, chr6:132265957..132267459, Cluster 12
gcagcgtcatataatttctacttcaattcaccgctccaacatgcccgaggcagagagatgtcaatgtttcatggcatcaacactcaataaccaaagatgtccatcgatgctattacatacagtattagatatctgtgctggccagcaatgggcattcgtttgcagcaattaaagcctacatgagctagtttatgctacgtgtgcgtaaaatgctaacagctgcaagcaaaatattttggaattcaccaaaaaaaaaaatcccgaatattgataacccgccgcatactctccgaagtcacaatgtggggaattgaagctcgctcatgacccgggccttgacttgttgggccactgattgggccgtggcccagcagtgtccttgaggcccggtgacgtacagtgaggccttgagcgcatcttcgtctccctgtcctggaggctggatggtcctctgtatttcgtttgtacggtacggcggctagccagagccgcatgctgcttctgcagcgcgcagagcaaaaggttagaccgctagagacaagggagcgcgaactggaactctggaagacgggtacagtacctacgtagtagtagactagtagtagtagtacgtacgcggcgcgaggctgtcagcccgagcacgctgctacgccgccgagcgacgctgacttaacgaagcacagtacgtcgtagtggtcgatcggtacggtgcacggagtgagccaatgcatgcaatgcaatgcaatgcaagctaggctgatgaggctgcagctgctcctggccgaagcgaggaatgatgcgaccaggaagcaagcgtacaaacagatccggctgagaccgcttctccgtcgtcgtcgtcggcttgcgtgctcccgtaccttggacgcgcacgggagactgagcagctgggtagccgcgcgcaggccgcagcagggcgcgcgcgttcgtacgtgcgtcacgggatcgatgatgcggctggccgaacctgggggctggcgcatacgcatacgtgtcattatcaagaagaattacgtgtacgtacacagcatccgctgccactactagtttgtagtttctctcaattatttctcccgctaggtaatttgactgctgccgtagggagtacggctgctgtgttttttatatcacgagtacggctgcaggttgagtgccgggtgtcgtttggttcactggaacgtaaataacgttaaattacatttatttaactctaattataataagatattatattaaaaattgatacttgtctatttaaaacagagcgggtgtgaattattattattgtcatttatgttatatttagtgaatcaaacagaatatctgttttggggatcgttcaatcggcatacgaacgagttggcgtgcacttcaaataaatcgcagcctcaggtacatggaccacaactaattcttatttcttatccggtaaatagtcctaaaaacggagctcatattgatcccgcctgtatatgcaccgtttgg

SEQ ID NO: 2051 - DNA, 2544 bp, Zea mays
  misc_feature (1)..(100): optimal_loci_231810_G1, chr6:142317325..142319868, Cluster 12
cattggcctagctatacgtgtggtgtgcatgcatagtacaggagctataaaaaaattgtacccagaagtttttggggtcggaaggatttacattttttgatctgaaaatatataattaaacatccgtagttactcgagaggccaggcgcattaaatatacgctgtaattaaccatatctgaatttttgacacatgttttaatccatcaggtactacagagagatagtttgcaaatatcgtcgttgttttagaaaattaaactacatcaatcaagttttagaaagagaccatattgcacttttattgggacgctttttatctagccagcatagggcagtgacttaaaatccctagaatcgggatgcacagcaatgacgacgatatagacggccggccgggacctgtcaacaataacatgtatgtctctctatatatgagcaacaaggacacccacaaggcagcaattgtgtatggtattatttgtggccgcagcaatttggcggagttggttatccggcgctttttttgcctacgtggataccatgtgtcaccccgcttgtcctatccggtgggattgaatggacacgggatgaggccggacggcctgcgcggcagccgagtcggacggtccacctggaaagttccgctctatccacaattctctgcctatgtggacgcgggagagcaacgtgtcgtgcgacgacaagcggtacgcgtcaccaacgtgtcctggtcctgctcacgagttttttttttggctttggcttttgcggctgctttagccgtctggcctaattttatttatttaaactccgtcccctggctcgtgcggtcgtgcctcactttctttaagctagctgcaccttttcttttttgtttattccctagctactagcactgttgtcgcgtatgtgttcggctggcaggagtctgaccaggagagaaacaaagctacgtgtccgtcaacgacgtgtgcctgcctctgcccgctgtagttgtcgatgtctcaagaaggtagagaattcgacggaaaagagagacctgctgtgctgggcgggtcatccttgataagtttatctttatcttgcttgtgtggacgcggtgacatgtcttgtcgtgtcagcagagagcgcgggcggccggctggtaacgatggctaaaagccagccagccagccttctgggatcagaactcccctcacgcacgcacgctttactgcatccggccggcttggcggcggctccgtgatcaagtgcttatcttctttgccgttggactgctagctgtgacgagtctagcacacaaatatcagcaaaaatattacgtgcacgataataccattgttcctggcatgccgatctattttattcggttcgtcagtcgtcacttcatttacttcggaaatattaagtacagtgcgtgtatttggatgggcagaaatgatgcttttttgtagcaaataaaaacgtaataaataaagcactgataaaagagtataaaagaagcgcatgagctaggggcgggccttatatatcggccacgaaaaatagaaaaggaaaatacaagaggccccacaagctagggggggggggggggggggggacagcgctcctactagcttactatacatgcgctcgggtatatacaggcagcagcaacaaaaaaaaaatggaagaggaaaaaaagaggggggcaaaaaacgagggacgtcggaatcgactctggtggtggaggaggataaaactataagcaatgcaagaagaatgatggcgctgtgtgttacatgattaggcatcaggggcccccaccacagttagctgataagtgcagcagttaaatggcggctaaagctgacgaaccgcgggtcatggaggagaggatcgactacgtactcatcatcatcatcatggcatcgatatccaagatctctcaacactagctcattagctagtctgctagtaagtaacttgaaggatctcctgctatgcagccttactcctgtcctgtcaccaccgtggcaccgtaccggccggtcggttagactcgtggaagatggaccggtcgtaccagcactagtgcacgcacagagagagttccagtatttcttctcggcgtctccgtccggcgtcacggtcaccgtctccgtctccatcgccgtcgctgctgtttattccatatatatatgtaaaatttgctggctaaggatcagtaaggagaggaggatatctggataacgatgatcggataagccacagaaacaacttgctgaagctatagccccctgctggtctgggtaaggtttccacgtcgatctacacacacacacgaactagtatatatcatatatattgatagacactcctatatatgtactacgtgcgtataccatcgtcacacttggttcatcagttgccttaatttgcatgtgtgtaccaatgtaaaagtctggccatgcggaactgcactaatttcccagagctattaagttattattattagcttgtttttaacgagttttagcagctggtaaccattatatagttg

SEQ ID NO: 2052 - DNA, 3470 bp, Zea mays
  misc_feature (1)..(100): optimal_loci_231867_G1, chr6:142554783..142558252, Cluster 12
gtatgtttaccaacgaatgtgcacagcaagcagcgtgctgcgtgcagaggaggctcgagtccacgttaacgcgcgtacgcacggacggaccgcggcacgcccagcaccctccgtgttccccgtcgggctatatgctcgcaccgaaaccgagctggccagaagccgttggcgtcgtcgccagttcgccaccggcgacctgtcggtctcggctttaatgtgcgtgcaaatcggggaaccacgcccgcgcccgcgatggacgacgcgaatcactgctggccctggcggccgtggttcgctcgatcggttggtgcctggcgcgtgcactgctcgggaagtcggggggcgtccgcgtccaggtccagtcagcccaaggacccagggaaatgagtgcgcgcacgcgaccctggcaacgggcaggggcgcaacggctagtttcatggcgcccccggcagaaaacgccactggactgactcgactggcatacagtctacacagcagcgccacggtgggttgggccgttggggtgagtgcgcctggggcccttttcctgcagggaatcggcgagcgagtactgagtgactcctccgtgcgcaactggccctccgtgccggttgttgtccctgcctagtagtgcctaccgactcactgacggtgatttccgcctctctgtctgtctgtccgctagtgctgtccgagtcccgatcatcaaaagaaaagaaaaaaaaagtgttgtctggatccaggtccaacggctaccgtcaggagtcaacagtgaacttctgacctggactggaccagttcatgcacctacggattttctgacacggctgtatatcattcactatcacttcacttttaccaattcgtctaccgttctatagagatgcatttgacttgctaaacgtggacagatgaaccttaacgcactcgccgtaacgcactgcacacacagcttctgaaccggaacaatatctaaggcctttttcgcgatcgtggcttcgtgatgcagtgtagtgtgtaccctatgccagtttcgcctactttaattctcctcgcaagggacggacgcccccacgtagacgtactagtagtagcagtcgcctttgtcaaccgtccttacaaattccgctgacttccgaggaggccaggccaccggacgctgtcctcgacaacaagaacacaacgcaacctgtgcgggtgtgctcttctttacgcaaaatgcgaccatacgtacacgcacgcacgcacgtacgtacgtacgtacggcggtacgggcattcttacaagtgaagtatccgcgggacgggcagcggagggtagaaagagggagggagggtacagacagagaaagagtggaggagaaggcgatgccagcagcaagtcgcgttgcctttgccttgcctgccgctgagtcagcacggcccggcgtggggcgagcgatggcaataatattgctgggggaagagaacacgaccggttttgtggtgtgggcggcccacggcctgtggtcggcaggaaagcgagagagctgcctgcggggccgaaagggacgcgtggtccggcccaaaaaacgaccgaccagcgtgcggccgctccactccatcaccatccccatcaccatccattatcccagtccagtccagccacgtgcagagaggcaaccatcaacgacggacgggggtctgcctgcgtgcggtgcggatgcggatgcggatgcggtgaaagttggcagttgcgccgacgacgacgaagacctcgtgctctgctgctccgcatcttcgcgttttgttttggtcggtggggtgatcaccccgtcggtggcccgccactgccgcgtgttcctgggaaggtcgacggcggcgtagcaaaaaagaaagaacaaagaaagccagccctgcggcggggcggaccatcagcggcgtacgtacctttatggaatggacggaccagctttcttttacgtctcattttcgccgtaaaaatgataaaatgtacggaccagctttcttttgcggctccatgcctgaaaagataaatgaaaaaaaatgtaaagaacgtgagatcgcggctgcgattatcgtcgaccacagcccacggaacggaaatgtagagaagggactcgcgtgaggtgcgcgatggcaatgcaagctgccaacctggggcagtgttcgtgaaaggagtcctgggggctgcccggctgggggtggcgcctaggccagcggtgagcatcgaaacatgagcaaaagggaggaacaagtgaggtagaaggtgaacaaatcgttatttctccgtaacccatgatacggtgcataattcttattgagtccactaaatctgaatctatttttttttcgtacgaagcgctaacgaatgtgtccaaacttcaacaatgcaaatgcaccaccaactcgatggaaaagcaacctcacaaaccggactggaatgcccggtactttgggccgcccaagcaggccttttttttgggcttctgccggttgcaaaagatagctggagattttataagaacgaccgaaactgaatgagagcacgcactcagctagactagacaaaacgatttgctctcagtttttttttaaaaaaaaaactttaccaaaataatcttctctttagcaagctatatgcgaaaatatcgacggaacatggtattcaaactaagcctagaaattagctacttttttatcggcacggcttacttattaccggcctctgattcttgcagattaatatacgaaacaaaaattgttattttttgttgactcgcgtagtggattgaaattgcccttttttaattaccaccaattattcgtgaccgacgaaaattagcctagttaattttcatcgcctagtcaagcaataggaattagtttagctaatttcagtcaactaatcataaccaacaaaaattagccttgacaactacatgttaattcttacatccatcaacaacaattatatatagacacacactagtatgatgacaccacggtttacaaggtacgagtatgcatgacaaccttataaggagaattctagctattaaagttgcattgtatggtccaacgaccattgccagattagttcgacacaccctgtaactctctgatctgtttgaacagaccgttagatccatcttccattctccaacgaactaccattcatagggttcaacgatcaagctctcttaggctatctacatggaggcgtcaggccatcgttattagtccaatgaccctaaaacgttaggatctgattctgatgcctctaaaaccctcaaatattccaagctatggaaatattatgagtggggtttgatccatacgtcttttggggtcatctgagcttagtgtgtaccatactaaatttatttgacatacctaggtcaagctactagttcgtacccctttataatatagttacagtaaataaagttttaaactactctaaagaga

SEQ ID NO: 2053 - DNA, 3417 bp, Zea mays
  misc_feature (1)..(100): optimal_loci_232484_G1, chr6:146122164..146125580, Cluster 12
gctgtcctactccgttcgtccagtgccgctgtcgccaccagcctggtgtcacttgtccctctactaggccgtaaattgtacagaagaaaaaaaaaaaattggaggttgcgtaccgtatcaaaactgtcataattctgaacatgtgttcggtttttggtttagggtgggacggatcagtgggcatccttgtttgggacaggcagattagcatcctgattgacaagctgttagatcagcatcgaaacggtaagcgacgagctccaagcgcctatatatgggcatatggctgcgttttgttattttgcatggttccagtttctagtaaaagtgatggttccagtttctagtaaaagccatgattaacgcgctgacagggacctttgagaattactagtccctaagtacctcgcctgcaacttacacagaccctaagggtccggtcccatcatgtagattctgtcactgattgactatgcgctgttaaatcaccggtacgtacgatcgcaaacaatcggtaacgagcaaaggagcagctgcagttcttttcttttcttttttttttgttagctcttgtcgagcatgggagtacgtagtagggatgcgaaattgtgcttctttttttttggggggggggggagggcaggaggagtacgggctatccggcaccccccaaatagtgcgcaatgtgtcccattgacgcggcgcaattatgtgcaaggaaggacccctttcatcacgtttcacctttccgcgcgcggaccgtacgggacgggacgaagggaaaatcccagggccgccgtctatcctgagggcaaggcaaggcaaggaaaggaaagaggccggccggcgcaatggcatcacatgtgttaaacgatgtgtcctgtgcccggcggacctagcgcccaagctcattcattaaaactcggggcgcgcgtacactgccgaaaggcgacacacacctttgccttgattgaacggatgacggcgacggaggcctccccgcccgtttggtgcagaggccgagaagcggacaggcagccggtacggaacctggcgagcggtgagccaaacgtttcgtctactaccactcccaccaggacaccaccaccacctcccgcgttgttcgttccggcacggatccgccaggttttttttctctcttcccctttactaccctggtggcctggtctgtctgtactgttttgatagtgccatgatatcagacgtcctggcgtggcgtggcgtgggtgggttgtccgttccgttccgtcgcgacccaccggcatccgcgcgacgggatatttgcattcgtggacacgtctttgttcaccgtccgccagacgttaaacgtgttgttgtttactaataaaagaagcagccaggcacagctttgatcggtcggtcgtgtggcgttttgtcgagttgatcggtcggtggctactactactaggggtgttgctcctccgcttgtttggtcggtcgtcacaccagacgcatcctttctacacagtcctactagtgctggcacagcagcgcccatcgcgcgcgggcacagagaccgagccacagcagcgtggtcaaccttgtcaacggattttgttttccgtaaaaagatggcgcgagccgaagcccagcggtccatgacaccaccattatcctctcggttgatcgttatctgacccgacgacgcgcgatgaaacaaaaaaaactcttgtgttctgtccggccagccaggcgccttccggtcttcggcgatactagtaccgtagtacgtgtgcggccggctcggcgcggcgcggcggacgctggtgggcaatagcaatacacgtagacgtagcgatcgaatcaagcgaccagctggtggcgcctggtagtgctcgcgtccacgtgacggagcgtgggtggccaggaggggtgcgtcggcacggaggtggtgctggcgagacgggggttggttgtctgcctggctacttctacttggcgcgccgccggcacgcacgcgacgcgagtgaggatggctgtctggccgcgctgggcctggcctggcctgccccgcctcgcctttgtttttttcttttcttttcggggggttttgttggcttgtggtgggggaatccgcgtcgccgtagccttcccataggcttttggcgccttgcgcctggtcgctgctacgtgtttgcttcctccgcccgcctgcccgtacccctcccccccccccccccccccatcccactcatttcacactcgttctttgtcttcccagcggataggatcctttcctttcctttcctacatggcaattaatgttgagcggcacgccccacgcacccacctcgttcctttccagttccttcctccctcccggccacccctcgctcgcccgcgcgttttgacttgttgtccaccgccgctggcgctgttctgtccaccaattgggggagcccacacaccggggggcgctagtcctggtcctggatttatttatggactgcttcaggcccccccgttggacgcatgcaactcggagcctctgtacttttgtttttcttccgtgctgtagctcctccttcctagcttggtgcttgcttgactgctcgcgtcgcgccttgcggcaggaggactaggccagtaggccgcctacttttttcaccgcgcacgcacgcacatggcagagagaagaagattgagggcaggcgaggcgaggcaccaccgcaccgcgcaccactcacggtcacgggcagcacagcggtaaaaactcgccatcacacacccacacagaggcacgggcggggagcttttccgcgtggttcgttcgttcgttgcggccgggtaacgccggccccgattcggtcgtgcagcggctccggacaaaaaacccgggctggcgggcgggcgagaaagtcaaagcagctccgcatcccggcacagtgccagtggccgacgcaccggacggacgtgctggtgctggtgctggtgctggactggaaaagagaagaaaacccggggcgatgggcatgtgacaaaagcggtgccaatggctggcgtgctggtgccgccgtcccgcccgcgtctcttccacctccgcgttttattttttttatatatatatctttgctgtctgctgcaccgcaccgtcgattgggctgctgctgctgcggctgggtgcttggcatcatttgggttggacggagtagtagtagtatcgtgtatagaaaaagggcggccggatctatgccttgcctcccttccctctccacctgttgcgggtgataatggcgaggcgagggatggatggatggatgatgcgctacgccgaggggatggatagctttgaacaattgaaccggtcgcgccacgcccacgttgacgtcgtgtcgcttctggagcgctcggcataaaaacctcctacggccttac

SEQ ID NO: 2054 - DNA, 2215 bp, Zea mays
  misc_feature (1)..(100): optimal_loci_232497_G1, chr6:146215663..146217877, Cluster 12
aaaaatatccttgtacataagaggccacccttgtcctttgaaactactaatggacaaataaaatcttctacatttagatatatttagagtagttggccaagtacaggaacggttcgtggtcgctaattgcggtgcgtggctttggcgctggcctttactgtatgtttatctgccgcgctcgggctagcttagctggcgctggctggagggcgaccgcgacgccgacgcggaagggggtccgtgcgcgtggtggcgcgtgcgtacgcgacgcgccgggttgcgacaaaccgggcgttccgcgacaaaagaaaaggggggcggggggttcgcgaggccaggccgggccgggcccggcgcttgattactacgcgcggcgcaccgcaccgcggttttggtcgccggaccggacggcgaaacgcgaaaaataaagggtttctggcttcagctctgcggtgctacgctacgcgacaaggtgggggcgcgtggtgctcatgcttcgtagtagtagtagtattaaattattggcgcggtgtactagtactattacgcctggccattagcgaagaaaaaacacatgtctaggatttttttttttgtcattgccagcgagacaaaagaccacttccggatcgagaccggcggccggccggccaggcgtgcttgacctgtgcagcgcaggagcgggatcgagcgcgcgtgagctggttgagcccagcacgtttcgcacggaccaacgtaggtcaagcaaagcaaatgccagtagcagggtccgtgcatatatataaaaaaaattatgataataatcacgcatggatggatggatgcagcctcgacgtcgagtggctggctggtgcgccgagtagcagcggtactagtactactaccacgcacaggcagcgttaatgcggatccatggccacatcaaagttgccagcgacaagcgatcgagtaccgcaccgcaaacgtccaatgccgtgcggcgtgcgcctaccagtctaccacccagctggagtagccagcgagccaagagcgcgcacgcacgcacgcgcacggccgggccggcgtcgcttcgatcgccctcctcacttccagccagcgagcatgccctgctgccgacctcctcgccccggccgaggaccacccccgctcggctgtagcgtgcgcgcaccactacggccgggcccggccgaccaagtcatttggcagccagcgacgcggctgcagcgttgcgtatgcgccgtgacaaaacgtcgcgggtcacgacaaggaggagacggagacaccccccaccgcggtggacgcgcgtacgacgccgacgctggccgggggccaatgaacggatagggttggtttgggctttggcctccggcggccggcgccacgaaacaaagccgggcgcgtgtgttggggaattgctgctgcggccagggcgaggcccacgcgcgccgagacgtgtctctcgctcggctcccccggccttgcgcttgcgcggctcggagtcaagtgtcgagcgtagagcctgcgatccggtggcctgacacgagtctcagttttttttttttggccattcaagtccagtccgacccgacctgctagcctggtcaggtctattttgtacctgtgtcagtcagctcagtctgtacggcatcaggctacgaatgggttgcttccacgacacagcgagcgccacggtttagcccgaaccagcccggccgttaacggtaggcacatgactccttagactgatccaatccaaaaaaaaaactgtgcctgcagtagcgcgaaactgacagtggacaaacgaattcattcaaacagaaaatgtgccagatatagttgagataggaaaaggtaatatagaaacaccgacacacgtatactcccccaaaacaaaaacttatcatgataccgtcaacacacatacgtaacttcagttttatatatcttgaaactaatgagataaaagagaacaagagtcaatatcgcaaatccaccgtaactcacgcagctatccaaaacatgtcaggcgtgtttgtcatgacatcgtagttgcctagttggcctggttagggagccggctgcaagctgcaaccgcccccggcccgcgcttagtttttttttctctcgtgttcggtggctcctcgcctgcctacgatgatttggagttggggcaggcgggccgtgggctcgagcttaacattgtggaaaaaaacaa

SEQ ID NO: 2055 - DNA, 1704 bp, Zea mays
  misc_feature (1)..(100): optimal_loci_233530_G1, chr6:150297056..150298759, Cluster 12
tgcgtaatatagtgcaccgactcttgattctgcatttctgcccacgtgattaacacatgctaattgaacaggaaccgtgttatgaatatatgaaaagagccccccaacgtactaaaagaaaggcgcacacagacgtcacgcggatcatatcggagctgttatttgttttaacgaactttgtttttttgatgtaggattccttggtgtgcaagctatagtaataaagcgatctccaaattaaatataagagaatatattaattgcatgggcaggcagtgtgcttgctaataacctgcttcgaagaagtagtggcccggccgtgtcggtgcggcaggcgagtagccggtgccggtgccgccgggcgtcgccattattgccgtaggcggactattctctggccgggcgccggcccacggcggctggtacccttcgccgccgccagcgacgacgtgggccagagcccgcaccaacgtcgacgtctcgagagcctggtacgacgagtcaccggacaaggcaccgccggtcgtctccgctgccgcatcgtcaccgtcgtgctcctccgccggccagcagcctgctgattgccggcgcgcgtccgccatctcgatctcccgctcccaccacgcactacgtacggtcggcacggccgccctgggggctggggctgcaatgccgcgcgctagtggtgggcgcacgtacgtacgtagctcgtagcacacgtacgacgacgacgacgcgtcgaggctgatttaagcagacgacgggatgtgtagatgcaatgcaatgcagatgcaaacgcaactgggggtcggtcgatcgccggttgatcggcatgcaggaaggaggaaaggacggatgatggattgaggcggactaaccagccgtgctgccgaatatatatagacagagctactactactagcagggagagatatactatatagacggacggatatatgtactgtgtgtttgtctcgaaatagatggaacattctacttactgtacgcacgtaagaagagaatggtggaaagagagggggggacaacatgtgttgggatcgtcatacgtttctcgctcgccgccttgaacaactggaaaaataatagtgcgcggttcagatttggaccgggtcgcccgctgaccgcgcgttacctgctgcatgcatgcacgagagcacgcacttgcccccactgttccgttggtacgtaggcggcgaatggattccctctggactagtacgtaccacgcattgattattactacgtatggattagggaaagtgggcgatcggaattattagtcgcatcgcacgagagagctttgccagtttcgtcgtgcattcgggctgttattacgtttacccggattatctattatgagtacgtacgtagtcaaagcgtgatggcagcagtctcgtctccgccgcctcctgtttaacttgcggccggatttggatacgcgtgccaagcgctgacgaggccgtttccctccggcgggtgtggcggcggcgaccacgacgtacgagatgcgtcatgcatggtttctgaggggaacgcacctggctggccggccggtggccgccagtaagattcatacgcgcgcgcgcgcggtcgcagttggctcgctctggtatcacaacacaacactgcctctggtggtgtgcatgcgtctctggggtgcattatttcattcgagatagagat

SEQ ID NO: 2056 - DNA, 1430 bp, Zea mays
  misc_feature (1)..(100): optimal_loci_233633_G1, chr6:150839464..150840893, Cluster 12
ttttgtaaatagttttaatttttttattctcattccatctcgattctaatccagctaacaaaacaccatattttatgattaggtgcaatgcaacacactaatggtttattttgttggacgtacaaagaagaatgaaggggacggctatattttatataatgtttagatgagaactacaagaaaataaggtgaacacctgagaaatttttagtaacagtagtcttaaaaaaaaggtccgtgtcgccccggcttatcttattttgaccttaatcaaaaccaaacacattcgtccggcaccctcgccgcccagccacagctgtggcgggagccagacgcccagacatgcccaaaatcgggcagaacactggctagatttgcctgacgccgaggatgtctggaggctggagcattcattcacgtggccaagacgacgcgtgaatcctacctagctcatcaatgcttctctggctatttagtagcccactggacaacatcaatggcgctgctgccgtagcgccatggcccatggctgcgtgcttgtccggagagagtactacggcgtgctgtgttgtacagtatgtagtaggcttgtagtatgtaggagtaactacggcatttagtgtagtagcctagtataaggttagatcttcctgtaccactgtcatcttcattagaccaacagctgctgaagatcgtggacgaacgcagctgggcctggtcggccgcgtttatggacgagcacggtcagcttttgagtgccgggtcggtacaactcttactactactacagttgttggccgttgctgccactgccgcccactcactgaaggcaggcgccaggcacagccagccgcacacgcacacggagtggtgggtgctctcacgccatcgttatccaaaatggcgcgctccccccgtcccccactaccgaaaccagtggtagcggtgatgtttgcggcgcggcgcgtggctccgccgcatggaagccagcggcctagcggctagcgctcgcacggccggaaaggcggcggagctggacgtcgctcagcacaggacggggcgcgacggcggcgagccgaaagacggtctgcgcctgctgatcgatctcctgggcgtgcttggcggccgtgggcgatcgcacgatggccgatgggtgcggctgcggctgcggcctatcgccactggggaagtagggagccgggcgtgcgtgaccgcccggcgccacggcggcacgccgaaacggcagggcaaaacgtgcgcgcgttgctgcgtaccggacgtccgtgtcgtgtcgcgtcacgagggaaagctcgatcgggcgcgcaccgaaaccatcactccggcgaagcgacgcgaagcaaagcaaagcatccaaggagaagaagggggatttgtgtgtggctgtcgcttccttttcggtgagccgagcg

SEQ ID NO: 2057 - DNA, 1685 bp, Zea mays
  misc_feature (1)..(100): optimal_loci_235546_G1, chr6:159828361..159830045, Cluster 12
ctagacttaggtaaaaaaaaaccatggacacatacatctgagctgcagcacgaacgagctgtcgcgaacatggacgacgacgacgcatgcatgctagaagtagatcatgggcgaacgtacgtaccaatgtgggaactgtcaggtcttcccgccgtgccaaagtcagacgtggaacatggttgtgggagctaggtcaactagaaatatttcactttatttatttccccgtccaatcttattcttatatgcatgatcatcactagtagactatatgggccggcggccaatcattttgagttaattaatcgcgcttgatcatgccactgagaacatcccccctccgcgccgtcgtttcgtttctatctgcgtcgcatcggaagctgcgcgcaacccaataatgaaaagcatgcatgcgcaaataaacgaacgaggcgcgacgagttcgttatggacttggtcacccacgcgggcacgcggccagctgagcgaaggcgtcctccgctagctgtccccacgagcattgacgtagaacgaagctcattgaccaagctggttaatgatcactgagtgtgtcgttgcttacaggcatcggctgcatcattgggcgcgtcacaactcgactctcgccaaatgccacacagtgtgtcgtcgtccgtcctgcaacgacaacggaatggagtgtacgtattgaccaacaaaaaagtgcggttgacataggaggagtgtgttgtgggacacacgttccctgtcctgctgtctcgctctacgaactctctagcttagcgtgaggtctttttaacaagttaaatgacagagagagaaaaaaatacgaaggggcgatctctccacgacttgaagtgtttggctagaagaaagaaagaaagaaagaaaaaacgagagagctgttttccctgaatattgaacacatggcagctgtccccggcactccggtagtcagtactacagtagtagcgcgcacaatgtactcatccactggctatgccgtttgctacagcttcagagtgacggagcgccccctcaacaaccaataatgctgcctctgcctgtcaccaaggagctcgagtacgccaggaaccaacccccgggtgtcgtgggcagcgacgcgccgcgcctaggaaagtgccggtgccgtgcgcggccacacggcacggcacatgcgacggccggacacacagactcatgatggcgcagggcaccaagctgcggctgcggcgaagacgcgatctcaccggtcacgttaggtgcgcccacctcgacggacacaacacatcgctcgggcgcgcgcgccccgaaccgacgaagcgaacggccgggtacggtggtggtgggtggctttccgtatgggcggggcggggcggggcgctcgggagcctgggacgagagcacgaggcaactcaccgtgcacgtaccgacgtacgcagacgcagacgcagcgcagccacgaggggttgacggccaaaaggaaagacgtgagcactgtcgtaatcgtgctcgagcatcgtggcagcgcagcagctggaggcgaccaggccggaccaggacccaggagtgcccggcttggcgcacgcatgcccacgcgctacagtagactctgctttgccagatcgtcgcagtccctgcaactggcctcgggtgtacatgccgtcaattccattcttcccaat

SEQ ID NO: 2058 - DNA, 2251 bp, Zea mays
  misc_feature (1)..(100): optimal_loci_235933_G1, chr6:162104927..162107177, Cluster 12
ccatggaaatcaacgattcagaattggtggataaccccttgtccattactcacttaaatccaatagacaatattatttagattatctctcatcactcccgtgccgctcctgcagcccctccctctcactctgtgttgtcgcggtcgaccccctctcatctctggggtcataacattagcacgggatatatgctagtactacctctatttttatactcgacaatagaaacgtcaaataaaaaaatagaggtagtatattatataataatgttttcaattctatacacacatagtcaaatgcaaggaaaagtttgattaccatatatgctagacgtacgtactcttgtgaagaagctgtaacattattttgaatacagtaggtgtgtgccgacaaatatataggtacggtgacatatatgcatgtagtaacgttaaggccgcgatgaattagttccggatcatttgcaggcgcctgcgtcgatctgactagtagcagtaggtcgtgcgctctagtcgtggtgaggggagtcatttatttgcccatgagtagaagcactcataccggtcagtataaccgacagcttacacgtttgggcgagatgattagcacacatgagctttttaattaaaagcatccatcagtgggcagcagtagtggcaacgactgatcccccgttgcttctcgccgtgcgtgcatgccctagcccttttcgtttctttttattgtttgtttgtttggttggtttggaaaatggcgcacaacaataacgcactgtgtactgctgcgcgtaaccgctactgcgtgcacaggcacagcttgatgggacaacgaaagcccgcctactaccagctgcttggtcatgtgtggaggatcgagtagctagagcttgaggcttcgccaaaaaagcaaaacaggacgagccgcaaacgcatgcatgcaagcctagctctatacatatgtgcatggaatggaagtgcatatggaggaatggaggatgaagcaagtttgacaattgacagcatcgtgcatgcaagcatatgacgaatattgcacgcattttgcagttgtccctaagatattgagccggattggcaattggcatgtagcagtaatggagtgtgcatgcataccctaccctagctaatatgagtcatatatatgcaaatacacatgcacgtcggtttcgcacgaacatgcgagcgcgcgagagtagcaggaagcagggcagcgctgtcgtacctcgtacgcgtgtattaccagctgatctatccatccatcgtccgattcctggaccgaccaacaagctggaaggcaaagcgatcggcgtgcgtgcatgcatgccccttgggcctgtcgcgtacgtaccacgaccgcacgagcgagtggccgtgcccggcccggccggacgggggccgcgaccggccacctaacggcttaacgatagctccatgcatcacgcacagccgggccgcgtgtggtacggtacgagtacgacgctcggacggcgggagagcgtgcatatgcccctggctgctatagctgctggctgggtactggagtactggggttacttactgccttactactgggtaggctcgctttctccaactcacgcctcctccgatccccactgtggtcgtgtcgtgggctttgtggcgttcgcaagtcacctctcgggcgtgtacatgtactctcggctagtagtgctagtagtagctagtgctagtggcagccagtaggcggcgctatcattcgccgttgctccgcaagctacgtacgtacctgcactgcaccatggcagatgcatctagctacgtacgtacacactacgcgcgcgctagttaggtccgatcggttgcgagctctctgtacatatcaacgtcctggtcccacgcggcgtgtttttagtttcttgacttcttctaaaacttggatccgtgcacggccggaccacgtacggtctgcaacgagaaaacggttgactgttgccgccgccaccagaaatgtggccggccggcggacctactacgtacccgcaaaacgatccgtgcgtgtgcgtgccaaaacgaaaacttcaacgccatctttcaacgtgcagcagcagctttttgacctggtgccgtgccgcgccgctgccgttttgtgctggccggccggaacgctggactggacacatccatcggtgtgccgtacagtgcaggcgactcgatcgaccgtgcgcggcgtgcggctgatttatgtgcccgcgcgc

SEQ ID NO: 2059 - DNA, 1751 bp, Zea mays
  misc_feature (1)..(100): optimal_loci_236100_G1, chr6:163001621..163003371, Cluster 12
agcagcggccggtgacgcctctcaatcagacagtcgtaggatccctctttaggccacgtgaatcggtgtttctgttcgtgtggccaccggccgcccccgcccttctctttgttggcttctctcgccgggcatattcttgcagctcgtccgttccttgacgtggcggggttttcccctgcacgcgtgacgactttatttgaggccagctcgccaatttttttttctccaggcaggtccgagaggaatgtgcatgttttgcttctggcaaacgggccctcgagagtgcaggcagtagcaagtcaaaaagctcagtggctaccgataatagcccgcagtttgtttactactagtagtagttagttaccgcgcatctacgactgccggcgccgtttcacacccgtcgtcgtcgccgtcgccgcgcaaggtgcccggattttcgcatgcatgcactgcagcacccaatcccagcctgaccgaccctgggcatgtcccccaactgacaccgagaggacttggctgacgatcccaggcgcagtccagtcagggactactaaacatgtgactcgcgtgaacgtcactcacatcaaccaaccaaagtatactactagtagaatttttactgtgtctcgcgtgaacgtcacgctgggctcagcacgcaagttcgtcctgcctggtgcgagctagctccgcttccgatccttctatttctccataggatcggagttacatgcagagccgaagagactagctatagctcctttcatgccttgcctggtagtactatactagctagctagtggtgatcaccgagtattttaaacccaaccatcagcgccatcgttcatccaatccacgtagtctcgactcgatccaacctcaggagttcggcggcggcggcggcgacgacgtttcttcttgtccacaaagtttgcatgtcccggtacggtacggtcactgtcgtcgtcgtcctcgcacaaaattaaaataaacggccggatcatcttctatatataaactactctcgcgtctgccgctttgtttgtctaattaattgtctcatcgtcgtcgccttcgaattcctcgtctcgtggctcagcgtcaatgaccaggagggatgtgcagacacactagctagtcgcgataacacgcgccgcacatgaccgccggccggccggacacaatcattaggtgccgggggaattctagcgtacaggtgccggttcacacgccgcggtcgtcgtccttcgccgccgcgccggcgtgtaacagatgaaataaacgtgagcagaaacgagctagctaccggcctctccctttagaaaatcgtggcggcctagtaggtttgaaactttgaatgaaacattgaggacggacgaacggacgtgagctgatgtgccgtgtgaatcaaaggcagatacgaggtgttttttagctagctagttagtagcttccgcctgttctatttcgatctagctaggcttctagtttctactactactatactatcctatatattagtagcatgcgtttcaagtggcggtatttttcgctgatcgatgctgatgggtgcgcttatttgtttcctttgtttgacgagatgggcaacatgatggccatcttgactcagcaatggggctcgtacgtactagtgttgacattgcctatgattagctctcgcaccgggagctgcaaagtctcccttggcatggaataaatatataacttacgcattatatatttattggttatta

SEQ ID NO: 2060 - DNA, 1562 bp, Zea mays
  misc_feature (1)..(100): optimal_loci_236380_G1, chr6:164508909..164510470, Cluster 12
catctcccggggaaccaaactctgctctgccgcacggacgtgggagtgtgggacgacgacgacagtcggagtagatctttggtgatacaggctgtggtagacagtagagtacgtagtacgacatgtgttcagagtcatactagctcacagggcgccgcctcgtctctctctctctctctctctctctctcgtctctgcatgccagtcagtgaagtggttgcgtgtttctacgtgcatgtctcggccgcgaaatccgtgctctggggttccagttccagccgcctcgatcatgccaataatctagtactgtagggtttgttttataaaatccaggctccttgtccgtgaagcaagattgccgcttccatcggtacgacaagacgctcgatctgtgtaattataccagtttacatgcatcaatcgatcgaccagttcacatttttctatttttttttctaaaattggggtcggtcattaccctttagaactgccgcaacctctttctccatctatctaggcatgcacgtactgtagcaggagtagatactacaagtggtctcctagctagctaacaatactatagccctatatatagtacagtcttgcgcactaactcctagtactacgtgatgatgatccaatcgtacgtacagtactcctcttccactagctagggggtccaacactaccgatggtgtgcaggtgcaggggcgctagctctagagtctagacgtacagctgcctgcgtgcccgttccgtcctcgtccgttgcctgtcttgtcctataggtttgccgggtctttcggccgcccatgcaccaacccaccgggcctaaaagctctgttccacggtttgatcgaaccatgcagcacatctgctgcgtgcgtgcgtgcaacacacacgcatgtgcggcggtgcagcagctgtcgacctctttcctcgctacaatctcgtatatatatactcatcagctccggcgcatgcatgcacggactgtactcgtacacgcactgcacgtctgcaggcaccgcaattacgtgacccgcagatctttcgggcagcggtccttggcgagccattaaccgccttaatgatgtcatccacccgcggccagccacagccagcagcaggcctctcccggcagaccgccggccgccgcagcgtgtgtgatttatggcggggcattcatggcgaccaccgcgttgcattaatttacatggggatctgttaaaaaaaaggaaagaaaaacggaacggcgtgtcgtgtcgtgtcgtgtcgtgtcgtgtatgcccgttagctgaactcaaagtacgtactccctccctccgtccctccctcctcggagtcgtgttctttcttgttcctgcttctagtagcaatgaccatttactcgcgccggctccatgtcggatctctgggaccacacaaatttgcacacgccacggactcgcgagcaaattctttttcaccttggtcggtagtaggcgtctgcctgactgtttcgcgttcctgcccaagattctgccgccccccgtgcttttgctccacagccttgagcagcg

SEQ ID NO: 2061 - DNA, 1707 bp, Zea mays
  misc_feature (1)..(100): optimal_loci_240632_G1, chr7:18621746..18623452, Cluster 12
gagatgcatagatcatagatgccatgccatgctatgtgaggagagcctcgcaacggggaacctaaatgtatatttatttatttattgtatttaatggtaagagtggttcggtaatttttgcaaggtgacggtctaaggccgtaagagtaagaggaatcagggcatgaacagtaaacatccagccggcaggtagagagagtccctcgctctctggctgtggcccctatggcgaccgacacgaaaaggtgacgggcccacatggtagagacactctccgccttttctttggctgcttgtgccttgtgcagtaggtggcgttggcgtgcgaggtgtgcatctcgttttcaactttgaaggagccgtgtgtcggcggtgtgtgtgggggcgagcccgtggcgtgtggcgactggcgacagaggaaggagagacgagctcgagctcgagtcaccgacacactcccactggccattcccgtcactctgccacaaccgtttacgtgtagctcgaggcttctggtgtggtgtggtgtgcggtgtgcggtggcagcaggcacgccggcgggcgcgcacgaggaccgcccatgcggcaatgccaaaaagggcaaaggtactttctccgagaggctggcaggtgggtcctctcccgggtgataaacagcttctgcgaactgcttcttctgtgctggctcactctcgtcggccgtcggggcttgccgctttctttaattattttttttaccggagagacaacctactccttctgaaccttttttttttgggaaacaaggtcaaccttatcttcgtccgacttccggttgcgaccgtactagtacttggcatttcggacatcttcaacgcttgttgttgatgggtattatttagtttgaaaagatagaattcatttaaccgccaacaaaaaaaggtattataaagttcagtaatttgatgaggctagtaggtatttgttgcgccctcacaaagccataattcagattcctccccctcccctcctcccccctttttttctttataccatgtaggtaataggtattttaaaaagtttcttcaaaacttaagcatgtgcattcactacctaccttgatatattcgttgcaaatgcggtttccatgctagcagtgacggacccacggcccgacgaccatgggtgcctgctcggactgctgccgctacgtgcatagatttatattgcagaacatgatctaaactacacgatttagttagcccaatgagatttgcccgggctacgatcaaactgcgtgctagtcagcttccaatgtatgaaaatattagtaatatttatatacctaagtgtatcataaaattatattcaatggttaatttagcgatgtttattgacagaggcggatctcgcatcagagcgtgataggcttgatctttgcttcccaccttccacctaacaacgacatttgaaaaggaacggaggagtacgtaaatagctgctacaaaatcaatctcacaaagatagatttgtaaaacacacaacctttattagaccactaaattaaacgcacatgttcttaggtaacgacaaattccagcctcagtcctcttagagaagatgcaatatataggttaaataaataggtccactttaaaacgcttgtagcagctccacattagtggatatgcatgtgtggtttggctttggctaaccactcagcaaaat

SEQ ID NO: 2062 - DNA, 2505 bp, Zea mays
  misc_feature (1)..(100): optimal_loci_244502_G1, chr7:41425984..41428488, Cluster 12
ctcctttggtcccaaaacagatgcgtcgctacatgtcaaactcttttaaaatttaacaaatagcggtaatatttacatttaatcatgattaaaacggttgacttacaaaaaatgacgaacgatgattattttgggacgaacgggaggagcagtgaacaagaaccacagcaaccccgcagaggccaacctccactccatcgtggcggtagcagcgacgactcatcatcatcgcatcgcaatcagtgagccggcccctcctgctgtacaacaagccatgcattcgtgttggctggcgttggttggcgtggccaccacaccaccggcctcggagccgtgcgttggacttgcgcggagcatgcatggcgtagtagtacggggaaacaaaattcgggcagattgggcggccgcggggcggcgtagatgacgcatgcgctctggctctgcaccgcgcgcacaacgccgactgccaggctgccatcagagaaagaaagctgctgcttgcggcttgccaatgctctcgtgcggcgcagtgctcctttcttaatatcttatcggcgcctcccgccaatcatggtgctggtgccccccgcatgcaggctggccgcgctgcggcgagggcgggccacggccagcgcctagcggcgggctgctgcaagtgcaagcggagccgagcgccgcggccgaccggccagcctggttgagctgggcgtggccgcgagtgcatgctgcatgtgcctgtgcggctgggtggaggacaaatcagcagctggccccgctggagccgtcgttggcgcgagcgagcgaggaggagctggcacgggggcggagacgggccagggtttccactgcccaggcggcggatgagattgagatgagatcatggccccgcctgtggctgctgcgatgcgggttgcgcactccatcagccggccggcccgggcgtggcgcaagtggacggacgcgcggtcccgcccgtgccatcatctcgtctcgtctcgtctcccttctgcccccagtcgcccagctcagctgtgctcgggcggcttgcgttgcgactactgagctgcacggtaaaaaaggtctggcgctcagggaaagcgaaggcgaatctaccacgctgacattggagcagggcgcgacggcgcaagagacaaacgtggtacgggcacggggtacggctggcctggaagaaggcagcgacaagaacaagcagagcgatggatggatacggttgcagtctattttcaccgctatatctacgtccctgctgaggtaaatctgcaggcacatgcgtgtgcgcgtcactacggtcggcgatggacgtgtacggtcgtggtcctggtcctggccagattagtgaggtgtcgcgggcacgcgcgcccggctcttcgaacgaacgcaaagcgaacccaatcagcgccgcggatctgccggacggacggacggccggccggagagtcgttctggcggaccgctcaaacgttcagctcgtaccatctagcagctcagttaggcacgcccgggtactccgaccggaggggtgctctggcggtctggctctggccccgcctggatgcggcggttgccgccagcgctgctgctgcgtggtctcgctcttgccttgccttgccttgccttggactcttgggcccggccccgcccgtcgttccagacccttctcctgcccaccaccgccttccagcaggtccgaacccgaattctctccatccctatccaccaccagccagccaagaccgggaccagggccagggccagggccagggccagggccgcccgagctcgatcgctgttccaacggcgacgtcgacgacagccgctggggtctgggcgggccgccacgccgcgcgcagccacacatccatggacccggtggctacgtgtcgcgcctcggctggcgcgccgcaattctttaccatatatgtctctggctatacggttcggttcctcgagatgctcgcacattcatctcgttgtcgttgctcgcacattcacgaagagcgtggctggccgcgtcagcctctctggctcgcctggttcgtttcatattccatcctctctctcttctcctctgggcggttctggcgagggaggcgcccacctgtccatgggagcccgacatgcccgatcccgtatctccactgcgggcgtggatgatgagagtgagagtcagtaagtcacaaagattaatgcaatccggccattcaatgaagcgtccaaaacaggaaagcacatgcacaggcagcgggagctccgagaaaacgggggccctgcagagccacatttctcattgggaaaaaaacctttgtttgtttattcctcccctcttcccgattaccactgtcacaggcacggtcaacagggcggcggcagcagcagcaaacctgtggatgaggatggatcagcccagtcacgttgcatcacgcaccgccagtccggcaccgctgcagcggagattctggcatggctcggcttcttcagttcttc

SEQ ID NO: 2063 - DNA, 1513 bp, Zea mays
  misc_feature (1)..(100): optimal_loci_251640_G1, chr7:94019106..94020618, Cluster 12
aaccaagcaagatactgaacgaaagggttcccctcccttttttttacgatcgacggaaaagattatcggtggccacgaaagaatccgacgcgagtcctagtcatcagagcaagacaagaacttgtatgtccctacgtacatgtgctacacgcctacacccccacagattcagaacagtcatcctcgtacaacacatgctggcatggcatgaaccctgtacgctgtctctctgtcgatcgcgttgtggccttgtggggggtcagcgacggcgtgtgatccggaccgtctaccaacccaaagatccgtcaccgtgcatgtgatggctggagacgcaagttggagctgccgagttgcttgctttcacagcgtaatgtaatgttgcccttgcccggcccgggcgggcgggcgggcgtgggagatcccattattccccatggaccagcgcgatcctgcccctactgcttttggtgcctggctattcgctgagagatcttgccagcatcctgcttgcacttctgctatgctatgtatgagagggggatgaacggagcgagtacaataatgggcgaaataaaccgtcgtgcgtttctctagcttgcacgctttttccttggaaccaaaacacactagcgggcatgcagtgtgtgtactgctttggtgcctaagcttgttgtcctgctgttgttgctgatagcattttccaacccggaaggaagggaagggtggaacgaacgaacggggaaaaaaaagtgggagcttttgtgtgtacccgtacctgctgtcgtcgcactcaaagaaggctaagcactaagcagatgacggagctttgctgcttccgggtttccggagataaggacgacgacagggcgtgaccagaaagaaagaaagaaaagaaaaacatggcttcctttttgctttgcagaggtcagatagtcggatacgacgcacaactcttggtccttatctgatctgcagattcatttttattggttcatttattttcaagttttcgtttattatttttgtccacactccagcatacgtttattattcagttttattgattcatttattttcaaccttcccttccactgccactgccactgccacctgccagggcaacgtcctcactcgctcccgtgtcctggtccactggcgcggccgctgcgcctgcgcgagaccaaaggcgtcgtcgtcttctcttgcgtctactactctttctttcttttcatctgtttatttttccaaagttgtggcatggcgcgcgcgcgtacctctgcgcgtgtgccggatgaccttctctgcatgcgtgaagcacgtgttaccgacgccgcgacaacgatggatatagagagagcacgcactcagattgattggtacggtgttgtgttgtgcccacaatgtccacgatgcccagtactcagtcctagagctatgcatgtgttatgtgtatagcttttttacatattgctgtgttgtgcccacaatgtccacgatgcccagtactcagtcc

SEQ ID NO: 2064 - DNA, 1415 bp, Zea mays
  misc_feature (1)..(100): optimal_loci_260274_G1, chr7:141573866..141575280, Cluster 12
gaagattccaaaagtcggctacaccctcgtcatcgcccacatttgccaactcatcgacgtccccctctctttccgtgccaacagaccgtgggacccacatggcccttcatctaatcgactcttctgtactagtataagtagtgcagaggttccacacactggcacggacacacccaaacccaacccaatgggtcgtgggcaatggctctctagtagtaatctccatctatctataggataggactacagtctacagagaaggatgatcagcgaacggcagatgatcgatgggctttcttttgctggcctggcgtgtcgcttgcatcgcaacggctcctagcaattggcatttctcgattgggccctggaaagtgcgctctaggaaccgctttaggtctggacacgactggtcgtggtccttcaacgtgcacgtggtcgtctcttctccagtccagactctagagcttccttgttccatcgggggctcggggctactacaaacaaactgattttgctcagctgtgagcctgtgacttccacctacagatctactagtagtaggggtatcatacataggcggtccacggctgctaggtggcttctactgtcagacttgttgagaaacgcgagctgggaggcaaactggcacccttttatattgtcgagcttgttcgatgcatgatgctgcctggaaacgctcatcaaccatttatttgatcagagttttacaaacagcttggaccgagacacgcggtacactgctgaaaacgccactcgagtgtgttaaagggctcttaagcccttgcttttgttagccatctaattttgtgagttatgcctcactcctaggtttaaaccagcttctctgcgggtttttttttttttgcttccacatgtggcatgtcccatgtatttttgagacttagacatgtcccatgttagagcaacttaaaaaaaaaagttatattcccccgtggttcttccatactatgtccggaatgtcccgtcttagatcaactagtctctttatattcctcccctatcgacagaaataaagatgttggtaaaaaaacatgttttctttaacggcttcactaattagatctttaaactgttgggcgatgaaaatacagagacggcaatgtttattcaaacaacgactctttaaatgagaatttagagagcaagcctaggaaagacatttaagatactcctaggtggtatgattcaaacttttgacctataaactgactgtatcatcaggacaagtggtcggactatccaatttatttcctccataacggccttgcttatttgtctgtaactaagttgcatagagcctccttatttagctaaatgctaccattatctaagcgtaaatgtagatgattaatcaagcgacatgttctttttat

SEQ ID NO: 2065 - DNA, 1502 bp, Zea mays
  misc_feature (1)..(100): optimal_loci_261037_G1, chr7:145760575..145762076, Cluster 12
aacgggaaagcaatcgccgtctttgaaagaaggcagcgcgtgcatgggcagcacgagttctgtgcatagtgtaccctggccccactttcatgtacagtagtttaacggcaacttgtacgcgcacgcgcgccggaaagaaatattttcagccctccgccgtttatgaacaagcccacgttccggcatcgtctgggagatctctggccctgggagtgggtctgtgggcactgcctagctaacccaccactgaccactagtggactataatgatgtgtttgatttgatgtcgaattaggataagtcagagatgacaatattttctcgattttttttatcgtgctgccaccaaaaattactctggtgttcatctcgtcatcgcttgactctcatacagacactataaaaaatatgaccgcctcatttcatttctcactgtacattcaactaaatgcaccttaaattaatcagcgcgccaccggcgcgagttaccagatttggtaaggcaaatccagcgaaatccggagcagcgtgggctcggccagcatagccagtagccagcgatactgacccgagccgatgacagctcgcgtgtcgtggggcaccttttttttattaaagaaaaaaagctcgacaagcaggtcggcagccggcactcggtggcaggcaacagcgtcgtgtcggtcgtgaggtgcgtgatggcagtggcagcacatcagcgcagcctgcgcacagggacagggtaatcttcgacgtggagtggcgcacacgtgccaagccgctggcggagacggcaacgagtccccaggatcaagatctggaggagacggatcggaggtgccgacgccggtgctgtcaaagattctctctgtgcactcacttgtatggctatggcggccaaggtggagtctagacaaggatactaatccaataccactgcaccagcaacatcagcgagcaccccccccccccccccccccacacacatcccccgccaagaaaaaacagatagagagagagacgttggtgggatcctaatcccaggcttatctcattccccacgttgcgccatacgcggcaccagattttgttgatacgatgccaggaacagtttgctagttcaacacgtaatgtatatttatacatttactaatataatagtactcttgggggattagctgacgtgcccccaccctcaacaccccccgatctttaaagcgagttaagtacacctggtgtcgtctttgtggccgtcaccggagcgccactctgacaggtgttgatttgatcgcgctgtctgtgtccaccaaactgcgtacgcctagtccactccgctctccctctccttcatactgcctgccgcagatggacacttgtcggctgcgtggcctcgtgaaaaggcgtcgcggtcgaaaagggtgtcccgtactccggttcggtcacggacgttgatctccggtctcggtgtgcagtaggaagtcttgtatctagatggataacaggta

SEQ ID NO: 2066 - DNA, 2562 bp, Zea mays
  misc_feature (1)..(100): optimal_loci_261498_G1, chr7:148458185..148460746, Cluster 12
aaaaaagagagagaaagggcagtgcgcgtgcagacgcattaaatgttcagacgggtcggatgccgacgacggcgcgagccaagacaaagggcaacgctcccccgaaaagcggcggcacatgcctgccgggtgccggggctggacgcctggacgtgcccagtggccgcgcatgtgaagggccgcgtcgcgtatccgtgcacggtgcacgcggcctcgcgctcaccggcacagtaggccgctcggacacatgtgccgtgcgggcgttggttgcatcgttggccacagcgcttcccagtaggcctcgcgaccaccgcccacgaggcagcgcgccggccggacacgagcccggcaaaagtttcaactgccggcacatgcgcagcgtgtcgacgcgcgacgtgccaacggcctcccgcgcccgcttgtctactgtccagtcaccagtcaccacgccccacgcaacttggtctgtgaaaacaaaaatgcttgtctacccgtatgcatcaagtcgcaactacacacgctaccgcatatatatctagcgttcagcagcgtgccggcccggataggctgcccctgcccctgtctctggtcagacacgacatgacctggatagctggactctataaattgtgagtacgtgtcgacccatttgctccatatatatgtcggagtacagtactagtagtagtagacctagaccggcatgcattactacctgccaccgacactgcggtttcacagtgtagccgcaatagcagcgtcacatgcactcaccaaccgcaccagcgacaaagcgcaccattatattcacgcaacaagcctcctcctcccctcacacaaagcaaagcaaagcaaagccggccggctagcagagctagcactcgatctgtagctagcttaggtaggcacgcgttatgtagcagatgagagcggaacaagcacgcatgacgtagctagtacgtaggaagcatgattagagagagacgggcggcgaagttgcaactcgccatcgatcgatcggaatctggaacgacggaaacgcaaagcgtcaacaagagcgaaactcgttgccccgccggccggtagatccatgatccaagcaacgccactgcagcggacgaacgagagaagagaagagcagagcgagtgtcggtgcccgggtccggccgagacgcgcagcagaagcaaagcgagcacgccagcgtgaccgtccatgaccatgtccatgagcgcacgcacaccggcacacgacgcctgcgtcccgtcccgtccgcacgcatgcacgatcgcaccgtcggtggcggtggcggtggccggtgggcggcacgtggtcctcccgcccacacgcgcatcattgcgcgattgaccccgcccggcgcctggcgcggccgcgacaaggggaatgtttgtttgtttgttttcccgtcccctctctctcacgcgacgcaagggcaaggcatgcatagagcggccgggcgggtccgtaccgcccaggtccggcaccagcagagcagccacccgcgcgccggccgggagcgggatcgatcgattgccaaggtgggcaccgctcagcgcatggagatgatggagagatccagccgcccaggcctaactaaccgttcatccagcggcgattacgcgtacggacgttttaggtgcacatatttggaaatgatggagaggtaaggtagccgcatgttacggagccccagaccaaccgaacaggggaacatggccgtgccttccggaggatcttttcatcagacatgtacatacattagtggacgacctccttttcccgtccagtccagctgggtacgtactactcgatcaggaggaggagggtcaacctccactccacccaccaacggccgtcccgtcccgtcccgtcccgtctcgtcttttgcgccgctagctccatctggctgagaaggtttcagtttcgtttcaaacacacacacacgcagacacgcggagggccggagaggaaaacctgaggacggtgcaagctcatactaaaacaagtactgtagctaatccccgggacatcaggggtgtggcaggcaccaggttgccgtagtagttcagttgtgtatgcattgcaccagcgcgtctgatcctatctaggtatagccgtatagcacactactccagacaggatccgtgttgatccgcgtcggaattaaagatatacgctcgatgccacctactactacgtagtatgctcgtccagtccagtcgcgaatcgcgattcagagacaaggctgtggtgccggtggccggtgggtgcgctctgcggttctgtctacgccaatctctaccgccatcattgccttctcgaccaacaacagagacgtattgccacgacgatggccaccaccgacgcggacacctcacatgccgagcaccggcccgccgcccgcccggccggtgcctcgattccgggcggcgatctctcgacgacctccggccggcggtccacgcacgtaaagccattgctaacttattagatagcgactcggagcgcgcattttctggaccctctttccgctcttgtctaat

SEQ ID NO: 2067 - DNA, 1909 bp, Zea mays
  misc_feature (1)..(100): optimal_loci_261784_G1, chr7:150028455..150030363, Cluster 12
cactcacgcgacgcgaggactgtgaggcgcgaaggagctgcagtctgcaggtgaacagctagaagaacaggaaaagtcttgaggttttcatgagctggcggcggtggtggtgaattgagggggggcagtccgagaggcggcgcatgcagttgcagagcgtggccggagtttgcatctgagctgcaatgcgagcaggaaggagcacgtcccctgacggagtgtcggcgtccatctaatctgcgccctagcttgtcaccttgctcggcgagtcaaaagggcgctcacgtcgcgacgccgtgtcgcgcgctcacgggatctgccacgatccccgcgtcccttgccgcgcgctcgtgacagtgagagcgacccggacactgacaaaccggggccggtggagtggacggaggccgcgcgcagaccgccggacattggcgatctggcagcggtcgtcgatcgtcgatcggtgcgggctagctggtcgccgcgcgcaaccgcgctcgggggccatggcttggcgggacaggcagatcgagctcttccgcgtgttggcgatgcgtctccggtctctctactctacgcgtgtccagtgtccacacaccacgctagagttattactgaagcggcggcggcacaggccagctgaagcaagatgcagacaacaccgccgaggcgccgactgcacctgcacggcgcaggcgctgacctttgttgcaaataaaactctactcgcccgcgcccgccggtcctcgctcctcgcagtgcttgtctcgtgccgcgtccgcacgctgtgtttatttcttcccttccgtggcggcgtcgtcgtcgtcgtcgtatccggcatcctattcctatttcctacctgccgctgccggactcggccgccggatacgcctgcgttatctacccaacccaacccatgacaagccgctcacgacctcacgtatattatcaccacccaccagaccagagagactccgatccatgtgaaggcaaaggcatgacaagttttcgcggcaggagcaggagacaactgatccgtccaggtgtaaagtgcgctagctgccgtcagatacgtgtgctggttttcagtcacgggtctcagctctgacctggttcgcatctttgtactgaaaaaataaaaactggttctcatggtccagcggccagccggactggtgactctgattgatggatttcatttacctgcagtgcagttgctgttcaagtgttcaaattgggccagcgtttggcgctctacattctcccttgtacacacacgcacaccatcccaacgcgcaaaaaagacgcagtcagtactagtaaaacgcaacagactactgtacagagagagctgaccagctgcctgattgttaatgttatctgtccgaaaaaacggacctaaacaatcgttctgtgccagaatccaggagttaatatgagctgcaaagtcacatctctgcccttgttctcaaggtgttccctttccccatctgtaaaacagccgtagagctaacagattatgatgtgaagttttgagttttttttttttttttttgtagaaagattgtcagtctcgcctgcttcgaccatcaagccgtcatttgattttatttatttttttttttgaaagaaggaaaccctgcaggcaggccagtttcaccaaaaagtgggtaagaaaacacataagcgttcagtttacgaaatggcggggccgcggccgcttccaacagagccacgtacaataggactgactcccttttgtttggttcgacgacagcaaaaagctttatggaagtaccaaagcctgctgataattctcttttttttttccatctgactgctgctgcactgtgcatcaccaccagaggcgtggactgatggaccaagaccaacacccacccttagctaa

SEQ ID NO: 2068 - DNA, 2124 bp, Zea mays
  misc_feature (1)..(100): optimal_loci_261982_G1, chr7:151237930..151240053, Cluster 12
gattatagttcaaacacctagtctaaaaccatcctaaatgttataaaagcccccacccccacccccaccccccaaaaaaaatcttgttttcttggcatcgccttgcttattgataattcaacatattttgaatttcattcaagtttctttttcgtttctccatatatataagttaaatttcacgatcgtatatttttttagacgtacgattgaggacatcataatgaagactcaaattagccgactaaccttagccaagttatggcggagttagccaagaaccaagcatagtcgtaatcctaattaagccacataacatggtaataacgtgcactacgaatattcaagggttatttaaaatttgaaagaaaaacgataaatacatgctaattaactgagtttataatgtacacacaggagctacgtatgggaactgtggaacattgagggaggttgttactggttagatggagtatgcatacctttacgtgtataacacgctgacgcataggatcgaagaggtagttgtttcatttttgtttgattttttttttcctccgaagcatgtttatcgattgtaacaaagtctgtacaccctgaccgggcggttgatggtcctatattagcgcgcatgtaaacggcggggcctctactgaggggagtaacaatggtggcgtccgattgagaaccgagaggtcggcacgcactgattgggctgtgctgtggcctgtgggatggttgacggacgtgcggacagcagccgcaccgccgcacgcgtatcaggcgaggcgaggcgaagcagaatccattcgatcgataggtataggcgtagtatagccgttggtagcatcagtgttgacgacgcttccaaagcatgcgctgcgccaccaccaccaccgggtggtccgggtcggttcggaatatttgatgcagcggctcgggtggcctccggggccgggggcgcgttggttattacccgcaccagacaggcacccgagtggggattggctctcgctcattggctgctggtgctgctcgcgtgcacgtgatccgaggcgtctttttcggccactactacgctactactactgtgactcgtgacgacggacggactgagcgcgccatgaaagcaagctgatgcatgcccaagaggcgaagaaaagtcagtctcaccttctctctctctctctctctctgctccacacgttgtcagtcagtctgtctgtcacactcgacccgttccctcgctcccgttcacatgctgtctctctacgtactgacgactcctatgtatatctaggagtagctccccccccctcctgatcatcagtgaccgatcactgaccatgactgccgttctcctcccgtgcgcctttgaagtttttcattcacggaccggtcgctgatcaatatatacagcaggcagaaggcagacgcggacgaagcaagcaatgatggtcgctgagcgagcggtggctgcactgcgctgcgctggtcggtcgcccgcggacggacgtcaagacaaaaggattccgatcagctgctgccgtccgcagcggggagggggccgatgctaccaccccgtacgagtacgatctgccgcctgccgtgcccactgctgtgcccagcctctctatggggtggggtctgccgctgtagtgccatgcccacagtgcgcgcggcaacgacgagaccggtggtggtgtcgctagccacccacccacctcgcctcgtctttactgttgctgccacgtctcctcgacacatttcccacaagatctgctgttcctctcgcacaacgccgaaccacgcgtgcgtggtatcgatatacagtgtaccagtactacgctcctttcgccgcttctgtatacttatatatatacgacccgccccggccccaccagcaagcaagcaggcaggctcgctcgagctcgacttcgttttctgctctaccctaaccaacatcacaattcacatgagggataccccgaccgacgcgcagtgcagaacaatgcacaagaggaggaggataagacgtctctgcccccctccctccttgattaaagccacagtgggctggccgggccccctgatcaaagctttacgagcaaaagcagacgcgag

SEQ ID NO: 2069 - DNA, 2209 bp, Zea mays
  misc_feature (1)..(100): optimal_loci_262900_G1, chr7:156219087..156221295, Cluster 12
agtagccccccggtacttcgtttgaaaactgacggttatttgttaatactttgttttagaagtatattcgtctatactatacacaaaggggagaaaacgaagatgattggagtccacttggtggctcaagtgcgaagacaaaagcgagggagatgaagaagtcacggtgttaataacagctcggaagacgaggccactaatagataatacacttcacttctgtgcgaataaggtcgagggaaggcaatatacgacatgtgttcataacgcgaggcctcatcgagttatgaataataaatcttacccgcatagggagagggagtactacgactacgacatacacacacgcacacaacacatgaaactgtgtcgatgtagttttttttttatttattatgaaagcgtagatgcaggtagctaattttaataagacggctcactgaccctacacgattatattttggaaatgtgatgtgataggcactcaattcagcagcatcaattggatccacacgtaatgcaggtagtccaccacctgtagctgtagtgtgtgggcgccttggcatattgaagaaacgcgcgcgcggcacctttagaatccaccatgtagagtagaggcacgcgcattaattttgtttggataagctaagaaataaaacgcttaggctttccgataaactattaccatggcccgattatatatagcgtgacttagtgagcaccttagaaattagactcggtcagtctgttcggagggtcattgtggtattcattaagtactgaggccatcatgcatgtggccggttctgtagctagacgtggtgttcagcagctagtttgtttgttatgtatatacaaaagtacgggggaaccgccactgtctgcaaccgtagcaaagcagcttcgaaactcagagccaaactaaactgaggataaactgtgctgtgagagaactgagaaccaaatcgtcgatcatccatagctagcagaatagttgtctgtgtgcgtgcctgcctgcctcgtacaggactcctcctcttcgtccatcgtcgtccccccactctgatccctaacagcatgtgacggacaggcagcacatccgcatcgacccctcggcgcacgacgacggatcggtcggattgcccatctgcgtcacgcctctgctggcacggcgtcgggtacgctccaaattccctgcccggccggatcggtcggagcagacggtccgtccacatctgatggcaatgtatgcttgcattcacgcactgggggggccccccgcgcgcgcgggggctgagtgacaccagattcccacgatccaaacgagccatcgtacgtcgtgcgctgggtgccgagggcactatctatctatccggtgcgtggtcagctttgctcgcgtgcgcgccgctcgggacgatcccatcccacgcgtccgccaggtgaggtgcgtacgtggtcgcctcacttggacgacggtcatgcatgcggtcgtcggtcgctgcctcatcgatcgacccaactcaactccaagcggcttgtccaccacggcaccgcgcgtcgtgctgcgtcattattctcttgctttttttttttgttttcgttcacagtcaggcccatagattcctcttttttatttgtgcgagcgagacaggcggcgcacaggttgcaagagtgtcggcgacggcgatcggggatggaggagattataaagcgaatgggccgtgacaaatctgcatgtgttcctcgattccctttcccttctctacagcggcggttatttcggggttttggaagcagggcgtttgcttccgttccgtcagaatgcctgcgttttcctacccatctgggctgtacgattcggcggcccaggcccggtgaggtagcgccatttctcgtcaatgttctaaaaaaccataaaaatgtatgtatccttctgaaaattatcaaaataatcataataataatagagctagattgggatatggataatccaagtaaaatatttagtgctcgtgaaatttatctaggagcttgaaaaaatgatctagccctggaaaataggggaaaaaagaaatatcctaatcgacgtccaaacatgttttttttaaaaaaaaaactttgcgctatgaaacagtagtatgcagctaacatagattcaacataaattaattgaatgcattcgtgctattcatttgtgttggctgcacct

SEQ ID NO: 2070 - DNA, 1650 bp, Zea mays
  misc_feature (1)..(100): optimal_loci_266330_G1, chr7:173741691..173743340, Cluster 12
cttggaatgcatggaacatctagctacctgcatcatgcatatacagcgcccgtctcatgtgtttttttttcctccccgtgttgttttgtccgtgcatccccgaacaagcaagcttagccagcgtgcatgcgatggagagtggagtcgtcgtcgtccatgtccgtatggatttcaaggaccccgctagcttgtcctgtcccagtcggaatggcgcgcaagcacaagcagcaaagatggcgtaatcacccaatcatgcatacaataatcagcagctagtgatcatgatgatgattacacacacagcagtacgtaacctgattgtcattacatacctatctccttcgatcgggtgtaaataaataaataaataaaaccgccagcaggggccaggaatctttttttttctttttggtggctcatcgtatatgcattgatgcatccaggggacgatgtcgtggtcgtctctctctgctgctggcttgttgccacgttgagtgtgccaccggggcactcctgacggtgacctctcgtcgtagcgccctagctagtatgtagcaggccttctaattccttggctctttggtgatgaacaagtggcgcgcgagcacatatggacataagcgtgcagctgatgtgtctatgcaaatccttggatttcgagagttttagaagcaacaagcaagggccttgcttggggggcacgatggattaggatatgcactggctggagacgagacgactcacgactggtgtgagtgaatagtgatcctcggttgatgcatgtctgtctgcatggatatgccagaagggatggagagagaggcactcaagagaactggactggaagcttgcagaaacggacagcagcaacctttgctgggcctcggttcccatttgggcaggccgaaagcgggcgggctagcctgctggcagttcgttacccgtcttttcgaggggcatgcacgcatctcggacccgatgccatctcttttacagttcaccgccgtcgccgcatcgcaggcggcggtggtggtggtggtggccggactgctgctagtgcgtgtttggtactatctagtgctctactgctacaaggaggtggcgacaacgcggagcggagcggaggaggtggggccacggccagggcggtggggaggagggaggcgtcctgatccggccgcgccggagaattgggagtcaaaagggctatcgatgacgacgatgatggatggatggatggatggatcgcagtcgcaggtgtacatgtgtgcatggtggtggccaaccacaacccgtattcgcggaatacttgcttgctaatgctagctagctaggccatatacaacaggggatcaggtgagcgtaaagcgtgtgttttttctccccaccatcgtcagctcatgagatgagatatgattaccaggtcaggcactgcaccgcgcgacgacggcgagcgagctctgttcactcaatgtagggcagctatagcttagcttgttcattctagctagctagctagcactggtaggcggcagaatgcccgcaccgcgtggcgcgtgcgcctcgcactgcttgtgtgcacgcatgcgcatggcgactcacgcaagcgtgtgtggtggtgtgaccccgtgcgtgagtgccagcgctcgc

SEQ ID NO: 2071 - DNA, 2105 bp, Zea mays
  misc_feature (1)..(100): optimal_loci_266332_G1, chr7:173749035..173751139, Cluster 12
atgaaatatcttttactcgcctgcgggctgcggcccagatgcgaacgctttggggggaagaagcgcgctcttccgacgaacaaaattacgtattttcaagcgcaacgggccggcccaaatcaacatgtaaccaggaggaaaagttagttggatgcggcccagttggtgtggcagtgggcggtccaagattcccttccggcgtgcaggcaggcaggcaggccgcagtccagaaggaagaaatggtccggcatgcatgcacccggacctggaggagaagcgttcggcaccgttggatgcacgcacggcacatccatccctcgttagtcgttacccaccgtttattttatcacatttcgtattctccatgtgattggaagcaaaggtgcactaaaaataagctcaagatatattttaatcgttagatttagatcagataaatattatttatcacctaaaaatagagcaagtgtttattaactaaaaaacaaagcaaaaatcagactgttatggtttagtaactttctttttttagatcgtgtcgaataatttatctatatagttatctaaataatgttttacactgttttatattttagactatagactgtactgttcgatagttcgtagagtaaaattttattttgaagataggatggctaactggttggagtctactacctcgctcgcccagtcaattccgtcccgtccagctccacgcaagagcacgtagtacgtccaaaacccgagcacagtagtgcactgcactggaaaaaggcagaggaggcgtctgacatgcatgattgtggtgcaggcaggcactgaatgactggtggcggcgtggacctgggcgtgttcctcggcgaggagacacggcgagagcctagctagcgagatggccaacaatgctacctgtgcagcaggaagaggaggccggtcctaatagtcggctagctagtctcctatccatgtcgtccagcctgcctgagcgaccgagcccatacccctgagcatcgcaccggcggcagtagcagacgagcgccgtcctatccttggcagtgcctctgccaaccccagccggagccgctctttcatgcgtgcgcggcggcggcggcggcgagtgagcgagcgatcgaacgcgcacgggcacggcgaccgggcgacgtgcggagacagacacatgcagtacgtacgagtacgacgatgcgatgtttgtactccgtccgctgtgtctgcagttcctgctctctgcacgcacactgacgctagctcggctcggcgccccggccatttccctgtcgcgatcaccggcgcagctccagagcactctcgtctcctcctccggctccgtcgtcgtcgtcgctaatactaataaattccaccccggcggccgacatggcacgcggctgccggtcacgcttttggggcgcagccggccgggtgccccgcccacaccccacctgccccttaattgtgcacatgctccgccgtggccgtgctccgcgtccggcgtccgatcgcaagcgccaagcgccacgccacgcggggatcggaagcagctgtacgtcccaacggccgacgcgacgcctcgtgccgtgtccgcggttttttttctctcttgccattgccctatatactatagccctagctagcttcatcgaccctctccacttccaccagctgccgatcgatggctcatcaagtgaatgtgacgggtctccgtctgtgtgtccctgtcctgtcctcttccgcgacgtcgtcccggcccctcgcgctcctctcgatcgtggttgctttcacgttccaggttccttcgaccctgctgcagcaacaacatgaagcatgcatatctgttgacgcctccgattttgtcgtctcaaaaccgattattcgtacctcgcgaaactactgctccctccatcccattccagcagattgtaaatgagactggaattttgttaataacagacaggggtactggggtatctgctgtccgtcctagctaatcaaaggtatcattagctagccaaaattaaggtcaccgaattgtcctgaattggcatcattgtgcacccccctccggccgggtggggcatcatcacatcagg

SEQ ID NO: 2072 - DNA, 1652 bp, Zea mays
  misc_feature (1)..(100): optimal_loci_2664_G1, chr1:13678481..13680132, Cluster 12
gcagcatctgaatagcataacatgtacacagctgagctcatgcatagctagctattaagctgccaattcaacctaaaaatttaagttgatgggaagggagcggacaatttaattatattatattatattctaacaataacaaccgatgatgatgatgtcccttcatccgttgttcaattagcggcgaccagtgcagtcgagaagacaagaaaagaaaagaaaaagaaattgctagttgggatcgcgttctgaaaatttaaaaaatcggcggctctaccaaacgaggacaaaagaagaatttttcttgtcaggtcacgtgaaacgcgcgcaggaagggaaagggatatggtgatgccatggatcggcggctcatggatgggcagcacagcagcccagccagcacagcaggcacattgtcactgtcaccaaacccgtctcaacgcccgcgtcacacctcaccatttgattgattaattccccccttttccccattatcccagaaaccattattgttttctcttgcgtgtaccaaaaaaaaaaagatggtggtggtgatgatgaagcttcaagcatctagatcgagtatcgttgattcatccgttcatcggtggctaccaatgagcgaggcaatgattggtttggttccattccattccattccaaattggtcaggtcagctgctctgactgaacccaaagtctgaaaaccgcattcaccgcccgcctcaggtacggttaggttcggttcggataaaacattgaccctagcaggcctcagacctgcggagtacgcagctaccattcactgatgctgtgtgggtgtggcagtgccgggttcatgcgccatatatacatccatttcgagtgaaccgtcacagagtttcagacaaagtaaaaaaaaaaaaaatcagctggccttacacagcagcaggagagagacaatattaatatagtagtaagccatgcatgcaccgcgctagctcgccctctctgtgcaccggccggcgaacgtgccgtgaccgggaccgggagggatgggtccccagtccagacgctaggcccagaaccgaaaccaaaacaaagagtatacatctcacgcggctagcagcgtcggcgtcgctctttcggtagtcgtgcagagggaatggacgatgcaggaggcaaggggaggagcaccgcaaatgcaacgaaacatggggacggacggacacggacagcccatgtgaggagctgtcggcgtggggggtacggtgcaggggaggggaggcggattgccgtgcattcgtcggcggggacctcgtccggccgcggatgctgggggcgtagtgggcggcagcggcggccagggtttaggctggaatttcctcttttaacaaaatgaaataacattttttgaaatgaaatttgtatttgtttgcaagaaattctaaattttaaaatgtgtcccctgaaaacataaataacttatatgcccttccaagaaagaaaaggggaaataaggaaagacggcaaatacataaatcttatgatatcatgcatgttactaaaaaaaaagctaaaaaaattttgtggtcagtatttgatcggatggactagcaaacgttgcagtcaaatataagactacttttacgagatacctttttctcaagagga

SEQ ID NO: 2073 - DNA, 1617 bp, Zea mays
  misc_feature (1)..(100): optimal_loci_268882_G1, chr8:10866065..10867681, Cluster 12
gcactgttatttccaccaccaggcctggacggctgtatggtcctggacggctggagcctggaggagtggagggggaggtagaggacaaagcctgcggctgtgggcagcaaacaagccaaatctggatcaacgcccagtttcctttccgtcagggatggatgtagccagggctacgagtcccttgccgtatcgatacccaacacacacacacaagctttgtggaaaagagagggtttttcctagcagcagcagcagaaaagaaaagaaaagaaaagaaaagaaaaagctgagagacactaaagcagagccagtagtgctacatcatgcatgctagtgtagatgctagtgtagctgaagcgatgctttctccattacagaatttcagtcaagaacacatgcctattgcgtgtgcgtgtgtgtatcaggctacgaggggggagaagtactccaacagccatgtgagaggcccacccacgtacagcggacctctcacttctcagcatgccatcgccatggccaggcagcgaggaccagagctcagggaacagtggacaaaagctggaacccagctgctgagtgtgcgtggaaagccatgcacagcgaacaatggacgacacaacacaaacgatcgtctttagactttataccaccaccaggcagcttgctttggcatgtcactgcaacaaaactgacgcttggtttcagcagaagggcgggggcttataatgagcctgggctagtttgggaagcagataaaagggcaaaaacaaacaccttcagcagagagcatcagagcagggggcgccacgctcgctttttgacctgcagttgtgcgaagcacggtgcaatgccacttgcgactaccaagaaaaccctggccccctgcgagatgaacaagcaagccggcagagaacccattggggagggggaggcgatgagattctctctgcaaatgcgacgttcgcctcaacagacatgccagccttttgatccggagctttggtatttgggtggtgtttcgtgtattgttatatttatggtgcttcgaaatgagggggggagctctagttggtcattatcacaactcaaaatattaactggaattctaaataagctcaattaaaactaagaacgaaacattaaaaaagatacctacctagcagtttcagtggttcttagacggtctctaatagagtgtgggaaataggggatacagaactgtagatgatactgtttaaatgtaattagaggtggttccattgggagaggggattactccctatggatcccctctaattcactatccaccaaatcagccgtaatagcgaagaaaacaatttttatcctaggtttcaaactaataaacatgtcttccaaggctcaaagtaacctgcctttttgtcaattaacaaaaacgtagatgaatcattggtgtacgctacatgctcaccgtcttactgtagtactccggtttaactttatgcgagtaaaaagtggaggatgaaatgaaactttcagttccccgatggaacaagtccggaagcctacagtaagacggtgtggaaacagccgacttagggggtgtttgtttgagattataatccacctagattatat

SEQ ID NO: 2074 - DNA, 1466 bp, Zea mays
  misc_feature (1)..(100): optimal_loci_269118_G1, chr8:11922628..11924093, Cluster 12
ttcctcttgctttgccgtggatctaaacaaagaatagaacgattttgttcctctaatttaatctggattacaaccatactctcgtgggtctcccaccaaacaggccgtactaaaacctagaaaaaactatgttcaaattggaaaaaaaaggtatgatagccgcattaacaaaggcttgtacatagataaggtctagaaaaacgaatggaccaaaacaaatgatctcctacgaatacgaagagcgtacttggatttcatccttgtgccccccaccaaacacgtctataaagacgtggcttcttcgtcgtcttcctataaagacgtgtatggtaactttttatgatgtcgtgacgtcatcatgcatttatatttatattcgcgtttgcaaagacgccaggagttcctccacccgcaagacgcgcgggggggggggggggggtttcttgcccgttacacgaaacgaaggaaggaagcatcggcaccaaccgacgacgaaagaaaccaggcaaaggcacatgccatgccgcgcgccggcgtggaggcactccgagcccgtacggaaggtaggcacgccgcgcgccaccgaacgaacgactggagccggggcctgcatggggcatgccgtcgacttctctctctctctctctttttccccttgccgagacgaaacggatccagtccagtccagtccagtccagcacacaccacagcaccgaaccggccggccggcgctggcgcatgtgtggtccgcttggcgggccaagcgaggttgccgccgcgtgcacggccgatcacaacgggcggtaggcgctggcacggctcgcccaggccctggccccggcccctcctcccggcaccaaccatcccgctggaacgcatgatacatacatccatcctcaactgacctgctgtttctcccggctcccttggcgttgattgtgccgtgcctgccgctgtggccgatcacgcccagatcatctattcgattcccttgcactggcgccgttcgcctgggctcgtgctccccccgtcggttggactcggagagtcgccgtcgccgtcgccgccgcagtagctgagggagcttacgcgcacgcaccggccggcagcgtcggttgacggttgggatgaaaaggtggttggattggaatttggattggatcgcatcggggcaggaagcgggcgaggcgagcacatgcctgcgtggccgggacctgcaacgcctgcactgcacgctagcagcagaagggagttggcaatcaattcgtggggaaaaaaaagaagtggtgtggtgtggtggttgagctgggatcttggggcacctgcacgactgcctgtccgcgagatctcgagggctgatgaggagaccatgccgcatgagcatggccggccggcaggcaggctggacttcctcaacgcatagtataacttaacatttatttatgttgttacatacatggactttt

SEQ ID NO: 2075 - DNA, 1669 bp, Zea mays
  misc_feature (1)..(100): optimal_loci_285555_G1, chr8:118074604..118076272, Cluster 12
agcagggtggggaggggacaaagagagaagaggagacaccagtgggaggtcgcggagaagccgctttgttcgacagccaccgctggccgccgccgccgccggcagcggccgtcaagggcaagtttggagtggaccggcggtggcgcagcctggtcgcccccaagacgcccccagcggagcgacgcgagggaattgaaaggcaaaaactattctagcatgaatcctaagttttataaattagagatacatttatcattgggtaaggaagaaattgaaattgcagaccatgcatttgacatacctgtcgatgggatagttggagtcaaagacgagcatggtgatcctctgtaatcaaccatcgtcttgttctccaatggtatatccaaattacgtattgcaacccgcttcattgctttcaacaccatagaggtgcctgtcccattggtgtttctttgacctgtccgtctacacaaagtatatgggaatcattacataactcattgcacatatcattagttaatgattgcaaggaatctcgcaaaccaacaaccatcatgggaaccatacctggtactgttttgttgacaggagttgcatatatgaaaggagaatgcaaagttatagtcccactgccaccattccaggaccccgttggggagatactcctcaccgattgctgcccagcctccaaccgggaaggtggcgatccagtagcagaaacatcaatggggaacatactgcaagactttctattgagtagctgatttctttccaggacccaaactactgacatgacatgactcatttgtccctaagttgggacttgaaggttgtgcaacctttccatgaggagatggagaccttactggtaagctgctgcccatccttggagaagaaacaactagctttgactgcgtcctactatgtgtagatgtaagatgttaacacatcggtcactgcttgctgcccaacctccaacagggaaggatgagatccagtagcagaaacatcaatgggtacatactgcaaggctttctgttgtgtaactgatttcttttctagacccatactgtcggcatgacgtgaatcatttgtcgctgggttgggacttgaaggttttgcaacctttccatgagtagatggagaccttattggtaaagcgctgcccatccttggagaattgcaggctcaaagtcatttccttccagagtaaaaagcaatgtgataaccttctctatcaaagacaatgtcagcagtgagtgacaattgatccctgttcattatcccaaccgaaattcttatgacacctttttcctatatgtccacatatctacctcgagactggttccaattactaatcccagtgcccaaaagccaaggtaatgtctcaaagcatgaggaactttagaaacatgcacccacacttcatccagatggtatgatggtgtgatatctttagcatcctgccactttgatatcgtcagtgtcactccataatttttaaggcgaaaatcgatatcaactaaccgcttgagttcctcatcagatggacagtggcgtagacaaggggaggctagtgggggcctcggtcccctctaacaaaaagaaaatttgttttgtagctatatattatatatatctatggctaaaataaaataattagcttata

SEQ ID NO: 2076 - DNA, 1482 bp, Zea mays
  misc_feature (1)..(100): optimal_loci_290466_G1, chr8:145193370..145194851, Cluster 12
cggcgaatccgaggcggggcttttgcccgcgctcgcccacacccagccccagccccagcgtgcatctcaggcagaggcagctgaggaggaagctagctgacagctgatggcctgagacagcggagctagcgtccagcatcatgcccgtgggaaaactttttctgcctctctctctctctctctctgatgccgtgcgaaaaatattctggagttgaaggaaaggaagggaaaaaaaagaggttgttgcggtgcggtgcattgtgctgatgacaaaactgcagagggcctgcgggtgcaatgatggagcgagcgacgcgtaggattttcgcggatcctgattctcggacgggagggaaatttctttttgggttcgtttcggtggggtggggtggggtactggggtggaggggtcggtgtgtatgtagcagaacgaagctgtagaagaactgagagaagtggcctctgctcgggcaatcgagtccgtcttttgatcgagaacgccactcattgtggctgcgcaaaggaggcaagctatgatgcgcgcggggggggggggggggaagaagctgaaaactctgatgggactgactgactcatcacaagccactgtttctgaaaccggcgttgcgcttgcgcggatcgtgaggacagttgattgaccagttaaaatcctcgccggaattggtgggctcgagtcctaatcaggcaaagcactgttcttttaagactatattaactataacaatgcttgttcaagattcggaatctatagcctgtgagaccacatactatatttttttcattagcaaggccctagagggaccacagtccacaccaatcccgtccgtgtctgcaggggatcgaaattcagacaacaagctcgcgggtgctgtcccgtccgtgtacgtggactagtccggctacagtgcatggcgcacgttgtcgaccggggagccgggagacacggctcgactcgactgctgcagtctccgactccgacggtgagctgacctgaacatgcccgctttctgcacaaacagcaggcaggcctccttggatgcgtgtattcctgcaacgaacttctttgccccgggcttcagaggtgcaacgaacacatgccacatcggggctggaggcgtttcgttggtcacgtcgtcctaggcccctcccccccaaacgtgcctctgaatcacggacaggggacgactccagagacgatatgaggatctaaagtcttcccagggcccgacaaattcttccgtgaccgtgacacctgcgctgtatggcttgcaacggcagcaaccgcgatctctgccctccgcttgtatagtgccagtggctggagctggacctccatctcgggcccgaccagacacttatatttttttttagattactgacatacacatatacattatcaattctacacataacacaaatgtagttgagtcctcttggttagaagggcgcggttaagccttt

SEQ ID NO: 2077 - DNA, 3619 bp, Zea mays
  misc_feature (1)..(100): optimal_loci_2922_G1, chr1:15077585..15081203, Cluster 12
tatataagacaaccacaaatgtcgtggggatttgctcaatggtcgtcacaaccactgccatagccaggagcggtaagttaagaccaatttgagtatcttgagctctagagttggaaaatgcagtaattcaagctgtatgacaatctgacatatgtattgtatctcttttagtgttcgggttcacgttgaactctataacacaatatgatttttgtgaaccagctattttaacccaagtggtgaagcttacgacgaccaacctttagagtgaagaatgtttggactatgtttggattacggatggacttattgaccagtatgtttggacttggccaatatatgtgatatactttgttaactgttgtatgtgatactctgttttttttttttgttgtatacctgttcactgttctggaggcttccatcctgggaggaagccaaaacatattttatatatttttatttttttttaagaatgtcagttaaccgacatacttaatgccacatgggctaattacgtcggttcgacatacacgtggcgtctctgcgtgcctgtgatggccgaagtaagaacatcggtccgcgctggcggacagatatgtactatgtgattaacacccacgttcttacatcttttctcactgagcatgcaggctctctgtacatcttttaatacggatgtctcatgagaacactagttattaaacggatgtatttaatggcgacgatcccgaaaaaaaaagatggataaaaatatcttgaaaaatgctaactcagtccggatccagaaaagttgataggggcgcttgatcagtggaggaataatctgacgcagacagcacgcaatggtccgaactctgaagcctctggcagcgcgcggttgcatcgtcgtcatcacttgcatgtatatggaccagccggcgagaaaacgacgggtgcaaatggcggattcgtttggtttttacccggcccggaccccggaagtcggccaatgcaaagggctacttttttttttctttctttttaattaacccggagccggaagatccatggacataggtagggagatgcatgagaggagagagaggacacgatcgatcgacatccgcctcgaaaagacgaagaaaaacgaggcttgatgaagcgtgttgttgttgttgttggcaattgccatcgcgcagggccccattagtgacatgcgaagactttggtctaaattcctgtgccgtcaacgcgccgctgggggccccagcccccaaggaccacagccctgtgacgcaacgcgtacgtggccttcctgttgtctgtacactcctgtagagtcgatcagctaggcggcgtgtccaggtatactaggtgggtcgtcgaacggtattatgacggtattccattgcagtcgaattcgaactcacctcgcaattcatatactcccatatatatagtttgaaaaaaaaggatggtcagctctacttcattcacccttgttctcctggctgaaatttaatgatcgcttggggtacggtcttccagctgtccactccagcctcagtggatatctgatatagaactatcttaatctaatatccgaatgataatgctgttcttatatatatatatcgatctactagagagaagaaggaaaaaaagaaaaactatatgtatatatccatgtctatattgaatatccgataaaatgtacgtttagctaggtgcgtgcccaacaaataataagatacctaaatcacagcaaaacatcgtcgtccctactcgatctttacacacacccctagcctaggcccaagtcaatgcaaatgggatgcatcatccggtagtgatgggacaggaacggatatgagctgtgtcgtgggtgatttaactcacttacttgcagctagtagcttgggaccaaaacagtaccattctgttggtttgtatgtagcatctaagctcctgagtggcactacagtatacggcactcaaggaagatgcgccagttcatcgtacgcgcgtagtcgtatccactaacgacgacgacgacgacgactatagcgcgcggtcccgtacggtacgtgggtgccagtagtgccaaatgccaaaaatccaatggtgccaagcatctatccccaacagagacgcatcacgcgcccaatcgattgcgtttctctctagctgcagtttacagtcgacacagccgcctgtatgtgtcgtagccgtacgttcttgatatactcgtacgtatgctgtctatagtacagtacacccagtagaataccaaagtttagttttctgactctgagaacaccggcgtctagtagcatcagaaaggcgatgctctttttttctgctcggagattaattgggagtcggaggtcgatatattcgtagatagcatatataacaaagcggtggtggtgcgtggcaacgacgacgacgacaagctagagatatatagatatgcgcatgggctgcttggggtacccgcgcgcatctgctagctcaaagtggatatcaatcaatcatgcactccttgctgagactgatgagagggagagcgaatgagtgtggaataatgagcagtcggcggcatgcatgcatgcatgggctttattcgaaacgccggccggcgggcggaggcggaggcgatgacggatcgatttcgaaaagcagctggagagcaccggatccataccggcgagatttgacgcggggaggatcggcatgctggcttattattacgaagagaaacctgatgccgtgtctgtgtgtgttgttccctgcccgaattattcttcctccgcaacgctaacagccggaggaaatatctgatgatcgacagaaatgccatccggccggtccccccgtcgcgcagcgccggccgggggggggggggggggggggggggcagtacccggctatagcttccagtgcctagcttatgggcatggtttgatcggcttctggtcagattttagccgtcagcagagttggcttctagccgccaaacagtttactatcagtttgttttttcttcttttcgaaaacctcttttattttaaacatcgtgtaaatcaatgtgagtggagtcgttgtggcggaagaaatctaccccttacaccataaaaccgcacggatcagttcgtctttctccgcacgaaaagccccacgatattcatatcagaaaagctctttgggacaaacaaacaaaaatttgtaccaaacaggccagcttgcttccacgaacggaggagccggtagctcaggagcacagcgcaatgccgccgccgccgccacgcaacaagtttttgctcccaccaaacgaagtcaaaccagactgaaagtactgctcatgcatggacatggcggcggaccaccggtgatgtgtgcgctcgctcgggcgcggatcatgtatggacgtcctccagtcaaccacctcatccatccatccatccgtgcctgtttcgtgctccgacacacagtgaggatctgagccctaacgtgcaggtgcagggcttttatttcgcttcccgaggctatccggcggccggtttccagtaccgaggcgggagttaaatccgacccggcggacgggataaggaagaagaagagcgtgacgtggccg

SEQ ID NO: 2078 - DNA, 1560 bp, Zea mays
  misc_feature (1)..(100): optimal_loci_293444_G1, chr8:160096082..160097641, Cluster 12
gtcatgttctttggttccttttcctttcctagagtttatgaccaatattaagcatgattaaaattgcatggagcatgagaaaggattgacaatgggtcgccaattgccagactaacgacgacgatagtgacggtggagaagcgtttgcagaattctaattctgactgtttatttctctgcgtccaatgaaagcgacgtgatactaaacccacaacagaggagttgcattgcattgcatcaaagctgacaattggcgagtgaacgcgcaagtctgctggtcactctctttgcacttggaagactgaaacctgcgacgccacgaattagtcgtaggtagtaggcgcgtgacggagggaggaggaccgatcgatggcgcgtcctaggatgcacgcatgaggcccacagccacagcccgtcaacggcgacgccggcaggcatggatgcagcagcatgtaacacgccgtcccccccgggggtgtcgacgtcgtgctgttttgtttcttcttcccgacagccaacaaccggccgccggcccggtctgctcctgtgtctgcgtgcgcgcggcgcaaccacgtcagagatgcggtgccgtgccgacgcgtgtttcgtcttcctctccctggacgtttctcagtctgtccgtacgtacgtttccgtcgccggtctccccacgcggcgggcgtccggccggagctggagcggactccttcacgcttcacactttttctgctgccctgctagactgctacagcgaatactcgtacgaacactcactcgtacgcctgtcgctggtcgtcgacgtcgccacgaggaaaacgaggcagagacggtggtctgggcgtgtggcagtcgtagcctgtgaggcagaggcaggggccacccccaacagcagcagtgcccgtgctgctactgcgagggcgagcagagagggacggcagcagcggccttgtcgcgacgcgcttggactggcgcggcgcctgcctagatgccgtttcgactgatgtgggtggctggcggccccgcctgcctgcctccccctctccgtggtggtgggccgtgggctgcttgctgctgggctcgacgctgcctacagcagcagtgagtgtctagcgagcgcagcaccgggccgggccaccaccccgcacagcaattactagtgctgcacctactacactgcgactccaggacaggacagcatgcatcggtgtgcctcggatggagtgggagggtcccgagcgcgtggcgggggccagggtcgtggagggtccacgtgccagcgccatcatcgcctgctcgactagggcgctactactctggattcagtgtcacatactgccaaatgatctactgctgctgctacgctacacgtcggtagcccgtggtagtgcccagttgcccactgcccagtgcaacagaagacacactaggcagggtcagggtcagggtcaggcgcaggcagcagcggcagaggtatccccagggtacgtgctctgtgcaaagccatgatgatgcttcccgtggaaccgcgcggagccgtacaagcatcggccgccacgtccg

SEQ ID NO: 2079 - DNA, 1434 bp, Zea mays
  misc_feature (1)..(100): optimal_loci_29352_G1, chr1:179570141..179571574, Cluster 12
gttctggcgcagatagatctattaattatttttgtcaataattgggacaagcacgggccacacagtattttatttatttttcccacgcgatagctagctaggaagctaattgtaaacgcacgcagtcctgattacctcctagaggttttggaaattatcttggttttctagcaggtcgctgtgattggggctagcaattttctcacgattcctttttttttagctagacaacagacaaacactgtgtgtactctgtcgtcctagaaaaggcacaatccatcgtctttttgtgtgtgtgtgtgtgtggcccatgccttttggtgatcgtacaccagatcttcagatcatatatatgtaggacggcaaccatggttacgcattcaaagttgtagacttggattttttttataaaaaaaaagccctggaagctgtaccctttgctttgatatgttaagacgacgcacgggctgggctggcaactgttccaataaccaaagggcggtcttatgcaagctaattcgcacgcacttgattatatatagttccttgcagaaaagaaagagagagagagagaaacaacaacattagctagcagagacgcgtcatcgacaaacggctccagaccaatggagtataataataaaacgtcttagctagctggctaattaatgtgcaaacaaatgagctgagactgagagagaaggggggtagcaagcatgaccatagcctttgcaggccagcagatgcctgctccatctggttgtagttgtagcaccgtacctgacagtttagctatagcggttgcctagctaatcattgcaaggggatgattaactaatcgcacaaaaacaatccatggccggctttggtagggtagctagtagctcttctctgcctacgcatgcagtattattgcagtgaactgtgaacctgcctatcttccttggcattgtgctgaaggctgaacctatacacatatggcgcgatacggcatgcctggccgcctctgcgtgctgcctactccccccatgtcaaaagatgagacaggcacagacgactactccggagtccggacgggcccattgaatgaaccaaccagtcaggatctctgtatcaatgcactgtctgccagtagagtaccaggtcttggagccagccacacaggctgcagctttagctttagctgcggctaacagaatgttgccatgaacagagcgacgaaagctggtgccattagtgcgcctctgcatgctcgtctccgcgcgctcagctaaacagctgactggctacttctgcaaaagctcacatgtgatcgaatactaccgcccaaggttttctgttaccctgcacttggacagccctgcagtttctgctctcttcttcacaacaatcttcttgtttctttgttttttttttttttgccctgatgaactg

SEQ ID NO: 2080 - DNA, 1964 bp, Zea mays
  misc_feature (1)..(100): optimal_loci_293717_G1, chr8:161538503..161540466, Cluster 12
agtaacacttcgagaactagatattggtgctgtagtatcgcagcaacacggaggaagtattattgaagaaaccgaaaaaagaacagaccaaaaaaaaaaaactttgtgaggacttcgttaattttgaaaaaaaaaacagacaagaaactgtcatcgggttgacctaaatttaaaaccatgatgaggaattcgtttcacgattctccatacaataaaactgtcagcaggttgacctaaatttaacaaaccacgatcgatgaggactttgttgtgcaaaaaaaaaaatttccacttttaaatcctgacaacagagtgctgccagcaggttgacctcaatttaaaaaaaaaaacacgatatgacgagaagtatgttagcttgtctactagtaataacagtctttaacactgaaagctttttagcgttccaattaactaggagttttaatttggacgaaaagtggagaggaggaaattgagtttgggttttttttttctctctcgtcaagcactggttgcacggagaaaaaaaatgcgcacaacacattgcagttccgttgcagtccttgttccagtgatgagtggtgacggaactaactgctcggcgaagaagtagactttgtagtagtgcggtagattgatcgaaatagatataaagtatctacggcgcgtgcacgaaccggcagctagctgccttctgttccgtgtcagtgcgttacagatcggacttgtgctagtagagcgggaaagggaacccggtgcgataacccatcgtcgatcgtggtggtggtggtggatacgatacggttcggggttcagctgtgcgcgcggcctgttccgtcttgtccggccaccatcccgtccggaggaggctttggctccggtagtagagggagctcagccttctccgcgttcccctgatgagatggatctttcttcttcaatagattggcggtttgcatccaccacatggacggatggcatgtaggtcacgttggcagcacatgcagtgcagcccaagtgcgtgtgacatggaaagaaaacggggccgggcagatggagccaccgttccgtgtgcgttgcccgctctgctgactgtgctctgcttccgcgccaccgcagtaccggaccctcactcgtgactcgtgagtcgtgagtcgtgtgcgatgctctccttggccgtagcgactagcgagacaatgcgggcagagagagacagacagagagtgagtaaagaaaggccgagtgagtgagggtgagagggcggcaatgcaagcgggccacgcgagacggccggggagggacccgaggcgcgacacatggagcgcaccgcatcggcaggcggcggccgcgtcgcgccacacgcaggccaaggaggatccggttctggtcgacccaccccacccccacccccagccggcgagacgcagacccaaccacccgacccaaccacatgcaccaactgacgatctgcaccaccgcctgcgctgcggccggccgggctgagctcactccgggtccgggttagggtccggggttcaggtcggtcaggccggccgggggtctcccgccagccaacgcccacctgcctcaccgacgctgtctcctcctgcctccactctccactccactgcatcatgtggctgttcgccgggcaccaaccactcctcacgtgccggtgcctcggctgccccaaataaagtgcggtgccgttccctgtccgggagatgtggcagtaggccgcagttctgctgcccgatccgcgcagtttttgcttccgcggggaacgtttctactgccgcacttgcattgcatgtgcatgcattgccacctgcttgtgcttgattgtgcaggagaggcaatccaactcacctgtactactactgccgaccgataatcaacacgcgccgtgattttttataaaatcgtccactaaatttaagtcccacacattacctcgacgccgt

SEQ ID NO: 2081 - DNA, 3010 bp, Zea mays
  misc_feature (1)..(100): optimal_loci_294489_G1, chr8:165550287..165553296, Cluster 12
gcctcttactccatggtccctattatgcctaaattaatgtgctctacgtactgttgtagttatctagacatgtagggcaagcacacccgctcttcttgtctgttcattttagacatcagtgttgatccttagaaatctgagccattgctttctatgtatcaaaatacttatgaaccacgatccagaaagcatggccatccccatcccacgttttgattgtgtttttaacacctgattttgtggcgtcctaattaaatttgtgtttgtttgattcctcgggaaatgacattttcgttttttttttgtgagcgacggattacaatactcccatatgctgatatgccccttcacaccttccacacggcaaatatagggggaaaaaagaatggcggcaatgaagccgaccggccggtgtgaaaaaaggtcgtcggctggtgcctaactgcgcataatttcagattctaccaccccgccccccagtttccaatctcttcttgcagggcgacgtttgggcggtgccaaacctgacgttgcaaaaagggcttagcttgcctttcctttgcaagaaagaaaaaatgttgcccgaaaggaaaccaccacccattttctaatggtggagcgttgaattctgccgcgataaaatgttcgcgtgttgctttcgcagccttttgatttgcttgtgacaagaaaaccgcgaaatttccactcccgtagttgcgctccatcttgcttacaactgtacccaagctcgagatccaatgtctttttttttgtccccgtttcgtgcaggtggcttgcgcaaaatatgttgaagcaacggggagtatcatggaaacacgctcgacagaagttaccgcaagagcaaggacaagattcccgtcgcgggcatgactactgatgcgtactgtgtcggttttatccaaatcccatcctcagcaaagcagccgagatgcagtagtacgtgtacgtggacagacgagaacgacacccgggcctagctagaaaccagtcgccgtctggtccacgcgacctcgacctcttgccggtttcacctgcattattatgcacactagtagttccgagaggggggaggagggatttaccacttaccagcggtttgggtggctgattgagtggaacgaacaatggaataaggcccgggtacctcatatgaaagccatcgcacgtccgttcagtgtgacgtgcctaggctgcgccgtaaacgtaacagaaagcagcagcatcttcccgccgttgttttacccatgaatgcatcggcggctgcaggtgggccaggagccgtttgggcgcaataataaaatctggaaacagctggcgcgacgcacacccacggagtgaacagacagagtgtgccccccacccccacgcgaggaaggaacgagaccagctgtaaagcgggcccggcctactggggcggccatcgaaggtctgccccacttgcgcccaaaaagccaccgaccactgtcccccctgccccgggctcggcggcacgtgcggtccaggtaccgcccgcgtggcgtggcccgtgctcacagtcagtcagtcacagactgctgaagtggatgtggaggcggaacggaactgtggatccccgacctccttcctctcccttgtggtgcaacaggaaatttacccctgcacgcccttcctctggtaaaggacacggcagccgtggtggtaccttgttctttggataccacaacttttttctgcacgcattgtactgccctaatggctaatggcctagtctagtagtaccaccgttgtggcgttgtccagggaaaaaaatacagttctaagttcggctaaagtgaatactatattttaagttcaactaaaaatagccgattccaataaaaagaaggagaaagaacagcagttttgcaaggatgacgagggagtaaaacccccggttcgctgttcgccctggaaggctggagcctgtcgcgcgcgtgattgtacgtagacagtttgcgcagtgcagtgggcgagtggcgagagctgagagcaagtggcaagtgcacgctggcgggtgacgctgacgccgtgggcggtgcctcgcactcgcagcaatatacaattcgtgacacggcgccagtgcgttgcggggaggggccccgtggcggtcaagtcattgcagcgggggtgtggatctcgaggcatgcatgtgggcgtggtccaagcatcgcagattctgtccggctggtgcagcagccagcagggcacagctaggcgggcatcgtctccctcgtatcgtcgacggtccaccgcaaacgacgaagattgctgttttgttcccgtccgctcccagtcccagacaaaggccgccggggtatcgctggcgcgttacgcattccaccttcgtcctccggggagggggcgcagactgcagcgtgcagcgcagcctacggtggccgacgaccagaaaagacgagaccgacggtcaaggcaattcatagctaggttaaagggtgcttgcccttgtccccccccccccccccccctctgcgtggcgagaaatgctagtttaatcctaattaagataagatgctcaaacagaactgcagtaacatggcacggaggcgtgggcacaagccccaagcactgtggcgcggctataggacttggagtggagacagacagtgagtgaggaaaagagaggctcgtttgaccaggcgaccaagcgctgctgagacgatggcagcacatcgctgcacactcgtcaccagcaagcaagctcaccggtccggggcagcagcaggaggaacggacggacatgcagagcgtcagcagtacaccactcggcaccaaagaggcaaagacttccagctgcggacgtcgatcagcattcaggaggcggccgtcatcctgtcctgcctgcctgcctaccatgtggccaaggaggaggagcaccatgagtcgatccccatgacttcgctgccggcgccggcattgaagggggaggcagccgcgcgctgcccgctggatc

SEQ ID NO: 2082 - DNA, 3415 bp, Zea mays
  misc_feature (1)..(100): optimal_loci_294554_G1, chr8:165871201..165874615, Cluster 12
gacggcccaaaatccccgtgccattctgccgggctggcccaatgtcacattcctttcgggcggccatccgcctttcctcatctatttctccctctttctctctctctctctcttgattgagggctccgcgtcatttctgaaaggtgatcaaagcatcgcgttgccatgccgtgtgggtctgtgcgatgacttgcatggacccgttacgtaacgcatgcatgaatgcatgatgcatccgcaccagagaaccgcagcggcacgggagtcaatgcgggccatttgacttgacgaaagcgccggactgagctctcgacgctgcagtagtagtacgacgcatgggcctgcgctcacacacagctcgtcaagcatgaagctatagataggctcaagcgatggcctcgtcccgggccgagcgatagcctcgtccgtcccggacagcaagtcagaaacgagcgcgaacatccccagaaacccaaggacggagctggggtacgtgtacagacatggaaaacgaccgtgtgctcgatcgatcactcaaccaggccggcaacaagctagagagccaaggagcacacacttgtgtcctctaaaccaaacctgcgccgcgcaaagcccgacctaacgcggtttacggaaaccacacggcgatcgagctggcgagcgccggtgactttctgcaacagcgctttcatttttgcagccgctgcggttcactgccgcgcgaacaacctcgaggaggaggacgactgtccgagagcgagggccgtcgctgtgccgtggattcctttcctgggacggcaaggactcgtcgcacggactagcatggcagcagaacgagttcccctcctcgtaaaagtcagtaacagttctaggcgtcagcagtcgttccatgggtcgacgatggaagcagaaggccgaggcttccgtcacttatcgtcactttgtcagggccagatattgtagttcttccagatggcactgcctagactgggccaataggattcatttacaaattattttatacctagtagctagccagctaggattcatttacaaaagtctttgtcactttttgatacgtgtgtctatacgacatatgacatgacaagctgctgctgcagtgccgtcatgtggtatagacagaacgccacgactccgctctctgtttggataacatggtaggtaagaccaccggcggccaaccagcacagcggtttaatctgttcgaccgctctacgtcatcttgtttttgtttttccaagccccgaacccttgttttccactgaatggttctatcacgacagagatagtccctgaaccatcacagaaagaaaatgctgttaacccgcccgaccagcttggaaaataacgggaacaggttggttgaagcagccgccagccaatgctttaggtttcctgttgtgcatgtttatccgggcgttgtcaattcgtatatcgccgccgtttgacagacagacagacagaacaatgccatcagcgccaaatccacggcaaagagctctacggaatcgcactctccatgattagcctgaacgttgttcgcgcacttctcgctccgcgctcgcttccgcggcttgccaaatgtcttgttcgtctccccacactccacttgtcctcgtccagagctctcggaggaggggatctccgggcccccagcaggccagcacgacggaacagaacgatttttcttcgttgtggtgggacgggccacgcggcccaaaagcacgcctcggacccgcgcgggatggcgtcgtgctcgtgccgtgccgtcacgcctggttgatgtgtcgcttctgcgccgtcgccgcataccgttgcaggataagtcctgtgaacctgtggtgcggtcgttcacggcttcgcggcggcggcggcgcgcgctccctgctcgcaggagatgtgacgggaggcgaagcgttttttttttttttttttgtaacgtgtcgagttggtgagcggtgagccgtcccgtcacgccgccgtggcaagcttttcggcggcgcgtgctatggtctatggaagattggaagcggagaatcatggtgtcaccggtggggaagtggaggcagttccgggtgggtgggtacacggaccaatcccgcctacgccacgtcacgtcacggcgtagctactgggatagatatggaagtgcgtgaaagcctcgatccaactgaccagctcgcgctgtccccccgatccaactgtccagctcgcgcgtgtccgcacggatgagactgaattgacattgacggcatggtggtggacacgacacaagtgggcggggcggagcggaacggaaagcctgcgccaacttgctgtagagctcgtggcggcggcaaggacgcaaggtgatcatcggaggacatagagtttggaacttggaagcgtgagcttcgtgcgtgccaatcaatgatccgcaagccgcgaccgcgaacgagggaaaaggcggtttggtaggtttaggtagggggacttgtccgcgaagttacaggtaacgagaactgtcgttgccacaagtatctcgccacgccacggggacgggcgtggaaaaaacgtagtacctggcaagatgaaatcggcgactgacaagcaacctgtgtggtccggtaactatcgttgctgcaacaagtcatacatgtaaatcggcgatcgactgacacatgcgcggaactccacggcaactatcgttgctgcgacaagtcatacatgtaaacgcctgtctttctaagttccaaccaacaaaaaaaacccgaatgacacagatgtaaatgctcgtcttcggctaaattactttgcaaacagagaaaccggatgattagaaagaaagttcgtggtacgttccacctggagagtttacattcgtggtacgtacgtggcatgaacacacatatatagactatactagagtctgggaaaatcatctacctgactggtgggtgagctccgcccgctgtcagcacgcagcagcgaggtacgacaaaacacgatggccggtgcaccggattctgaataacaagatgggcgggggacccgttaaccaaccctctcttttttttcaggtgccgcgatgaaagagaaaaccctcacatggacatggaccttcggggtacatacataaatacccagcattctctagtctgtaagcactgtgcggtactactacgtgacacggaccaaaatgtcaaagactttgaaaaatcgctggcgcgagcgttgattaggccaaaaaaaaaagttttaagccctggtacccatcgatgtgcacgtcggacacttacccgcaaccgcaagaaactctgctcgtccacggtctgacgagaggataaagaacttttatactccggcggtttccaggctgacaggtgacaagtggtacatggaaagctccaaagta

SEQ ID NO: 2083 - DNA, 2764 bp, Zea mays
  misc_feature (1)..(100): optimal_loci_295856_G1, chr8:171612604..171615367, Cluster 12
tcactagtatatatatactgtagcagaccgattcggttctctgaattggcacctccaacggggaccggataaagaaggccacgttctcggtagtcagccaccacgggtatccaaatccaatagaacagggcgggcacaatgcatggccatgcaccttatggaacggcagggtggccatgcgctgccctgccctaccacgataaggcatcgtctgctggaacggattcgttcgtgtatgtattcatatccgatccatcgcagcgatggacggacggccggccctaactccccgtacgtgtctgctcgtcggtagcacgaacctggtccgacccgaatgtagggaccatcgccccccgacggcgaggtccggaccgaccgccgacggatctgtacagatcagactacgagacacccatccatgctgcttgtattgtatgatttggacttcaaagccgacccagaggtttcctcggccacttgccgggaacatggagaggatcattcatgtcatgcgtacatcatgggtgggagccagtcaaggtcgagccgcatctcctccagcaacagttctgaagaatggcttgcactggtcatcaagtatgtatttgtcagagtcaccaggtatgcatgtaaacacaggcagcatgcatactagtagtaggcaacccgccgcgcttggcaacggcagatgtcgtagcagcgacagcgagcaggggacacgggtcgattggccgttatataccgatcattaattacgtcagtacttagtcggtaccacacaaggatcatcgctggccgcgctgcaacaagccaacagcggcagtgagcaagagctttggcgccgtgcacggctgctggggctgggctcaccccatcatgcatcggatcggagcaacttccatccatctccactggaccaccgccggggtccagaagaaacaccggcacgaccgttttctttccgggacggctacaccacgaggccggggtggcgcgcgcataaatctccgcaaccaactcgattcgcccggggcgatggaggtgaccgtatccggtgggagagacatggcatgtgcagccgccccagcagcaccagtacgtccattatttgtgatgccaatctcgcaggaaaggaaggaaagcaccgggagcccacatacatgtctgccgtcgctgccgcgtgaaagagccgtgggggccggccgggccgggcacatgccatccatgaagcgtcccggccgggctggggttgggcgggtcgatggcttgcgctgccggttggatgttgggttggagaggggggatgatgcgttgcggtgtcaatttgggcagaggttgggacggatggtccggccggccggcgtgccacgcgggtggatggaccgatgggtgccctgccaggttggtggatcgcacagcacccgggtggatggatgatgcggtgtcaatttgttcaaccagcatcctacgtactgtacctagcctggtccatgtctgccgcttcctatgcatcgtggaggtttatgaaaatggttccgttctgcaatttggattcaccgcagtatgccactgcgaagattggacacgctgagcaggtgcaaccatcgtgtttggttgttttcatttccgcagagcctagctgctcactgcagtagcccgtatttgtttttggatgcatcagctacaagtcaccttctaacatcacaagggtgtttttttgtccaaaagagaccatgtagccatataagtacgtgacgcattcaattaatcaaatctggagcgagttccagtttggagaaaatggacaggacaaccctgggcctggaatgtactacgtttgcacctgtctgtcctgaccaatccattcaggcgaacagaacgcagcgcagtagaaatcgcagtataccgcaatttttttatcctgtgtggaagaaagatatagcggggtaaatgagcaatcgctaaaccttgttcagttattggcatgctgggccaaacgcagttttgctttgtgttgttcacagacttcagtcaggtaccaccacacagcacactttccccacgaggtcaatccagaaaattgtactagctagccgtgtaccaaccacgagtgcaagacatatatcgggagttcaaacccaaaaaaaaaatgttcgtttgagaaaccgactgataaatgctgcaaaaacacatggagacttcttcagttcatccttcagttgcagtatgaggtagcaagggcctccagtctctgaacaacaaccaaccgttgatggtttcgtcatcccatatcaaactgtctcaccacaaactgttctccgatagtagttacagatgggctatttcccttcccgccaactgggattccccgcagttttgcacagcacctcacggcctcaccttgaggttcttcagagatgacaagactccgctacagaccgaggctagctcaggaagctcccacaggtgcagcgactgcaacctagcaagagtatcctctcccaaggtccgagatgtcaaactcactctccaaagtatcacaaaatcgtacatgcaaaatgtttcaaaggtttggacagcagcccaagagcaggtgcttcagacaaccgaaaccgttcacgtcttccactcctttgcagaaggatgacaaacttgccatgttcgagtcgagacccacaaactgtgcaagttgcccaccgcaaactacttttgctgacagaaaactatctaggtggtgacaattttccacccagagttctcgtac

SEQ ID NO: 2084 - DNA, 3077 bp, Zea mays
  misc_feature (1)..(100): optimal_loci_297653_G1, chr9:3655864..3658940, Cluster 12
caacaagcagcagctgtgccaaacaaggtataagaataaagagtagcacatagttttgaatacacaagtgtacaagagcaaggttttgaatacacaagtgtacaagagcaagaatgaaaagcatcttgatttaccaatggtttgttttgcggaattattggggatggtgtgggagaggagccggtatctaccaggagcacttcgtatgcagcacattaggaaacgtacagccgtggggcccaggtcttgcggaacaggtgcccggccggccactacacgcacgcgtagtacgtacgtactcctatatcctatgggattcgacgtggatcggtgagggcgtatccaacgacatgccgggccctcggcgtcgtctcgctagcgaatcgactgcccttgttgtcggactttgagagggcggttggtacaacaaagtgatgcgggatcagtacactgcagtactaacaaatacgattccgctgcatctataagttatggcctaaatatttttttcaggtaatggtcttcctgctagcactacacgtcgttttggggcatatataaaacctaaaaactacgttgtggttctccaagcatatctaacaaattcaattcattcatacaacccaaatgtaactaagtcctgtatcttaaacatctcaagatccaccacatttattcgagttgtatgtataaaacgtatctagacttagagatccgtgttaaaaatattcctttatcaagatattgtctcttatatttttgtgcacttactcttgatattccttaaaacacataacatttatgtgagttgtacatcacttaacaacccatctcgcgggggttcgttcctagtttttaggtagtacgcactacgcagcaattcatggaacgctgtctgccggtacgcatgtaccgatggctgatgggggcgagagaggagacatgtatgtacgcgacgcactttattattatttatttatttatcaactactagtagtactactataaccggacgtatgatgatgagttctcccagaaagataattaaaaagcgggtaacgcgcaatgattcctcataagaacgggggaggggtgcgggaaaaagcttggcacgtctgagcaaaaaagtgtgcgcgcccgcagatccacggggtttgcattgcgcagagagaggggggctccttcctgcgtcatttgttgagcgctataaattttgtttccagatcagacttcacagggatgatgccaatggcatggggtactcctttctataccggttcagcagaaaagagagagagggaggctactacagtctagtgatctagttacggagcaaacttaaggaatatgacagtagggtttgcgttttagcaatcatggacacgttaagtgtaggtcgcatgtgtttttttatttttgtgactaattgttgaaagtacatgagacctgacctgctggctcaaacctccctcccctcctaataatttatgtgtttgccgcctctctccggactccggccggcagcaggcccccatgacaggtctagtcgaccgactgatcgatcggggcgccagcgatgatggctttggaggtcgcggcgggcatggaaaggcagcgggcgcgcatgatggtgcgcccgagcggaggggcagcgcgggatggccggccacgggggccactcatcacccccacccccaccccagaaaccacgggagccaataaacaatccaacaaaaggcgggcacccttcgtgcgactcccggagccgcgcgtggcgcttgccagttgttgccaccgtcctggcgcctggcggtcgagcactagccgcggttgggttgggctcggcagttcgcgcccttcgccgcccaggcagcgcgcgcagctaagcttagctttcggtcggcacccaccagcctttgcctttgccgcgcccgcgctgctgggaggaggaggggtcacgtcgcgtggtccaggcccggccggcgcccaaagccgcctacacgccggcccgccacctcagtttggcgcgggatggctggcccggccgggcgctgccatggcacgtcgcagatgctgcgccagagctctggtggctggactggaccgccggggctaatagctactagtactcattcatggtcatggctgaactgaagatcttttttttggggggctacccttccttgtctcgtcgtgtttcctttgcatcgtctcacggctactcgaagatagggccgtgctagctccactatcgctgctttatctctctctcgctcgttcttatctcgacgccttgattgagatcgactctgaacgaggaagatctctgagcctgacgcatcaacggcttgctgtcgtgcgtggcgtggcgtggcgtgcggatcgaccgatctttctgcgggcaactcaagtcgagcttggaggaaccggagcctggcggtggcgggggtgcagtgcagggtcgtacacgtcctatggagatggagatggagacgtcgacgtctgctaaagatgctatagctagctagtacaaactacaacgcacaagacccgtccgtccgtccgtcgctttgttccaagaggggggaggaggagttgggttggcgagccaatggcaagggcggtacgtgcacggcgccacccttgtgtattgtagtagtagtatcgctttggcagcagatgagatcagacggcgaaagtgagcccgctttagcagcgtcgtcaccgcatctttcacatgccgccgcctgtgctgtgctgtgacctgacctgaccgtcgtccagcaatcgagcacctgactgaatcttttcttgctccacttgcccagcggcagagagagtgcgagcagtatatgcaaatcgaatcaggacgaccgaccggtgcgtgcgagacctgcctggcctgctagcttttctctccccggccggctaaagcacgcacgcacgtacgggaaaaagctagcgcgcggcgtggcggcaacctggcgcgaggccagcgagccctttgtcttctcctctcttgtggatgccaggtgccggttggcgtgttctcaggctcttggatccgtcgccatcgc

SEQ ID NO: 2085 - DNA, 3112 bp, Zea mays
  misc_feature (1)..(100): optimal_loci_299952_G1, chr9:13159363..13162474, Cluster 12
gctgctttgctcctgcatgcatgcgtaacgccacgtatttataggagaggaaggagaagatcgagggcgaggaagaagaaagaagctctcccggcctcttccggaaaggcgcgcggcaactttggagggaagttcggcaagtttaaaaaaagcggcggggggagtgttaaatgccggtactaatctaggcgatgaatgatcttggaagcttgcttgggttgcgctaatggcgcgctggccccaccgtcgtcccaggccaggcatgcaattggaggcgcaggggagggaggaattaactgcggggggcgagcaacccatgttgatgctgctgcagcctgcgggggaagggaagctgccgctgccggtaccagtaactgcgctgcgggctctgccgtgctgccatttttaaccctctgcacgcaaacaatctctcggaatggaactgtgaattcctgggtgttactgacggccgaaccgagcagagcagaggtcgggcagtgccagggccagggaattttccttctggagactggagggtgtgtcctcatgtcagcgtcgtccagtgcagtgcagcgctgtgcctgcctgtgcctgtgctactgctgctgggaggagacggagctgcagccttgcagggtgcgcctaggtctaggctaggtagggcgtaggcatttttcgttaggccggaactaggtggcggggagacgtcggatgaagcatccgacggctggtattgagcccggcaaaacgagtcgtagtagggtagaagctccgtgcaactgtgcaagtgcgtcaccagcagcaatacgggtggtgtagctgtagcagcaagcagcagcattttcaccacacaggataatttttttttgaaatgcgtccgtctctgactctctgatctattataaaaaaacactccactaatcatggatggcgtggcctaggcacctatatagctcaacctgatccaaagacacgcacgatcatggcctggcctagttggcgagcagcgagttactcctaatttgtccagccgaccagtccattacatatggccacgtcatgcatgacaccatgcatggcgattagagtcccgtaccatatacacaaacgctacctcgtactaacttgcgtgttaactgcggattcgaattgaaacgatgaggaattaaatgggagagccacggggttttttttaactcccagcagctggttaaaccgcccgcgctccgatccggatagaactgaaggctttgggcattgaccgttgatgatgaggagttcaaattcaattcgtccgtgaacagtacgtgtagctaggcaccgtattccagtcatcgatcagctgcaggtaacaacgccgccaaaccgaaccatgcagcagcaactggttctcgtacactgttattagggcgataaatacttgttgtctgactgacgaggacagaccttagggcatgtactacaaacttgtacaacccagaggcttattaggatcgatttgtaaagtataagagacggttaagaaattgcataatacaactcagagcctataaatcataaatacagttaagacataatatgtatagagagtggtgtagagacgggctctccacgaagagactgtctcttgatttatttatttatttattgcacttactacaccctagagactgtttaaaagatgtctaatttgagcgtactgtgagctcaaaaaaaaagttacggttacacacagctcgttcgtacacttctccgtaacattcttgatttatagcactaataaaacagggaaaagtgaagttattaactgaagagtggcttgttgggagactagtctacaaactacgtacttaattgcattattaattgctgacagacgatagctttatttgtttaaattactacgcactccagcagccatgcatgcaagggccggccggctagcgacgaagtcgttattagctaggggattaattagagctatagactgcttgcggagtactgtataaaattacttctatacttccaagcaatcgtcattctaattacttttacttttacttttacttttacttccaagcaatcgtcattctaagcaagacgcattacgtgtgggagttaaaattttgaataaagaaatagacacgtacgcggtggtattaccgtgtatttcttttttttttcctttttacagtatgcatatatgccttgcctgccaaatgcatggcacgccattcattcctaggcgacggtacagaacagaacccacatctcggcgcagaacctacggtacgcgcgcgcgcgagtccggcggccgtatggcgcgccgttcaaaattttccaaaactccgatccgggatctatccatgatccatgcatgcatgagatatgcatgagccgccggcccgggggctggacggagccagtcagccagcagatagatactagatactactactcatgaatgctcagctcgctacgtacgtactacagtatacgtgctgacgatgattgcaattgctgcaggctcgcgggatcttgtcggccggccggccggccagccacacgaagaaagggagggagggattcgtgtgcgtggctccaccacttccaacgtgcttccttccttctcgtgtgtgcatgcgtgcgtacgtacgtaaacccctcagcgtacgtacgtggagctagtagctagcgcgggcagcaacgaacgaacaccgcgcgcgtcacgtgcatagcatgcacttcaatcgcgcgcgatcgagaattttaatttccgcgcgctatacgaaggattttgaaacccccctccggccgggccggggatctctccgatcgatccggcatatcaatgctgcgcgcgcgcaccaccctgcatcattgatcatcgtccatcgtcgagccggccggcaggcaatcatggatgacgacgatgatcacttccatcaatgcgcgcgggagtcgggggccgggggcgggtacgtagctttggaaatgacatcaagttgtacagatggacatggacgtacggactacggcggaggggggagagaagaatcatttgcagtaacgacgacgaccacgtctcggcaagctagcgcgtgcgtgcgtg

SEQ ID NO: 2086 - DNA, 1489 bp, Zea mays
  misc_feature (1)..(100): optimal_loci_300336_G1, chr9:15362696..15364184, Cluster 12
tctgatcatccttcgtttctcctcgcgtgtcctggtcctggcatgcgtgccatgcgatgcgcgtgtcctccgggttcgaggccggccggccggtggcagaacggtgtcagagagcccgcccgggaaggcggcgcgcggaccgcggctgccctcgctcgcgctcgcgcgcccgggtcaggcgccggcctgcgcgctgacgccgcctctggccgcaagccggtgtagtactcctacgtcgtctatggcagagcgcgcgcgcgagagatagagagagagagagaggcactgaggcaggcaggccggctggctggccttcttttcgtcgtcggtcaggtggcctgtctctcttgtcagctttgacgttgtttggaagcaagttaagctgtcagagaagcaggaccatgtcgatccacgggaccgcagcggctgccaccgctcgtgcgtgcatggccactgacacagcgtgtacttcaataatgcagcggcgtacgtactcttgcttattaatccaatcagtggacggagcttcagtctcaccccccacgcttaattagctgaaataaagtaccgtggtttgaccctgttttgacccgctatacggatctctgttcttgtatattatagctgacagctgttttaaaccttagcagtatttgtttaaaatatttagccaaacaaaatacaagaatatgttattacatctgttattaaaaaaatcaggtcttcaaaatgcaaaaaaggttcatgtatctctccccccccccccttttttgcttgctctgacgtgtcacttgtgtctatttgcaatgcgcaaaattcgaacacctagtggcattgtagataatattgtttcacactttagggatgagatatgggagccgttggatactagcctaagagacttgcacttagaactaaaaaatgcatggctagttattgtacaaaatgaagaatatatataaatactaaaaatctaataggaaatagtgttattcctcaacctttcacgtttcaacttccatttcatcctaccaaacggagccttgttcttttctaatacgctgggtcttgtactcttgtgagtttgatcggagcttcgaagtacagccctgggccacgttttggtcacatagcgctgcggcggcccctgccttgcgaccaggaggcagctcaaccatgaccacgcgtggagtacgagcgccaggtccacatccacgcacacgagatggccgcgcgatgacccgcgccggtgaagctgggcacggcgcgcaatcatccaagggctctccccggcaacgtgatccggcagcagaacggggatttcgtccgcgtccggcgcgaggggaggcagcaggtcagcgggggagatggacgagaagacgcgcgtggagcaggggatcatctgggtggggtgggtgggggagcaggccgacgctgacccgccccgcccgtgcacccaatcttggacgcttgcgcggtcggatcccac

SEQ ID NO: 2087 - DNA, 1521 bp, Zea mays
  misc_feature (1)..(100): optimal_loci_300888_G1, chr9:18619817..18621337, Cluster 12
actactactaacaaatcaggggattcttctgaactatcatctaggtaggacaccaacagtatatgcatgttattaacaaaaacaccatacaaaaagcaccaaaccaaacacacacacacacacgacgagaggcggttgcttccggcacactcctccgctccagcccaaatccgggcgttagaaaagcgaggcgaatcaaatcgggggctagccgggccgggctggaggcaggttgtggcttgcaagaagacacagcacgacgcacgtcgccggccgacagcgacggctcgctctctttggctttggcatcgcgttatatagtccacaccgagagaccgtactggagtccgcttgcattgcagccgatgatggaatgcctccgggtacgcgtacctgctccccggcggcgtcttcctaaagctagcggcggctcgggttgttgggggttcctcatcgtttggtggcttcctaactggtgctcgtattcgttcgtatgcatatgcatgcatgcattatcgacgccggaggttgtaaccgattaaacaagtacagtagcatagcagcgcgattgttttaggagtagatgtcgatcctctatgatgatgatgatcgatgatgcgtactactactacgcaattaggggctttcttggaatgtgggacaggggcacatgcatgatgatgaacagatgagtgacttgaaggaggagcacggcggaacctgcaggggtcgatcgtcaaaagatgagctttttttttaaattatgtttgtttgacgtcggtctcagtctcagatatattactatactctactccctcgatcacgcggccaacgactgggccatggacgacgacgatgagctagcggctagccatcaagccatgcatgcagataatcttgttaaaatgtacttccttccgtcccttcccttccttccttcccaaagttggtgattttattctgttttatttgctagaaatatctaatctagctagctgcacagctgaaatctctgagtacactgatgctcttcatttacctaccttattaattattctttgtggttgatccatccatccatccaagattccgaaacaaacagtctgatctgcagatgactaattagattctgaatcaaacagtcgtctgacgcgatcgatatgtgcttgatatgacaatccgttaatctggtttacagttaaaacgcacttctcttcctctctctctcctctggataacagtagcaacggactgcactgcacgcaactacacgggtgccgagttcgctgaagaattgacacgccatccgcccggccgcctgccgcgaatagtagtagcactagcagctagtagtagtgcgtgttctccttcccccgcaccacgttattggagttgttgagccctagcttttattggcgtgttcaggtacggcgtaggtgtcatggggatgggaatccatcgagcactgccgctacaaatgtaacgacgacgaaccgccgttttttgtttcttcttctctta

SEQ ID NO: 2088 - DNA, 2001 bp, Zea mays
  misc_feature (1)..(100): optimal_loci_301417_G1, chr9:21722128..21724128, Cluster 12
agaaaagtgcctacagaaacatcagttgagtttcagctattgtcattagatggataaaatgtggaaggtactgaatggctctccagtaaggactgatttggtgaccagggaattggatggatccatgggcatggatcccatataattccctggtcacaaaaccagccctaagtgtgcacccaacactgcactttgttgggaaaaaagcccaaagggtttactcaagccaattcaagaaggtaaccactggaatactggatatcctacatttaatgttttgatgagaacaatatcagctgagctcatttctgcagagtaagcatgtaagcctgaagaaatcaatgaagatgataaaactttaaactcgtccagaatgatgagcttgttactgttaacaaagggaagactcgagctcaactaaccacccaggatcaaactgctttgtcttaactcaatactaagagcccttttggcagcttggaacagttccgatgctcacgtgaaactccagaatcgctgccaaacgggtaggtagtacagaaacgtttcactgaaccgattcatctttttctgcctgtactgggagagccagaaatggacgagtagtttcacctgattccgtttcttggctcccctctctactagcaaccataatttcagttaatcattttaagtgcaacgagctaattgctctccccccattaaaaatgttatgcatttttaagcatgttttatttatatgattttttaatgaaaacatttttttaccagaatccagccacagttgcctagtgccctagtcatttctgtagtctgcagtgcatgacacatcagtcatgatgaaaaggacaaaaaatgaagtagttaaaaggaaaggaggataagccataagcatcaaaggtcaagcaagtagtctcaaaggtgccgctgtcaccgagatctcgaacagtgcaagacaaagcaggaaaactgataaaagttggcatgagatgaaacggttgtcttagtatcttttagtaggaattgtactaatgcctgcattgcgctttcccacgataaagccataggtactcttcatcgtcgaaactgtatttttcttcttccaaaacgtaggttgcttaaccttttttttttgcatcttctttttgcagatggcaccgacagttggagctatcagctagctctgcagttaaattaggtcagaaaacaccctgcatttctgcatatgatgagcttgggaactagtagtagtgtagtacatgatgaatccacgatggttgtctgaactgaactctgacgacaggtggtccgcctgcaactgcaagtgccacaccgatagaggatatggttcttttccgagactgcggcaccgacgttctcgcggatcgagccttcgacatgggacgtgcctggagaacgacggcagtagggcactgcgactctgctagtctgccctctgcactgccccctttcacttttcgtgcaacatacctttgcttgctttgagcctatgacatggcacgtgccagagcaacgcatctgtccttgggtcgcttgcagctgcagctcgtcctgtatgtgtttctgcaaccgagcgttccggagctcttggatcctgtgctctgcgtcatatactcgtggtatattgttaaaactgtcggcagatctgatcgacccatttggatctgtacaagtcgcgttctctgcaacccgtggactcgtgcctcggtttgggggaatctatatggggtgtggattggaattccgtggcagatacgaaaagggcaccaactggcaactgggcaccaggtcagtgcatggggatcatggaacggaacggaaaccaagtccggtctccggtgctcccggcggccggtcaaccgtgctcgtgcctgcctctcccccagtccagctcgcacatcgcacccttgcttttgccatctcaagcaaagctacggatctgactaaaggtagcctacgcgagctggttgacacttcagc

SEQ ID NO: 2089 - DNA, 1917 bp, Zea mays
  misc_feature (1)..(100): optimal_loci_301789_G1, chr9:23521476..23523392, Cluster 12
tccctagtcctaaaaacacaatcagaaagaaagaaaaagtgcaagggcgcgcgatctcaatcgtctcttcggtcagacagcgacctggcactccgccgtcttgaacaaagattcggtcaggtcccaattccaacggaacacacctcatcacatcgccgcactagtgcctgtctaaaaatattaataatctgtccgcagcgcatacgctctactctactgcttgcttgctttggtacatcacagacattgtgttggtgtgagtgtctgactatttgctacaccgggcagggcgcggcgttactggccaccctggtcattctacatgtagtctaatacatgccaggattgcaccatccacttcctctgtgtcgtgcgctgcctaaatttacctgacagtatagcgaaaccagccatctcctgcctaaatttgacggaaagaacatcgccgctttaatggttggcgtctcttctactaatatacaatgtttctgcttgttgtatgggctgcagttctcttagagagagagagagagagagaaaagaacggctagtgcgcggcgcgggtgcgatcgcacgcagcttggccgggccggcgcacactctccggctcgaagcgaagcgataacgttacgagacatccatcgtgcggtccgcgcgcgtgcggagctttgttggcagagcccggtgccgggccccgcgcggcgctctgcaggcgtttggccgcgcccagatcgcatctgcgcgcgcgcgcgtggtggcgacatggagccccgggccgcatgttcctgccccgggttacggcctccccaggccccgccgccgcccacgacgacaagcgggaaccaaaagcgacgggcaggctccattgtcactgctcactcacgcgactacgcgaggtgtatggctccatatgcttcccccgcgccaggccggtagtccgtccacctgtccagtagagggctcgtccgacgaccgacatttgagttgagccacttcacgcgtccgtcctcttggatccaccacgttcgacggagacgtggcgtgaatatcgcggtagctacctggagtaagtagctagctaggccgcacgtgcgcagcctagagtcgcagccgtgtatcctggctgctggtgccatgcggatgccgccgcggcctagttttggccggtccgagcgccgtgcctcgtcggtcgccgccgggatagatatccgatatacgacatcgtctcgatatttccggacgcgttcgccgctgtatcaaaaagggcaaagttttcagttttccgcccgggcgtgacgtcagggcggacgcggtacagtacagtacttgcgcacgccccttccctttggcgttgctctggcctcgcctcgcctcgtcggcacgtcacgtcgaccaacaaagtggagcggatttcattcgagaggcgggccacggacgccagcgcgagagcgagagcgagagagcggggggagggccggaggggtggccgtggccgtggctgcggccacgcggcgtcccgacgcggtcctgccgcggatctccgtgcggattccgtgacgtagacgagacgagacgagaatgcgggattcgctgccagccttccagaagcggacgagacgagacgagacgacggcgcggtcgcttttttttctcgatcggagaaagacgtaggagcggctttgtcactgcgccaccggacccgtgaggttggcagggcccctcacctaggctagtacgaaggacgagaggcctgccttgcaagtggaccctcgccaggccgtccaatcacggacggacgggatggaccggggtactagtactgcaccgggctggcgttagttgctgactggtgctgcgcttttcagtcctttgccttgtacgggtaattttgttatttagggactattttagttttct

SEQ ID NO: 2090 - DNA, 2867 bp, Zea mays
  misc_feature (1)..(100): optimal_loci_3142_G1, chr1:15998560..16001426, Cluster 12
tcctctcacctgcttgtttaattgcatgggccttgggctgtcgcctcgcctcccgtcaggagccttattctgctgctactgcacccgtgcatcgtccgtcctcccagcagacccccctgcagctcgtgatggcgaactggatgtcaggcctgtgggcttctccatcaatgccgccgtggctatagcctgcgctgcgcataaaaaaaaaaacaaaaaaaaaacctcacttattcacaaccgagccccgagccgctcgtgagctgtacaggccgggggagaagaacgagagcagagcagcgccgcgttccccggaaatctcacgcgccgcccgttgttgcctgccgagccccgctacgacgatggcctgcactagtgcgcctgccttcctgcagcctgcatcaccgcctcatggtcagagctgctgatcgatgtgcgtacgtgctggcgtgctcccaggcaccaggcatacgtacattatacgtacgtacccttgggccatggcacggacgggcggcagatctagcagaatatgtacgggtttgccgggcggccgttcacatgtacgtacgctcgctcgctcgcgaaatgcgtagagcacgagagaggcatacagtgagcagtagtagtgtagtcctgcctgcctcgttgcgatcgttgcgacccagggccaggctggcggacgccgccgtgggatggatgtcccctccccgtgcagcggtgcggaacggtgtcagcagcgctgttcatgcaatagctgagtagcagtagctggacagatatacctatcgtacgtactccctagtctagtatttttagagcactcggcacatacacatacaccactgcacggccggaactgtcgtaacgtgacgggctgacaatcgacgccgagtgatcgagatccgaagtggtgcgtaactgggcgcatcggtcggcactgcagcccatcatgccagcatgagcagatcaacgagcaggggagtgagttgctcctgccatgcatgcactcccagtacggtcgtggtagcagtagcacgcactgcactactgcagcaacccagcgctgcctgcagtgacaaaagtggcggtgcagtggtgctcctgccaaaagaagataaaggcggtggtaggggggtacacgtagcatcgtaggcccgcacgtggggaatcagatcacgcgtgccaggcagggcggcagcccatcatgggagccggagccccgtcgtccgcccgccggcctccaaaactctcgccatcgccgccggccacccacccatcaggcttttaattgaggcgcgcggcctagcagctaaccgtaggctactagcctgtgtcaggatcgcgcgcacgggacgggacgggacgggaacgggaccgtaacttttggttgccctgcactgcactgcacgcggtaaagaccaaagcagcaagctagcacggccacgtactatgcgcggcaagcgatccggcggcacgccgggcccgcgtgccatcgggagcccatcggcgctggttgcttttctctctcttttctcggcgcctctgtcacggtcatgtcgcgccgcggcttccgagaaggcagatgagagcaaagcagagagcattcagcgtcagggagagggagccagtagtactgtactcctactggacgagacgacgacagacgaagacgatgatgatggcggggacgggatccgatcccgcgagatcggtcggtcggtcgggcccgggcggggatgcattcccaccccacccggccacccccacgcaggcagagcttttgtggcgccgcggtgcaagtgcaaagcacaaagccaaagcgcgcggcgtggcggcacgtacggggccacggccatcggcatcggcttccgatcctccgcgccccctggcatcgcgcgcgtgatctaccgatgatctccagggggctaccgtgttgtgcctcgggatcggcggccggcgaccacgaccacgctcgatcgcgcgctcttcttttcatcgctcgtactgtacgccgttgccgctgggaccggacaacactgttgttggcgcccaaggtttcaactttgaacgcacgcgcgaaccttaccttcgtgccagcccaaattggaagcgctgtttacagtactagactgccaagctttgacaaagagtgtggctgtgttagtgagtaacaaagtaccaataatagccgcccggtgctcgtaaacgtcatgtggctccgtctgcgtgcacgtgcctacctagctagctagctcgcccactggccgatcgatttgcctcctagctctgcctccaaaacgacgctgccgatcgattaatttctcttgcgcaccacccaattattgcccaaacaaatgcatatttagctcttcttcatatccgtgataaagttgattgctttcgtgacaaatgtccaaaaaaatgtatacatgtcaatatttatattttttagctattatctcctccctcaaagtaggtgctgaatgcaaggccatgcaaacgctgctccatcatgtcctaataagaaatctcatagctaggttcgtaggccttgcaccttatatatgctctagatcccaattcccaactatacctacctctcacaagtcacaaccgaaccacaacttataatgtattcccttctttttaaattatagagtattttaatattttctaaaaacggtccagattaaaagatattatagtttttctaaacatataatttttactatatatatataacttataaataaatgcacagtaaaacatatgaatctaaaaattcaaaaattcttataatttataacagaggaagtaattatacaggagcaccgcaatatttgaaagacgttgcactgcaatatttg

SEQ ID NO: 2091 - DNA, 1799 bp, Zea mays
  misc_feature (1)..(100): optimal_loci_315713_G1, chr9:110244685..110246483, Cluster 12
caaatttggaactaagtgttagttcaaaatttgttggattatatataatcttattagattataatcatcccaaacaaacacccctttacacttacgagtacttgtcttccgagtctcggttcaattgcaaacaacatcctgatccaaattaagaacactcacaccccacaggcaaaactagctaggtgtgcgacaaactgccaaaacagtgtctctggacagctcgaagtctagaaagccagatcttaaacattggatccaccatggagtagctttaacttggatatagaatgtaacaactgctgaattttttttttttttgggggggggggggggggagcgctctaggatgaatctgctaggtcggcccaacaaccatccatctgcatcccattagtgagagctctagaaaattcatgtgtctggtcttcaggtctaactcttttacggatctaaattttacagaggagagatgtttaggttcaaaaaaatcatatttagaagttagaactgattttttaggaaattctagaatacttagaggccggtgtctcagactcagagacgcccttgctgtctgatgatagaataattgaagctttccagtcgcgaaagcttgaggagatagacagggcccagccacccagatggacaagatacatgcatgcatgcatgcaacaatgaaatcactcggctcatctcgcgtcctggacctggaaactgtagcactccactagggtactagtactgtacaaaccggccggaggcagtgctctatcgatcatcattgcccgccaccgtcgtccggagcggcgcggaaacggcgattggcaacggccgcctccttcttcgtcgtcctcccccgtcacctgagacggccagcagctgccagaaacgacgaaggcatccccgtcccggacctagctagcatagcatagcatgcatgcaaccagccatgcatccggccggtgatcgaacgctccgtcgacgtcgtgtggaccatgacacacaccacatgccaaatgcaaaaacattgaacggtcatggtacaaaacttacaacgatcgtcgagaccagcaggcgatcgaatcgaatcgacacacacgcacctgatgaaggaaaaagcaatgaacattgaacgtacgctttgcaggatgggtcgatcggtcggtacgccacacggtcgatacgatcggcgataattatgtccacgaacgaacgaaccaattagcaagagctggccatttgggttgggatatgcatgcatggatgcttctgtgcaagtgctctatatcaggccgtaacacgcatgcactcatgactcatgcagcatgttgcttcggcatggccgcggccgcgcgtacgtggctccaccgaccgatggccagccagatcggtccagactacacttagccgcgagagctagcgagtacaagggcatggggacggcgagggcgacgggcgatgaccaataataataaagctagcgctagcgcgagcgcgcgcgatcgatggatggatgcaatggccagccggctggccgggcgggcggcgttatggaggcttgtcacgacgcccgctttcggcaatcggcacgcccagcggccagccgactgaccaccgcgcatgtgcctggcctggcctcccccccagttcgcttgcccagacccagctaaccccatatccacactttgggggggcgtccctgctggtcaaaacagaaacttccctgcaagttcctgcatgcgttcctccgcggctctgcttcccaatcgcgtggatagctagaccgggcatca

SEQ ID NO: 2092 - DNA, 1681 bp, Zea mays
  misc_feature (1)..(100): optimal_loci_319724_G1, chr9:132005098..132006778, Cluster 12
catgtacatctccatctcttatctgtttctttttttcttctacttcaattaagcatgtgagttgttgtttgaaacgaactctcaatcaatcaaatatgcaataatactgatcacacacgttatgtttttttgtctttatactttgtaaattaaagtgtatctaaaatccgtgctaagttcaacatctccgatcacatggagagctggattggtggtttcgataaaaattgtccatcgtgtgtacaaatacatcgtacttggaagcgtgttcaagtttccaaaaacgtggacaaccttttgctcacgtgcacattgccgtacgtgttgcacttattaatggacatgctgatgtgcaggcaatgatgccgattaagcttggaattagggggaaagcagcacgcgcctacctctcgcactgaaaagtggcctaccattcgctgtgttctgattagccgcgctctcgtttttttttccctcccctcaaagcttacctctgtctgtccttcaaagcggcctaccctacgtacagtttctactactactagggaggacgatgaccgcatctgctatcatcaatttgcgcaaagaaaagacgcgccgctttaaagaaccaaagagcgcacaaagctgttgccggccgctgcactgcatgccaagttctgttctgtgtataaaagaggtggtgaggcggcggggtcgtggaggtacggtcctgatgaaacaacaggatcagattttggcagttggcgtagacaagcaggaccgcgtaggctgctatagaacatgtgtcggtcggtcggtactacggcgatctcgggccattggcgctctgcactgtgcagtctgtgccgccatgattgttgacctgtgagcatgcatgcatgctgctgctgctgctgccctagatcgacaacaggaacaggcaatgtcaatctggagatgacctagctatttcaaatccaacttccaaagatgaccgggatcagatcagacaacccatccttaaactacccgaatagcggtgcacgagcacgagcacgatcattgggtccacacacactcttggggattttttcgcaaagcggcgacgaggcgactgccctgcccgccgagctcgctcgctcgctcgccgaaagggttggagagtggagcggtcgccagcaacacctcgccgctgcttccgcctttacatcacgtcgagactgcagactgcaaaggcaaggggcacgccgcacggtgtggggcgcacgtacgtgctgcgtctgcgtgccggtgccgaggctgcttttaaaggagagctggccgcagagaaattcatccgagctacagctaggccgagagatgcagagggccgggcctccgcaccggcgacccgggccccctgctcagctccgatcgagctgctgctgctccactctgccgaacggcagcgcgcgccctctggctctgcgtctgcggtctgcccctcggcacggcacggcacggcagtcgtcatcgtcagtgtgattcagctcccatgtgcccgcgcccagtcgctgcctgtcctcgcgacgcgcgcatccggggtggcatggcaatcatgaaagtgagatagaaatgggtggataccggaggatattactactgctgccgctctgagccacggtcacggggcacgggagctgtcaaggaaaggcagaga

SEQ ID NO: 2093 - DNA, 2864 bp, Zea mays
  misc_feature (1)..(100): optimal_loci_320866_G1, chr9:137496267..137499130, Cluster 12
gattagtaggagtgtttctttcgcgtccggccggtacggacgctggcctggccatcgtcgttgcattggtggacttgcaacgtccgatcccacactaaaacgaacgaacaataatcagaatatcagatcgctcgtcgtcgtcgtcgtcggtggcaatgattaggaaggaacacatgattcgatctctctgcgtcgatccgagggacacgcaaacggggcagcttgcattaattagacggactcgttgcgcgcgcggatccacgcacagcgtcggtgtgcagtgcacacatttgcacgatatcggggcaacatacgtatactcctgctccatccgtttcgctatctcagtgtcacgaagtttatgtttcgaaactttggccaacagcatctacaaaataattatttttttaaaactaaagaaattatatattatactttacgttttaatcgtaaatataatagtttatttttatttagtcaatgtttataaatatcttgttattaatggtcaaagttcaaaataaatcttcgtcatcttacgatagggaatggaggggagtccgttggtgcatatcgcctttatctacggatctccaagattcgagacgtagtgctaggcaacggttgaaggcatatccaatttggagccagagcagatgcctagaggggagtgatgggtaggcattcattcattcgcgggtcgcggtgtatatcttttccgcgctagttgtagttgatgcgtgagtgagatcgacctccccattcatgctcgccgtgtgggacaggatccgcgcgcgcgcgcttctttattcgctgttgctggcgtcaaagcgaaggcaacaaccccaacgctagatcgccgatcgctcaaggccctcgccgtttctggcttttacgctcacaaatgtctgcaaaatctaaatcttgtaataggatagttactgatttcagtactaaaagcagaggttcttcttcttcttattctgtttttttaaataacgtcgcctgttacagattccgttcactcggtctctcaacgttgaagtccttgtacgccatcgcgagacctattcgcagagcttgttgtcgggctagataccgtcctataatgtggggtgtgtgtgctctactactgtactaatctattactcaatcttgctagaatctgggaaaagcggccccaccacaagttgcaaaaaggcacttccctgctggtcaaaatcccttctttttcctggcatagctttctggaggagctgtctccgtcccacgacaagccggagtcgcattagctaacaagtactactaatactttattcaactggctaacccagggcaggcacagctgttctgattaaacaaacatccctttcccttgtgtgcgggcaaaagcgaggcgcatcgcatgggatgcacgaccccgcgtcccagtcccaggttctcagcacgatccattcattcatcccagtcccagccaggaccaggatacggtgcactggaccaggcaagacgacaggccgggactgcacgagcacgacgactcgcagtgctagctagcaagccagtccttcccacgacggagacatggaccaaatcaaaatccatcccggagagtcggcacgacgcggacatccaccgcaccccgcacacgcatgccgccgccggcgccgacccgctggggctcttcctgccggcacggcacggtgccgcagccgacggacgggtcaagcaagagaggccggaaagcatgaggaccccgcggttctgtccccgtgaatcgcggaaaaacgttgtgcgcgcggcggagactgtgggctgtggagtgtcgtgggattgcgcgacaccggcgggcagcgcaacgtggggcgggacgggaggccagtaaccggcggcccgacagcacggggcccaggtgccggcgaacgcgagatcacgcgtccccggcccccgctgtggtggtgccgtagcagtgtagtgtgctgccgtccggccttttggctcgtcgttgccgtgccagttttggcgccggcgcgacggtgctgactgaccgacgccgagacggcacggctgggggtccgccgcaacccgcgcgccgtgccgaatcggggcgtcacgccgaccacggaactattttcctttccttcggtgacctgttttttttttttttttgacttgtgacttccctacaccacacacaggttatagcgtgatgcaaaaaaggtagatgctgctgccatcacgtgggaagctcaaatgaagctgaaagcaaaggtatccctccctctcacgccgttgttgttgttgttgttgttgttgttgttgttgttgttgtttggggccgtggcggtggcgcggctgtctgtctgcacccatgctccgacgcaacgatgcgcacagactgtcaccatcggcgccgcaccaaaacacacctgcttgtcggtcgcttaaccgagtgtggctggctgacggctcttgggtccttgtggcctgttctgttccatctcttccactcggcagtacgtaaagaaaggttacatggtggtggctgcacaagttttaccagagggccgtggcctcttcatctcttcccctcagcgggctccgacactggctgttgaacaatctttgggtttcttatacgctgatggtatgattttttttccaagagatatttttacggtgaaaagcaaaaaaaaacccccgaggattttcgctccggagatttgctcaagctgtcagtaccaactgatcctggattcctaagcatctgggattgcccgattgggatgggacacagacagtcagacacacacacacacatccaagcattaggtccagagcaacatggcaagatcttgtaggca

SEQ ID NO: 2094 - DNA, 1627 bp, Zea mays
  misc_feature (1)..(100): optimal_loci_321306_G1, chr9:139758530..139760156, Cluster 12
ggttgggaaatcacatggaccgagatacgattagtgtgcatacacacacacacagagagagagagagagagagagagagagctgtaatcggatcacatgcatgcaaggtaagagagacaaattattactacttctccagaaagtgatggaaaatgcattctgtggactacgctgcgtgtgctgggtctttattgtctggacgcatgcataatgtccatgcacgcatggttgctgttttgttttcggcagaaaaagaggcatgattttgctaaacaatacgattggattggatgtgtattttaattaaataaagggtggcgctcgatccagatctgatactatcgctagctagatctcttgagcgcgcggaaggcgaacatacaaagatcaggatgccaataattgagggacacgcatgcatgattgcaattaattaaaaagaacaggggaaaaaaaggtacgtaatgaataaatccataaatatttgaaggagtacgtacgtacgtgctagaggttataagtgtagcgcgtgctccctggcttcgcaggcaggcgcctgtttcgctcttttgtacttagttagttcaaacggacattacaaggatattcaggaaggggcgaggacgaatttactacagcttagtaaattgaatttactcacgagctggcatggagtgatgcaggtgtgacttttagtgagagtgcaagtggggtgtggtggttccagcaggaactaattaaccagctgcagaatgctagagaaaagtgtccgctgttgcatctggattaagctaagctgctaataataagctaggcgtgatgttagattactactagtttactagctagcgaggctgtccgacggctgatgatgtgtccatgcaaagattccgtcatgcaatgcaatgcggtctgcatgcaggccccacatcgtctaacggcacgcaatgagagaggcgacagatccgataaagaaacgactgtgcattgtctatttgtacagcaaacccatggacagtaagagagagagagagagagagcctcgccggcttgatgatttctcatccaaatgtccatccatctatccatccatccatgatccatccaagttggaggaggtaataattcgtcgcacccaagtacacatggacgcatgtggcattcagaacatttctctctctctctccatttcctttgaaactaggagctggcgtggtccccttcccctccctgacgccgtgagagctccgcgcgtggcgctaaaatgttgcggacactgctcttcgttaaatttcaggcgcctggatcaactgccaagtctgtcccgaaagatgatgtccaaggcaaggtgccaaggtagctactagctagctagggaaaggggtcatcagtacgagtggtccatctctctctctcgagctagagaatggagacctgacacaagtggttccggccggctgggttggcgatagtggccgccgtccagctctctagagcgggagtggcgagtgggacagtcgttacgcgttgggttaggttaggcgcccaagctccgatcctccatgcaccttgcatccaaccacaaaccacgccttattcaggtaaactaaaaacttgacgcacagca

SEQ ID NO: 2095 - DNA, 2162 bp, Zea mays
  misc_feature (1)..(100): optimal_loci_32133_G1, chr1:197389260..197391421, Cluster 12
ggactgcccgtttgaacatgagtacggacgaccccgacgccaaaaggtgactacaaaggcgagtggagcctcgtgcatgcgcgcgggtgaccttggccagctgggcctgagccccaccgtacccactacccagccgtccgtgccattgtgtggcagtagtgccgtaggtcggtcgacgcacggaccacgcacagcacgcgttcgatggtcgagcgcccgtgtagaagctacaaactatagctgcggcgcaccagacgatgaagcagctggacgcgagtcgagtcgagaccacgatctgcttgtgttgtgcacgccagcagagcatgtgttagacgatgggtcgctctccgagctagctcggcaacgcgcatatatagctagctagataggtcgccaccgtgcatggcggcgcgcctttacgctcgctagctcgctgccggtcggtggtggcgtgcgtgcgttgcgtacccgcgcatgtgcatgcgtgtgcgatcgaggacctccgatcgtcggcatctagctaggtcacaagtcgcagccagtcaccgattagatagatccccgcctcccctggcattcatcggcctgccggccggccgtccgcagtccatgcatggcgcggcgcggggatggtcctggtcctgcggtcctgccgcccgcgctgcgctccggcggtgccttgcgcgtgcgcgtctccgccgcatgtgggtttggtggactcgtgtgcacgggcgctcgctcatcgagtagacgagtacgatcggagacgacgtcgagacactgtgcggctcgtgtgctcgacagggacgtgccatccgacgagcacgtacgtctgagattatattggtccggcaggtttccaagttgcatgtatatatgcatgtggacgcgcatgcagtgcaggaaaggaaaacgaaaagggcgcgcccacacacacctactgggctagctagctagccgcgccaataactcttggctggtggatcacagacagacagcgtacgtacgtacgtgtacgtatatgatccacgtattgtgctgtgctgtgcccccacatattgtgctagctagctcacgtattgtgctgtgctgtgcccccacatgatgcacatatatgtgtagcccataatgcttatgtacgagtatatatatgggtatatatatgaactgaagcccctaccgtacgtgtacatgagtgactggtgccacacccggacaatcgcggatcgagaacacacacaaacacacacgcttcgtgtctacagtacgtatacgtatagtacgaccacaggccggccgggtccacagcatgcatgcaggatcctcctcgacctcggcgatcgatcgacgcccggccggggaccaggggcacacagcacagtaagacgcacgttgcatcagttaagccacatgcgcgtgtgcgtgcgaggctggctggccaatgaaatcctccgtgcgcgctctcacctcgcacagatcgagctctaggctagctagctagcgtcagtgcagtacagccagtgtgctgcccgcacaggcacagcctagctcgctctcgtcgctgattggcatcatttgcgagcacgaaaagctagctaacttaaaaaaaccccttttgccctttccaaaaagctcatctgaatatagatcgcgctacacgcagctcatcatcgccccatgcatcagcagggggcctggctagcagttgagtactaccaggccgtagcaaaggggtgcgtgctctgcccattttaagtacgctcagcagctttcctaaaaaaaaaactcgtaagtaagcagcagcagacagttcattcagtcgtccggccgtggccgtccccctggatgcatgcagtgccctgcttgagatgcatgcatgccctgctagctagctgcccatgtgggtgatgccgtatgcccatgcatgcctgcaccgtacattcttccgggccgtccgatgaatgaaattaactattttgcgcccgtttccagtttctctttacagccgtttagtatccgactccgtccgtgcgcaccgcacgattccagcaggaatatttttactgcctttatatactatactatactatttcccgccctatttgcatggcccttggatatcctcaggggactgctactgaattctttaacgtgtactgtat

SEQ ID NO: 2096 - DNA, 1955 bp, Zea mays
  misc_feature (1)..(100): optimal_loci_321645_G1, chr9:141534683..141536637, Cluster 12
cataatctattctttaaatgtaactttacctccaatccgcacactggtatccaaagaatcaagaaacaattttcaaagccctagacgatgaaagtcatcgtaacaatgacatgatgtatatggaaatgcaggaatcgatggactttcgataatatcccaccaatgcagctaagctacgtcgagcccttcgagaaagaaatggtcatggtttggtacagaacgaagaatacgttagcaggccttgttgataatatcacaccagtagcgactatattcgccgaaagtcaaaggtgtcgtgctgcgaatcagctagcgaacgaaatatacttgaggatttcctaaaaaaaaagagggagagagagagagagaattgaggacttcctcatctgttacctcaagccatctttccgtggaaaagcagtatccgtttttttccccccttcgttctgaccattcaaaagctcctttttactgcttcgacggacggatctccagtgctccagttgaaatggacacttccttttgcagattagattcccccgcgcccgaagacgcatgggaaaccatgccgtacagtacgatcgcgttcgttgtggataaaattattattgttccagggctccaggcaccactccagtccagggtgtcatggagacgagacaaaactacagtacgtacagtctccagaccgctgcaggggtcagtacacagttttttttttcttttttgcattccaaagataataaggccagtacatgcacagtactgcttcatttccatgtgatgtgtggtctagttcatcatacctagcttaagtttccatcggaagtgtaccgcagtacttaaacccatcacgcatgatcctttgcgttgattggaagcaccaatcgaaccgaagaaaattggttgcttccattccattcacctaaacgtgtgtgtggtggtcagagctagtgtccacatattcttcaccccaaattaaagcggttactctcattcactgacctaaatcataaaatcaggctcatcacgaatggactagagaccgtgcgagtccacttagctagaacagcacgcactcgtcagctcctctcctctgtgatatagggatatgatactgaaactttgggagcccaaaatacacttgcttcctttcacctcctctcccacttgaagcgctcgacgaccttgcggtgcgtgtgtcgacctgcatgaactgaagtcctcgaagacgaaggctatatgcgcatcagcagtcatcagcacaacgcaacgcgaatatccaggcatccatccaatgggcagcgcgaactcctttagaataacgtaacgcttctcttctagtagtagtaccaccaatcagtggcctccaaatcccaaaagcgaggctcctacttattgttacgtgcccacaacggagctagccaatgccgcaatgcgtcgtctacgcgtagatggtcggagaaagatcgtcgagggcatggcatggcggcgttctcatagtcatatgccggccgtgcccgtggtcaaagcctcagatgtcagacagagaggccttccgtgggctgtcaatgcaagaagctagcatccggccggccggcgagcgagcgcgagattctcaagcaccgggctggctggagctggatcgatgccaatgccatctagaccggccggccgcttttgcccgtgcagtgtgcgtgcccctggctttaccacgcatctgtgcatgtgtccccgagcgaggacgacttgcttcctgttcctgatgcggggccgtgacgtctttttttgtcacccgtctttaatttctaagctctgtacctttagtttgttcctcgccgccggcactagctttgttctcctcgatccaatgatcttcagttttacacatgaccctatcggatgagtgctgttgagcggtcattctcggctaaaaccagctctctttttggacg

SEQ ID NO: 2097 - DNA, 2210 bp, Zea mays
  misc_feature (1)..(100): optimal_loci_321649_G1, chr9:141543794..141546003, Cluster 12
attgttgggtcatgtctaccggatcgggtccgacactattaaataggttgtagctgtcgggatagatcgaacatgactatatatatatactaataatttgataatacaaaaatataatcgtgtcaagctagatcgacaccgtagatcgagaaggaggtctaagcaagacagttattaggtcgggtgcactatcgtattgtctagctttgtattggtttagttcagtattgtataatcatgtttaaataaatatttcatttatgtaatatctgtctatataatatatagaaaccatagtaaggtatgagcaactaaccagtaaaaaataatgtgtgaaatgcccacgttgcaaaggacgcacaaaatatttgacacccgagtgctggtaagtcaacaaagtaaaggcgaaaatatggccctagcaaaaggagggctcccaaccacaattccacaagtagccaatttagatagggtacggccagacccacaatggacttgctaggactagcatctacctctatattaagctacctaggccgaggcccacttgcagattgacaggggaaggaatcattggcggaattctgtgcgcgtacgtgaggggagggggaggcaacggcaggcacccccgtcctggcggagctgagctgcgcctgccggtggtgttttgttcccagcaacaagtcagcgacacgccgacaccgcggcgagctaacgtctcggtgattgccatcgaggaattcgttgccggccatcgaagctagctagtgattccatcccagtggcgcggggtcgggggcatgcagctagcgcggcgttgccctgcccggtccaaaaggcggcgagccggctggatgtggagtagtggacaggacacaggccagcggtgaggtctcgatgcagctccctttgttttgcccgggacgataggcgcctagggccaatatctccggcgaacccatctcgcgtccggcggtagatggcagcgttaagctggcactgggcaggtcaaaaaggcccacgagggttgcttgcttgcttgctgatttcgcaagtcagctcagtggtaggagcagagcattagcccgtttaggatggacctatagcctaggaggagaccagctatacctccactcaccccatctccacgaaggatcaaccggcacaacacaaggatatttatatatttacagtgaaaatcttggaaaagggcaagacggggggggggggggggggggggggtgctggtagtgccttgcctccaattccattgcgtggtcgtggctcgtgcgtgcagggggagagaaaaaggtaatttgatgctagagatggtacgtacgtactagtgttccaaagcaaaatatactccttgaagtaaaattgcgagacttgggccggactcattattattgggcgtagtatgaatcttttatggccctcgactaacgactcgagcagttctgggcctaaagaactcacttccttatcaggttttgtttggatactctattattcactctaattcatctctatggattagagtgaatccaaacaaatgtcgcctctaagtccacgaatcagagtttctgttccgtagaccaagcatttgtattttttagtactatgtaccaactgctactggtgcacaatgggatggttttatggttgaaaatggaccgtatcgtaatgcctggcagttgcaaatcgcattaacataatcttttcttttcctattttctaacaaaagaggaaagagcacggtttgcggtcctgtttggaacatagagttttttccctgttacgataaaaatcctgcgaaatctttgcgtcccacacggccacacatgcctacatatgcagtcaatcagtcggccatctctagtacatgtctgaatcaacgagtccagccggtcatgacaagaggaatgccatcggcgacttgtttttacgccctcgcttccagtttccaaacagagcagacggaatttaacttcatgctgcatctgcagtgcctactgcctagtcactaaccccgaccatcgtccaaaccatcaccaaccgtgagaaacaaaccgttgatgacgtggttggcacttggacttggcaggcaggacacgattttcacgagactgccagagatatggctctacattctatcgcactgaagaattgccggcttctgtcatattttgttgagtcaaacgcagcaa

SEQ ID NO: 2098 - DNA, 2485 bp, Zea mays
  misc_feature (1)..(100): optimal_loci_321831_G1, chr9:142647802..142650286, Cluster 12
ggcgtttcaagtactactactagctagcatgatcgacctgcagatctatatcgttttgacaaatgccgtccttttccgcacatgcccttttgattccgcttgcgcgattttctcccgtccccggcccgcagaatcctctcagggttagttctacaaggtcgcgacttttttgttttttggatcgtgatgggagaacatcacacgtgaccgttcttgcaaagttacagtacagtagtagtacacgcatcgtccgttttcgacgccgatcgtcagttttcgtcacggtctgtcttgtacactacctgtacgtacagatcatcagggcgaacacagaggatccttttttttttttgttgattctcattcgtttaatttccttggccgacgatagattacctagtgccgcacctggcgttattcaagcagtttcgcttggctttaatccgaatctaaccgccagatttttattatcccaaataaatgcaacacataccacagtacggtacgggctagggaaagaatgtgacccgtgcgtgcgtgcgtacatcactgtggctgctaggctaggctactggatcacgttgtcgagaccaccctatatatactacgtaatccattcgcaacttgcggatcgggaccacatggccacgtacaggcggcacacacgagaaaacgaccggtgtcccgccccacggcacgtcgtcggcaccgtgaaacgcgccccattggatggcgcccgccggccagcagatctgtgcgtcgttgcgtgcgacggcaacacggccctaccggctgcggtccgacgcgaacactcgcgcggcggcggcggcggcggcactggcaccaggcgctccgttggtcacaacacacacaggtcacgtctcgccggcccaatggaacgccggtgctttgctgtcgaaacgcgacgcgctcgatcggcttggtcctcgccctgtcctcctccgtgaacaggacaacaattctgtgtgtattgttgtgcggggcgccacccgattggccgttgcggcgacgtggctagggtcgggcggcaggcatgtgccgagcgccagcggcggtcgagccatgtgacggcggtcgggaccggggagccgggagagtgtgacggatcgcgtcgttccgtggattaatttgacaccgagagcgtcgccgtgactcgctcccgcaagactcgtttccccgcatcatcatctcatctggatgcggcaggatcgagcgaaagcgacagtgcccggtactgatgcgcggcgctggctgggttactaatgattctctgaggtgagcgcgaacatgatcctcctcatcctccacaatcttggaagacagcgatacccttgcccttccgttctttgtttattactaacaagattgttcgtaaggtaaggtaccttacgttgcggtttagcacgaggccgggccgtgcttattactttcggttgcgtcggtgatgccggccagctggacgagcaaaaccgcttttgtttactttacccggcccgccctcgtggtcagagaatccaggtcgatcgctgtgtgcacctactactatactcgtcagtcacaccaggcgaaagttggtggctgttcgttcaccaaccggtcgtctcctccgtccctgtcgcttgcggcagcggcggcggcggtctcgttctcgtgcatggcctggttctcgtgctcgctccgtcgctcgcatgcgttctggcactgtttgcttgagggggctgcttggttaggcgtcttcctgcatgcgcaaaaactactactactacgcagttctttgcttctgcgattcgggtgtgggtaatagattcagggggaaagtgaaattttgtcgaacaagttcttcggcggttagattcgcattgattacgcacgacacgaatccgataggttagcggccgctggtggagcaacagtgacaacagtatattcttatcactgtagtaagctgctcaaaattgtctactgaatagctatgcctctacaacccacacgtaacatgtcaaatgacaacaacaacaacgggatcaattttattgctatcatttaggatacatttgatttgataagagacctacattctcgtacaattgtttcagttccacttcctttcagaaaacgttttaggtgctggataaaaatcacttcatgaaaacgtttagtttgtttcactggattctgtacccccaaataagtgttttttcctgacaaaaaatatacaaatttcaaaaaatatatatatttgtggacaaataacaacctaaatgaaactcattttaacatgttgcactaaaaaggataattaggggggaaaaacaaatcaccgttgcataggataaaccaaaatcagaactacgcaaaactactttggaggtgattcttgtctatagtaaaaagaaaagaaatattggaaatgtttctacctaaatcagtactccctcggtcctcatatataatttgtttgcct

SEQ ID NO: 2099 - DNA, 1571 bp, Zea mays
  misc_feature (1)..(100): optimal_loci_322305_G1, chr9:145060052..145061622, Cluster 12
gcacttgctcagtcaacgcatgacacggagtctgaacgcgtacatctggacaaccaaacacacggtgattgaattcagatgagcaggcccggcagccatgccccatgggtgacaactcgcatcaaccaacgacgaaacgaggttgacgacagtaggaggagcccaggaaatgattcggcggctctccctggacacggaagtccacgggcacgggagtgcatgaatctgttggaagttggagttctaaaattttaatacgtaaccgtcactaaaacgtagtataaaacggtctcaccctctgcatagccgctaacctgctgcctgctggcgccctcgcccgacgagccgtcgacggaccgatcgatcgatcggcctgccgcagtgccgctgccgctgtactgtgcactgtgatctggcgcgcgccgggcgtctgtatgcagctgagctggcccctcggcccgtggaagcacgaggctcaagcactacgcaaatgatacacgcgcgaaagagggtcaaaaatttcgaaacaccatctctttttatttcttctccaggcagtccacagagattttgctctgaacactccagcattgattgcacatggagcatccgccgttagtgacgcagcagcaggagccggtgcaggggggtgtggggacgagagggtgagacagatcacgcaacagctaacacgtcctcaagtggctcgcgcagtatgtactgtatcatgtactagcatatactcggatcgagatcgataccatcctgccggccctccaaattcctaattccaccgagacgcgattgaccaaacactttgttgtttcagttcgtcgacgacgtcagagccaccggggctccgctatacagtgtagtgcgtgtgctctgcaagtgtaaaggcacgcgtccagattgtttgtacacgcgctcctgcctcggcacaccgagagtccggcaccccccacgaacgcgccagcccgatcggcgcgcgtacgctcgtggtcctgctccagcggtgccagtctccatccatcgacagtgtgtgcactcacctccctgctcccagtcccacatggttgggcttggccgcttgggcggccgcccggcccctcatctccagtgcttgctttgcgttgcttcacccgcgcacgtcctagctggccgcgtacgcgtacgtgtgcgcgagaaaagggacagcttgtacgtgcgcgcgagaggccgcaaggcggcaagggggacacggagacgtcgcgtcgtggattttggacgcgaccgcgaccgcgaccgcgacggcgacggcgactgcttcgttcgttcgtcgttcgatcccaccaaggtcaacgtgaccatcaccattcactcaccaccagctccggagatagggctagtactgtactacaccggtggcgctactgctagtcatcaccactagctagatagctagccggtccgcctagaggctagttaggctacagctgcgccagtgatgactgatgagacagcagcgcctccggcctctataatgcgaccggctcctctaccttaacgttcagtcaccgccagacaaggct

SEQ ID NO: 2100 - DNA, 2032 bp, Zea mays
  misc_feature (1)..(100): optimal_loci_32717_G1, chr1:200631155..200633186, Cluster 12
gggcttaggatttacaagtaagaagcagcattctgcgacagacggacgacgatgatgccggcgttgcattgcgatcctcccgcgcgccatcgagttctctgcgcgcgtgtcggtgaaagatacacagtgggggcggggggcagaagcgagactgcgagagagagagagagagaaaaaaaagaggcttcgagtccactgcacgtgcgcgactagtagttgtcggttggtcattcggtaaacttggcgcggcagatcgtgcgtagccatggcatggcaaatggcaatggcatgaacgtggacagacagcccagacaaaggtcccgaagtccacgaaccggtactacttcagctattttgaatattctttctcttctcccaccacacggagcagtattcgacactctctctctacaaaaaaaaaaccataccgtcaaaaggcatactttttgttagcttgtggcgtggtttaggtcccaacttgtccacctggtaaaagtatccagcagaatatttggccagacagacacctcacgctgttgtcttgtgtgtcttcttctatagcgcaccaccgatttcccccccccccccccccccacctttttcccctgtcagtgtcgtactcgtctggcgtatcgtctaagctcttcgattcgcaaccgatccggcgctctccgacttttagattagatgcatccgacgacgaccacaagaacccccgtagggtcccaccccgtttccgtaaagtggagctgctagtcaaatatttccgattccctgacgaagcctggttataattgacaaaatactaaaaatactttcgtaaaaaaatagagatagacatgtattacgaaaaaagaaaagaatgtttgggaagaagaagaagaagaacaaaaaaggtgcatcgcgaagtaacacaaccttaatgcaacctgtcctcgtggtaagctgaaaaactgggccggccaactgggccaagcctaataggccgacagagtgtttactcatagaatctgtccgagtgacaattgccagctgaaaaacacacaagtgggccggccaagtacagcatgccgacgagtgttacccatgaaacatgtcctcgttggtgcgaagccgagaaacacgtgtcaagtccaataggccggcatgagtaccgcccaattcagcccaccggatgatcctattcctatccctacgagtgtcgtctgtcaactaaaggtttcttggatcttggttcacttcaaccctgaacctgaagagagaacttccgtgttcagtgttctcatggaactttctgacccatctgcagtgcagtcctttttcttgtggcttgcttcacttttcacccatgttcctgctcaagatatattactaaaacatgtcagttcttttttgtgtgtgtgtgtgtgtgaaaaagagaaccggtggtgtggacttcttgtttttcttaaaccctgtggctgtacacgttgcaggctaagcctgttgtgcaggcaacaatggcattgtttgcactgtatcgcttttggttggatcaatgcaacttcacggtaaagattgcatgctaagaagctaggtggaatgcacaaatggggaactttatcaggtgattagcgtgttaacatgcccgttgcccactaacgtcctgcacaaagcatcagaaagcagcagctctgagtgaacctggataataggcaaagcacctgtactgtattgtacgcctgagaacttgaggaagtggtgaagacagctgaagggggattcagaagtaccaggcatctgaattttttttttctctacaagccggctaaggtcccccggctagggagggtggccacgatagcatgttactctatccgttattttttatttatctgacaaatattggagaacaaaggtaaccgtttgattattgatccattaccacgtgcatccatggtgtatccgtgggtcgtagaccggtggaaatatgttcctcaactcctgaccccagcatgtatctttagccattgactacatagtgtaagataaa

SEQ ID NO: 2101 - DNA, 1552 bp, Zea mays
  misc_feature (1)..(100): optimal_loci_33549_G1, chr1:205370920..205372471, Cluster 12
gacaggttggataacccagtcagtcacaagaccatggtcccctgtgtcctaggagggcgaaccgccaccctaggaaaggctgaggaagaccaagagggataaggggaatgggtaggaccttgcaaaaagggaagaacgcccataccatcgccttggatgaccaaccctaaggaatccgccccggtccatagatgtgaagcaactagtggagggagggcaagggccgctgaggaagcccacgaggcataagagccaacatgattgcccacctgttagggtgttctctttaaaaggcgacgcccaaaggaacttatggaaacaaacctatgaccctgaaaacgggagcagatcagtggagaaaaggccttgaggccccatgacatggtcgcatggagtcaaagggcagcacaagcaaaaggaaaatagaaaccattcttatatcctccctcaggaaacgacattaggacgtaatacactagggggacatcgagcgctacgaacgatatcgtctttagacaacctatctacaacatgattggtcgccttctcgtagtcctccagtacatcctctagctcctcttccgatagagatgaaggaaggccaacgatgtcacgaagaccacatccggaccaaagctcctcgatgaacaccaaagtcaatgatatctcggacacgacacgagatgttgtccaagcgcttactaaggaggagccatgagccccgacgtacttctcaactttccccaaacagtggcacattttctccaattcgtcttctagaactaaaaggaaaagggagggaggtaagaaaggagttaaaacagccaataaggaacgatgaacgagcgacctaccagctacacggatgttagactcggcaagctaggcccggagcagtccagcctcagcctcggccgcctttagcgccgcgcgaaaagcctcatggctctcccgggactcctaggggagagggataggctccaatgggcccgaccacaacgaccggacagaaggtgatgcctcccacccgaatgtttcaggggtcgtcctgcgacaagaaaggcaggcgtcagaatcacccacagaaggggaaaggaagtgctcggaggaggaggaatcatacccagacccgatccagcacggcttcctcctgacccgagatctatcaactgacccgttggcggaacccaacttgggtgtgagttaaaaaacgaatactatgggacgactacaagcaggcgctcacccgagcttataaagggggacataacatctggttccccctccccgaacaagggaggactgcgttagggatgttccacctccctaaggtgtgaatattgttactaaacagatatgcacaacccaaatatcgaggcgaacaatgcccaacccgggggaagccaccaaggggagatactcttcgctcaggggctcgggggctactatctaggaaaatatccctggcccctggggcccacaagtcagcgggaggatgagggaagagtctgccttggaaggacccacccccggatagtctcaaggcaccgag

SEQ ID NO: 2102 - DNA, 1663 bp, Zea mays
  misc_feature (1)..(100): optimal_loci_347614_G1, chr10:136009176..136010838, Cluster 12
ttcaagtggtccgaagagacggaaaactgaggcgtgctcctagacgcgagctcaggtttggccgacggccggcctcccctccccctacaacgaccaaacgccgaagcaaagtgcacctcccaaccatgacgtgtgcgtgtgtgttttgatataataaaacaaggaagaaccatggtctgtgacataacctgcaggcagcagaaaaggatagcagaaaagattaaacgagtaatccttggtatacaaggcccccctaaggccctaacagaagactgttatatcatcaaaagagtgcgtacgttaagcaacggcgcttcttggttaggaacgctttaccttttgtgctttccactactttgtgctgctgtgatgcgaatctaacccactgcttttatctcctagctagtttttgcttgcaagtaaaacaaggcaacaaaaaccgtaacaccaagacacgaaagtgagaaatgtggggtcattcagcgtccaaagaaaagaaaagaaaagaaaagaaaagaaaaggagagtggggtcatttaggctcggatccatgcactgagtggaaccagaaccgaactggacgctaatccatgggggaataatgacacatcaaggcctcgggaccacgggttcacccgttaccgtccgtacacgatggggcccggccggccagctctcgacgtcccgtcgcatataacggctgtggcagctgcccgccgccgcatcgtcacgatcccaggcaccgatgtgaattgatggacacgtctgcctggctgcgattcgacctcgaacgcctagcagtgcaacagcagcggctctaaaccgtggcgctcccatgcccacatcacatccgacccacgggtggtacaagaacccattgttgccagtcgatttcgcaaccaaagcgataaaaacgataacgactgggcaaaagcttgtgttatcttgggacgtggctagtttcagagaaagggtgcgccgcgttgatctctgcttgatgggaaggggaatcagacgcaacaggcttgggtctcaactctcaactctcaatctctcatccaccatctcgcggtcgcagctccactgctattgtggcgtgaaaatggaatctactgctctgttgcccatgtttcaagagtgtggtcaaaaaagttttgcctgtcttgttatattacttgtacttgggtttttttttatagaataaccagctccttgttatttatcttttgagggaacaatatgttttttttttttgttagcaaggccgtggtttctttgaggccgttagttatttgggccgagtgtgtatgtatggaccaaccgagggacaatgcgggcggcttcacaccacggtttgtggctcacgaaagcagctcggctgcaaacggactcgaggagatgaaatccatcagaaaacaattgaagcccatcgtgtagcagctgggctccaaactggctgcactcaagtatcaacgcaaggcgacttattatcgacaggcgtgaggcctcatgggccgcgtcatctctgtggtcgaaggttccgcaatgacgtgatcacgtgagctaaacataaagctgatctcatgggacgctttggtctaatggacgagaccgtacaccgagcgagaaaaaaaaggtctaggcactaaactattatcagaga

SEQ ID NO: 2103 - DNA, 2262 bp, Zea mays
  misc_feature (1)..(100): optimal_loci_349349_G1, chr10:144931456..144933717, Cluster 12
gggaattgaaagttgattccggttggaaataaataatccaaatagtccacatggtgtacacattaaattgtgctcaagataaaggccgcctgcatcaacttatccatgttattttctattttaaactctactctgtaaatgatacaatccacaacgcaaaacaacgtgatcatataaatgatccgctcgagacagcctaacaataggtttcgtagggagaaatctttgagcacgtcaagataacagtcgaagggatgtttttcccccttgagtgctgacaatatggatgtaaaaaaatatctagattttttcttatagaagaagatgcagtaaccaaaagcagtagctgttgtgagctgcaaccaaaccgaggagcaagtcggtagacgataagcgcccctggtgtttcagcagcatgttgcccgtcctagcagaatgtagattgcagaaatgattggagaagccagcacagcatcagatgattcaaaaaaaaagtattacaacaactctctcatccatccatggtgtacacagtatctttctgggcgctttcagtttcagtgccccgcatgttggcgatctgttcgtgagcacgctttacagggaggaacagacacgctagctgctaaagccggcttgctttccttccctttctttctttctttctttcaagctcaccaccggaaccggcgccgatgacaatggcgatgaagagagtatagtagtaaaaaaaaaaaaaggctgtgggctgtggctggcgctcccgtgttgtgcgtcctggacgacacccgacaccctgtctgctgccaccaaaagcagccgatgcgatagttgtcgtgccggcgcggcacaccaattcctttccgaaaaggactcgggcatctggctggcgtgcctctgccccgtgggccctgcgagtgcgattcctctccgaaatgaacatcctcctcgtcgtctgcctggctgccttgcaggagatgatacttctcggaacccactacccacccggtcgatcgatctctcgtcgtgcgcatctgcttggaaggtagcagcagcaaagcacacgacactatactcctactcctactactcgtacaatcagtgcagcgcaacaggagattattcttgattggaatgcgaaaaaggaggttcgtttcggggatgagctagtacggaatgcatggccgcatgatgcacatgagagcgctagctggttttgttgggtaactaccagtcctgccacaagtggcagaatgctttaggccatatttctattcgtccatccagggtaccaccgcgtgcgcacgccctcttcatcacaacgagactcgctagaggcacaaggatggagaggacgaatggccagccttgcttagcattacagtatgtgtgtgtagctagctttaaggtaagcaccccgtgcatgattagggtttgtgggaggcatgatccttccttccttccttccttcccgccgccggaatagagtacttacagtacgcgcccctgtgcttcgtggctgttcctggtcccctgcgattacgaggattaagctggaatggaatggatgccatctccctcccgccccacccacgccttccaggcaaggcaacgtcccaaccactgctcgtcgcacactcgcatatgcttggcgggcagaaaaggtaccatgcacaccgctctagctatagctaattaatcgcctgatagcatgctaggcatcgcagttaaacactatccatacatttgcatgcatgctggactgcggattgagaaagatatacatcggggattcgacagcttttgcacggtaaccacgaagtctctggttgcctgccggtcactgtgccagagactgttcggatgaggcagatgcgttgcgtgcgtccaatctgctagggcgagagctcagctgcccggatgctcgcctggcgattgttgtgctctgttctactgttcctgttccgtgctcgcgagagccagagcctgcctgcctgcctgccggtgtgcacggtgctcgctgtgctgtgcgagtggacgtgtgcccaggagggcaggaggctgcacaagtggattgattgatgccgcgccccccgtttgttcgacgcaacgcaacggcatgttgatccttgtccgggctcgccgtcctcggatccactcacgaccgccgatcaggtagcgccggaacggaatcctgtgacggtgtgacccatgcatgaattgcagcgagtgctgtgctggtttggaatcgttcccacgtgt

SEQ ID NO: 2104 - DNA, 2870 bp, Zea mays
  misc_feature (1)..(100): optimal_loci_349407_G1, chr10:145261230..145264099, Cluster 12
attagatttggtgtagctctggccctgtttactcgctttcaaaaaaaaacagaggttttatacttttaaaaaacaaaacgtctacacgcaagaagcccataggccatatagcccagacgtgtaatgagccatcgggaagcagacgtgggcacgtagcccatgggccatggctcgtgcgtggatgctggagcctggaggcaagcaacggccgagtcgggccgcaacggaagcgccggcagcgacagtctgcagtctgcgggcgccgccttgagtgtgcacgctagcctgcaatcactgcatgaccttcccgcttcgactggcatgctactagcagaccgggctcgtgatgcaactttaacgtcggcccaataagcggctttcgggagcagagcagagcagcggcacggggccgtggaccgggggagcaagctgcagctcgaaccgcccgccgtccgcagactgttactgttacatcgtcggtcaccgtctggactgtacgggacggcacgggtccgccgcgaatccactccacggcagtggctgagtgcgacggggttggtggccagagcagcagagcgaggctgctggtccaaaggggcctgcaggtgctgtgacatgctcggtgggcgcgtggccgaaagctgaacggctgggtcgtcgaacgacccgcggtggtcagttgcagcagtaattgctcagttgacccgttgtgtatgcatgcatgcatatgcgtgggatcacgcaccgcggaaatgagcgggcccacccacagccacaggtaaagcgagattcccgtgacaggcgctttcagattagtagattacagtgtgcttgccatcgcctgcattgcttggtccaaaaggctcacgggaggggcggagggagcagcaacataccaaatttttttttaaaaaaaaaacataccaattttgtatgaagtcatgtgaacacaaactttgtaccaaagtttttctttgaaaaaacataccaacttaataatgcctaaccattattcacgctaaacagtcgcttagtagggtgaaacgattattttaatgggatgaacggttgattaaaagaacccgggtgtagtaccgtgtaccgccgtgtgcaaacggtgtgttaaatagactaaaactaaacgatgttttagacaaacagtgagtataagaaatatcagtatcttttaatatataaatctgattaactttttaccctgctgctccatgcgccggcagaggcgctgtgttacagtgtgtgaagttctctcttttgacaagggttgggtacggttcgaagtttgaaactggggtcggtgggtcccagcagtcaggcactcaggctacttgtgtaataactgctgacacatgacttttgcagacaatgctacagtgctactaaaatagtctactccgtagaagaaattgccatgcggctcgggagtcgggagtcaatgggtgaaccagaaactgtccaacggcgagacgccaaaatgcacgccctacactgtcctgtccgtccgtccacgcctcacacggtacgcagcttttacgcaggcagcgcgcgtccatgtctgatgcagagcctgacgtctcctctcgccggccttcctgtgtcactatttgtatgagcggagggagaagtagccggctacctcgacggaaaaccccagcaggatttctggatgatgcttggtggatgaaaggcaaggcacgtaaagccatgcatcatgcaccacctaaagtcttagcagtacgaagcagacgagacgaccggtaagccaaagcagaagaagaagataagcatgcgtgccctgttttatacacttgttgtgttgatgctgagaggattcttgcctttcaatggtattggtggcacaccaacacaacactgcgctcttgcatcgcattctagccagccagtgcccgctcgcctactgctctcaccttctttacgttcccgctagggaagggaatggcagatgggcgcagcagcagcagcccatagctagcgcgtatccaccagctagcaatttttcttttgaaagaaaaaaaaacaatcttttttaccaggcaggttacagcgtgcatctgtcagaatatgttggctcgttgagacggattaataataagagagtgagtttgttgtcgacgtgtgtgtgtgtgtgtgtggggccaaatcacagtggacgcaggaggaatgatccggtgcatatgcttttacagtaatcactagccagcaccaacaacaattatagagacaaatccaaaccctcagccagctctctgaagaactggtcaaaaggtaattaatatgcacaggcagcacactagcacagcacagagcggcagaggataacacagtggtggagggcgctactacacactattctggataatatgggagagcaggaaaccctttcgtctgaacttactgaaacaagaaaatcaagaagaaaaaaaaggcatccattcagtgattggtgagcgagcagagcaggtgacgatcgaggtgaggtgaaagaaaaaagctggcaccgcatttaggcgaggttctttacgtaatttagcccaaagtggcaacaacggggaaaaaaggtaaagaccatggcggatcgccggcgcatccttccaccggccgtatattcgccccggcccccggggtggagggaggacggacggacgaggagcacgagtcccggtcagaaaagcagcgaagcacgcgccagatcgacagcgcagcgcagcgcaggcatccgcatcaacgggagcggagtaggcctcgggctcgggacgttttacccgaaaaccgcgcgaaaaaaacagcctctttgcttcatgagcggcgtggctgacgagcagcgtctttcc

SEQ ID NO: 2105 - DNA, 2531 bp, Zea mays
  misc_feature (1)..(100): optimal_loci_349408_G1, chr10:145283276..145285806, Cluster 12
gtggtttcgccgtttgaaacttttggtttggattgaagctacgcagtccgcagccaagactacttttttttttatgctgcgtggtttttttaagtaaataacgtggtcgcagcatgacgacgctcctgataattgccttgccgccatgctgtgcttttttaggtgggcagggcagataggtgccgccaccgacccgggcgcgccgctcgcgtgcataatttgctgcggggggaatagctggcccggctttcctcctctcctgcccgcgactccaaacccaaaaaatcatgcaaatctaaagccgagagctgtcggtttcctacgagagacctgctgctctgctctcgagacgccagggcatcgccagtagtacccaatcatcagcgccagcaagcaagcaagcaagcgcgcggctcgtcgtcgtcggcggcaggtcgtacgtacaccgggcagtggggttttggatccagcggcggcagggcagcacgggggacggacaaacacgacgtgtcgctggggcgcggtcggccggcggggccttcacctcgccctacctggaccacatgcacgaggctcgagctcgataggtggacaataacgttgtagtcctatagtacgagcggtgtatgtagctgtaggctagctagcggctagggcgccggtagtggtgcctcaacgtcgatcgcgcccccgagctatagcctgtgtggtgcggcggtgccggccagtgcaaataggattgtccaactcatcttcttcttccttgctcgtttcatctctccttcgcactcggcgatgccggccactactgtagtcgccacgtcctagctaatgttcctcaagacatcaacgcgcctagctagctagctaattccctatttttctgtcccacgcagagtttttttttacttggcacaacagtggcatctggcacgtatgggcagcatgtcaacgatattgatttcatcgcagtcaacagtaccacccactgtgcagccgtgcaggacaaagaaacgtcactgtatccgcagacgaaagtagtacgggccggtagtacttctctgttggagattacacgagtggacagggaaagagaaaaaaaaaaccccgtcactctgatcaactggtacggcgcaggtcagcagcgatggtgtagtggatggtggatgccgggattggaggtggtcatcggctcaccgggtgctttggccgtcgtttgttaggttcagccggcggaggaggagagcgagacaaacagggcacgggcacatgtccaggcgccgtacgtttggtgcacgtaccgatttggccaaccccccacaaccaaccgccgttgcgttgcgtccatcggcctcgctcgcaccggcaccgccgacatgaggtgggcgggcgggcggctccaggtccaggtggcgtcgtcggggtgatgcgcgccgacgtggagacgtggccccttccttcttctacgcaaaatcccccacccacccacccacccccatccatccacacctcctcttcctaatccggacgcgggacgtcaatttgcttgccagcagcgacggcatcggccgcccgccttgtatctaatctaaccccgtaatcattcacgctaacgacgcccgtggcggggttagcgtaggcagcggcccggctggctgtggctgtctctgtctgcttggaagttggaccacggtgcggcgcgtaggggcccggccagctggtgctgtcgtctgcccgctcgcgtggtcgcgtttatttctcggtcggcgcgggcaagcgctcctctaccgggtccggatccggacggtagctagagggcgcagttgctgcaggtcggtggccgagggcgggcgagtcgtatacgtcgcggagagctggatcggagttgggtgtgcaggtaggtaggtgtgcgcccgccccagcagacttcagatatctgggatgacgtggggagttctgttgggtccgtccggcccgccgtacgtagtacgccagctcgctgcttgtctgtactagagtgaccagccgagctcgcgacgggtactggatgccggtccgtaccgtaccggtggtaaacagcgcatgcagtgcatttcagctagctagatccagtactagtagttttaactatatattcgtcgtaccagatcagaggcatagctggtccccgcctccccggacaggtaaactgcttccatctgtttccatcggaggcggccctggcgtggcagtggcactggcactggctctggctgcctcgccatgcaacgcaacgattatacgtgtgcgcgtcgagctgcatattctagttgtaccggcaggcagttcaagtgtcgaacgatctcagacaccaaaccgagatccaagtgacggcgaacggagctgcccccgcctgcccagcccagacggcctgcatagctgccgccaggcccaggcgcgaccggccgcagcgcgccgacaaggaaccatgctggctgactagctcgatcgagcggagcatgcggaccataaatggccaaatagactgtgcc

SEQ ID NO: 2106 - DNA, 1492 bp, Zea mays
  misc_feature (1)..(100): optimal_loci_349573_G1, chr10:146175970..146177461, Cluster 12
aagaggtgcgtgtgtgtgtgtgtgtacgcgttgcattgatgattcgccagcgatgatgcatggcggcgtctctcttagggttagggaccgtggcatgttaccgtaacatgtcccgggctgtattgatcaggccaggcagaggagagctagggcatgcagcaggacgatgcatggtctgccgtgccggccgtccttcttctccattcgatcggttccttccaggcgatggatgggatggacgtatacatatcgatcattatcagtcacaagttcagaaccatgatacgtacatcctcttgcaggaaaactagcatatggtgatactgacacggcatgcatgatgacggccgatcgagttcagaatccctaatccgctgacattgcttgtgccctgctcatggcccgaagcactgcatgatacggttgaataataatcacgggtcgcaaatggcaagaaactgaccgttacgacgaaggggatcggatcattgttaataccgataggttgacttgagaagcggccggcgccggtcagccaccgccacgctgacagtccgctacaacaggtctggcagctgtggtaataatgtcgcgcgtgatgatatcggcaggagtaatttttttttcgagtaattattattggatcagttacgtaggcggagcgtgactctgactctcgtctgggcatgcatagagaagaagaatcggttggaataattaggggtcgtttgaacgtaacgacgaccctccctaattcacgtgccgccctaccgccaccatgctgcttcacgttgtctctccatttagcagtatatatactagtactatataagcattcttgaattccgggaaggaatcgatttggctagaaaccaccgctgctgatgaacccatcattctttaacactttctcctgctcgagagagcgacggtgtgacgactagttcatgttccaggaaagtgtcgtccggccggtctaccaaaacctactttctatattttacggaaagcgacgatcgtgaaacatgttgacgacaattattagccgccgggatggatcaacgacgggcctgtcgtcgttactgagcatgcctagtgccgagagactccatccaatatgagactagtgcctgcatatgcatgatgcgcacaacgttacaagagggaatggaatctaatgggcgatatgaaatatggttttgtcacgagggtgattacagaaataataatagtaatggtgggtgtctgacttgtggtcagcaaaacaacaacaacaaaaaaagttacgctgcctccctcgaggccagccagtccaaggggccgggaaacaaaaaaaaaaaggtcaggagatgatacgaaggcctgggctgggtgagacgaaagagatcgcaggatttggacagggttcaaccgcttccccgcccgccagaattgaccggccgcccgagagccgtacgtacgtctccgagagccttttttttttcctctgcat

SEQ ID NO: 2107 - DNA, 1770 bp, Zea mays
  misc_feature (1)..(100): optimal_loci_349709_G1, chr10:147003876..147005645, Cluster 12
aggatcccaacaacaaaccctaacctaaacgctctctcccgtcaagctagcagtgacccggtggccggtgcagtgcaggagatgcgccgtccctgtgacccccagtctctgttacgtgcttctgaaacaagcaagcaacccaccgctaggccatggcttttgttatccacttgagatacgcatacgctttggtgagcgctctcttcaattccttttgcttttcttgtgctaaacaagtgctgaagaacgagaaccccacatagtcagagaaccgtaaccatttgtttatctggcagtttcctgcatgcgttagctggcctaaactaaaccccacgagcgttcagatccttaataaaccaacttcaacaacctgacaagagagctttttttcagcatgtataattcaccgcgtctctctctagtctctgcccaggccttgcaggctcactcactgtcctgcactgcaagtgcaagctctctgcgattccaagcatcgtcgtttgcataggaatttattagtgtttttttttcgatttttcgtatgcctggttccaggagcccaggaccagacgctttgaccgctgttagcgaggagattaggaggatactcctaataataaacgtttttttgtagtagtagcaccttttttcttttggcctagttaattgccatggttatcagagcttccgaggagagagacctgagagaagggtgcaccactgcacgtggcggcaacgtgcatcggcgttggcgagcaggtggtggccggcgacgtgtgcccatgtccatgtccatgtgcgaaaggctggcgcgtgcctgctggatggtggtgtcgcgggcccactcgcagcgcgggtcctctctcgctgaggtgttgaatccatcttctgttgttctgttttttgttttttgtttttttttttaaaaaaactaaggttcattgaaaccatattgaggtaagcaggagagcgccgtcaaaaagacagagagaggagctgccgcctgcgtgcctctcacgaaagctcccaagcctccagcgatcttccacggccggcccagcaacggcaacggcaacggcaacggcaacggctggaggtgcgtgcgggcgcgcgttttccccggtcggatcggcggcaaggtcacgtgaactcgcccagtagccgcagcagcaggggcggaggcggagcgggaccgaccaaccagcccgcccatgccttgcggaacgcatgttctcgtgctcgccccacggtctcctcgtgtcctgccgctgccggagacggctttcttttcgggggtgcgcgttctccgtctccccagtggtttggcttgggtgcgcacgaacgagatgtccacgtcgatcacggtggctgctcggcggtgatggctctctccttcggtcgtggaggcggctcggttcggttacgatggccagctccctcgttcggtctctgccctctcatgcagtcatgctccactatttatgtttgctacagggataaagacacacacatctgacactgttcgtagacgtttcctaacaaaaaatacagaggtttaaacggataaacacacatggaaaaatagctaagccgtctgttctaatctacacgtggaccgttcgcgtctagaggcggaccgtccaacctctttaggtggcacaaacaatatgctacttcgttaatcagccacacatatttcatttggttggtgcacttattcacgatagaccattgcattgcccaacaacaatatcaactgagatcatttag

SEQ ID NO: 2108 - DNA, 1796 bp, Zea mays
  misc_feature (1)..(100): optimal_loci_37229_G1, chr1:224249059..224250854, Cluster 12
cgagaagcccatgatgatcttgcgcatgattacgctcggcatgaagagccctagctagaggtctagataattaaccaagtcaagtccattaattattagtgcggcgatcatacgatggtacatatatacgtacgtacgaattcttgttttcaaagcgaacgaagctagcaacgtcgattcggcacggccggcctcgtacgtccacccaccgcacagggacaacgccgcagccggagggcaaagtggaaaaccttttggacaccttttgccgcttggttgggcggacgaagatgaagcgtggtgtggtcgtattttctttctcgtccatagacccagtggagctggagactgactgagccacggcaccgcaccaacgcatcgtcgaaccgaatccattatccatgcagctctcccggcaaatggcaaccgtgcacggccaatccacggactgccacttgacatgcatgctgctgcagctcgatctgccgctgagtcgtcgtctggttcggccgtttgggctgggtccccggacctttttttttagggcaccatctgacggtgtagggttcttctgttctcggcagaacgcaacaacgcacgagctcacaatctcactgagatcgctgggtctatattctatacgcgagtattatacgttatatatactggcgcagcgtggagttgagcattactttaaattatatatatgcgggcgagatgcgtcgcgcatgcatctagatgcatgcatgggcgcggcaggaggtcaaagacgcgagcggtggttggtgaactagaagatgcattctcttggtcgtcggttgagatctctgcaaagcaagtatacggaagccagtttgctacctactatctatatctatctatgaattctctgtctcctgcaatactagtccattgcgcgcgcgcacacatatacaattttttttcctatctaaaacagcaatgtgggatgacagttcagtcaaaatcggcaattggtcttcagagctggccggttttatatagttagttaggaacaggcagccgatctagcaagcagagcagctgcggccatctcatctcctctgcgcgacacacacacacacaccgatgcgaagcgtagaacggcgtcacgtactggaacaactggaaggcattggcaccacggaagggaagacttgcaagagacgctagcactactgcagcgaggagaggaccaccgccacgccacgccacgcctgtctctgaagacggtttcgagcaaatgatcgatcaatgcgcggaacgaaattgcccaagtcccaccaaaatcacaggcagcatgcaaaatataaatgagagcataaattcttccttttttcatatatatataaaaagaatatcgatcatcgatatctcgataccgtgtacaatcggacgggatgactttttttttcttctgattactgaattaatgcccactccctggagatcgatacgcagagagatatgcagggctaggtaccgagcttgcaagattttcgattatattaattaattatactatgtcacaaatggcattccgtgtaaggaggatgcactcgtagtgcagcggccggcaaatgggtccatgcaccgatgtggacctctttttacgccgccagcgccaagttttcaaggaggtgcgtgctgcaaggagccgattattcctccgccataaataccccatggccatcaatcttgctttatgacccagctggttttcgcggtgatgttatggtatgtagcaccactaggtcgttctgtaaataattaccgtt

SEQ ID NO: 2109 - DNA, 1624 bp, Zea mays
  misc_feature (1)..(100): optimal_loci_4166_G1, chr1:21713213..21714836, Cluster 12
tgtggaagacggctcccaaatggtttatccgttgtttaaaacccagtgttgaaggaattttggacctgcaaaaggacacgcagcgtcgcatccagacacgcatggttctgatatatggtaatccacgtcagcttttacacctgtaattccttacgtttctatctctctctccaataaaatgttggctgtttcctgcgtttacacgcatggacctacgcttaaacaactcactcaacctagtcaaagaaaagcactgccgaacaagcctgcgtcagtccactccctcctgcattctccaagcctttctcacagtcacagtccgtcgccccgcgtgcaacaagtcgcggcttcaatgatgacgagccatctcctcgtcggcccatagcagcggactttggtcagcccacttgctgagagggccgagtcactgccatgccccacttgtgaaaacatggaaaagctagggcgcaaacgttctgaacagcccagaaacgtggggacggccacttgggcctcgcacgctttgttgactcggagtcggagctttgtcaacgcggcgccgtccaagatttttgcttttgtacttgattggtctgctgccaagcataataataatgcaacgaataatgggccaggtagtctgcgagtgtgcatggtacgaacggaacggtcatgtactgttgtatacctcaatacctgtactcatgttcccctatggtctgagctgcgctgcggacgcattgactcgcggactgcatgcggcagagcaggtagactgggaaatggcatcccggtcccacacactgggaagtgggcacgatgcacgatttggcgtcgcccacgcagacgcaggttttgccgttggagatctcaggcctcaactgagttgaatcatcccagatttttctaacgtctgagatacgcttctagaccccacccagatagtaactcgatctgaactgatagcaagcactaaaaggcgagtgctcggtcggtctgttgggcttgccgccttcgtcagctcatcagctgttgctgcaacggacgggtgggtgacgcggacgacgatctggaaagcgtcggagcggttgcatggtcggcaggccctactctgctttgctcacgacggacatgcatatggtgcatttgctgcccggtgaagccgaagatgaggagaagcgtcgtgtcctctggcggtctggcctgtggcaggcacaggacggtgtctgctggcctcgtctcgtcttcgtcttgtctcgtgggaaacaggcaattaagcagcagcgcatgtcgcgtgaatcgtggacgagagaggcgaggtccatcatcattcatcggcttgggaagatccccagcgcgctgaacttcccaactcatgattcacggtcacgcgcggcgtgcagcaggtggacttcacacgaggaacacgtcctcatttctgactgcacacaggccactttactacggccttcgtctccgtttgttaggtcccgggcgacattttagtcggttcatgcctgtactactagctgcggtagcgcgtggggctgcatatatagcgtggtgctcgttttggggccgttgtgcatgcgcgctcatggactgaatatgtacatgtactcac

SEQ ID NO: 2110 - DNA, 2190 bp, Zea mays
  misc_feature (1)..(100): optimal_loci_42257_G1, chr1:249306758..249308947, Cluster 12
  modified_base (1553)..(1553): a, c, g, or t
  misc_feature (1553)..(1652): n is a, c, g, or t
  modified_base (1554)..(1554): a, c, g, or t
  modified_base (1555)..(1555): a, c, g, or t
  modified_base (1556)..(1556): a, c, g, or t
  modified_base (1557)..(1557): a, c, g, or t
  modified_base (1558)..(1558): a, c, g, or t
  modified_base (1559)..(1559): a, c, g, or t
  modified_base (1560)..(1560): a, c, g, or t
  modified_base (1561)..(1561): a, c, g, or t
  modified_base (1562)..(1562): a, c, g, or t
  modified_base (1563)..(1563): a, c, g, or t
  modified_base (1564)..(1564): a, c, g, or t
  modified_base (1565)..(1565): a, c, g, or t
  modified_base (1566)..(1566): a, c, g, or t
  modified_base (1567)..(1567): a, c, g, or t
  modified_base (1568)..(1568): a, c, g, or t
  modified_base (1569)..(1569): a, c, g, or t
  modified_base (1570)..(1570): a, c, g, or t
  modified_base (1571)..(1571): a, c, g, or t
  modified_base (1572)..(1572): a, c, g, or t
  modified_base (1573)..(1573): a, c, g, or t
  modified_base (1574)..(1574): a, c, g, or t
  modified_base (1575)..(1575): a, c, g, or t
  modified_base (1576)..(1576): a, c, g, or t
  modified_base (1577)..(1577): a, c, g, or t
  modified_base (1578)..(1578): a, c, g, or t
  modified_base (1579)..(1579): a, c, g, or t
  modified_base (1580)..(1580): a, c, g, or t
  modified_base (1581)..(1581): a, c, g, or t
  modified_base (1582)..(1582): a, c, g, or t
  modified_base (1583)..(1583): a, c, g, or t
  modified_base (1584)..(1584): a, c, g, or t
  modified_base (1585)..(1585): a, c, g, or t
  modified_base (1586)..(1586): a, c, g, or t
  modified_base (1587)..(1587): a, c, g, or t
  modified_base (1588)..(1588): a, c, g, or t
  modified_base (1589)..(1589): a, c, g, or t
  modified_base (1590)..(1590): a, c, g, or t
  modified_base (1591)..(1591): a, c, g, or t
  modified_base (1592)..(1592): a, c, g, or t
  modified_base (1593)..(1593): a, c, g, or t
  modified_base (1594)..(1594): a, c, g, or t
  modified_base (1595)..(1595): a, c, g, or t
  modified_base (1596)..(1596): a, c, g, or t
  modified_base (1597)..(1597): a, c, g, or t
  modified_base (1598)..(1598): a, c, g, or t
  modified_base (1599)..(1599): a, c, g, or t
  modified_base (1600)..(1600): a, c, g, or t
  modified_base (1601)..(1601): a, c, g, or t
  modified_base (1602)..(1602): a, c, g, or t
  modified_base (1603)..(1603): a, c, g, or t
  modified_base (1604)..(1604): a, c, g, or t
  modified_base (1605)..(1605): a, c, g, or t
  modified_base (1606)..(1606): a, c, g, or t
  modified_base (1607)..(1607): a, c, g, or t
  modified_base (1608)..(1608): a, c, g, or t
  modified_base (1609)..(1609): a, c, g, or t
  modified_base (1610)..(1610): a, c, g, or t
  modified_base (1611)..(1611): a, c, g, or t
  modified_base (1612)..(1612): a, c, g, or t
  modified_base (1613)..(1613): a, c, g, or t
  modified_base (1614)..(1614): a, c, g, or t
  modified_base (1615)..(1615): a, c, g, or t
  modified_base (1616)..(1616): a, c, g, or t
  modified_base (1617)..(1617): a, c, g, or t
  modified_base (1618)..(1618): a, c, g, or t
  modified_base (1619)..(1619): a, c, g, or t
  modified_base (1620)..(1620): a, c, g, or t
  modified_base (1621)..(1621): a, c, g, or t
  modified_base (1622)..(1622): a, c, g, or t
  modified_base (1623)..(1623): a, c, g, or t
  modified_base (1624)..(1624): a, c, g, or t
  modified_base (1625)..(1625): a, c, g, or t
  modified_base (1626)..(1626): a, c, g, or t
  modified_base (1627)..(1627): a, c, g, or t
  modified_base (1628)..(1628): a, c, g, or t
  modified_base (1629)..(1629): a, c, g, or t
  modified_base (1630)..(1630): a, c, g, or t
  modified_base (1631)..(1631): a, c, g, or t
  modified_base (1632)..(1632): a, c, g, or t
  modified_base (1633)..(1633): a, c, g, or t
  modified_base (1634)..(1634): a, c, g, or t
  modified_base (1635)..(1635): a, c, g, or t
  modified_base (1636)..(1636): a, c, g, or t
  modified_base (1637)..(1637): a, c, g, or t
  modified_base (1638)..(1638): a, c, g, or t
  modified_base (1639)..(1639): a, c, g, or t
  modified_base (1640)..(1640): a, c, g, or t
  modified_base (1641)..(1641): a, c, g, or t
  modified_base (1642)..(1642): a, c, g, or t
  modified_base (1643)..(1643): a, c, g, or t
  modified_base (1644)..(1644): a, c, g, or t
  modified_base (1645)..(1645): a, c, g, or t
  modified_base (1646)..(1646): a, c, g, or t
  modified_base (1647)..(1647): a, c, g, or t
  modified_base (1648)..(1648): a, c, g, or t
  modified_base (1649)..(1649): a, c, g, or t
  modified_base (1650)..(1650): a, c, g, or t
  modified_base (1651)..(1651): a, c, g, or t
  modified_base (1652)..(1652): a, c, g, or t
gtctgcacttgtgagtgtgggcgtgctctgcagtctgctcacctcctccgtcctctccactctctctctctcttgctgttgctggcgaggagggagactacagtcagcatgtgccgccgcacgtgtggcggcaggcaagcagaggcgagacgagaggcggatccccggccgacccgaacccggggcggcgacaaggccctgcggtcgccgtcctccgcgatctccatcgggtcaaaaagatggcttcggccctctcccatcgaccccccatgttggatttgatggatgtgccgcaacaacagcacagcacagaggcgagcttttgcaccccctcctaccacagatcatgccagagctccctaccactagctagctagctccatggatggatccatccatgcatgccacggaccggcaggcgccggcggcaacccatcgcgtatccgggggctgctgtgctgggtgaagaatgggcaccgccatgtcctacgaatccatcgaaatctctcctacagtccccgtaatcacatccacacagtcctcccatcccccccttcgcagtcgcagctagcacacacaagacaagacacacaacgcaacgaggatacgacaaaaggaataaataatgacaccagctttgatggagtgtttagcagcagcagtatacaactagctagctagtcactcagtaaacttgagtgtcagtaaaagagtaaaaagtgaaagctggggtggggtggggatgcgggaacagagcaggagcagaggtgtgcacgagtgggcagaggacagaggaggggggatccagtggaatcagaccagcccggccgtgagggtagggccaaggatttatttatgtgctgccgccaacactcacatgcacccagtaggtgaggtcaggaaggaggagccactcactcattcttggggtcttggccagccagccagcaggggcaggaggggcctggcctgggtcactcacttctctctctccctccctgctgctgcagcctgcacctctttgtaggattaataatcatcatctcatctcaccctcacctaataaacacaggtgtagtgcagcgtagcttgttaaatcacagatctaactaaccttactcctagcatctagctactacttgatatccatccatccatgcatgcatgtgaggaggtgattgcccggtgtactgattcgctaccaccagttccatctgcctccctctttgtaattgcctctcaagtactgtaccttttgtgctatgctcatcaatcaacgccccccctcccccgcaccccgatggtccaatggaaaccaccccacatgtgccacctcaaactgcatctgcttccttgttgcaaccatctctcaccccccactgtatgtgctcttaattttaatctcttctgatcagtttacttgctttggagtactgctagctaggcatgcatggattcattattctactgcccggcctagctagctagctagctagtactggtacccagtaactaaaatcaaatctatccatccatgcatgccatctactaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattctactccgccccccctcgtttcccattttagggtgttttttttctcctggccccgtctcatgcatgattgatggatcagctagctagctatcgcccccttcccccggcggcccactcacaaaacaaatctccctccgttccgggattattgatgaggatgcagcatcgatcgatctccttgcaaacgagagagagagagagagaaaaaaagtatacgtgcaccccagatgatcatcactcacgtaacattcatgatgtttcggccgcgccggcgtcgatcaatcgagcttgcattgcaaattattattagtacgtgactacgtgtgtctggcggctcggcacgcaagcccctagctacccacccagttgaactgatggagaatcttgggatcgagcacgcacatctccgctgacgatactataatgatgcacaataatcctccgatccggcctactagcttggtgtgcacagcaaactaaaacactcatcgtatatattagttctaacttgaagcccggccggtctgtgtacgaa

SEQ ID NO: 2111 - DNA, 2019 bp, Zea mays
  misc_feature (1)..(100): optimal_loci_42715_G1, chr1:251733356..251735374, Cluster 12
agcacgcgccgctacgcgtgcgcgcgcatagtagggcgcatagctgagcggctgtccggtttgtacgcggcagctgcagcgcaggcagccaggcaccagtcgtccagtctacggagcctcggcgtggcacgcgaggcggcagaggatgcgggcagcggcaggggcgcagcgcactgggcatgcgcagacatgccgcgtcttgtcgatggcagatcttcctccgttttgtctgccgtgccgagccagctttcactgttcaatcgcattgagtggtgtctctatcctgtgttaaatatttaagacatgtttggtacatgctctaagcagccacagcctgccacatttcaaccaccgcaagtcaggcgcggtgtggcggctcttagatctcaattaaagcaaacattagttagttattatatactttaatatgtaagggcatctataactagtgtttggatcaattttcaaagaacaagatatacttgataaattacatgatacagcaataattctttagataataaatagtcaaaacatagtaggtatagtgtggtataaatatggactctttgctaagaatttgtctcttgttttttttaaaaaaatagcgttcaaatatatgatgtgacacgagtgaagtttattaaacttgcacctccattgtccctgctccctctctctctcatctttacttgccatgttccccttgggtagttgggtgggcacgccagcgggcaaccgggctctggccctctgggcatgcatcacgaggttgcacgcggtgccgcagagaccaggaccggtgctaggatccgccggtcgatccgccggtcgggaataaatccgggagcggcgccggctcttggcagcgcgcggggcacgcggcggagctgggcaacctggtggcccgggccagcggcgcaacaacgcgcgccgctcgcttctttcaccatttgggagtctgcggcgcgggcggcgatgataggcggcatcacgcggcggattcgacgtgcacgcgggacgccgctgacgagggagcctgtcactgcacgacgtctgtaccttattataactaagattgtgtgttcccgtttttctcgtactgtgactgtccagtgcatgcatgcactgggcgttccgatatagtcctacaaggctacaagatgcagggcgcggcgggataggataagatagcccgcagcacgtactgtcaaagtagatgctgggacggtctgaccatgacggcacattcgcggcgtgcctctgcaatgtctgcatgccctctactgcacacgtacgtactactactctacgctagtggtacatgctccttgctgcagcgagcagtgccatgcatgcctagcacgactggacgagttgccgtagtactgtacgtacgtgcagcgctgctgtgccgctgccgcaagggtgcgtgctgcggtgccggtgctgtctgctgctgctgtgccatcaatatgctttttgcactttttcgcagtttgacctatgatgtgatgtgaccagcgcgcggccacgcccgtgaggccgtaaaaatccgccgctgcgaaccaaacgcttgatatgtatgtccctgtggggccggctgtgcgtggcgagtggcgacctcgctgccactcactcagctgctgctaaagtttggatcaaaaatcaatgttaatgagaagctatatttatgcttttataaaaaaaatataattaccatatacatataaaaagagaaagtaaaaaataactagagttagatgatataccattcctaaatacaggcttccaaattatgaacccgaaatgttggcaagccatgatttttagctgctatctgttttcctaccaaattttgtgaacctcgcatatttaacctgttcaattcacggtaattaatttttttttggccttatcaaatcttcgacatgacaaaatttctgatcctcttggcttgagttaaccgtggagccgtggcgttgatacgctaatgtacttttgcttcatgatgttatg

SEQ ID NO: 2112 - DNA, 1508 bp, Zea mays
  misc_feature (1)..(100): optimal_loci_44307_G1, chr1:260132439..260133946, Cluster 12
atccataaggatgtcaaatagttaaatttccctttaaaaacatattatcatttattttggaaaggtgccttcattggtgcaaaggtgtcgagtgtcgaccgaggatgttcatctagttagtctctcaccgctttcaacctttcatgtgtactcaacatcttctaaaacgattggcggctatattcttttcacggtgaagctatgagaaatatgtgtatacttgaatgactttagggatgagctctactctaacttaagttagaggaaattgagtcgctgactttagagagatcatagtgagacatatttaccgtctgcaaaaagtttgaatcatccaaagcatttctagtctgaaattagcaatgcactatggcatgtgtgcattggttccccacttaaaagtacatatactaagaaattgtctaaaccagagcattcagcagagaggctacatcgtcttgtcgaatttcagtagagaggctataccattaagggctagttcgaaatctccgttattttttaggtagccatccctaagaaatgttattttaataaaatgtttaattatttatgtgagattttttctatttaagtttgtctcttgctggcggaggccggagagtatggccggcgtcgctcgctggtcccagcttccctaaagtcaccgatgcagcctcatcgtctcatcccatctcatcggtttgcgtggtgtggcccggcccactcaaatcgtccactgcccagagctgagagcccggccggcctcgtcggtttgggcctctccggcacttttcccggcgtttcgcggccgagctcggtgctcactgtccgtgacttcctcctatgtcgtgttggtgctccgtgactttttatgtccatcacatgcacactgaggctggaaaaagctctgccgtttttttttgtctttcttttacgagggcaaagctctgccgctaataatgctagtctggcgaataatcctagcaccaaaagcatgcgccgtccatccattccgtttcatcgatggacgctggactggctcctgccctgctaatgatgatggcgcccgtgtcgtcgctggcccgccgctaatgacctgtttgaccaccatggccaggtgaaagcacaccatcggcccgctgtccgcagacaggtggacccagggcgccccttacccgtccagagtgaaagaaagcctgcctacgccacgctatgctacacctacacctggcctgggcgggtgctccacggcggctgccactggatatacgcgcacggcacacggaagaattcttttgtttgcaagaggaggtggaacaggccaagaccaacacatctaccacccagtttcacttgcggttgggcccggtgcagacgaccttgcggcttgtggggcccgtccaaggtggagaaaaaggcaacccgtggcgtcccctacccacccacccacccaccccttttaattgcttcgcaagccgcaacggaacggaaccaagagaaggcggcca

SEQ ID NO: 2113 - DNA, 2017 bp, Zea mays
  misc_feature (1)..(100): optimal_loci_44445_G1, chr1:260931346..260933362, Cluster 12
ctccatccgtatgcattaattaattgtgacgtttttcacatgaagtatagcccccgtgtgttttaatagatatatgcgcactttacacagagacagaggacgtaagccaggcgaggtgtgcgcccaacgcgtgaacggaatcgttgaacactagtgcgcccaatttaagagctccttttgcgcagcaatcatctcctctccgcgggtatttgctagccagtatacgcttttttatattatatcttagtgccacacgctagtgcgtagtatactttttttttgatgtgatgtggcatgcaagagctgaagcacgatgtgaacagagaaccgtatttgccgcatcagcacatgtcagttcatggatccaccactgtttacttgaacgtaagcctcgcacaaaaccttgagccaggctcagccagtccgcagcaggcgccgccgacggagctccgaagagaggatacagatacccgcaaccggacaccggagctcgtgcaacttatcatgatggacacatggtgggtggatctgccgccttgggcgaccgggccggccggctgctccaagaactcgcatgatggactcatatattgtaccgcactgtagcgcgcgcggcccatgcatatgcattgaagtcaactcgagtcggaaggaagacgggcacgcacggacgcgctgcgcatatccaacgaccaacgcgaccgacgcctccgcagtccacagtccgcaccaaacacgctaaagcccgcattccccgggatgggatccacatccatgaagggaacaaccggccaagggctcgcgacggcgacggctggcctgcccatccactagctctcccagcaggcaaggccgtacatgtacacactacactacaatacacctgctcgccaccaacagctagcacaacacaagtagtacttccttctcccgcttttcctcgtggcctcgtgggcatgcctagctatgtttggttcgcaaaggacagaggctggcagcgtggagggaaaaaaacgggtccgccaacgacagcagcaacgaacgtatgcgtgtgtgcgtgcgggcgggcggcctggcttgcagggtcttgaagcaacctactggtcgctgcctgcggtccagcggtagtctccaactcggctcaaccgaacggataggcgagagggagaggtcgatcgggcccgggcccaggcccagccgccgcaaggacccgggtccaaacgtccaacactgtcaacaacccgcagcacatgatcacaagtagcgtgctttgctttgctgctgctgctgctagcatgacaggactggagtgcggaacagcggaagtgctccacaggccaggttgccgtgtttccacaagtcagagtgggtaggtagctagtagaggactggttcgaattcggactgatcgcaacagccagcgagcctaacttaactgcaagtctgaacgaaagagggctaccgcactagttgagttacagttggaatggcgtgctgacaggttcgcagaataaccaaaccatcgcgcggaattcactcacttgtcgagacccaataactaaaaaagtgggtcccccatctagtaaacgctttcttgagctaattaagatccaattcgtactgagtactatactgccctgacctgtttcagcaaacttgcacttgacctgtctcggcagaacgaatcttcagaagtcttccttttaaccctgccccgattggtccgtttcccgttacagtatagaaggttcccaccaagagccagaaagagagagagagagtgtcacaaagtcagaagagaggcagtgacagaaaccgtcctgccaatgcttcttccgttcttctccaatctccagccactgtgcgcgcatgacatgtcagatatacgtgctgctacagcagcatgacaggattccatctatacatcctccgccctccaattcacaccaccctatgtccagcacacacatctccggtccactaatctacttcatcataacagactggtgttgacaat

SEQ ID NO: 2114 - DNA, 2202 bp, Zea mays
  misc_feature (1)..(100): optimal_loci_4470_G1, chr1:23228225..23230426, Cluster 12
catgcatcggtattagcagctctctggcatgccaccctccccggccggccgtcctcttcctctctattttttagcaggtcgtccgagcccctgattagttgagagaattcgatatggagatgcatggatcggagccgatcacgcacgcaaaggagaagggagcgagatcgacgagcgaatccgccgtgtgcgcacttcgaggcggcgtacgtacgttccttgctcgctgcgacctgcatgcgcgcgatgcgtgctcgatcttaattctccctcccgtttactaccagctacagctagcgtgcagcatgagcgctctccctggcgtccggccgagcgccggctcggcgtcggggcagtcgctgtcgtctcgtccgtcgtcctcccaggcgccccacgcgcgacaccgcgccgagctgccgcccaatccgggcgcgcgcggccgcggatcgtcggaggatctcccccccggccattaaactaagagccatgctgattacgctgctggtaccgtcgtcaaagctgagaggcgccctaggcccctagagctagctagacgacgacgcggcctaccagcagcagcacggatcggattagctagctagctagccagccagcagagggccgctaaactagctaatcaaagggaggcgtgtagcctgtgccccgaggagattaggtgtggttgtcacaccctcgctctctgcacggcgcgcgggattagttaataaatggcgtctgggattccacaagttggagatggggaaacagggccgggaggtgtctgagataaggatggcactcccctagtttatgtgcccaaagcgcgccaacgccggcgcgctagctagctctcgtatcgtagtactaattaatcaacgcccaccactcgctgctctctctcttttttctttcttgttggtttgttggattaacaaaaaaaaatagtagagactactctaatcaattgccaagtgccaactggtggtgcttgtgtgtgtgtgtggtgctgcgtgcgctgccactgcctgccatgccaaaagggccctctcgtagtcgtcgtagctagctaggctaggcagcatgtgacagggaatcactcatgcactcagcccggggtaatatgtgctctacatactgctgttacacttggcatctctttattccatcccccctcccctttgtttcactactgccaaagctttgtttagcgctacatgttgcatcggcggtagccccccctgctcaaaccctagaatttcgcgtagtatatatataacggtgcgcaaagactccaggccagaaaaggacaggggcacagagccaaggaggcaaaattgaaatcaaaagctgggtacttaagctgggtacttaagctgggtacttagatgtagagcgaagtttaaaataggagatgagaatttaggttagaatagctgccggagacagcagtcttattaagagcctaacaagctctgtggactgtcggtctctagagtctgtaaacaaattaaaaaatagataataatgccgcatgtggtcgttgttgggaactaaccacgcagtttaccgtgcagctccctaaacacgtcacgtacattggcaaacaaacaattaacgcgtcgacgatgttaatatatgatcgtccttatccggtctccaaggctcgggggcgccccattggctgggccggcgagggaggttggtgacaacagggggcttggttggatcatggatgcacgtgaaaggccggccagtcgtacgctccgctggtcaggtccaaacctagtcgtatactgtaagcaattgtttatcactgattagtaccttaacctggtgtggtgggttaaagcgaggaggtctagatttgcgctagtttgcctccgatctactacgtacgtttctttcttgcgttgctgtgccgctgctgccgtgtcgtcgtcctatagcaggaaggaaagaagacaaaggccggttaagctcacgatgataatataattattatattatcatcaacggagttaacacgcccgcaggtgcagcagatggattgatcgataggttttcgttgtcttacgttgtgtgtgtgtgtacacatcaattcgaccagcccagcaattgtctcaacacataaagaatgtccacttcattcataaaggatgtccacttcattttctacatgtacggtgccataacaacacgtac

SEQ ID NO: 2115 - DNA, 2241 bp, Zea mays
  misc_feature (1)..(100): optimal_loci_47037_G1, chr1:275037504..275039744, Cluster 12
gaatccagtcaactaaactataacgagttcgtggttaaaatgacgtcccctgggtagatggatagaaagccttgaacacacaccacaccggccggctagcataataatagcggccatatgatcacgcacagtaaagcgagcagcagcgcaaagacgcggcggcggcggatgcccggacctggatgggccctcacacgagtatatactattggcagcgacggccgggcattggctcgtacaaaaaaacgcacggtacgttacgttcgtcggggccggggtgcttggtgggccgggggaagaatggaagggaagccgaaggggaaagaggggcaggcatgtgggcggtgtctcgccggaggcgccggcgcggagagacccagggccatgtgccccccggccgggccggtgcgccccaccgcccctgaaagcccctctcccgagcttgcgtatgctaggtctagagcctatagtgctgctgctgcatctgtagcgagcgcaccagctcaatccatactagaggaaataaaaataaaaataaaaataaaaaagcatctaataatcataataatagtatggtctagaaatatgctgcgatccgtccgtccattcgcacgtgcccgattcttcctgcccgagacctacctagctgctctaccccacaccgatcgatgatcagcagcacgatccaggaaatgtcaagggacgtagacgtacgacggaggaagcacaggagaccctactactactactggcatgcagccgggcgggccggccagcaagtttctcgtatatcggcagccggcaggacactcgctcgatcgcgcggcctggtcggcaatcggcatgcagcttcaacttctctgctgcatgcatgtcctggcacgcggcagtagccggccggcgcggcgcgcgctggggaacgtgtcgccgtttcagattgactagtagtctagtacaaacggggacgccggcaggctgtacgacgtcgctttttattttttgaggcaccgtctcatgacctggcctctagctaactggtttagggttcagaagcttaattaacctggccacactccaaataagaacagtatcctacttccatttttaatccgtatgtgccaccagtactactgtacgctacatagtgtcatgagagatggagcacttcaactgatcgatgcgatgcgatcgagagaagcatggcgcgtggaccatagtatggagcgagtggagacgtggaatggagcaagcatggccgactcgcccagccctgctttccttgcctgccaatagcgtgggcgtggccccaaaaagcactcgtacgtcctccgcactcgcacgccgcccacaagcgactccatgtcgtcggccatcgcgcattcccggtgcgcatgcctgccgcctgcgcgatctcgagcgcgcgtgatcggcgtctcgctatctccccccgcatgcacagcatgatccggagaccggggcgtacggccggggaaccaccgatccatcgacgtgacgcgcgcgtaggtgcggtgcggtgcgggcactcgagccggccaacggccaaagcgcctaaagctcccagcgccgcgccacgagatctcttgtcgccgtcgagggtgtgtgtgtgtgtggctttccaccgtcattgcggtatggcaagccgacacttcggtgcggtgatccggctactacagtggtgccggatcttttgcacgcaacaaaatccaatcacctgcccaactttccgtgggaaataggtccatatgggggtgatgggtatgggagcaagcggcgtagactttgtagttttgaataaagagacaagacacaagaggatgtccatattatgtttagatatgcatgccccgtaatgaggtccattttgtgtgttgttggagatgtttacgtacgttagcttatttcaatttgctatgaaacataggtttgtgtttttttgtttacgcatgacagcgagttcggtaaggtacaagtttcatacccatacatgtatttgcagggaaaaaactacacatctacatgactacatgtcacatgtcaggtatactgatacactcgtggccacgaactagattattgctagaacaggggagaggatattggggcctataatttccaatagaagtccaatcagtacacgcttcggcttgcaccaaacaccccgaaccccaccgggaacactgatgcgtgatttcaattcagtcgggtgggaatcagcccaat

SEQ ID NO: 2116 - DNA, 2643 bp, Zea mays
  misc_feature (1)..(100): optimal_loci_47122_G1, chr1:275703970..275706612, Cluster 12
acccacttcccaatgcaccttttccttttcccaatacatctccatacccatttctcattctctctctccttgatttctgggtaccaaacctcacttttccttaattcccgtgtacaaacctaaaacacctactagtactaatttgggtcagatggagtatttagtatcataaattttagtactgtagtaaaaatttggtcgaacagagatttgacttcttagcaagtgagaattgcattattttggagacagaagggatatggacttttaacaaatcaagccacataatcaaggattgtcgaacaacaagatttcaataacgagcaagagcgtttaaggattcacattttagctttgcttaacttattggatgaattactcataccctgtaccatctagcttatcttcatagtatgctacatcatgacgagcaagagcggttaaggtttcttgttgctttgttggaagtaacaccagatccaatttctggtattccagcccaaaccaaatcaacctattaggttcaggttttttttccttattttttgttgccaaactaaatttaaatgattctacattcgttgggtctctctttagctaggtaacgatttgcaccaccccccaccccgcttcttcagttcttcttgtgctttagcttctcgagctctgccgacaaactaaaggcctttgccttttgggctgcactgcaaggcctgcaactatactactagtacggtagtgtcaacagccgtaaagagtaatagattcgccagcggtttttgtcagcacaagcatattataacagaacagtaactcatgctgatgggtccagtagaagtgctgcagctctgcgtctcgtcgacctcatctcatctgttgtacgtgatcggctttaaacgttactatacgacgaccgtgtgactgaccccagggaagagatagagatcgttcctgcacggaatcaatttgcggctgcttgaactctgcactgcgccgaatgaagtgacttgagattgatcgcgtcgagattattgcggtcccggggtgtgtcgtctcttccccggagtgccacgacatggtcgccgatcgacgacgtgactgccggcgcggtgaggacgacaagggtgatcttttgccttgcgacagcttccgtgacgtgtccgatggtcgtctcgccgagctggtactacgcagacgcagtatatatatgtaccgcctacacgcctagatagcaggctctcctctatctgatgagcacagacgacaggtcttccatgttactgtgaatttaggaacatattcttgacctaaaaaccctatccactcaaggcaaagcaaaaggcgcggctggtgagagaagagatagatagaggttagagtacgtcctcctccgcaaaaaaaaaaaaagttaagttccggcgcccggtcaacagcatgcatgatggctgcccccacccccccagctctttcgccttctacgaccaatccatgcaataaacaatgtcatcttatctctgttcgttcggtcgatggccgccgttgccgtcgtgcgtggagccagccagccactgcccgagatcgagatcgagtgtgccgtggtgatcacagaagcggcaacgtacgtgccagtgttttcccatggctgctgccagccttctgaccattggctccttcaaaccgtatggcaaacctgcagcttggcttggatgtggagccgcccccctgcatgatcggtgatcggtgttggtgggtggatgacgagggaagcttcagcccaaagcggatcagaaaatatatccggtgaacgacagtggctgcactgcccaagatctgcgacgtccgtacatacatggcaaggccaagttggattcaccgtcatacgttttgacgatccagcgacccgcggttgaacgctttgtacaggcgccggattggctttttttcttgttgttgttcacccgacagctgacagctccacatgaagcttccaattccatggccatggtctcttccccgctttttatctggtgctttctcttttccgttgttttctccgcatttgggccgtggcttctcgctcgcagaaggcgaaagggaggcaaagacgacagcaaatgagcaaactgcctgttctttttaccttctaggcttctattgccgcaggagtggaacacgatgccggggagagtttatcctcttttttttttttttttttttttgcctagctggttgctttcttcacggctatgtgtgtgcacaaggaggccaggcctgctgtccggtcactgcactgcactgttgcaggttgcagcatgcgcagtcattggctcattgcagcggcaagctgcgttgagagatcagaaatgcacatctgtttttttagaggaaaaaaatagcaaacggtttcgaaatgcaagtcaggatcaggactcaggaggggcatgcgcgggttagctggttaggtatcgctccctttcactcaccctccgtgcaatgtcaatggagaagaaataaaggcacacgtctggattgccctccgaaatcctacggaagagagagagaaagaaaaactcttaatcttagactcagagagagatgtttaactgtttctacaatgacgaaggagcttcatctgcgttctgc

SEQ ID NO: 2117 - DNA, 1586 bp, Zea mays
  misc_feature (1)..(100): optimal_loci_48009_G1, chr1:280715108..280716693, Cluster 12
aacttattttagccaatgcaaaatatttgtgtgtgtgctgtgtgcacacgggcagcacatgctctaccacacacgtactggcagtactatgctatgtaggtaccccattatagatacaaccatcccacgatggacatgtactagtaatatacacgagcagcaagaaggccggcagacatggctaccgactcgcaacaccgtttaaacaaaggcggacgtcgtaccgcgcggcgcccctgacgaagaagacgcacgcacgcacgcaggcgcatgcacgcgggcgggcggcacagcacaggcacagccagccaaggcagcattaacgcgccgggctcgaggccagaccagcgttggcatggccaccgaaaagccgcgcgaggaacacggcgcgttaggcgctgacccgggcgctaaacaacgcggatcaaaattcccttgcctgcccccgtttggtttttgtatatatagccgcctcgagaagttcctcccgcttgttggcatctccacggccgtagcgccgcggtgagcgcggcgcgggcgcgcgcgggcggtcggccggggtcgccgtaccgtccgtcgccgcggggcgcggccacctttttccctttgtgccgcgaggactcatagacgcgttcaacaatcgtcatgtacatgtccgtattcgttctcaacaaatgttgcagatgcatgtttcgcgcaatgcgtgttccaccatccagtaaccaaacacatcgaacgaatcatcactgtacattcccccatcacatctaatcctctgcatatgaatcctctgcatatgccaggccgggcatgcatggacagctactcctcatcatcccgctacagcttgccatctagctagcatcgcaccagcggcggtgcagtgcagccgcgcgcgcggcagtgcacattcattgtcacgccggcggccctgctgcacgcagctcgtcgcagcggcctcaccacgacgacgggcgcgcgagaattccattccctccgttctcgaatatggaaagtcgttccccagcgccctctcgccctctgctttgctgaaaaagagcccggtagttttacaccttttcttgcattgcagttgcagcacaagcacaatgggtagcccttggtagctggcttggattcatgtcagaccctaccatgtttattcactgcccctgcatgcattggctccctcccgggacagttctcagcagaagagaccgagaccggtgaccggacatctcaacccaagtgctgaacattctctaaaatagctcgtatattcatagccacgcactatgttgggcttcaggcttcagctaatatatactcaataagcatgtcctgaaccccataagctagctaggatcaccaaacccactaattaaataacagtacgcacctctatatattgtgtgttttattgtcctagctagcacctaaaatacatacctatgccatgcagccggcagccctgaacaaccctgtgcgaggcatgtttggctggggctggtgagcatccgaacgtgcttagtatggagaaaccattcctctgatctaattagtctgatgatgttttgaaactaata

SEQ ID NO: 2118 - DNA, 2018 bp, Zea mays
  misc_feature (1)..(100): optimal_loci_4819_G1, chr1:24670466..24672483, Cluster 12
cggtaaccgaatgggaggattattaactacaagctctaactaaggtataaagtatgtttataattggtcctccggtatataaacgaaggtggtaagctaggaagccaacccttctgtcaacccatatatctatacatgcaagttcttggaaatgtgtgcgaatatttaggctgcatgcacactagtagtagcttcctggcaataatggacggacgtgtacgctcggcaattggtggactagctggtggcccaagatatatgaacgaataagcaccatccactccagagatgcatgcatgtttgcagctatatattggcatatgcgacgagtacgtgtgttgtgctgctggcgctgtcgtccatgcatctatctaacccgacgtcaagacgatgataccagcgggttgattacgtctgcacgcatgcatgcatgtgcaatgtaacccggccgactacccgagagagaccagcagggccagtgggttttatttttacaaaggccccacgcgccattcttttactactactacaccaaaaaatgcgatcacgacctcacctgtcttttttttaccgagactaaagttggaaaaggtagaacaactggcagctagctagctaagctggggaacacacatgcatgcgtcccagattccatacatcttccaaaggaaactgtagtggtagctacagacgacagcagagcgagtgcaacagagagaagcagccgataacgaggcggcagaggcatgcagtaggttactactactcgatgcatgggcttagtgcacacatcatactccgtagtagtagtacatcgacggtgagcactgagcagaagcaagttcggcgacgagggtttggaatcgcgcgcggcgtcctagttgttggagccgtggagatatccgctggacgaccagagagccgtggcgaaagtttccatccatgcatgcacaaggccagtgagctaataggagtacagccactgctgcgcgcgcatttatttcctccgaatttccaggccttccctttcgttcccgatccgtcgtcgatcggccgccgggtctccgtctccgatccgtgcgtgttcgaacaatagtggcaatgccgccgcccatgccccgtacgtgcacgcatcggcactctcgctcgtgtggcggtgccacgtgccgcgctccggccgccggaccacctgtactagtactacgacgtccaaagccagcggtggtggcccgcgcatctcgtgtcgtgtgcatgcacatacgcgtgaaataaccacgtgcgtccatcgatcgcccgcctgcgctgcgcccggtgaccagaaatctctcgcgcgtttcctcccttccttcccgcttccgatcccggcccgtacgtcgtccatctatctagattgcagaatgaggcagcctttgacggccatgcatggtcctcctagctgctcagagcctacgatcttcagtaaaagtgagaccagcagcacgtacgtacgacgacatcacgcgcaaagctagcagcagcagcagcagctacataccaccgatcggacctgcatgcgaaacggtccgcgatataatgatactattatgatcaaccaacgcgtgttgctatatgcacaaccaacgcgagtagtggccatgaggcacttgttcttattcggagaagtgagcgagaaaaccgtccgaaattttctcgcttcgtcgcgacgacggtgggcttgaattcttcaacgtgcgtgctaatgctttccgattagaatagaattcatctactgtcgtgccgtcttcatgggagttagctgaatttcgacctggtccgttctttaaccttacgccgccatgggttcagagcgtggttagtagctagttaattacttagagttagttagagaccatgctagacctgaaagtgtgggtcgggtcatttagggccatcgatacattagtagtcatgtttgacccaacttatttttagcttcctaagcagaagttatatcaaataggtagcttctccaacaggtt

SEQ ID NO: 2119 - DNA, 1544 bp, Zea mays
  misc_feature (1)..(100): optimal_loci_4825_G1, chr1:24680833..24682376, Cluster 12
cgaaaggataagtatgtcggttagccgacatacttaacgtccatgtgacgtatccaacctacccggagtatctaccacatggccgataagtaagtatgtcggtttctcctgacgtatttactgaccacgtgcttattaaatacgtcagtgtggggaaaccgacatatagttaacattaagtatgtcggttccgatgtacttattcgattaagatcgtcaaaattagtactcatcataagtacaccggtctgttagagtaagaatgatgattcatggccgactttttctaatcgtttttcggaagtggtgttggtcctcataattttacgcagtgcggagagggactctaaacaaagtttttttttgtttaccttattttgcgtgtgctcttctctatcaaatagcaatatataatgatgtataaaacagtattcataattagtcatatctatatatgaataacagtatgtaacttttagatatgaaaatacaccgtctattagaagacgtgtcgtttttagttgtctatatatatatatatatatatatcagatttcaggcttctataaacagtcccaagtagtatgtgcgttgtacctgccctaatcattcaaaaatatttagcacgtatctacgtaatttgattggctgacgtagcgatgccttttgctgcgtccatgaaagcacgcggcatgccggcaaggcggcgtggacggattcgtcccccgaatgcccgaatctacgcgcagggcttctccatcattcccgctgttcatctacctcaggcgcgtggcatgcggaggccgggcacgcgttcctctgatcaccaagcccaggctttgcatgccacttgacggcaccactggatgacttgttcatcgcatagagtagtcttttactctttagctccaacgtcgcgctcctgttaatggcttcgtcttcaggcaatctacaccaatgtgtatctatctatccttgtctgatcttccgcgtgtgtgtattttctttgttgccttccctgatccatggtcgactttgactagtattgtttgcagtacaagactgtatataggtaggtagctgcaggagaaaagagagagagaggacagtagactctacgacgaagtacagtgacttggtcgtacattttgacggcccaatacctaacctctagccctttatatttggggattatattgcatctcgtcttcgtggcttcatggacctcccaggatactgccgaatttgactagattgaacaacctgaaaacgttcagagatgtcgtgagaatccaaacatttactcaccgtgacgacaaacctgaagacttttgagggtgtgttgcgaagaaggacgaaccagacctcacccgaccttctcgagcgcgcttctaagctaaaactaatcctttataaatataagaccaggtgcgaccggacacttcgacaggttcgccctaccggtgaagcctttgcccccgatggttgatgccgaccgtgcaaaaaggcagtttctatgggggctcgccgagagcgatgaccct

SEQ ID NO: 2120 - DNA, 1587 bp, Zea mays
  misc_feature (1)..(100): optimal_loci_51101_G1, chr1:297012932..297014518, Cluster 12
tggaaaggaagttaccggctgctgacattgatggagctcgagtgtgtcgccattttcaagcctatggcgagggtggcgtggtggactgatacaggtggcgttggctggtggagtgatggatgaccactggcggtgtcgtggcgtcggcgctacctatttggagcggacgagcgacgagcagtggagcctgctacctgcgagcagaccgcgacatgcatgcccgagcggtcgccgagcctcactgcgactaggttttagggcgactagcgtcgccggccacttcaggtgtgagtgtacaagtggcgtgcacccgtatggcttggagttggtgttgaacgcttggtgcttcggcttcgaggcttggattcctagtcgatcggacgtttggacccaggcaaattctatatatacaaagcgggacgaaaaagtcttcaatcatagcatccacgtcgcctttttcaatcctcaccgttccatcaattatcagcggccgacgccagcactcgactccttccgcacgcgtttccttcatgaacccgcttctagaaacgtggacctgctcccagaaacatcggggttatggtctcgctccggcatcacgcctttctttattcgtcgctacccgtcttccaggctcctcccgcggcgcgcctgagtttcgccctcgcagcgcaccccgcacgtacttcctcctcatcttcggacccggcggcatgcgctccttcagttgcgctgccataggtacgcggcggcgtggaaatactgtgctgcaccacgcgccatgcgcgagctcctccttcaaccagggcggcgcatggaaaaggatgtggccacagtcgaggccgcagtcgcggtaccggggcggcaactggacgtgcgggtggccacgctcgtcaggatgctcatttccaagggcagggccgcgatgcttgccgaggccctggacgagttcgacgccatctgcatccgcctgctgccactgcgtgtgcccttatattagtttgtgtttgctacaaatagttcctagtgtcttgttcgtgtattctctcctgcgaatcgtgctgactacagctacagaaaggcacttttcccaatccagagtttcaatttttgactatcttctgaaagcaattttcccgtttcgcctgatgtagactaattgctgaatatgttaccgacgatcattaggcttaataatattgattaattaattttaagcttttccgtaaaacatcatatctagaaaaaatgaatcttctccacgaagcaacatatctgaaaaatgaaataataaattaagttgtcatgtgatctgatattatatctttaattatcttatactactaaatctttgtgcaggaagatactcggagcggtgccaaattcatcacacatcaatgagatggactcagactgattctctcctcatgctcttccatctcagatgagagctcccaccactttgtgtaatgagcgtctgtttttttctgtctctgtatgctcctacaagcaaagggtcaaatttccagcaatattttggcattacaataggtgggtcattgtgacaattatgcatgaagggaattt

SEQ ID NO: 2121 - DNA, 2820 bp, Zea mays
  misc_feature (1)..(100): optimal_loci_51379_G1, chr1:298971863..298974682, Cluster 12
tcactacaccttcgcaagctctttaacaacataggagtggcaacaagcgtgaactcagcaaatggccaacccacgatttgaccgcattattcacctatttatagggttgaatatttatgtaactctgtacgaaattatattttttggtcccatttctcacacgataacgcttcgcattcgaggagtacgttcatgtcattttgaagtttgatatatcttttgtttgtcgaagacttttttgtgtctcttcttcagtctaaggccatatctttgtcgtcgccgaagctttactttcgatagattcggctccaatgcactttggacctaaccacgtgtttagaaggcagtctgatgagggtttcaatgaatcaatggtaggaggtggatttccttctagtcatgttaacatccctgacgagaaacaccatctaaacaccggttttgttaatttggaacttggatcggagaccttttccccgaaagaaaatataaaataaaggatttacgtatctttgttttttttttgaaaatttttatttggcttgagaaaataactccccgcagttaaaatagcacgagggggcaagagccggcaaatactttcgtaaaataactccactaacatacgcttcgacatcatcaatatatatactttcgtaagctctttgacaacacaagagtggcaacaagcgtgaactcagcaaatggccaacccatgatttgatcgcattactcacctacgtgtttggctcttcttcggcccaaggccatctctttgtcgtcgccgaagctttactttcgatagattcggattcatgcactttggacctcacccacgtgtttcgaagcagtacgacgagggattcaatgaatcaatggtccgaggtggatttccttctagtcatgttaacttcactaaccaggaacaccgtcaaaacaccgattttgttagtttggaacttcgatcggagacctttcctaaaccaccagcaccaccaaaagttcctcatttcatatagctggggatgaggtgcaaacacactttctataaagaaaatataaaataaaggatttatgtatctctgtttttttaaacattttatttggcttaagaaaaaaaaaactccccgcagttaaaatagcaggggagggggcaagagcctgccagcaacatacggtgagtcggagcatgcagagtctgtaaaggaagagaggcaagcatgcatgcacagggtcctggctgttgtgaacaagacagacgacgagacacagatcctgcatgcggcggtggacgacgcggaacacgaagactgcgataccctagcaacgaccagctaggaggacggttggaatcttggcctctcttcttccctgactactaccagaccagacaccagtacagtacagtattccattccattccatcagcaagcaaagtcagcatacaaatgcatggcaattggcaatggcatgcagatagagagagtcacagacaccaccaggccggggggtagacgtacgtactcgatcgatcgattcgatcatcttgctggcactaggctagatagatagatgggcaagcaatccgatcgagacgaccttgcactgcatgcgttggtgctcctttccagcagcgtgcaccttgcactgcgttggtgttgtttctttcttcttccccccggccggtgcatgcagtgtgcagcagagcagacgacacgggatatctgcacacggctggctcagtcgtcgacgatggccagcccatgcccacgcgcgtatatagatagatagctcttgcacgcttgcatgcactgccgactaccgtacgtctgccggccagcctgcagcgagtggtggctgctccaaagcgaaccgcgcgcatggcgactcgcggtcgatcgatcgtggtcgtggggaatcggatcatcgcagagcagcagaagctattgccacgcacgcagcctgcaaaggcgcggcaaagggaaagggaaagggaaagacgaagacgaagacgaaggcaagcaaaagccaactcgatcggccgggcccggccgggggccaatatgcaaattaaagccaccacaccacactgtccatcgtcgtccaccttccgccgggcggccggctattagctgttacgtactagtgcgactgctctatacgtacgtagtactcgtgcctactagtagctactgacggctgtgtgtgggctggctggccgccgacatactactgtctactgatcgatggatatgcctggtcccgtcccgagccatgacgacgatagagcatgcatgcatgcatggtgggtggtccacggccacggatggcatggcgatgccgcgttccattcgcggggggtgggaggatcacgatcatccccccccatgcgcgcctgcgtgcgccggccctcatcatgcgtgtcgtgggcgttcgtgcgtgtgcagccagcgcccagcggcgaggcgacagtgtgcgctgccatcattgcgcctcctgtgccggccagccggagagccagccagcgaccgcccgggccgcctgttaagattccccaccattattatgtcggacgcagaggctgcgggccgctgcggccgaagggccccgccggcgtccatcgggcgccgcgccgcgccgcgcgcccggccgatgtacagttctgccggccggagattggccggccgcgcgccggtcccgtcgaccacatacccgtccgtacggggcatgccctgcgtgcctgcgtcacgtcacctggtgtcctcctgctcctgcttccatctctcctctcaacgtgcatgctgcatgcttgctccaccg

SEQ ID NO: 2122 - DNA, 1459 bp, Zea mays
  misc_feature (1)..(100): optimal_loci_51482_G1, chr1:299472453..299473911, Cluster 12
ccttttagaaaagaagatgaattttgcatagccaaattgaccaatatatatatagtggtggtcgcgcctaacaggaaaatgggcttcaacaccatactacatactagtcagtccctcctagctataggaatggtggtggagtggcgatgggatagggagggagggtgatggatcgatgatctgcaaatgcaatgcatcgccgtacgtacgtgtgtggtgtcgtgatgcgcgcgcagggtcgacgacaatttcattgtgctagttggaactaagcgtgtgtgcatgctgatgcgaattgttttggctcgtagctagctagagcttcctttggctgtttccggagcgcaaagcaatggagggaggcatggatcggatcggagagagagacacatgagtgacgacgacgacgacgcatgcatgcgggcattgccgatcgacgaacgaacgatggctctatatctcggacggaccaggaccaccacacatgcatgcaaataatctctccggtcgatccgccgtgcggtgcggcaccatgcatatgcatgcatccatatcgatcacctttactataatttgtccgccatatgcttacatacaacaatcacttgcttaattcttggcaaaattgaaggcagctttgtactagtacgtacgtacgtgcatgttgtgcaacttgcttgcttaattagagctgagacatgcacgattggacacgtgccaagattccttctggcgcaacatatgcatcgatctatagagatattggtgtgtcttgagatcaatgcaagttgcctcaagagcatagcatagccttctgtaaaaagaggcgatggccggaaaacgacaacactagcagctagcgagtgcattcaggtacctctgcggcattctgcgagtgcgtgctagctagctgctataggacgacgatgctatagctagtacgtacaccatcaccatgcatgcatcatatgcaatgcaagatactactgcatgtgcacgatcgacgacaagcgaatgacaaccacgtacgtacgtactagctgcccaaagcaaaaaaagcctcgctctctcatctcctaggtgtcgagttctcatacgcgcgtacgtactgctactctgctagagagagatagagagacgacgaagctaaggaacgacgacggagagctggctaggttgccgtagtgtttctttgagctacgatccatcgacgacccatccatatcatcacctgccagcacgtacatacgtacttgcgtttttttgtcagcttgcacgcacaacattatttttttatatattactccagctagctagctagtactgatcgatcgatgacaatgtatatatgtgtaatgttagtttccaacaaagcacatgcacacctgtcgacctgtgagtgcatgccgccggccggttagggttgttgccttaaaccgcgcgtatgtttaacacacgt

SEQ ID NO: 2123 - DNA, 3135 bp, Zea mays
  misc_feature (1)..(100): optimal_loci_52178_G1, chr2:2261381..2264515, Cluster 12
cagcctgagccacgagctagctagtctcgctcgcgcagtcgccgtcgcaggcgtgcagcgtcactgcacggcgacgcagcccctgctccaccaggggtcgccgggccctgcggtggtgcatggtcgtcggcagagagcgatggacacgggccgggggccgacagcaggccgcggggccagcagacagctgggggccggccggagccccacgccatggccccctccagcttttggcgcatcgctcgctgttcctgttccctcccaagctctcccttccgccctgcccccagctgctagctagctcgctcgacccccgtcgaaaagccaaaggaggcgctgttgtgttctcgtgtagcgctccccgtacccgccccgcccccgcaccacccaggagcgccgccgccggcctccacctgatgcacccaccaccactccatgtccatggccagccccacccggccggatctcggagcagcaccgcgcgcgcgccctttatttccttggcgcgcgtagtacggccaggcgccatgcccatgtgttgcgcgtacgagccaatgtcacgatcacgaggcaccagagtaataagctgtggctacgtacttactgacgcgctggtacgttcatggttgctcagctggtattaaaaaaacagagagagagagagagggcagtaccgaacaagtgctgattactgcaggaaacaaacagtgcttgcagtactgcgttttgcacagtacgtacgagtacgacgcaagcgccggcggcccatacctcggacaccacgatcggacgggacgggcacgcatgcggcggtcgtcaatgcaaacatctagtcatgggcatgcatgcatgcatagggcgcacgcagcagctgctggtccactacgatccagagcggggggggatctatctatcggagggggtacgtgcatggtttgaagacgactgctgtttcgcgtaacgtaacgtactacactacaccgctgtttgacgtacgcgtgcatccaaacagcggcacacgcgcacgtagcctcttcttgtgtataaataaatgaaaggaactgccgggcgtgacgactggccgggacacaggactgctgcatgccgactagatagaacgacgatgcaacagcgaagaactcgtaaagctgttccagacatgtctcggcacattatatcgtgggcctaagcttttggcaagctgctcctggagctagctagctggctagctcaccaaacggacgcgacgcgaccaaaggcggctcgaccggtctttcgagtcctctcaacaagtctgcagatgagcacacggcatgcatggaccctggtccgccgtgtccacgcggcggggggccatgcatggcgtggagggaagggaacaggcgcaaacacgtcgcggtgcgtggtgacctggtcatgagtcatgagagcaagggccaaggggggtatatacgtatatcggtatatggtttaaaaaagacgctagataaagcctaatactcctacataaagtaatagtttaattaaacccatgcatggtaaaaatggaaagtgccgccgtgacccctgggcgccagagaggggcagtcgtacgtgcacgcaccaaagcccctccccctacagctacagggacagtacaggtacagggtgtgggcgcggtcaaaagcacgagtacggacgccgcgaccaccgctcgttttgggcttgggagcacatgagcgcccctttccccctccctatggattctttcccggtgtgtgtgccctcggctttttaccgctttggagcttccatgcaattacgcgagcccccacctgtctggccagggccattgggatgtgttggtggggggtttagcttgcaagggagatagataatcatgacggtcgtaggcttacttaaactatgactgacctcacgctacagcgacagagacggtgacacaacagacgcgtacgtgacaagggaagccactagtcggcactgttttggcacagtgagcttccaaacacgagtatctcgtaccacgatgactaagtagatatttatactccttcataagtagcgcgttatatccatagaaaacgtttttttcccctctaagttctagccacttctgtttttccaaaattttaatatgacaaatttttggtagacaaataagtaggtttatctcatcttttatgattttataccactgtcggtgttgcttcaccatctgcatacgtactacgtagaagtagcacgtggggtgggggaagccggagtagtagacacgcggtcgcgcgcgtcgaacatctacgctgcagtagcagtacatgtgcgcgggcagtcttgggattcaccgcatggcgaccggcggttggaagtaaaaggtgagaaagcgtggcggagaatatccctgctcctctgctacgtcctgtcatgtagtacgtacgagtcaaacatgtttttcgtgtcacaggaatgcccatggcctgtcactccgtctccccttttccccctttttgttttttgtttaaattgtgaagtggtcgataaataatactacatctattttaaaatatttgttagttttttttaaattaaagcgtaataaattaaaaaagaaacgaggaaatagctcagacgacgggggaccacacgtaaccgagagaagggggggacgcgaggaacagaaaaccgatgaactggtatgtgtgccccttcctggcacgaaaagcgataaatcaaatactatatatataaacaaatatttgtaaacagtataatatatttttataataaatctatgtggaggatattattttttatgttagaataaatttagctacacttgagaccagtgggtttggattggactcctcggccgggcattccgaagatggagtccgtaaattagtcctcaaattgaataggaggaaattattctccatagatctattcattcgtgatccgtggtcactaaatcagtccataaagtgctcagaaaacacgggtgacactctgccaattccaacgttaacttacactcattttctcctatgactttggggtaaggttacaaaacggagtcttaacgacccgtagcggcctagtcctacacgtactactatactccaacctagtaggcta

SEQ ID NO: 2124 - DNA, 3116 bp, Zea mays
  misc_feature (1)..(100): optimal_loci_52226_G1, chr2:2481701..2484816, Cluster 12
  modified_base (2218)..(2218): a, c, g, or t
  misc_feature (2218)..(2317): n is a, c, g, or t
  modified_base (2219)..(2219): a, c, g, or t
  modified_base (2220)..(2220): a, c, g, or t
  modified_base (2221)..(2221): a, c, g, or t
  modified_base (2222)..(2222): a, c, g, or t
  modified_base (2223)..(2223): a, c, g, or t
  modified_base (2224)..(2224): a, c, g, or t
  modified_base (2225)..(2225): a, c, g, or t
  modified_base (2226)..(2226): a, c, g, or t
  modified_base (2227)..(2227): a, c, g, or t
  modified_base (2228)..(2228): a, c, g, or t
  modified_base (2229)..(2229): a, c, g, or t
  modified_base (2230)..(2230): a, c, g, or t
  modified_base (2231)..(2231): a, c, g, or t
  modified_base (2232)..(2232): a, c, g, or t
  modified_base (2233)..(2233): a, c, g, or t
  modified_base (2234)..(2234): a, c, g, or t
  modified_base (2235)..(2235): a, c, g, or t
  modified_base (2236)..(2236): a, c, g, or t
  modified_base (2237)..(2237): a, c, g, or t
  modified_base (2238)..(2238): a, c, g, or t
  modified_base (2239)..(2239): a, c, g, or t
  modified_base (2240)..(2240): a, c, g, or t
  modified_base (2241)..(2241): a, c, g, or t
  modified_base (2242)..(2242): a, c, g, or t
  modified_base (2243)..(2243): a, c, g, or t
  modified_base (2244)..(2244): a, c, g, or t
  modified_base (2245)..(2245): a, c, g, or t
  modified_base (2246)..(2246): a, c, g, or t
  modified_base (2247)..(2247): a, c, g, or t
  modified_base (2248)..(2248): a, c, g, or t
  modified_base (2249)..(2249): a, c, g, or t
  modified_base (2250)..(2250): a, c, g, or t
  modified_base (2251)..(2251): a, c, g, or t
  modified_base (2252)..(2252): a, c, g, or t
  modified_base (2253)..(2253): a, c, g, or t
  modified_base (2254)..(2254): a, c, g, or t
  modified_base (2255)..(2255): a, c, g, or t
  modified_base (2256)..(2256): a, c, g, or t
  modified_base (2257)..(2257): a, c, g, or t
  modified_base (2258)..(2258): a, c, g, or t
  modified_base (2259)..(2259): a, c, g, or t
  modified_base (2260)..(2260): a, c, g, or t
  modified_base (2261)..(2261): a, c, g, or t
  modified_base (2262)..(2262): a, c, g, or t
  modified_base (2263)..(2263): a, c, g, or t
  modified_base (2264)..(2264): a, c, g, or t
  modified_base (2265)..(2265): a, c, g, or t
  modified_base (2266)..(2266): a, c, g, or t
  modified_base (2267)..(2267): a, c, g, or t
  modified_base (2268)..(2268): a, c, g, or t
  modified_base (2269)..(2269): a, c, g, or t
  modified_base (2270)..(2270): a, c, g, or t
  modified_base (2271)..(2271): a, c, g, or t
  modified_base (2272)..(2272): a, c, g, or t
  modified_base (2273)..(2273): a, c, g, or t
  modified_base (2274)..(2274): a, c, g, or t
  modified_base (2275)..(2275): a, c, g, or t
  modified_base (2276)..(2276): a, c, g, or t
  modified_base (2277)..(2277): a, c, g, or t
  modified_base (2278)..(2278): a, c, g, or t
  modified_base (2279)..(2279): a, c, g, or t
  modified_base (2280)..(2280): a, c, g, or t
  modified_base (2281)..(2281): a, c, g, or t
  modified_base (2282)..(2282): a, c, g, or t
  modified_base (2283)..(2283): a, c, g, or t
  modified_base (2284)..(2284): a, c, g, or t
  modified_base (2285)..(2285): a, c, g, or t
  modified_base (2286)..(2286): a, c, g, or t
  modified_base (2287)..(2287): a, c, g, or t
  modified_base (2288)..(2288): a, c, g, or t
  modified_base (2289)..(2289): a, c, g, or t
  modified_base (2290)..(2290): a, c, g, or t
  modified_base (2291)..(2291): a, c, g, or t
  modified_base (2292)..(2292): a, c, g, or t
  modified_base (2293)..(2293): a, c, g, or t
  modified_base (2294)..(2294): a, c, g, or t
  modified_base (2295)..(2295): a, c, g, or t
  modified_base (2296)..(2296): a, c, g, or t
  modified_base (2297)..(2297): a, c, g, or t
  modified_base (2298)..(2298): a, c, g, or t
  modified_base (2299)..(2299): a, c, g, or t
  modified_base (2300)..(2300): a, c, g, or t
  modified_base (2301)..(2301): a, c, g, or t
  modified_base (2302)..(2302): a, c, g, or t
  modified_base (2303)..(2303): a, c, g, or t
  modified_base (2304)..(2304): a, c, g, or t
  modified_base (2305)..(2305): a, c, g, or t
  modified_base (2306)..(2306): a, c, g, or t
  modified_base (2307)..(2307): a, c, g, or t
  modified_base (2308)..(2308): a, c, g, or t
  modified_base (2309)..(2309): a, c, g, or t
  modified_base (2310)..(2310): a, c, g, or t
  modified_base (2311)..(2311): a, c, g, or t
  modified_base (2312)..(2312): a, c, g, or t
  modified_base (2313)..(2313): a, c, g, or t
  modified_base (2314)..(2314): a, c, g, or t
  modified_base (2315)..(2315): a, c, g, or t
  modified_base (2316)..(2316): a, c, g, or t
  modified_base (2317)..(2317): a, c, g, or t
gattgctatcagtcgagattgaaagccttttgacgcctataaaacttggactagtgtgttgaccgcagatctattctctacatgtacgtgcgtgtactcgtacaatacaacatcattagtatcggtgacccatgcatgcaggcgcgcggcactgcataatactccaacgtcgtaatgcatgcgaaaacttctggtgcccaagtgcatggcgacccggccgggtgcattgatagagaagagatcgaccgaccaagaaggtaagacggtcgtcgacatggcggcaagctggcgggccggccggcgacgcacttgagcggccttggcgccggcacgtaggagacatgaccgcatgcaccagccaccagctgcctgcatgccgcgcgtgtttaattctggatcgtcggggttcgttgcaaaccaagcgaagctagcatttacgtaggtggaagcgtatgtatacatggtaagtatgcctaaacatacacatggcctgtcatcagcatctccggatggctactacctgtcgtgtactaggggtagggtcagatcacacatagatgatagcatatcgctgatcgcggctgatgagagacgggcaacagatagagtgagaaagaggtggtgtgcatgctcatcgaactccatggctgcgatgcgcgcgaatgaaggagctagttgaagctagctttgagagcaagatgcatgcatgagcatgacagtccagctttgccgcggcgtctggctgaagttgtgggcttgtggcggatgtagtgatgcatgcaggatatttcaggtcttcgttgacctggtgcggcacgtacgatggatccgggcatccgggatggcgcctaccagcgctagccgctaggtgctgctgctactacgtctacgtgactacgtcggtgtcgacgagatgcaattttatgtctgataaaagtcagatctttttaattacatccaacatatataactactacaaataaataaatgataaaaatatagccggggacaaatttaaatatttatccgcccgtctcggacgatttaatttgtggctgcattttcatatagtgaagaatactacaggctcttacgtacaaggcaacgattaatcaaatcgtataaagagtttatctggacacgaaggatttctatctatttcagatagcttctcagagataaattaatattgaatctttagttaatggtcaaaatgtgctctgatcactttggtttgaccccaatcaaaacatacttaccatttcgaaacgaggagagtggtgatagatataattatcatttccattttccaaacacacattcggccagttggcttggctctgccagaggatcacgctcgcagcgggcccctctggttcgctgagactggctgcatgcatgagatgagctcctcatcttctcccaggccagctaggcgctaggccttgggcgtagcgtagataatcgcggcagtgtggaaggaatacacgtacgcaggcgagcaaaagttttaccgcatccgggcgcgcggcgcaatgacgagactgccctcggcgggcactggcagcaggggatctagcggggctacgtgggccgtagcgtggtcaatggactctgctgctactgtactgcgactgcgaacgagtatacatggccatgggggaggtgagagaagggggcttggctcgggtggaccgctgccttgtcggcttgcggccatcatctcgctggactggaccagagacccgacccggtgggcactttgtcccgatccggcctctcgcactacccttccttgctctctctgcgctctctgtctcgtgtcgtgtctagggacagacttgtctttccgcgcccgctgactggatagttaattggatttcaaagaccagtgaccggtgtcgactctcgatgagatgagagttacaggagagaaggttgatagtatcaagtagataacaaaaggcactcggtccgtaaatataatagtgcctatgtttacaggagatcggtgagcttgttttgatataatagtgcctatttttactttggtcgcttattacgtccccaaaaaaattagcaagattcataaaaggtattatcaatactcacatcagtaaatataatcatcattatgaaagtacatatttcagtgtgatattaaagatattcgttacctatcatactgatactgttagtacgtacaataaaaatttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtatggatctgtcctcttggtgtcagaaaagactgacacccccctctctctctgcctctcggctgccaccgctctcaggtccgtccgtagtcaaaagtggcttgaccggattggagagagagagagagacagcaatgcgatatcagatcagatcagatgctaacgctatactacatacttcctcccagccaggcagccaccaccattccattctttacctccatctctacccaaaatacccctgccgtctccgtcacccccagtccctgtacggctgtacgacacaccacgccacatcttgaagccttgaaacaaccaaccaacccttcactcgctgcgtcgagcgtgaactcctactgcagcttgtatgtagcattgtggcacagcagcggcagatatatagtagcatgcatggaccgtgtcactctcgatcgctagttcatcagtagttcagggcaggctttgagaaggagtcaagagattgttgccgccccgtagtcgttgctggtagctttttttttttctctgtcggcatgcatgcagtgccccttcttagctcagctggaagaagaagaagaaaactggtagtataccactactgtcgtctactgctgccaatcatttctatatatatggtcttgaggcaggcagcagagtatttaccccactagctatcgtatgcaaactcatagtatacacgcacgcgcgcgtacgtgtgcacacaaaactttgtactcgatcctgctgagctcaatatcatcatcgtatgtcatcacagcggaatcggggaaaaatcta

SEQ ID NO: 2125 - DNA, 1725 bp, Zea mays
  misc_feature (1)..(100): optimal_loci_52424_G1, chr2:3561019..3562743, Cluster 12
tcatgttttttatatttttctcccacttgagacactggtggtcacaggaacaacgtgcacctgcagccacaccactccggctccagccgggtaagatggcctcgatctttctgagagcaagccatgcggccacgggccacgggagatggaaacgtgaaagcgaaaagagatcagagacccgtttcgtgccccgtgcacacaccgaaaccggcagacaggcgcggccggcacacaggttccgccgcctgcatgcccggctggccggggcgtgcacggtgcacgagctcggcacagaccatcgaaagcgacgcgcgccagcccggctcgggtcggcgacgggcgagagagagagtctgggagcgctggctgagcagctgtcgcggtcgtctgtctcgtcgctagggcgcgtgcatgtgctgtgccgtcgcgcgcaggctaggcgctagctagggatttgcacggagggcgtacgcgcgggagctgtcacacccgggcagtgccgcgacatctatcggtctcagcagcgttggcgttgtgttgcgttgcacccgtcacggccggccgcgcgcgatggctggctgccagcgtcagcgagcccgtgagggaggccgcggctcccatgccgcatcgctgttcccggcatttcggtccatggcgcccggcaggcaactcctgtgtctgtgtgcgctgcgcgcgcgcgccgaaaccgggcaacgctttccgtagtccgggccgctcaggtcacgtgcgcgcgcccacgcaacgccaatcgccaaccagaccgatcctccgaggccattgaattgttagcaagtgagacccgcgcgctgccgctgaggggtcgatcactggcactgtttgcggcttgggtggctccgaaggagtgggcgatcatgcctgtgcccggcgtcctacggaaaaccgcgagcggaacggcctggtttttctttgcaaatctgttggctctcaagtctcagccgacggcggaatattttgggcatgtgggtcgacttggagtcggccgagacatgtgttgctgatggcgaggtcccaacggtccgagatggatgagaatatgagatgaaagccattcatcctgtatctagagggctagagctagtatgatggagtatgaacaaagcctagggctagggtcacatgcgcctgactgcctgacccgggagtatgaacaaatctgttgtgccttccacggtccactagccctcgacgtaccgtacgtactacatgtatacgagattcacgcacctagctactgccacgactttctcctggtgaataaacctgaccctttttgcttcccgtggatggatatgacacgaattgtacgtgcaggcagcctgggccctggtcctgggaggctgggcatgcagcgcccactgctgctgctgctggccagcttatcgcaggagagaaaacacgtatgcctgccacgtaatgctgtgaatgctggagacgcacgcaccacatcatgatgtggtccgttgggtcagttcacaagtatcttcgcgcgcaaccaaaaacaacagcaacaacagaaaagttcacaggtaaatcgttccgaaaattccggttgcatatgcttcagagtatgttcctgtgaagatctggatgccgttctgtactgattgaaaatagcaacacatggcgtcaggcccgatctagcgagcgagacatgcatggtcctcccctggcgacacggccggt

SEQ ID NO: 2126 - DNA, 2598 bp, Zea mays
  misc_feature (1)..(100): optimal_loci_52429_G1, chr2:3593195..3595792, Cluster 12
ttagttcagctgggcattcaaacgagcgtttaagggcataagggcttgttttggatctaaccagttaaaaatagcattatgtttaaataataactagaagcatcaaatcgtggattatttttttaaaaaaaaagctacataaattgtgactaattgattaggtgaatttcttaatccaagttaggccatgggtagctcatatattgctacagtgagcatggttaatcaaagactagttaggattcatatatagattgtctcgctaattattagtcactgcttatagaacttgttttaaagttagttcacgctatagtggtgattttcagtagttggaatccagacatgtcgtagtagtatactaattattatacattcacagaaattacatgtgtatattatttttaatgaggtacactataaagataaaattttagaacttacccttggaagcacaaaaaatatgccattatgccaataaaaatatttaatgagttactaaccataatgctacttttgtagacaggtcgttgttggatcgtggtttcaaaataatataaaataaccacattaaatttcaatcaatgttacctacacatgctactttttttttaaaaaaaagtacatttcaaaattttagattcatttagggttttataacactcgtgccccttaacattactgagctggacagaagcaagcacgcattggtcattgatgccggcgcagactcaccatgcattcatgtaccggcacgtgcaggatcggagctgaagtcgatcgtttccttgtttcagaaacgagaaagaaaaacgtttccgatcggcacattttactaatcaaggatgctccccgttgcaaaacgtttattcgtgtagcaggaaattaatacaacatgcatgcagcgagtaaacaaacaagtcgagtcaaacacttctgcgatcgccgccgccgccgccgccgtatgggcatgtggctggctgcatatggcccgacgcaggccgactgctacggatacgagcgcctcgctggctggctgctgagccgtgcccgtgcccgtggaatcaggcctgtcgcctgccgcctgattacttattggaatcaggcctgccgcctgattaccgcgtggcgtccctgttacttattggaatcaggcctgccgcctgccggtgcggcggtacggtgcctggcggctccggtgggccgacgacgaccgtggggctcgttctgctcccgctttgcacgcccgtccacggcggtgtcggtgtccgagacccatctatcagaacgggcgcgatcgaagtatggatgctgtccgttctgatcatatccgatccacgcgcgtgcgtcctggcctacgcgcacacggcaacatgccaagatgcagagttaacggacggtgcatgtacgtgttgcgccgtacgttgccacacgtactgcactgctgccgcgctgccggtgccgcgcccgtattaattgtctatctgcctcgtggtggctggacgaagctaagctaattaagcatcttcttctcatctccatgcgatagcggccggcgagctggcatatccgcgcgtgagatccagtagtccatgggcgtacgattatcgcgtgtacacagtacaccacgcacgtggaacaaacaggctactacgcaacacacaggcgcgacgcgatgcaccgcacggcagcgtaagcagacgccaggtcgcgaacagacccgccggccaggcccgatcgatcaggcgcggattcgcccgtatcgcgccccggcgccgcgctcgcgcattaatttagccgcgaggatataatagccacggccacggccacgcacgctcgctcgcacggcggcacatgggtgatgggtggaggccggccgttcgctcgcctgtctgccgcgcggggccgtgcagagacgaccgcggcgcatcgcatcgtatcttccgagccgcagcgcggcgtttggctcggagcgaacccaacagcacccatcgccagcggcacggcgacggctcaaccgctctcccgctgccgtcgtcgcgccgcggcggcacacgtgcccgtgcccgccgcgcgatattcgtatcgaggctttgtacgcacacgccacacccctgcccctgcccctgccccgccgcgcgaatcgtggagtatgcaggcgggcgtgctgttctccgaatccgctccactgctctggcacattggatatttgtttggcctgcactgttgtcttctctcccgccaaagcgacgaatagctagcttcatgttttgacgcacggacacggacctgtttccatcgctatagcgtgtaggggcggagagcatcgagcatgtgtgctcctgctccatgacagttagccgagaacatgtgtgatcaaggacagttagccgatatcatggcattgacaggggggggggtctcgtttgactctctgccatggtgcatgaaccagttcacagtccgtgattctgcagttttcagcttggacgctactccgtcctactccacgcggaaagagagtttgacataagtgttcagccagggaaacatgctagtacgaagcctctctctgctgcacagcacccggcgccagca

SEQ ID NO: 2127 - DNA, 1975 bp, Zea mays
  misc_feature (1)..(100): optimal_loci_52709_G1, chr2:5077727..5079701, Cluster 12
tgtgaaggtctgcttttttttttctataccgtgtttagagaaaaatgcatcgaaaaaaacactagtctaattttaccttgccatcacaagtcaatcaatagtcttctgggacgtggtctcgctttcatgtcatcatatgataccgattatctcgtaaaatgacatgcacggaaaacgcaccgatgccttgtcactgttactaatattggtgaagccagaaagaaactaagaaaaggaacgttgaatatttcagagaaaagaaaacaagaacaggacgctaatttgagatgtatttgaatcactttatatatatagtctgctatatatatatttttaaacatataaaataaaattcgttggagccttttcttataagctaatccctatattttaaaacaattcactaatttaaggcactcttatcataggagtcagtacgacctgcaatcagtcatggttccaaaaatatcacacgtacgttgtggctgtactaatcaggattgccatatatacacatcaaatgaacggtggctcatggcgtcttccctctcaattgtacagtcactgtcattttcttgtgaatcgaaggcgctggacatcgccgcactcgatccaggaccaaccacctgtttcgagcctttacccaatcaatacaccgccagcttgtcagcgataagaacagcgacaaaacaaaacccaccgcgcatcaggcattcagcccccaggtcgctttttttctgaaatactaaaatcatttacgacaaacaaaacggcatttatttgaaaccatacgtataaaatcttttacagaaaaagttaagatgaagataatttgctttatctatttttttttctagaaccgtgaactgagagagcaaggccgtgtttgggatggctttggcgtcacaattgagcgaagagaggccgtgtttttaggaattgcggaccgtagtccatatatttttttctctctcctgggattgggaacatacaggccctacgtgccgcatcttggaatctcgtgtcccaggcactagcgacgagctgggagaaatggccgcgtcgggggcccccggagattcgaatctccgggtggcgaccacgagcaagattgtctgccccgctgccttggaccttggttcattggttgggtgcgcgcacgtgacgtgagtggagagagcacacgacgagctgggtggcgtggagcgggggggctgggcagtggacactgaagtgtgggccgaggcgagttcgcggtttggggggctgacctgtggggccgcgccgcaagaggaaacgagccgccacgcgcagctcaatgcctgccccctagcgtcgcgcaacggaccacgcttcgacggggggcacgggcagtagcagtgacacagtggggtatggcgacagacagcagcccttgagcaactcaggagccagagattacaaccaaactaaatactaggggtttgtaaagtatattttacttgtacgagttggttgttagatagatatttgctcgcgttggaagcatatgcatgcagcttgatttttgtgtgtgtgtgttccaaaccaaaagtacagagtttttggcttgtgatgataccacttgcgaagatcggaacgaagctaaagcctaacaaaaagtactcggtcgtgcgcgcggctgtaatgtaagcatctatcgtgcctaatggagatcctacttctccggagctgaatcatgggagcggagcggctgtcagcaatcaggaaaagggacaggacaaacagccgccagtcggccagtgcaggcgtgacaaatccgagcggttatttaatctgatctcgtcgaattaaaatggggggcaggctgagttggcgccgctgaagaaagtacgtactcccactacaggccggctgctagcagtggtgcgtttcgtttctagtttcagaggactgctgtacctggtggcgggtgcattgaacaccgacgactcat

SEQ ID NO: 2128 - DNA, 2197 bp, Zea mays
  misc_feature (1)..(100): optimal_loci_52751_G1, chr2:5219312..5221508, Cluster 12
aatgaaagttcatgcaggaagagcaagtgtcatgctcaccaaaccatttgaaggcggcctactcagctccctctccccagatgcctactgggctgggctggcttctgtgtgaggccgcaagtgagaaagcaaacacagccagaggagccgccaatccgatgaagacgagaaacatgtggtgttcgattcccaaatgccgacgtttgactcgacctacccggcccaacgccatgccgcgccattatctgatgaggaaaattagcgaggcagcaacccatgtgcatccgctgccggctttcctggggcgagctggtggaggtggagaggaatctttgcgtcctcccctgcttttaagcgtctgctcctgcatcagcatcgatctctcaggaggaccttccaagtccaatcactggttctggttgtaccccttttctccccattgtttcaacccaaagcaaaggcaagaaccacctccctggcgccttcctcacctgaaaacacgtttcgccgctcagctggagccaagttgtgaaccatgtgggcgaattcgctggaagcaccacgggccattaattaggtcacctgagagctggcagctacactaatcgtgtagtatattgcactagaatcgatttatctactgtcttcgttggaaagttgcacgggtaaactagtagcgctgctcacgagccaagtcattcccactgcttttaccactgttccctgaccgacaaaatctgttacgcagcatgacgtccgataattaggcctccccaagtcaaggttattcattgtcgaatggtccaatccatgcaacacaaacatgatccccaacagaaatgaaatggtccggaaaagaggagcacgtaacgtcagacgaaagcttaggtcttttttggcctaatgctagggccgtgcatgcatgcatgtctctgcatatgtagctctgaagagatgtggcctgcgagccacacgttaggtcaaatattaataagttggtttatgggctcagtgggaggcgtactattatgacctcatatgattgctgtcctgtcctctagtgttgtgctgttggattgtccaaaagcaagttaattagtgcggttcccatgcagtggaggtaaaaagtttgatgtgccctgtgactagactaaaaatggagtctacctgcctctaattgcgcgcggtttatcagtgtactctgtcctgagtcaaagttctacttgaaccatggcttaatcgtgagggtttcattctgtcctgcaaatggactgaatttggagttgttttactcctgcaaactggaagggttttgccgcggaactctcaaatagccgttgaacagttgaatgtctattgctatttgctacgtattactacctcctcctagtacgagataatagaaatagatatatgtttgtgtatttttattttggaaagtagacagaaacagtaggcagcatatcttctaattggaccagttggctcttatgagttttgccagtactgtccttgttttttttacatcattttgctactgaattaatggacgccccccggccgtttcttctcccaagcgtccttgtattcttctgtagagtgcacaccacacaccgccacagtctcagacatgtgcagagatcagccagagcagagcatgtgatcggcacagagcaatagttaatggtagttagagagcatcggcagctcgtttcctggacgcagcagataccgggaagaagcgaaaacagccgcctttctgccggagaaacaacgcgctccatcgtcggcctggcccccgtcggctcctaccgccgccggcgaaccaaacaggccatagtttttactcccaccctgacctgctgctctaactacacacgcagcaaaaggatttcctggtctgcactggacataacctgagcccccaccccactgtttcccttgagctgcaagcgttgccatcccctggcactggcacggcacggacggcgtttagcgtaagagagaggacgccacaactactgctccaaccagctggtgcctaaacaaggcaattgcaacccagacgtcgcttttttgtcccccgtggccgtcagggaatgattagtttagttcttccacgagctatagctagctgttagcaagtgactattgccgaccacttgagcagcatatggcaccttaaacaattgcaaag

SEQ ID NO: 2129 - DNA, 2415 bp, Zea mays
  misc_feature (1)..(100): optimal_loci_52815_G1, chr2:5542582..5544996, Cluster 12
acggctatatatcatcctactacaaaaaaaaaaacatggtccaatgtaggagcggacccaggtgtaggcatccagactcctctatttattttaatgaatacgtaaacatacatcaagcagtaaaatatagttaaatacgagtgaaaactaggcaaggcatatgattattatctttattcaggccgtcgaagatttctgggtccgccagttgtccattgcattgcaccactgtctatgcccttcttccctgtcgtggtcgtcgcagctgctggtgttgctccgcggcccctctccctccttgcaaatttcgtgtggtcttaagcttgggcaatcaagctgtaaactgtaatctgatatactagtgttggcggactggcggtaaacaggagtgctggcggaggagggctcgagacatgggtactcgtgagtcgtcgtcacccaaccagctagtactccgcctctgcggcacggcaagcggctatggatgcacatgctgactctccaacaaggcctagctctagctcccgtccggttccaagtgtcagatggccagcagattagctagcctgggacgggctcggcgtgcgtgttgacgctgttcatcgcgtactagtaaccgagtatatatttcttctcggtacgaatattctctcctatccaagttttaaaagcggcgctgcatgagcctgcaatggcctagtggggaccggccaaccaaggcaaggcaacagtgcccatcacctttcttttgttgaccatcatctgtggctaaacaaattaagggcgatctccatcgcaaatcttcatgccctcggactttgccagtacagcacgtactcccctcaggccgtctcagcaataatgcagtttttttagcatcgtactatatgttagtatcctataagtttgactaactatagttaaaagatgttaatgtttataatatcaattaaataccattagataaatcgtgagatatatttttatgataaattgatctagatcgataaatataaatagtatgcgttagaaattaaatcaaacatagacttaattgaggggtatgaatgtcttcatatatccatatgttaaactttagcatttgcatcgtccaaccattacccatatgctgctaataaactttagctctttatttgaaagggctaaactttagcatattgaaacatgccctaatactacacacagcctcttgttctagccaattgtgtccttctgctgctcctagactaattaagctataggacggccacttgttggtgcagctcgctttgcccattaatgaagcaaacaacggactaatcgcagcacttagcttatagacatacaaagtcacgtaggcaattaattattgtagtactaaaactaggagtactagtatactaggtgacgaaaggaactcgtgttagaccgacaaaactctgttaccctaaagccgagacgtacggaccgtctcgtctcgtcgtccaccaatgcaaggcaggcacgtgcatgctgcaaatggcaggacggacggaggcaatagcaagtctaccgcaggtcatgagggccagggtacgtacgacgtcccctgcccaatcgcgcgcccgcgcatgtgcgtcgtcgtccaatggcacggcagtcgcggaaacggaaagggaaagccggaaaggcactcatgcatgcaaatgcaaatgcaatgccagagcgggccgcctgggcctggcccgtcgggaattgtgggaggctacagcgacgtctccgtgcagtggggggccccgtctggaattgtggggccgggcgggactgcaacgaggagatggacatggagccatggagggggtcaagcaaaaggcagagggaggtggcttcatacacggtcacgacggcactttgcttgccggccgcagttgctacgactgttcccgtcctatcgtctaggtacccatatcctatgatcctagcttttaggcatggaacaattttagctatatatatatatatatatattttcgggggatgcatggaacaattttgtgttggtgggaaggaggacgaagtaaagatgagatgggcgcagtgcatggcaggatcaagtttaaccgtcatgtacggtccaacctgcttatcttccctgggcttctgaggtccgtacgcacacactgctggagtggacacgggtatagatggattccttcctagctcgtcctccatccgaatgctagctatcatggacgggatcagtctagtccatctctagccatctctgggaccaaaacacgtacaacccacttcctggtgtgctgacgccaaggtggatgaccaactgaatactagctagctcgtgatgcaacaagcctcggcagatctgcatccgtatagggtttggcttggttcagcttaatccggcactaaatt

SEQ ID NO: 2130 - DNA, 2133 bp, Zea mays
  misc_feature (1)..(100): optimal_loci_52817_G1, chr2:5553297..5555429, Cluster 12
cgcaagcccacttgcacgcggtcggggtgcgggcgttgtttatttattaatattaattaataatccagccggcacgctggagccagaacgaaccgtccaactgccggcggagtcggcagtggaattccagagcacgagcattatccactctgtccgtgcgtccggccgcccctcgcagcccgcaccaggtcgtcgtcgcctggttttctcttcgtttttattgctgctaccagcagtgttgatgatactctgccgcgcactgggccaggccaatgaatgatgatgatgattccgttccatggttttgttttgatttttcttttaataatacagcaagtgagcgacgaacggaacgcctcgttgtattcctggttactccatccaccagcaccccggctgctggctggctggctttgtttattgggggccgtcgcggacagataagatagcaacccggctccaccacctccccacccccactgcgcggcccgggccgtcgtcgctgtcgcggccctgcgctgctgtcttcgtctccatcacacctctccatcctcatactgcacacgtaacgtacagacgataaaacagccaagccaatgcctagatcatccagatagacgcatgattgccgttctcgatctggcttgtatatatttggacggagcaccgtacgtactccggccccgtcggccgtcgctctcgccgtgtctgctcgaccacctttgctgctgcctgccggccatccgtcagggcaggtggtacgtacaattagaatgtacagctcgacgccaccacacgtatatatattcatggccgcaccgaccggcgttgttgcatgggcatggcgcgcctgccactcactgccagggccccgcggcgcctccgaccgccgcattcatttgaattcaacacgggcgaggcagagccgcgtgcagcgcgcactcggggtcagatgcttacaaacagatggatgcagttcaccagggaggcagggaccaggtcataacctggtaccacgagtaaatactggatctagatagccgcatgcgctgtgttccagtacggcgtctcgtactggtctggagctcggttggtctacaggcagcaagctggtggtgtgcgtacggctcccgcgcggacccaggcccagagagtgcgtgacgccagccgagaacgcggggcgtgtgaatgcggacgccaccgacatcattgatgttgtactgcgcgagtcgttgcgtccaccgcgcgattttcataacagaactccctcccacccacccacccacccacccaagtctttgaaatcggttggggcacacacctacctgcacacggccgcggcacccaacacctgctccagctccgctgggtcccgtcccgtcccgtcctgttcccgtgaggaggcgacgagccgacgactggaccgcccgtccgcaccccacctcacctcacctacgccgcggatcggatcgtggacgggattcctccacacccacccacccacccaccctatgccggcggccctcttctcgtctgtagccctagccgccgcaccgacctgcactgcccccgccccgccccctagcatttgcctgcaccgaccgagctataaaagcgaccacgcagacacctggcccctacgccgcgccgtggtccacgcgtcagcgccccgccgtgccgtcgcggcagggtgcaaccgtgcaagtgtaacgggggacgtggacaggatgtggacgcggttagcccgccgcggacgtcattaacgtgaatgattgggggggtgggggttagataatgggcggccgatgccgtcgctggcaagcaatttgacgtcccgtgtccggattattcggccggccgaggaggatggatggggtgaggttccgtggacgagggggccacgtccacgtcgacgcgcatcaccccccgacgccacatggacatgtcggcggtgcgcgcactctcgcccctatccgaagaccgaagccggcggcggttggttgggggttggacaaattagtacgcgcaccaaacgtacgggcgcctgggcaggcagaggcaggtgcccgcgccctgtttgttggtattggtacctcttgctctcctcctccagccaacgcgtgcgatgataga

SEQ ID NO: 2131 - DNA, 1757 bp, Zea mays
  misc_feature (1)..(100): optimal_loci_52963_G1, chr2:6192629..6194385, Cluster 12
aatcggcggccaaattaagccctgctttgccgcctgattagtgccatgcggcagatcggttgcagaacaacagggacatcacatcactcaccgtccatcttttctcctcccctttggcccatgatgtcgtcggggatgcaaatgtcgctgcagccaacgagctagctctccttgctaatctccatggatccatggattccatgcccttcctcctctcaccgttgttgccttccctcaaaatcgaaaacctacgttcgcatcaaacagctgcatatttggattattcagaggaaaatgaggcgaaagtatagtaaatttggctctatttaaaacttaaaacaaatacaaatccatatttataaaaccatacttttttttcccaaagcactactaagcctaaaacgatccaattaatagattattttggttatatagacactctagatattttagttaaaatagattattctagcattacaaaggaagtgctttttccccccctctgaactcgccggcacatgggctctccgctcttcgactgggcagcagagaggcgaggctcgtcctgggcgaactgaactgtggctgggaatctgcctcctcacctcgatgacgcacgcacccaagcttttcggaccacagcactaaccgactaaccgctgctagtgctagctaagtagctaagatggtagtactagtcaatatacaggagcacatatatcttatcacaaacgtataaataggatgaaataaaatatcaaatgtgagacctgtcgatcaagatatcggatattaagttagcaacggtttactagagctgattgtcacaaccaccacatggtctagatctgtaaacctggtaatgggcccatataaaataggttcatttaaacttcatttcctcctgtatattgactatcacgccttttactatcacgttagcaacggtttactaaacctattttataaaataggttttttttgcatatatatatataaaataggtttttgtgctatacggtctagatctgtaaacctggtaatgaagcttgcccaggatcgagctaccttcaaatataacggcaaggaggctacgaaagagggcatgataaatatcctgttcctaattaagtgctggattaattagtttgagcaacggaactctgttgactgagaaatgaaaggaggaaggtagactctgcgcttttggtgacatgatagaagagaagaatagacaggcagacaagagcttggtttggtggggggagaagagagaccgcggacagagacgacacgaattccgtgtgcggacaagcatgtgtaccgtgttgggccacgcgatccctcctcctggggcctggtgctgggcctgggccttctcgatatcgcggtctccctggacttgttccgattcggtccacacgttgcaatgatcagctcgcgcccggccgacgacgtacggccgccgatccatccggagttccggactccacggcagaccggccggcacccacgacgcagctcgagaccgcaactcaatggctgacttggctgcagctgccctagctgctacctgcagtataccaccgctagctccttagtaggccggccggcgccggctgggacacgtacgaggcgcttactacgtacgtacgtaccatgcatcagggtttgtaggggctagctacatgtgatgatgaggtcgacgtacgtacgacgaccaaatgtacgtacgcgaacgacaggccaccaaacgc

SEQ ID NO: 2132 - DNA, 1627 bp, Zea mays
  misc_feature (1)..(100): optimal_loci_53484_G1, chr2:9276814..9278440, Cluster 12
atattataaaagatgacacaagatatatccctgaggtttcggttgctttttggcaccctacgctctcgttacgacgagtctaatctagatgattcaagcgctaattaagattcaacctacgctctcattagtccacaaggcgccacaggatcctccccttcctcttgacttctgaaagcttaagacctattataaagttgtgtgtgtttttttactgttttttaagcctacagccaacagtctagtttttagcgtcattttgcgactcacgtccgtccaacaattcgagcaatcgagcgtcgaagtatcgattttgtgatcacatcgttaacccagcaggtcattctaaggcttcgtcagataggtccctcaaccatgggcctgaatacacaagcgttagctagaaggctgatgaatcattggcaatgtcggacgcgcgatcttcgacgcctgtccagttgtgctctgtctgtctgaatgaatgaatgaatgattgccaatattttaacatatagccataaacgcatcgccaccgtctgttttgtttatgcgttgcgcgcgctaaactaatgttttcatctgacactgacaggccgtgcagtggccacatgctgcagcaggtttgtatcaggaactaagcggtaaactaagggaggttctttttttttctcttccttcttctcgcgcaggaagcttcctgggtgcttctctcgcaatctgacctaggttttccattcccctttgctcgcttctgccgaccgtttgaggcagcagtgcgacgatgatcgggaagggaacccgggcggttggttggaagtgattgatgcggccagttgtttactactttatttttttttcttgcgcctttctttgaagacgaaagtgcagcgctgatgtgagaggttggcaaatcctgctccctgcgcgtcggcggactctttgaaacgcatatcggcatatgcatatgcgactgtcaggtgtcgcgcccagcgattggcaccgcggcctgccttcggagtcaaactttcaggcagtggttgccgcagctgacagcaggtgtgctagtgttaagttgctttggccattcagaatcggagcttcccatgcatggaggtcacggggaagccccagccagtgatgcggcagctgttcatgcgaacgtgattgctccaagagccactaggaggagcagtgtcatcatctgcactgcactgcactgcacctgcggctgcgtgcatgcacgggacggcaggagaggaaggaacagggccatgtgttgctgcaccatccatccatccatgtgacctgaccgcccaaccaatggaatgtgattggattctcacacacgacacgccccaacctatgcgcctccaccgccgctctctccgttctccaactccacagtccccactttccaggaggccaacagtttaacagaaatcatggaggacccactctccagcaagcagacgaggaggaggactgacactgttattttctttataatcactggaaacctgaacttgtaataatacaaacctaagatggcccttcggcctttcggtgtcacgagccatgacaaattcgtcacactaaaaaaaagtcagaaacactacaataaacacct

SEQ ID NO: 2133 - DNA, 1551 bp, Zea mays
  misc_feature (1)..(100): optimal_loci_53783_G1, chr2:10789077..10790627, Cluster 12
taaaaatatgtttatctggcaccgtaacataatttttctaatacaataaatacttgtacgagattattaagatggtaaaattgtacattgttttttagcttcttaaagatcttaatttttttttaaaaaaaactgaaaactataatgttttagttcgtgtcgagagctacaactttttacatagaaaatatttcgatttgacaccatataaaaataatacagcttcttatattacggaaagtttatttaatttgttgacatatattaatatgaacattataaaaacaaggaagctgtacgtctcatgaaaatctacaactctcatacaaagttatcttcatctaaacccatgcaaaagagaatacatattttgtaaagctagtagtatgtctcagtgtctcaccgcaccagtccgattaacattatgctatagtatgacaggctttttttcttctgccggaacccgttgcggtgcggcagcatgttttgaccgcccaataaatatgccacggccaaaccggtttcgaatgggaataaaaaagcaagtgatatttttaaaataaaaaagcagccgtatgggtacggcccgcaggggcggcggcaggcggatgggccccgcggggaggtttctgcgttccacacgcacagctcagtggatcggccgcggccatatatattcttttgttttttttttctttctcccccgcctggactcgctcccgaccgctcgccgactgcacggcgttgtccgtttcagaccttcctttttttttcctgtcccgaattccaccgacgatttcttttggttttcgtctttgcgtgaggtctggtcagtctgctaggttccaacagttggccctgcaacaaattggccggttaattcgatataaaccggaacaacaaagacgacgagcttagtttttagtaactgcagtagaaagccggcaacgcaggcttgcgatggttgggatggaaccaagtgttgggcgctccgtcctcccaacccgcgcagcaacgctggttgacgatgcatagcataacggcagcaccgcgccgcaggcaaaggcgtcgtgtgggggtggggtgcgtgcgaggaaaccggggggcgcgcgaaccagacaggcggtggtagagtcacgttgcgcacgcgggggggggacgcgtacccaggtgcgtgcaggtggcgtgccgcgggcgctttcagcctttcactcgacagctctcgcgtggccggcggcgaagcggtgctcctgggtcctggcgctcgcggcttctacgctgccacgcgaagctgtactagtccgaatcaggtcaggtacgagctgaggtgcatgctgttgcatggagacactactgcctccgtccaagtccatgcatcatgcatgccgacaatatgctggcgccgtcctgcgcagcaaactcggttgcctcggcgcgcgccatcgctcctcgtctcctgcacagcatagcatagcatagcatagctcagcggcggcatccttttcggcatgcatgaacaggctgtgtcccgcgtgctttacattcgaggag

SEQ ID NO: 2134 - DNA, 1486 bp, Zea mays
  misc_feature (1)..(100): optimal_loci_53949_G1, chr2:11546173..11547658, Cluster 12
taaaaaaatagaaaaataatcgacagaaaatagaaaaaacaagttatctttgagttcttttacaaggtgttcttttggttaacatgacacggcatgatagtccggcacgactcgttttaaactaatcgaaccatatttggctcggcctgcggtccatgagcgagcacggcacgtgacgggctcgagccgtatcggcatggcaaggcccattggccacgtattggggggaggggcttgttaactgcaaagcaaggtgttgcttaaatctggaaatgtaatcgtcgctctccgtgctgcatgtaatcgtggcagtgtcacttgagtaggtggcactggccaatggccattaacgagatgattgcgatggagcgtgccgcggtttcctattcgctgtgtccgtcttgttgttgttctgctgcgatcgcgctggccagtggagtggagacgggctgccatccttttctactaccggatcgctttcaacgtctccctacgccatcgcgataagcagccacgtactactacagaagtagtactgctacacagcgagtcgaacagcaaccggtttagaatgcagtcagttgggttgcgacggcagcagcagcagcaattaatcggtgatcccttgcaaggaaccgtctgagggttcctcgatggcggcggattacgctctctgtgccggccggcccttgagtaggttgcaatcgaagcatggcatgggatgggcggcctctctcgcagagtcgcaggcggcgtacgcgcgtggtgctctgctgtctctttcggcccgcgccgcgccgcgcggcggcgcggccggtcgctcgatccatctccatctatctactacacgcgtgatctgatgaggccagtgccgcgctgcgaactgaacgtctgaacgggggccaccacctccagcaggcaagttgcatgattagcgagggaattatgcgtgcgtgcgtgcgttgctggtagccaacggtcggctcgatccggatccggctgggccggcgccggcgcctcaggcgcgggcgcgggctgtctctgtggtacccctgtaatccggccgtttggcgatcgacaccgtgcgtgattggagccgcacgctgacgtagtacgccgcagagctgcgacgaatcgatctccagcgacgaatccatcccggcccaaaccagctgcacaaattctagccagccaggtccggcgagcgtacgcgtgacaacacacgggcatggcaggcagtacgtcatgcatgtatattgtcctctggccaagtaagggtccgactctgatcgtgtgttccttgagatcgttctgtcgatctccgctgatctctagctagtctccgcaccgtcgttgctttgttcgcttcttctctgccacgaagaatgggggttctctgcttgtttggttaccagctagagatggccaaatagttgtattggtctggtccggcatgtagggatggcaatgtaaaattttcatcgca

SEQ ID NO: 2135 - DNA, 1938 bp, Zea mays
  misc_feature (1)..(100): optimal_loci_54138_G1, chr2:12689395..12691332, Cluster 12
gaccgatcagagatgcaaggatctgggactcacatagcctcgcctcacaggtggtgcacgttttgatgatgctgttcatccttgcccggccgctacttgtaaagattcctcgtgcatgcatgtgtggtttggtttgaaatcgctgtcttaggcaggcattcgagtttgatgaggacggcatgtgaggggggaaaaagatcacatggctgaataggagaacgtgtggttggtttctgtgctaaccgcgccacgcctacaacgtggtctgtggctcgtgactgaatcgaagctgctggttttctgcttgatttggatagcctgtgcgctgtgggatgtggcttattattattagctcccatgtggattcaattcaagaatatatagtgattgtgacacggtgacagcaaagggttttgagcgcgcgatacaaggtagtagtagtatcatataaatcctaacttgctgatgtttgtttgatggaggggatgaatttggtgctgctagattgaacagattgggcgctggatttgggtgcccgcttataatgaatcataagagagaattccatctaccattgtcttatgtctctttgtgttcgtgttgtcacgtgaaggaaacagaaaataggtcttcgtctacatctttctcacttctacattgctaacggaatggtttatatttcgaatatgagatccacaacgatgctgatacttaacacataggtcttcagcagatcatgtatatggcagagcaaaatattgttcaacacaattgtgtcgtttctcgctagtgttgtgggcgtgccgcttgggtgggttagcatgaggttctattttaaatgggccgcttgaagtcctgacttatcgtcgccttcccacaaagtaaaccagctatctatacccgaaacatcttggcccaacattttcacggacatttcgaggcccaaaaagacttgtgaacttgttcgtgctctcctggctttcctctcgaagactcaacaagtcaacagaaccagcgagtcgtcgtgaaacgagaagcagcaagcagtcactgcacttttgtttctgatggacaataacatgtggccatgtatgtccctgtcgcacatccaggtttcagcttatatactggcaaaaatgaaaaagaaaaggaacaaaaaaaaaatcaaggacctctgtcggtaacacgacaacaccatggagcacacgaaataactcctgtatttgtgtgagttattatggatattttatactgtagaaattgtgagaagagggtataggcagtggagattatgcatggctgaacctttatctcaattaatcacttgttggtataaatgggtggacaggataattattagcacagcgttactgtaggaatgggcagtggcggacctagggcccggcgaccctgggcgccagtccgggctgcaatggccatatatatccttgaatttctatgtatttctatgacaccatatgctctagaacgtactatctaactagattaacgagacttgctcaggctatgatttagcgctgggtctgtcactggaaatggggagaagagggtatatgcagcaactctatctcacgtagttacattatagataatacgaaaacgcaagtttttgctgttcatcctattttgatataaaaaaatgtatcatacagttagcacagcgcgctcttgtatacagtaacttgggtcgaactggcttgccaatagttcacaaaagtaaaatgagtaaactgatacagaaaaaacgaatgaagaaggcgaagatccaacggctgggataacgcccagctgctctcgtccgacggtccaagagctcctctgaagccgagggtcgagcagtgccgcgtgacgacgctaaggattacacttggctaagggcacgtcagcccctgtgtaacagggagctgcttaagtgga

SEQ ID NO: 2136 - DNA, 1619 bp, Zea mays
  misc_feature (1)..(100): optimal_loci_54427_G1, chr2:14224010..14225628, Cluster 12
cccccccccactcagcgcccaacaactgtgcgatggaatgcgaacgcttcccatcgttttgtctttttttttatctctatctctttctttctttgacagtgaaactgtgaaagaggatcaggcgagctgtccacgttgccacatcccgcaggtgttcgtccgtccgtcagtccaccgtgcgtctcttctctcgccggccgccgaacaagcagctcgcgtgctacgcacgggacgggatacagtcgcaagcatccgtaaacaaagctgggcgcgtatctccagagatgctgctccccggggcgaaacctgcctgcctgccggaccgatggaatctcgagcgcttcgtgcggccgcaacgcaacgcaagcatgcgcccacggcccacccccgaaagcgtgctcgcacggccgcccaagttgaaacctggcgacacagagtggtggtctactctaaacaacggagttttcttccttccatacacagagccagctagcgtaccgtataggattctgtccaaagttgtcaagttcaatgccggcgggcgcaagcacaacagatcgcgtgcatgtgcgttctcggccagtgcgtgcccacctcgtagcagacgcgccacctgccatgcattggttccagccgccgatgctcacacgcacggtgctgctgcatcgtggcgtgcatgcaccaactcggactggtccggagagaatctctgatctctcgtcaggaaggaaggagacctagtagtagtagtagacaaagcagtgtccatgcaggaaaagcctgaaatcgtgtgagtgagcgtgacacgtactgtgactgtgagggagggagcaaggctgttccaaaaactctgcaacttgcgagggcgagtgccttcaatcatactgacacacatgttgatgttggcatggatggccgcgcgcctggccatgcgggggcgcgcccgcatcggcgtgttttcggggggataaaaggatggcgcaccaattatcacccatgaatatacaggaggaggagtaggtaactaggtttagtttaataataaagccatagtttgggagttggggaccagcatcgtagtgttaatctgatgatgcagaccaatactctaatacgattctgatcgatcacgatgcgccaggatatctgcctcgagatttttgctgcacaaagcggagcaagtagcagcgtttgtgtttttgtaacagtccacggaagcggagcaggttcacttgctcagtccgtgagagcgtcctctctcccctgcgcacagctactaccgtcggcgctctctcgctcccctagctggaccatatgcctcgtcgcctccctgctcggctgctcgagcttatccgtggctggagcccgctggccccccctgcagcggcgacgcggccttgcggcggctgggctcggcccctcagcctctggcgtctggccaacgtcgactgcgcactgcgctgcgcacgagtctgccctccgccgaaacggaaaagcgcgggaacaggaacatcggtggattgggagctcggtggcggcgaacttattttttcctttttttttttctaaaatgaggattgggattgaggttttgaggagttattagagatgctaagtct

SEQ ID NO: 2137 - DNA, 2768 bp, Zea mays
  misc_feature (1)..(100): optimal_loci_54861_G1, chr2:16643329..16646096, Cluster 12
attctattccacaaacaaaacaaaaaagtgaggaaacaccccctataaataaattatccatctttttatcagcttaagttttttttattgagctggttgattctcacaactcaatactttagacttttttatgaactcattttatagggtgtcagctacgggttgacaactttcgttgcaggccatcaacgagaaaagaaaaggaatgaaccgctggtctgttgtattctaaatgtgtacaataacataggtgtagaaggtcaactaacctattcgtttgaacattatttttttaaaaaaagataatactagctgtgacgatattgcaacaattgtcgcgacggcatcacaccatcgtcgatgtctcgttgtttttttgaagctcatctacggggactgcaatatctcttttctggtaaataatgagatctccttctttttatgcactattatgttcgttgtctggactcttgtgcacaaaagtttacacctttgtcaatgcaaaaaaaaaaaaaacggggaagccggcaatccatcctcgctctgactcagattgacaagagcatgctggctcccttagaccaatgctagaattctatgtaagaaacagtagtgtcatacgcggggcgggacgggttttggtcggcaaataacgctagccatattcgttttggtcacttatatacaagctagctactagtatattaagctaacaacgcctagctagctagcagcggaatcatgacacttgggatctttgcttgctatggctctctaggaattgcggcacttgtagagaaagcaagcttggatagccgcttgcaccaccaaggtgctctgcatgtgccggcctagtagagcagcctgcagttaaaaaaaagcgcaagcattagtactaacttgggagcaatcgtggtgagatgcgctgaaaaccaggtagtatatgcaaaactagggtctctcgttcctgaatcaggcaacagcttgatgttgtggtcgtagtaggttcatgcttcacccagtagtctactaatactatcccctttttagaggatctgccgttaacaataatagcagcacacttgcagaaatggatcgatggcgccattgctcatcacggagacgagacgacgaccataggccaccaacatgccatgttaatggttgaggaaatataggtctctgcctcgcaagttgcatccgtgcgccggttgcagtatgtgcgcgcatcggctaggcatattatgacatgacatgccatgccaatgccatgccatgggggggaatgcatctcggcaacaagtggccgtattataaccgagcgcccagaggtttcggccgcgggggtccatgactagtgcagtagagcagtgcagcagcggcaggcagcaagcattggccttgtctcgctcgggcagtgaccaaccaagcgtcatggtccatgggtgtggtggtggtggtgccactgtgcgctagcctgaggcctgagagggctgagggcgttattggacaaaaggagctccaaggctctggcattgttttgccttggcttggctgcatgtgtgtgggagatggtccaagccatgtatgccgtgtggcctttcttgttgtatctgcaggggccagggggcgtggggcggctgctgccggcgcggaggcgccattggctcgccccgccgagtgtaaaaccaaggaggcaggtactggtacgcgcataacctccgcttgtcgcgagagaggcgcgcgctgtactcttttgttgcgttgctcctggccgaagccaatatccatgccccatggcgatggcagttgatgagagaggcagttgttgttgctgctccaagacttggtttttttagcccacgtatatgtcgtgagagagcatagctagagcttagttttcggctcacgtacaacgcacggctggcgaaacccgcggtcgtgagcaacggagccgggcccgtgcgtgttttatttcgccgcatatgtcttgtcgacggcctagcctacgctgcgcgggacaatcaagcaaagcagctgctgtatttagcttgcggcgacgtggacaaaaaaaaacaaaaagaaaaacgcttcgctttggcgcgtctccccgtcggcggtggagccgcggagaaactacgggcgcgttggtcctgagcgaaggtgacaaaaatctttggactcagcgctgcgcgatccacatggggtacttcaccggcatgcagcgtacgattctctggcccaggtgctgcctgacatgcgggaccctgccatacggatgcaggtagcaggagctaccgtgtccggcgtgctgataattttctgacatgtgggctccgtacacgaatatagataggtacacgaacaggctactagctccaaaattgctccctccataatactaataagggcatgtttagatctatgggctaaagcagacttattaaaatttagtcactttagctgctaaagtttttaaaataatgtaccaaaagggactaaaatgttttagcttcttcagcttgctaggaggagctaaactacactaaaacaacttatcaccacacccacacatgcaacttgcgcttgctggcttgctgctgcccccgtgctagctgcctgctccaccttccaccatcacaacgctagctgcttggtccccactccccgcactagcatttatgatttaatgtatgctttagtcacatgttccgaacaggagtaactaaattttagtcactttagtttagctccatagatccaaacat

SEQ ID NO: 2138 - DNA, 2345 bp, Zea mays
  misc_feature (1)..(100): optimal_loci_54949_G1, chr2:17089878..17092222, Cluster 12
ccacgctgtcaatctgtgtattacaattctatatataacatacaccctagtaacaacaaatagaagtaagaggaggtggtctgccgcctctccactacaggtccctctgcgtacttgtatgtgaaaaaaatataaaaagtataattagatacctgctgttctggggagaaacgatagacacatatagttttagctatgggagatcgttttgaaattttaaatatcttaaaatgtaaaaattgaaaaggatacaacggacgaggcggttgaggccccatgaagtgggcgttgttagccagaccagcaagaacgcttagaaaacctcgagcagaagtgggccgcagcccacgggcatggaggttgcctgctgcgacgcaaccaagaaaaggccccccgcatccaccgagccggtttggaagaggagggatgacggatggcacagccaaggcgtgggatctctccgcggaaacgtcagatttggcagtgaatagaattactcacgcgagtggtcgccgcgttgaaactccggtcccgctgctgtcacggggaggccacgtacgtactgtcgatgttgtgcatgcacgaaccggctacagaaagggcaggcactggcagccgtgtagattgctgcgcgtatagcaaatctatgtacccggcggccagcccctctactcacgagattgaaccacaagcacgttgcgtaccagctgcaaacacggaaccgtgtgtccgtgcctgtgcttgttgtgacgacttttgaacctcagcatacatgcatctaccatagcaggccgcctccgctccgaatctaccacggggtaaaaaggcgggcacgcgaaacagcaggccacgccacgtcccccctctacaggaggccgcagggcaacaggtagggtacgtacacatgattgcgaccgaaaagctgtaggcaggctccaaatgcactgcacgcatcaagaggcgtgcaatcagcatcacattagcaatcgcatcgcataggattctcggcgcgcggggcctgcagcacgcccgtgaccgcgcgcgggcgaaggttcttcaccggacatgccaaacgcgccgcgacgacgctacaaacaaaccggcatcgcgtcccaactaacccttgcattgccgcctaaactaatgaaaatcgcgcgccccgattcgctgctactctcccccctactagtctagtctaggttaccgcagcggcgtgtcggtcatgacgacgattagtaaataaattatctagtacgtactactatacactcgctcccagcaggcaccacacgggcacacgcaccgtacgtttacgtgtcagctcaactgtcctgtcctggccaggagaccgcttagcccttaaaacctttgcaggaattcccgaggacgatgcttaaaacctttgcagcaacagcacagctagcataccctcctccccacgtacgtttcgcggcagtcggaggctcggagcgaagcagagattctctccgggtctcggctcggaggccggaaaacgaccgagatcttaattaactggttattagctctccaacctctccgacgttaaccctgctggtccacctcacgatgaaaccttccttgactaggcaggcattcacaacaacaaagccatgccatgcaagcgatctctgtgtcccaacaaccacggcatgcagcagcttccttcctccaataattctcgccttttcgcgctttgcctttccagggaacaattgtacttgcgatcaatccatcttttttccttgacgcccgccatgcatctcatcatcatctttcgtcagatcacggacagcacacgagacaaaagtggaggctagctgctgatcggatcgcgcggccggccggcggggcagtggtagtggtagtgcgcatcattccggccctgctgccttttcccggccctttccttccaagaatcattggacaagatcgtgagagctagctagcttttacgcccggcaagcagctgtctctgtcggccggccacgcctgttagcctcgccgccgtcgccgttgctgtcaataactaacgcaacgctgctgcagcagcagcaggccaggtacggacggcttccgacaataattctctctcgatcggtgaccaccgcggccgccacaacagaaggcgtccacgaggaaagccaaatcttccacaaatgcgtgcctgccgcgcgcgcacaggaaatctagcagttaggcccaaacattccgttgctgactgactggtgctgacaggcgtatgtaccaccaactaccaatggagagtagtatgaatataacgaagaatatatatccacagctttgacccttattttacttgtttt

SEQ ID NO: 2139 - DNA, 1629 bp, Zea mays
  misc_feature (1)..(100): optimal_loci_55920_G1, chr2:22073805..22075433, Cluster 12
acatagtctcctggaccacaccaaaacttactcatcgggttgctatggatgcacgagaagtagacaacaataaccatttccaggtgttgatggattcgccgtgtcaaaaccacggcttttctacttcaattcgaactttttaacgggtgcaccaattagtaaattggtatcctttcaaatatattgatgtaggttctgtgcagcactgtttttcatccgtcattcttaattttgaacatgccaatatcatatttctcatcaaagccaaatcatactagtagtacgtcaggtgatgtgcaccgcttatttgcgaaataataatgtcttgattgctttatagttttatattaaaaaaattaatataactgatggaacaattcatatatatatagctctttgctgtctatatacgtaccgataattgttgctactataagcttctaattttatgcttatgcgtatgatttagacacgtgaacattaaccttagtacattggcatattgccatgtctttgtcacacgtagaacttaagaccctcctaattcctaaacttcggtcattgatcctaagtcagttacaatttgagccggcttgacagtggttagatgtcaggcatttcgtctctctctttctgccatcccgcttcttggagattgcaagagacgacgccctctcggaaccggatgactgcaggatctatgtctactctcagctgtggatccctgtgaggtgctgccgcccgtatgggatcatctatgcctgctcggctcgcgctccgtcgctttctaaagttgtggtcgacgactgttcgtcggatccgatactctcccattcccaaggctgtgaacaatcgttttttggtgttgtctccttccaagaatccacgcaacagcttgattccggttctgatacagtcgcccaaaagatcttcgttccactgtaccaggttacagcctcaacgagatatgggacgtgggttacattacgttacatagtagggggggaaaacttgcagataaattggtgattttacgatgtatagtatagtatagtacagtgctcgcgaacgtagggcttgaggagttgagctgtgttttcagcaatacctgaacctgacgtctcgagcctgtttgttgccattaatcgatagttccagttcatgttcatcggcgtgatgtgtcgcgcaatagctcggctgcgttatctcatctttggaccaaagctaactggtgggtgagcgtgataatccactcagcccgcgagatacgacgaaatgctcaaatgcggcaacaaagctagaagaggacgcccccaaaggccaccgagctttttttcgcccctccccaccgtttgccggaaacgtctatcttcttcctagtggaggatggggtcaaaagcctcgcgcggtgacagttcatggtgcgcgcggcctttcgctctgtcctcaacggatcaacggaggtgtgctgcacctgcacttgcgcggagggaattgacggcggtgggcgattggttctactttaaggctaacttgggagttataaacccggagcgaattggatgagaataggaatttagtctctctgaactcttcggttttgtggcttacaaactaaccccttagatg

SEQ ID NO: 2140 - DNA, 1726 bp, Zea mays
  misc_feature (1)..(100): optimal_loci_56005_G1, chr2:22709293..22711018, Cluster 12
taagttttgagctagaagcttaatgctgttagagacaccagatctgcatcagatggattacaaaaactgtagcaaggcaatatgcgagcatccaaaaccacactatagaggctactagctagggcgctaggcgtggtcctctcagtgtgacatgcacgcccttccctcgcacgcaagaatgagagctgtggcttttgtcgtcagctcatactcatacatacagagtgcatgatgttgcaacaagaccaatccgccgatcgacgatgcttgcacatatttcaccacgtgcgtgtgcaacagctagacgtacgacgatctggcagagatgaagaacccaatagctaggtctgtggatctgtcgtccccggcccaccggctacagtacaaaagctgcgtgctttgctctctttgttgccttgagctcgaggtcattagctaggagccttagctttccatccgaaaaaaagggggttgtttggtagtcgacacgtacactactaccttggcacaaacataaacataaactagcagggggggttacgttgtgggcgtacgtgtgggacagagatggcgatgtccggagcaagctagcgcgcggcggcatcggcgccggggcgatcggacatcggagctagctcgcatgctttgggaatacacaaagagagctatagctggtcgaacaagtggacgggataggagatgctggtgcctttttatcggccggccccgatagcgacgcattctaggatgtttatttgggtggacagcagttgtgtgcttaattgcgctaggggtggtgcggtgcatcttcttgggggagaagtgaagcaaaaggactgtgcgacacgccgcatcatcttggccgtctgccgacgtcattctctgggcccacattttctctcgacgataatggggtctcttgatcagtcaggtgaatatatgtagtagcttctgattaactatagacatttgctgttaaacaaaaggtgcaacgacggctgtgagcaggcatatatatacagtgagccagtgtgtcagtctctgtaaattaacaaaaggcggcggcgaagaattgaacaagcaagcgtgaggcagtattggtcaaaaaagtttgagggcgcgtgctgatttctgtgcgcgcgcgtctcctgcacactcgagtatactactggtactcctgtagcaaggcatgcatgcatatgcagcatgtgcctgaccttgttggtacggtccatcagttgtcgcccggcccgcgccgtttgcagcaacaacaaaggtgcacgtaaagaacacactcgacaagtcgacagttagagtgctgaggctcatcaagacacgcagcactttaattttacgggaccagggccaggaccagaaacaataatgtgtcgtgtcgcgcgacaaaccgtttgtactacacgaaggatcgatccatactgcatgtgagtaaccctgctagacttgtcagattcgaacccggccccggctcgagtgtgtggacgtgcatgcagcactgcgccttcggtgtacacatgcataatatcagtgcagcacacatggacaagacacacggcatcatatcagtgtctcccagtctagcaccatcgtcatcgagacgccgtgccggccaggctgccggaactccttgcatatccacttgcatgcagaactgaacatcatgcgatggatcgcctcctgcacgcatttttaaccgaccaaccggact

SEQ ID NO: 2141 - DNA, 1741 bp, Zea mays
  misc_feature (1)..(100): optimal_loci_56068_G1, chr2:22985347..22987087, Cluster 12
gtttttagtagctaactattagtcgtggaggttccaaacatggccttagttaattgtaaagcacagatagcatttctccgatttttgcgatacccgaatccatcatcatggcattgtggttgtttgccattatcttatttaaagggaaggaaccatcggggccctattaaaactataaattcagtttcttgattcttgacagtgtcaccttatgagaatcatggccctgtctacctcgcgtcctaggccgaccagttctttccagtgtggccaattgtgctgaaccaacgaataaagcatgacacataatgcacatgctttcggtttcgcagtgatgaaagaactctgatgggccatcaagcccttctctatctctctctctctctctctttctcagctgctttggactaacgggacagccgttatttgggggttcttctgaacctgtccgtgtattgtcatttgcaagctttccagcaaacaatatccgattaacttgcacaaggaaaccttgccgctacgacgcagaacctcgtcgccctttccatacaatcttccgccacatcgaccggcggaagccgcacagattttgcatgcatcgaacactttctcgactaggatttttggtgtaaaacgtgaacgtgacgattgtcaacccccctttttgactggaaagaccttacataatctcgtgaggaaagaggaggcaaaaaataaatgaagctgagaaaaaaggggtcttcgcctgatcgccgtaagaaatctcaggaacgcgcacgagagggcaccgactcagtcagtcgtttcacaactgcaaatgaggcggagatcacttggcgcaagtgaagctgaaagcactggctggttgcgtgaccaagatgtcaacctgaaagcactgacctatccatgaatcgtatgcctgtgttcaattcaatgaaccaccgtctcgtgaactattgcagtccggcatgtcgatcgaggaactcttgtctgtggagagagaatccgccgctccaacctgtgaaccactggattctgaggacctgtccttttttcagacaacatatagcgtgttcagtactatatatatgaatacacagaagtctgttttttcagacaacacataacagttttttagcacgcgcatttcaggaacgtaggtagctgagacaatgttagccacagctaaaaaagattccgtttatgttgctttgctgtcgacagaatctccagcagcaatgcatgcgtagtcatgcataaagacccggctgtaccgggaataatgcaagcccacccgggcagccgtgtactccaggtggcttggctcatactactgatataaacatcaccctccagatcatagcgcccatccctccatctgtaaaaccctagcctgaagataaagaatgcacacatctttctttatcaaggaaaagcaaaatgcaacccccctcaggcacacggaaactgcgcagattataaacatcgtgctgtcaccaccacccaccaggacggcagaaagagctgggtaacgagaagaaaatcgccgcaaggcacccggggacgaagttgggggcaaggtggtggtgatggcacgcaggtagtcgaaaaattccaagtggctgcaacgtctgcagcgtatcggcacggatcgttggccgaagctaaccgattaaaagcatgcatgtgagtactaggagtgctagtttagaaggcataaaatcggagtagattgaatagg

SEQ ID NO: 2142 - DNA, 5187 bp, Zea mays
  misc_feature (1)..(100): optimal_loci_56176_G1, chr2:23715362..23720548, Cluster 12
tagccaaacaaatccctgagagttgatctccagcatccaagaacacacatgcttgagtctcgtgctgatcgacaaagtcagcaccagctacatatatggcttttgctaatactgccagcgtgtccactacttatgaaatcccctctcgcgcacatgacagaggaggggaatacaatattcgaaaagcaaaagctccaacgtgctatagctacatacaactaactatacagtgtgctgctttttagctcttagccacggaatctctcgcacgtaaatttatgcgcacatgagttttgactaactaaaaggtggtggacgatagatgtgacatcgccgtactaactgttagtgcgcatcagatgtaaatgcctaatcttttccagtctaatcccactggcacacggtgcccccgtgaacaagagttgtggcgcaagggacgaagactggataagatagaggactccgtggttgattaattaactaaccgacgaagcaagctaactctatcaatgctgctgctgctgctgctaacagctactgcatgttgacgaaaggccgctgtactggaggaggaggaggaggaggaggaggagtggccctgcttgctagcggtggcaggctgcgggggaaagcctagagccgtagccgcataggtggagggtggtaccggctggaaaagcctgaaaaagccgtcgccgaaaacatgtgtccccatcaatgcatacgctgtccaagtgccgacggggtggtggatggatgtgtggtgtggtgtggccacgcgcgcgcgtatatggaacgacgcgagcacacccacacacaaacctactactgctagtacaaaggcatgccaaggtggctgccgcatgacctgttgccatctccaaacagtcccagcagagcagagccctgagatgatgagagtgcctgcctgccttctccaaacgacacatgagccctgagagtgcatgccgggcgagcgggccgccccgtgccttcttgtatgaacgccgggaaatccaagctgcgtgcggtgcagtgcagcagggtgtacggtgctgttcaccggacgacgagcgatccgcgattagccgacagatctctcagtaacgcctctgctgcggcaccgacgacgaatgcatgcatgggcgacaaatccccaaagtgcaaagcctgaacagaacgccacagtgcgcccgcactgttcgaccgcgctgtgatgcatgaacgcacgcaggcagcccacagaccacagtgtcgctctcgaggggtgcttgctttgtttgtctgataaaaaaaggctatactactcgtcctacgatcgttttcagagctagctctctctctctttgtaagcagccgttagtgagtgaggctcgtgggcggcgctccggccgcagctgcaggggcgtgcctctgcctgcctgtgccttcggaagaaccggccggggcgattcgattgtcccgggacggggaggcacatgcaacgcccccgccgatccgatccccacagcaccaccctctcggccactccccagcgtcactgtcagggcggcacgcaggcacaccgccgcaccggttttgctgttgcgtgccagtgcgcgcgctgtgctagctcgtgtcgtgacgcctatggtcgtgtcgtgtagaaaagcctgccgccgtcgacggcgatgcttctgtcgtcgcgcgcctgcaagtgtgtgcgtccttttgacaatttatttactgcgagcctattttgtttctgcccttttgacgaagtgggagcgtgaagcctagcttccgccgtatgtgacacggacagttcgtcgctagttttcttttcttttctttttacacaagaccagaagcgcgtatttaacgacgcgaatctcgctcgctcgctcgctcgggaccatgcacgcaccatgctctactgtaggcaggcatattgcaccatgcagttctggcacaccctagctccactgcaggggcccggccgggacgggatagacatgccgctctcaccaccctcgcttggtatggtaatataattaatggatgtcctcgtcgtttgtgcccccgaccaaatcatgggcctcacaccacccctcccccggcagaacgttggttaggcacccgcgcgacgcgtgccggcgctgttcgctctttgtccagactccacagacaccacgaacgtgccgcctgctgccgccgccgccgccgcgagcgcggtttcctggtcgctgccgatccgatcccatccgtgcactgcactcgctcgcgcgcgcgcgcgcggcgtggccactcgatggacaacaagggctactacatcgatcatgttagggcgtgcggccttccggctatgcacgttggcatgcacgttgctgctggccaagaacgcgctcgtagtaccccgctatgcttttatcaatctctcgacgtacgtcctgcgctcggttcctagctagcttagcccttagctatcgagctaggccacccgcgcaccagctgcctgccagccggcggtttcaccaaccgtgtgcatgtgtgtatagaccaaagggagagatcaacgggcatcggacagggctttagtttagggtttatatatatgtgatagggacagtagggcacgcgttggctataagttagggattagttggaccatgcatgaggcaagccggccggccacacacgcgtacgtacgaaaggaatctgggaagaacatggcgcgcgcccggtcggtgcgcgtgacggagctagtagctcgaatgctcgatcgatatgcatcgacctttagcatctccaatagtattcaaaaaataattatttccaaagctttttaagtcatcaaaaatattaaaagaaccaaacgagggttatttgttcactggttttcaaaagggaaaaaaacttctgacaaaaatatcattgacttgaatcttgtcacgccacactctcgtttgcacggttaaaaaatgttgtcacgccaacgagagtagcatgaccagattattctgcacgtcaaaaacactgtccaagcttaggtggtagatgtttgccgtgtcatcgatcgcatctggcacgataatgtgatttttttctcgcgctagctgcactagcgcgaccaaaaagttcgaatccacaaaaaggatgcaggagctactactatattacaatattaaataaaaataattaaagtaaaatagttacgggaacaaactaggttataaacataataaagaaacattttcagaatagtgtctaataactatataaaaaactattacaatattagatttgttctgtagaatgctagctatacacagaggtctcgtgtatacttttgtaattttctaagaaactatagtgataagttttgttttaataaaaggtgtgcgcatagcctgttgtaactttctaagaaattggtggaaaagtcttgtcccgcaaaatattatatataaaagttatgcgggtaacttttcaactttctaaaaaaaactatgatgataaattttattccgcaaaaatattatacataaaagttatgtgcgtaactttgcaactttcttctaaaagattatggtgacaagttttgattcataaaatatatttttctgaccaaaatcagcgtaagatggaccgctgcctaacctttgtaactttagaagaaaaaaagttgtggaaatatattatttaaatttttttgaggaattggaagtaaggcagaaccgatcgccggttttagaaccactcagtgatcattcgctgattataagcactgttcaaaaggctccgagcctctgacttccgcccggaagacctgtcgtttcgccgtcaagtgcttcttcctgctgggcgctggctctgctctggcttttccgcggctatctggtcgatccacagattccacactcaccggtgatcgactagcgctggcactcggctactactccgtgacactgtgctacccagtttgatcggcgtcaggaaagaaccgggtacagtacgtcctcgagggagggagggaggaaggacagaaggagcaccgtcactgtggcacatcatatggaacgcagagggcagagagaggcacagcccacagacactactggctaccgctaggcaggccgtggtggaccggagcgcctccaccgcattattgtacccatcagggatcacgtaccgcgctcataaaaggtaacaacggacggacggacggacggatccatcggccggccattcagtcgatcggccacaccagttctgccaatagaattccagatccgcggacgcccgaggccccaacgcacgccgctgcgcgaccagatcatccggcatgacatattgccgtgggctcgcgccgtacgcgtaccacggccggcgcccacagcggcggtacggcggcgcgctgccgctgccaccccgaacaatcgtgcgcgcgtcggcggcatggtgtgcactccgcagccgcactcgcacggcatggagaggcacgcctgacggcccagccgcgcgcgccgagatgcgcctctgcaattctgcatgcgtggtggaagagcgagccatcgagaccgaatgctgggagcgctgcggcctgcgtgcaccgagcgcgtcccgcgtcccgtggaccgggcatacgcgtaggtgctacactgctacccccacgccggcggcagggcagtgtgcgcatcgatcgcattaacgccggcggccggggcggccacggccagaagtggtcgctctaaaacgttgcctttaactcggatcctaggcgtagactctacacgagagcggacccagaattttggcacgtctttaagcttctgtactgctgctctgttctggtgctgcatgaccatgcatgagctacgtatatagtactagtatgtacaggctttagctcgcccgtgaatcagacgaaaaaaagagaacggcgcgtgagtacggtactagcaagtgtatatacggtccgctgtccgctccatgcacggatggatgtccattattgagaaaaatcggtgctgcagagtcggatcgtcgtcacatgcgccaggtccaggtgtgtcacacagtgcacgtacttcgtacaagatgatttgcacatacgtacgtgtacatcacgagcacgagacagcgttaacgttatgtcggttgtgacactttggataattgagctccgtaaaagtctgaaccactaat

SEQ ID NO: 2143 - DNA, 1833 bp, Zea mays
  misc_feature (1)..(100): optimal_loci_59397_G1, chr2:42630147..42631979, Cluster 12
aaaaaaaaaaaaaaaaaactcgcttgctcggctgtcaagtctattcggcagggatctctctcgattcgaaaataattgcactttagaaacttaaatcctatcgcataataatgagaacatgaagattatggcctacctgtagctgtatgctactagtaatacttcatagtctctgttttttttttcagaacgtaatcgtcgtatgttggttatttttttataattttacagcagcattgctcttttcatcacacatggtcgaccattatttatgtcggaacattgtgagtactcgatttctcaccttttttcagcataaaaaaaatcgtcgagctccaagctcctatagtaatgtacagtcctacggacatcccagatacgacaaagtggtatgcggttgcgagaacggcagatctgagatctgctcggcgggtaaattttttttttctattaggctgcctgtgtttgtcagtggccccatcctgagctccccccccatcgctttcgcccaaaagctagtgtcgggctcagtggcagggcggggaccaccctccgccgtggcgacatggccaacctacggtcctccggctccggtcgtacacaggctgatcactcgcggggcccccgaccgagtcgttgtgttgcgcggctgccgcagtccgtatgccgtgcacatgccgcgcgcccgagctggctgccttgccttgccttgccttgcctctcgccgcgcgcgggctgggctgggcatgcatgggatggatgagcgcctgagccgcgctcgcgagtcgtcagctcgttttgagccgcacacctggacgcgttggggttggggcgtcgttcgccagtctccttctacaccgtccgttcggatttcaggatttgcccacttgcggtgggcgggccgaggcacacttgtcgccgtcccacgggtgacggggccgcgcacctccgatttttattttttttacgctgccgttggcgcgccccgcgccctcccggcatccctcccagaccggcagcggcaggcatggccgacaggtctttcggccccagccgtcatccacctccgtgcgtcgtattcgaggtagccagcctcgggtgtcccgaggacctcacgtccgccgggcctctacgaggacgacacgtagcgcgccgccattcgctggccggtgggctgcgcgcgcaggaaccggagcccacccgcgcgggtaggtgatacgagacgagagaccgtgacagtctgttcactggtggccgcgggaaggtgacgtcggcggccgtagggcgggcgtgtggcgcggcagcttgctggcgcgagcgaccacggggccgcgccgacgcagcgcagaaccacaggtccacagccacagacaggcacaggcccccactatttgccctagtattggctactgctggcaagttgccgaaaaccgtggagccgcggagttaggtggtacagtacctacgcaagcaacaggccagcgaaagcacgacgtcgacgttttttttttggagctttgccgtagcgagcttgcgttggcaaccgttaacggttactgtagaccagtagttcagtactaccacctcggactctcgttttgctgatatgggggacggagatgacaagggtcggtactcgatggcttcgtgcggccgtgcgggacaatcgcgcggcgcgttttgccccacatcgtgtcgacgttgcgttcgtcacgcggggaaggccgttctgtgcatatcttgggcgttttggtccccgcgatacatgcttgcgtctcggatgagaactctactacaccacacacacacacaaggaaacctctgctcaccaac

SEQ ID NO: 2144 - DNA, 3070 bp, Zea mays
  misc_feature (1)..(100): optimal_loci_59704_G1, chr2:44373552..44376621, Cluster 12
gttgttgcagatgttgctctatttctagacagcagcgttgatgaagccgtgatctcgttggagcccgtctcgcagaaccaaggcccatgggctagaaggatggagagagagacccaggccttggctggctcgtgggtttgctactccgttctttcgtgggcgcatgtgggtcagtttgggttcgtctccgaagttccttttcgtgcagcatgaccgtccgagacatgggtttcgctcggttgctcctgctaccactaccaggtgtccaggtgaggtggcattctctccgctgcaccgacaactgttggtggtgctggtgcgccgcgccgtgccgtgccgcatcaagatcgaagaaattcagcccacctgcaggctgcaccagctggcttttccccgaggtcctgggcactggcatccgatcgtgatcgagccgctgagtgctggccgggcgtgcgcgagttgtttgcttacatagttatccttatccctgtctcgtgtgacggaagccgtgacactaggcaggtcgtcagggtcgatcgccgtagcagcccccggcggccggcggtgacggagggccctctcccggccctaccttttcggcagcgacatgcggccaaatcagctactgctagcaccaacacacggtgccacgtcagcagcgagactcgcgttaaggaataaataatcgtgtgggctgacgaagagaccgacggcccgtgacccgtgttccaccagccgccaccaccacccgtggcctcaaactcgtgccatttcccccctgtgctgattctctcctcctgtgtcaagggccggggcatctgttggttattattaatgttctgctggcaataatttgttgagctccaatccaactgctgcttggatggacgccaatggatcttgggataacgacgccccgccccgccccgccccgccctctggaattctttaacgcctggaggatcgaggcgtgtagagtgcgcagcaaggcaacctcgtcaaaatcatccgaggcgcgcagcccacgactgcctgcctggctgccgtctccatggtctcagcttctgactcgcgtacgcgcgtcaaacagagggattttttttaaaaaaaaataagggtgggggtgggatcgtatccgacggggggcgaatcatcagcagatgtttccctactgcgtggaagcttctccgttcttccccctgcctggccgtgagctgtgacaggagcaacgagcgaagcgtttatcggccggggctcattatcctctgtgatgtcgatgccggcagtttattattttttatccggagctagctgactgatctggttaggcttacgcttacgcatcgttagttttccttcgtctagaagactagaacgggtgcggtgacgccgttggatcttgacttcaacggagagagttgggacaaaaaaagggaggaggatgtcgccggtaggtaatatagcgcatgtgagtatctgagatgtgacgatcacataatttgatgtctcagactctcagtagcgggcttttctttgatgatgaatgaggtgttgttacttgccgtcgaacaattattacacgtctagaacaaaataatctatacacaccgaggctccaactggcattggttcctctagtaaaatctatgcaacctcgtgactcctacgtgagcaaaagtataataacaggctgtaaacatgctaaatactgagatagacaagatagaagaaaaaagaggaaagaatcggactgtatacgactatacgtacagtcgatttagacagcagaaccaagaaactttgtcactgagagaagactatatacattagctaagtgatagactgcaaaaaaaatccttgctgtcagcgagagtcggctgtgctatgaaccatgctgtcaggagtcagatttctcgactgcgctacaccctctgttttaaaagaaatgtacttttacaaatcgagagagaattctcataagaatatcaatactaccggtaaaaaaaaatttatgcacacatctgtaatgcaatacaactattctatcttaaaaaggagagaaagtagaaaaaggacgactaggtttacgctgtcgaaaatttttgaactcgccacggatggagagcccggcaggtggaatgcaggtacagccggacggtcagtcacgcagcatgttccaagccagccgcagtggtcggagccaagagtggccacgcacgtgtcggccgcctgtggttgtggggggaaaggccgtagcaggacgcctggtctgcacgagcaccactggatgtctggatacagccagcagcacctgggagcggaagcggagcagcggaggctgaccacaaccatgatgagaggccaggccaggaaccaagggaagcggacaaggacgcggggtggcgagccggacgggccgccgtcgccgccagtgcgcagcggggtccgggctgcgcgcggaaatgacaaggcaaccactccctattatatactactattcaataggtcgtcatctcacgattatgcagagtattattttacatagtatagattgaaatagagagtaagataataaacctgccgaagataatctaacgagacagggcgctattggttgatgaaatggtgagggcattctgctagcagcgcctagcgactgcgcagggtagttcgggcgatgtatttgaatatttgacgggttgacggttgatctaagggcatgtttggtttcttgaccaactatatatttaagaattaatcttacataaaaaaagattacacaaaataaaactacacgaagtatggcaaaaatatagaagaaaaagaatgtacgaatcgcaaaggtcccactagtattgggtactgggcaattttggcgacatcgcgcgccagagctgccgcaacagctggcataaaacgactagctagagaagtgatggtgtgtggtactctagactttgacagcacacgggacgaagtagcttcttcgtaccacattctacgtatatttaagtttatgtatagtcaaggtatcagttcattattagtggtaaatatacgcgcattgatt

SEQ ID NO: 2145 - DNA, 2157 bp, Zea mays
  misc_feature (1)..(100): optimal_loci_6095_G1, chr1:30682442..30684598, Cluster 12
cgcaacgcaagggaacttggacccttttctccatgcggatcgctgctcctctgcacgcggcagccgcgcgcgtgcaggtgtagaggaggcaggcaggcgctgcactggagcgtggtgcatggtgtacagttgtttgttctgatcggctttggctcggtctgagcatgatggaaacgcgtttccaatgataaggtgttggaagtcaacagcacaaccagagagttccatgctaaacgagttagttctctttcctcggtcactcgcccccatgacgcgtgcatccatcctctctggtggtgctgtagctgtagcacgagcatgagcacgaggccgcctaaccaaccattactgctccacgacctgacgggttgatcccatccgcagatctagctgacggacaggcccggatggaacctaacgagatgaccgaccgaccgatggatgcatggaggagaagctgacacaggccgcggtgcgggcaaagcaagttgcgcgcgaggtggccgcggagcactagttaacaaagttgccgctatgcgtcggtcgcatggctccccatatccgcgtcgctctctccgggtccgggccgggcgcgtcgccgtcacgcgcgcacgcactcggtgacgcacgcacgtgagctaggtgagaccggaccggaccggacacgccggcgcgtcgcgcgcatttctttttccctccctgtccctgcccaaccgtgcgcgcgagcacgcgccgagccagatcctccctcccgcgccgcgcgggaggggggtccagtccaggccagcaggacgagtgcgcggcgtgccagcgaatgaacaggcgcggcgaccccgacgtgtgcgccggcgaaagcgacgcggcagcagcccctccctccgtctccacggagggggtcagggagggagggcgcttggccacgccacgccacgccggccgtacggctcggggctcacgacgtccctgtcccgggccagatcgggggggtatcaaatcgaggaggctgcagatcttgcggaggcatggcagcgcctttagccccgtatgagccagccgagagctacgtaccggacctgcgaatcattgggctctctggggggccctctcgtggtgtccaagtccaagctccgtccacaattaaggccgggcgctgtgcatagctgtagcatacggtggagatcacccaacgacggcggacgggtcggattggctgcaacttaactggtaagtacgtacagtggcacagtggacgcgtacgtgattgagcgatcgcgcgcgctgggccgggggcctgggcctctgtgtccactggtacgttgggagcttggggaggagcggtctcttcgatctcgtcgaacctctctcgatccacctacaggcagggactgtgccggtcctcgcgccagttttgttccttgcattggcacactgtccactgttccatcggaggggcgatcgtgaacctccactaatcatggtacttgcacagaaattttgcggacaaaatgccagaaatctgccgacatggactcaggctcgatcggacgacctcggacccaaattctgtaccttttaattcttctccagcaagctaaggtttaagagtaacgataacgtagagaaaacacagtgctaataatacttggttttccttaaattgtagaccgcaaggtccatgctgattgctcactagctagttctgttccaaggctccaaacagctggtggaactttgttgtcgctctttttttttgttcttgcttcggttatctagtctcgagtctccacgacgggctttaatttcctcgcctgcactgttcgcctttgcttctccgcgtctccctccctagatacatgcatgcatattctatactccgtgcagcatgcatgattacacagtgcctgtactattgcactaaaaattgcgcatggacatcgagaaaaaagctcgcacagtgccatgcgtagggaggacgatggccgacgaacggaaagcctttgagtggaaaagggaggcatgcatgcatatggatggcacacatctttattcgcatcatttcctatgaccggaccccatgcacggtcgtacgtccttggcccttgcgacgatgcttacctcccaccctacatacatacgatcgtataggctgcacaattc

SEQ ID NO: 2146 - DNA, 1743 bp, Zea mays
  misc_feature (1)..(100): optimal_loci_62346_G1, chr2:58759048..58760790, Cluster 12
agtagctgcagcacttcatcaagaagaccgaccgaaggatgacaaagcaaaaacgggcaacggcgggcacagaggagtttgggtttggttccacttccacctccatccagctgctgtctgacgcctggtctgctgtgtgtctgctgccactctcggccgtgcgggggcatctctcccgcctgctctcggaccgacgctccatctctcattcgtcaatccattccggtgccgactggctctgaagggttcaattagctagcttctgattctgagcagttccttccaccggcacgagcacatttcatggagtttgctgctaggcttggcatttctagattagatcccaagctgagagattaatgcgagccataatccggccgtggtcccgcatttgccggtgagtcggtgaccgtaccaggggggacgggacttggattcgcaacacacacgacacaacggtttttgaagcgcctcccattcgcaagacctagctctttcggcttacctcattggcagcaggtgcggctgcaaaggagtcacagccaacagaacccgaaattagcttggtgacacaattgctatgcggccttcatttatggctttgtctatctatgaatataatcatggtagctcatgctcgctgcctgcttcatcggtcgtcgtcagcaaggcaggagcttgatggagtagcagacgagagttgctgctataatagtggttctgtgagtacgttctgtactgcactggcattcaattaccatgtcagttgccgcaagcttctggtacataacatacggcggcagattggtcgtccttgccgagaggtagacgatgggactgactactgacagacatgatacgagttaccgggcgggcagagaggtccgagccatgagcccatgagaccatgcttccgtgcttgcatgccatgagtagtgccgggtcatggtcctgcagctagctagctaggcaagatcgctgtgcatgcttcaaggtggacgacggggatggaaatgcaggagagccggcgaggcgctacagcaaaagaattgcatgacatacacagtatacgagttttgggcgcactgtacgaaggttttacagaagtgcagtatcagcgaatagcgtacgcacgcacatgcatgcagcagcatatagagcgtaaaaataaaagattgcaatttgcgaatgccataattaaactgatgtcgcacaggacacagtcataaactgatgttataaagccagttataactgatgttgcagaggacacaaggtacattagcactacggcgtagcagtttacggctgaaacgccgtaccagtaccaaagagactgtaacaatcaccaagcaattgtacagaaatgaaactaggatctaggatgggatagcaatatttgggaggaatgttcagagttggaggaaaaacatgagacacggctgaccccgtggggaagaacagttcattagaaggggaatccgaagtttcgttctactgtctcctcatacaaccgataggtctgtatcagggttaaaaaaaccgggaacagttttacaccagttttttttctgcaaatttcgttgggaattcaaaaacaatgaaaacacatttataaaaatcgggaaaaggtatgataaaagactaaatatttttctagcatatctttttttagaaaaagtaatcaacattttttggttaaaaacaataaaaaccagtgaaaagcgaaaaccaccgaaaaat

SEQ ID NO: 2147 - DNA, 1758 bp, Zea mays
  misc_feature (1)..(100): optimal_loci_6803_G1, chr1:34933362..34935119, Cluster 12
gacaatgggtctagccaactgaataaggtcaagccagacaatatgtagccttaatcctacctttcaactctagaccgacctttgagagttattttccaccatcctttttcctcctcctctcatttctcctatggttccacacacctccccagttggaccgtgaagtataataaattgcgtagttacaagagcatcaccatttttccttaaaaaacagaaacttgcctcagaatttcacagaactatgcatctcttttgatatgcccgaatatggttttagagtatagacgtagtgccgtttagaacgctggttcgtcaggaccacagattcatgcaaaaagagccaccctagtactaacagaagtcacacattttaaaaacgaatttccatcgattggtgaatggcgaatacctggcattccctggccttcagcgtttccgaaaagccaaagccagattcatagccgacaaataaacaagctggcctccgaaaagccatagatcttccggatttcctcacccaaattaagcccaaagcgagccctatccaagctaggataagaacaagcatgccgactctaacatagacatgctgaactgttttggtacagtttcagatacccaccgtgtgcagtgcagataatgctgaactgacgtttaacgataaaatatgatcttgtcacataaaaactggagggtccgaccttaaactaaacatgatcagtaacaattatgtaagtggggaaagctaattaagtagatgagctagcagaccagagctcgaggatgctgaaagtgtcaacttagcttgtagcaaagatcggtatgtagatgtagcatatgagttccctccaccgattgagcccaagaggctcctcgttgataaatagccgaataggcaatcgtgctgttgagccaaccccgcccatggattaagtggatttgagctacaacaatcgggtcacgcattacccacaatttttttttgttgcttaaaatctgaccccaatatggaaaacccataagaaacttgacctgacccgtccaatgggtagggtctttttccgcgtatgccatttttctccattaccgggtagcagatggcaagacatgtcactagctaggtcgcgagcacgagagtgtgctttggtaccctcgacttcatcaccaccatcgaggggatgttggcgtaggtggagactttcttgcagccatgtcaccaactttgacaccatcactgaggcgcttgggtaactacagctccacacctcggagacccaagcttccgggagcaagtggctcctggacctgaacagtgagtgcatgtggcgccaagttcacgcttttatgggaccccgactgtcctaggaggacatgtgcctcatccaagtctcgctcgccaatgcgtgagcacaactctccgactgagcaccgctctcctcgaaggtccttacgggaagcgtcccagcgctaccgcacggtatgccaactcccacgaacatcgagttcgtgtcagcggccaactatgtgtcggagtcgatcctcaaccttcttatggaagaattgggatcctctaacacgaactcaagtgaaaggatccatcactcctcacgcgaatgctttatgaccgaatcacgagatggcaatgtcactcccacggacggatcctagctgcagctgaaccggatgcaggagcgacaaagggagctcgatgacgcgcgctgccaaattgagcaatagcgcgtgaaactcgagcgt

SEQ ID NO: 2148 - DNA, 1860 bp, Zea mays
  misc_feature (1)..(100): optimal_loci_6806_G1, chr1:34951540..34953399, Cluster 12
ctacttccacagagtatactaatagtccgtctgtcacttcacgcttcggcgccagcttgtctggctatacgatcgatgctctgtaacagtagcagccagtctgatcgagagatttcctgtggacatgcccccccccccccccccctccccgggatgttgtacttgcgcagggtttttctttcaccgcctcgcatgcgggaagcggaataaaaatcagggaatcttgccgtccaaacccaacagaaaatggagggagcaagctgcgcgtgcgccatgcaagctgcaggcagggtggcgatcacggaacggaatctcgagggctggacggcgccgggagatactactaccatgcattgtccaggcatcatccattattcgtccatgcatgtccgagcgtaaattgggatgtgtgtttccaacgcgcggtaaatttggtgtgtcttttttagtcttatttggatatagtcaaatccgcatcattccacatatatgttattacagtggaacgtaaactaaattctatctcaattcaaccgcaacacatatggattcaggtacatttgacagtcacgacacgaaacacatacacttacgttggctacagtaattctcgtcggcttgcacaaaaacaataatttatgctcgttaaaacaataccaaagtaagttaatttaactttcgtcggtttccgacctagacggcggaatttagccatctttgatccgcattcgtgttgtcgtcgtcgtcgttgcctcgcggtctatgcaccgctgtgactgcagttgcacgtgcctcaaatgagctgtcacaggctcacagccctagatcgccaaactcaacactatgaacaattaacagttcagacatacaattcattctagcggcaaatgacgtcattaaaactaaactttgtgatgattataacataacaaattttgtagcttgttaatagtaagttctgccattgtgccgtcgcatccccgctacaggtgccgctctgccctcgcctcttcttctgacaagaaggtaacacgtgatcttaactatttaaattatgtgcatatagatattcaattccagtgtttcacccaacatagtttatgtatgagtgctgatggaagttatgcatgaataactcttgcttatggttacagcataattacaaacaaacagggcctaaaaggtttttgagctccttagagcttcggaacaccacataacaacaatgtctataagagccctataagggctactagttgggactggtaggttgcaccagctctggcgcagcacaatttccgtcctcgagttgtttagtcccgactcaaagctaggaagatgtaactgccagcaggtctaagttattagaagggaaaggacaagcgaacgagttcatgcatccaccacgccccttgaaagatgtcgtgtttggctttggtagacggggggcatcatttactagaattggggctttttacctgcttatccctgaagcctcacgttaggcggggaataaaagaattattagattgttcatgagtcttgacacgtacgcaccgcagtcagagcgaacgacgaccgaccaggcgagcattgtgatgcattgcaccattgtatatttttctatacacatgcatgccgcctctaacctagctatacaactcgatgcatctgcgttatgatcgatgatgcaccatcgtatatattccgcgcgcgtaccggaagaagttgacttcatcagagtcagactcagagttagaacgatactaacgcagagagtgtggtgtggtacacgtaggccggcattaccatgcaccatacatttatgctgcagagaatgaaatagacctcccaaagtaa

SEQ ID NO: 2149 - DNA, 2047 bp, Zea mays
  misc_feature (1)..(100): optimal_loci_6808_G1, chr1:34959480..34961526, Cluster 12
tagatccaggtgggtgagcgtggcttccaaggacggaattgaaacgagggcgtcgtcacttggcggccgcgcgcctcgacggctcggtatgggacgacggtccaccagcgcaagaaagctacgaactcagtccaaaaggcaaaaagcacagaaaaccacactactagctttgttgaattccatcgcgacgcccaaataagcaaatcattggcgacgggctcgtgcatgaacgcagtggggcgcggggcactgcactgcactgaaccacccaccccattaatatgcatgtccgatggatcccatcccatccagcgagaaggcaggcacggcgcgtctgccgttcacgtttacatgtcgtccggtcgctgcaggcgcgctgtatagcgagtgaggggaggcggcgcatggctaggaggactaggcgcacgaatcgcagcgcctgcggggcgccacgtcgccgcgaggtcccagcggccagcggcatggcatcggtcggtcggccggccgacgcgggagttgggcgagaatgcgagatgcgatgcgaatagaacttgggacgggagaaaaaaaaggtggcttggcttgccatgaccgggaggaatgcggaatgccattgccatgccagggggagcatgcatgcggacattacaagggaaaaaaaaaggctcgaaaaggggacgggggcgcgcacttttgctcgcttctatgcgagggaatgcatgcagtggagtggccgtatctatctactactactagtatcctctacttattaccacctttgtcttcgcctgctggctccctttttcgtcttcacagccgcccctaacgaagcacgcgcggcctcagattcgtgcgagtcagtgaaggaatatatgacgcggttccactcctgttacattacattactcgggagaggctgaggcgcgagcgagaggggggtgctgccaaactcacaatcgttgccacatgaatgctagcttgtaggatggcttgctatatgctgtatcggagatggggagcagcagggttgggttgggttgggtcagcccgcccgcccgccggaattgacagtcacccggtgccagagacgacgacagttggaatctgaacgtaccgttggaaaaacaaaaaaaaacttacagtacgtaccggttctagctgctcccagccactagactgtgagtaggaggagtgagaaacaaacaataaatcgcgccctcgactcacaaagtccagttcggatgcatggtttctgtccatcgacttcctaaaatacagattttcggattttcttatcacacggacgtacaggcgccgcgcagatgaggcgaggcctgtcgaaatccaggtgcatgcattgatgcatgtatgcatgcgccctatggatcgtcggatggagtcaaatagatcgtcggatggggcgggccggcaccgcgctttattccgggcgaagcgaaagagagcaagctcgcgctcgcgcgtgacgtgcactccgtttaacaacaaacgcggcacggaatggacgtctgcctcctgccctttctctctctctctatctcttttttctttcttctcagcccggaatgtcgtcgtcttttaccggcaccacattccgccgccttttggaccaatgcagtgcaggccgggctgcctttatatacctccgtctcggtcggtcctcatgctttaccacgtactactacgtcgtatgctattactcacctgtcatcatcacaaagtaatttcacaaggcccggcggcggcagcggggtgagggagggagtccgcggcggctcaggcaactggcgccggcatggtctgcgcgcccacatgggcttgcatagcaactagcccaagccgttttgaaggaaactggttaacaaattcagcaccgttaagcacgaggcatgcagcagcgccacgatctaccaataattcagcgcgcaattatgataagccgatcgacgacgacgactaatgcatccattctatattctatctagtactctctctctctctctggctgggatgcgctagctgctacctg

SEQ ID NO: 2150 - DNA, 3017 bp, Zea mays
  misc_feature (1)..(100): optimal_loci_7456_G1, chr1:38864112..38867128, Cluster 12
aacacacattgttgctggtaagcgaggacatagtgttagtatttttatgggcttgacccatataagtatttgattaaactttaaaggctcgtattaaataagatatgtattatgatttagaccttgtttgtcggttgttgaaaatagaatgaaagtgtgccacccacatgtgtgttgtcgttgccgccgagctgagccaagacgcagtgaggagtggcacggcacaatgcgatcacagtcacggagcgatgtagcatgcagttgttttgtcacttaggaaggcaaacaatcagagagttagagtgcgtagagagttatcaaaagtttctaatcctacctacgggtgttaaatgtttgctaatgggactgtattttgctatcatgagtctgcttggttctctgtcttcttatctccagcgcccgctcggttctcgcatttgtgatctattgtgttcgctcggttcctctggctcacctatataagctatatcttgtatttgtttcacttttctactattgtttcagctattagctaaccactctgtttcaggtattgcatgtacgagcactaggagagcatacctccaaaatgagtgtcatctaagaggtgacataatcgggtgaagggcgacaatcacatttcttgagagtgtttgtaagtggtactgactactcactttctcctccttttcctggtacgattgatgctccatcctctccttcccggcgcggtgatttggtggtgatatgcacaactgcatatctacactgcactagactaaaccaatcggacactatgtctatcactaggtatgttctaaccaataagattttagattaaagtcatgttagtcactattttttttatatgttctttatgtatagatcacacatgcacttttctaataccaccaaactattgttttttcttcttttttctaagttaaattgctactgaaaatatctaaatgtctaacacgtattactatttttactatatcatcgtactctatttgtatagtattgttttagttaaacataatagatatattagtacacatcgtatctagagcatcataggtctttttttaagaaaccggaggggcttacgtcgtccctagcgttgtaggctctgttgttcatagtgtttctcattttaacccaatggccgatggtttaggaaccaacgtagtcttgctgtcactttgtgcgtcatcctaggaaatttcgtgccgtataggtcaatgcagaaaaaaaaacaaacaaatcagtgtgaatccagagagagagagagagagagagagagagagagatttcggtgactagtggaagaaaaagaagaagaaaccagtgccaaatcagtcaactgcaaggcctacttcgcatacctgttgttaggttcagggaagaccaaagagcctataccattctaccagcagagacgtagacctccaactgctatttctccaccagtcaccagctgaggtagtacacggtaaactacttcatcagaagcttcgccacgcggttggcggttgctctctttctccgtctccccagcagcatcgggctgaccagaactcagtaaaactaaaccggggaatggtcgcctttttttttccttggcaaccaaggaccgataccctttttgccgaaactggtaccgtcgcaaagtcgcacggcggattttcctaacgcggccgtgattataattataatggcatcgcagtgaccggcccgcctttttctctctataaacgaccgaccgaccggccgaccatttccaataatttcggtggagtcaggagcctcgccactcgatggcagatgggagcacgaagaaatgaatcgccgtctccccccacgacgttcctttatttccttcctttccagcacgcgtcgccctcggcacaaatttccgccgcagactgtgcaggtgcagctagtatggttcacaaattcacctggttaacgaaatatccagctgggtataggacgccggacgggacaccccggtttggacttattggaagcctccctcggcatcccaatgtcacgcgcatcctctctgtcgctgctggctgctgctagactccgtagccatcttcctccttccgagctcgcaccggcgcggcgcattagagttagagaaggggtcgacgcggacggcctcgctttacagctcgaaagcgccgggcacgcccacgcgtgttttctaccgccgcagtgacagttaggcggcgcgctttattctgcgcacccaccgagccaagcgaccagacccgccggacccgatgattgggccgccgagccgatccggttggttgtgccgtgtgcgcgccaggacagtgctccgcgcctccgctacgctgacatctcttcggcacccgatgtggacggacacctgacctccctcgctggagctccagcccaacgcatcttgtgcgtgcgtgcgtcgttaggtggccctgtgccgctgtgtcgagctgagctactcgctcgccgttgcagtcgcgatggtaacatgccaaacaggaaacgccgtcgccgacactcacctcacgggcagggcacgccccctgtcctctttttttcggccagaacgattctgtccaggcgtagagactagagacgtgctagagtcgctccagaattcaactttgtttccgttttgtttgtttggtttttttttatttttatttcgtttgacctgtgtacgccggctggatcatacccgttctgtcatcatctgccaaactccctgtaccccttccttcgtaccagttgcttttgactttgcatttcgctgggctgggccacaaatgaaaaaaaaaacctagagtctcgtctgtacgtctattggtcctcggcgcctttgaatcaatcaatgaatggattgtcggtaacgtgcgaagctgccaacatttccacgccgatgtgaccaccggaaccaccaccactcctcctcgaacttgttcggctgcgtccagattgatgagattaaattttattctact

SEQ ID NO: 2151 - DNA, 1477 bp, Zea mays
  misc_feature (1)..(100): optimal_loci_75644_G1, chr2:144797343..144798819, Cluster 12
cagcctgctaatgcttgacagatgacaggacgagcatcagctgaaaccccggccggcggccgggcgatggtgtgggtgcttgcagcggcgatggcggcggcctgtcgcgcgcgtgggccgtgcccgtgcggtgtgcttgtgcgcgccccacgacgacgatggtcgatggatgattggatcgcgatcgggggcggtgaacttctcactggaggctgatagtgaccggcgacgtgccaccaccagatcgcgggcggcgccgcgccacagagagacggtggcccatggccgatcgcgcgacgcggatgatgatgatggtggcctgcagtgcccgccggtgggctcatcacatgtatccgccgcccagccaaacaggcgagtcgacgaatgcgatgcgctaacggtcaccaaaatttacttgtagaagaatacaatgggcagtcctcgtgctcccgagagaaaaatggttctgcaaaatctcactatatgaattatccatttctacagtcgtcgtgctccctcaccgcatttaaatagtaaaaaaaaattaaagttatacataaatgaaaatttgagccattggtaataatttatttattttattattagccaaaaaaaagatgagagagaactgtgggcctctttgggtggctcttgccctctagctatggctcatcataaagccctaccaaactgtcaaaaaacgatttctcatcaagagcccttaaaaagctgaagctgtttcaatgttcgtagctagagcatctaaaccctaacttgtacggactcctcctacattttcctcctacatcattataaagaaacatatgagaagctgttgtgccaaacgaaatgcaaagacggctcgataagccaaagagacagaggagccaagctgtttttaaaggagccacaaccccctattcaaagggagactaggtagctttagaatttgctcggttatatcgggattaaacgagattagagaggatttaattattttgtgttcaaaatcaaatagaaagaaattattaaatcctctcaatccccttccatttctcatgcaaagggacgtggcctaagacaggctagagtcctgctcatgtgacgctctaccgtactagtaggtgcgtagcctacacatacagaagggcagaaggccgtcctctacttctcacggttcaagaaattccttgaccaggccagggtcgacgacgctgacatgtgcactgcactggggtccccgggcgggcccggggggaatctcttgctgtgcctgtggcctactatcctatagcagcacgttgttacccgtcgccgccgcattagtgcgtcaactcgcgtgacgtgacgtcacgtcggaggtgtacgtgtgtgcacgaggccgacggcgcaccgatccatcatcggatcggaggcccacccaggcccaaatatcattcaagcgatggcttggacgcaagcaatcatcgggcgtaca

SEQ ID NO: 2152 - DNA, 2098 bp, Zea mays
  misc_feature (1)..(100): optimal_loci_7606_G1, chr1:39900868..39902965, Cluster 12
gtagatacgtagaacttgaaaaactagtcgtccttcggcgtgtaaacgtggttggttacattttgatagttttctcgtaaatctcttctatgtaaatgttttactatgtaaatatgatattatgaatgtattgtttggtacgtgaagatgtaagggcttgtttggttgatgaggattaaagaggattgagagacatataatccttataatttcttccaatcctcataaaaccgaacaagccttaagggcttgttcggttttgcgtcgtgtggatcgtgggcttccccggaggagcatggaccgcgttcgttcgttcgttctgtgacctgatcgctgctgtgctacaaccttcgttgtggtctgcacgtacgtagacacgcacgccttgataatcttggtacattcaccctcgtgctatttccttgtcgtcttgtcagtgttactgcttactgcgcctagaggagctatctattctgccctcggtgacctggttgccatgccaccagcctgctagagtggttatcacgcattgcgacagctacccttgtatagtactgggggctggggcgtacgtggagctgaagaccgaaagcaaaattaatgggaagttgctaacagtacaagcctcttccccaaaaggaactttactaattccaaaacaacccggaataagtgtcagagcatgcttagattattaccaccagtccactactcattaataacgaggtcaaatggacgtgggatacgtgaagttaggggggggggggggggggggcgcgcgcgctggagctgttgcttatagaaaattatctgtcagaaagattctgacgccaggggcggcgggcgcgcggggcaaccgttcatgttaggcgaaagcaatgggcgccatttccacacacctactaatattaccttaattagttaaccttcgatatttcgatgtggcattcaaaatatggaccaaacaggttcgacaagtgtggtcaaggaggaccgtgcgtgcacgcgagaagaatactcatacaaagcaagtgtatagtaatattccgcccgttttcgtaccagctcgtgcttgtaagcatcagccaaaaatgcgtgctcaaacgtgtctgcaggcccagcgagctttatacgcctgcccccacaaatgttcggccggcgagcggccacgaacaacagcgccactttgctcccagtgagcagcacgagcggcgggcaaaaccgtagggccggccccaaaagagcagacacgagtacacggcacgatacatcagccaaaaaccctgtaataaaagcggtgggaggagagtttgcatgcatgcgcagcaagttgcgcggggggtcgaggcgcgagttcgacggccgacgaagggaggattccgcgcgtggtcaggagctgattggcactgtgctcccccccccggtgtcgctcgttgcgaactcgcgagatgacactgtcagcgctgtaattggtcggataacctgggctctgcgtgccgtgccgtctcgtgatggaccatccagccgtaacgccaagccgacccgaccctttggcacgacacgagcggggagatgggcatgcacatcacatcagtgttcggcgagggcacatggactgtctctttagccagtactagtaggccgggtacgggcacgggcacgagacgaggaggaggggcagcgcagatgggttcaatcacttgagcccttttggtatggtccttgtgcctggctttcttgcgacgcgccgtacgtgattctcgaccgaccgtcctctctgcacccgcgccgtgcctagaagcgcacgtccgcaagacgattcggccttttctcttgggaaaaatcaggcagggctccggcctccagcgtggggaagttttgcgttcaggaaacgagctctccgcgtgcgtgacaccccaagaagggtggaggtggagcgcgtgccggacggacctttgagcctgcctgcctggctgccacgactcgacagctgctgccaagagtccaagacccaagcccgcccaccaaacccgattgctggatttgctttgctgcatgggagccccggatttgggcctacatgctcactgttaggtca

SEQ ID NO: 2153 - DNA, 1513 bp, Zea mays
  misc_feature (1)..(100): optimal_loci_7610_G1, chr1:39923343..39924855, Cluster 12
catgagcggggcccccctcgaggtcgaccgaaagaaacgcaaccgtgcgagacatcatgacctgtactgcctgcacggctggtccacctctcgcgtcgaagcagatgaccgattgaccggcgacaggatcttgaataaccataaccatggcactgtgctaccaagcgccctgttcatggattagaacggtgccttggcagcgacggcggcatgcccagattgatttccagaaccccggtagctcatcgatcgtcgctggcccaggcgcgacaatgccgccatcaacaacaaggagctcgacagtgtggccgctgttcactcgcggtaacaggggttggcacgcgggtcgtgccacacgcgcgcatagtcgatcagatcccgtgcacaaggtgaccacgaggtggcacgtggggggcgatagggcgatgacatggacggactcgtggttggtcccgatcccgatcgacgggccatctagcagccgaccggcaagtctgcggatcggagagggacgccgcgccatgcctgtcctgatcaccttatcctttcgatgttggcaatgagttttgcccgcacaagcaaattggtttaagcaagtgttagtcttgcatgggttgggattaattgcatgtcgcgaggtgcagtagcacacgaacggtggtgcctgcctgcgttagtcatatctctgtctgtcttcggtccatgactaaaattgggttgcgtctgcttcatctacatggagagattctcgctcgcagcagttgattagaccaagcctaccgcctacgttacaagtgccatgtgatgatcggcataatgcagttgctatggagtgtcttggttgagttggaacagcgttcgacttccatctactgtttgctttggaaagtaaatgatccttcatgctatccacagaaaccatcggcacctgtttttcaagataatattgttcagataactagcgcaatagtcttcagaggtctactgttgaaatgcgtcatgtgacggttcatcggcttactgctgaaaccgtaaagcatcctgtaacttcgactgccatttccgccagtgtcatgttcaaattcggaactgtaaatctagcgggggggggggggggggggggggggggtcttatagtgtgatttttaattgcatattgtttttaaaaaatatttatacaatattttaaagaaactttagtcttatttatcctctgaactatcacctgagttcgatttacttccttttaacacagacgcgacgcccgcaaacaccgatattaaatcgtccaaagtgtaaaactaaacggttttttccatgcttaaatttgcgttgccgattctatggtctatatgatttctgcaggaatgaaattattttcgataaaaaagattctattcttatttgcagttcatctttaaggcaacttattggataagactatggagtgctctgcaaaacaaggaaaaaaaggggggcaaattctcaaataggcctgccgtattttagagac

SEQ ID NO: 2154 - DNA, 1614 bp, Zea mays
  misc_feature (1)..(100): optimal_loci_82804_G1, chr2:186163915..186165528, Cluster 12
cacggcagcctctgattaatctttgcgccacggaggcccccatcagaaagaaccaggtcgatccgcccaaaaagctcggacatatccacgctgtgactccaaccaaatcacaccagctccgaccagccgtctcggcgtctcgctacgacgctacctctgtcgtgcggtgcgggctgtgctccgcttcccagagcgatctggatggaccagccagtaaccccgcgcgcacccacgacgctgttcattattggccagtgtccatgggcgatggcggccacccggccggtcgaaagcatgtctgctccagcacgtggtgcacggacacgaaacagacaagcaaggcatcgccacggcgcaccgcgcagagaagaaagcataggcggtctcttggctttctggtgtgagcagtgagcgcggcaaggcagggcaggcaggctagcggttacagaggccagatcgcggcagccgtgtcgagctgggcgttgctgcgtcgtcgtcgagcctgtgctggattggatccatcagcgccgcgccagatcctgtctcgcagtctcggtttggtggtggcttccctctgatggcaatgaaactacggagaaaaccagcatcagcaacagccaacagcaaagctaacccccgcacgaggcccccaacaaagaaaccagatggaggcgcccccaaaagctgggacagagccacgctgtgaccgaataatatcacacctgccgaccgtcgccatgcgtcctcgactcctcctctcctccttggtgtgtgcttcgctttccactggccccagacaggacgcctggcatgtcctggagcacgtgcatggacaaggggcgcgggcgaaagcgccagcacggccgagcgagccgtggtggcgtggcgcacggtgcacagcgcggcaggagcgcgcatgctgatgcagacggggtcggcctctcaggctctcagctgcctttctggtacgagcggcaggctatagcggttgccaaaggtggcggcagccgtgggctggcgccgtgtcgtggagccgccgtgcggggtggatccgatcgcctggccggcagcggcagggcgtacggtggccgtgtggtcgttcgacgtttataccctccgtaccgcaagtgtatcacatcgttaggaaggcggccggcagtgcgaatattcggccagcacgggcgatctgtcactcactggtcgcactcgcaccgcagcgcacggtccttcgcgcgcgccgctcgtttcctcggccaataatcgccatccgatggcgattagctgcagtagccaaatggtctagttatccaccaaatgtatcttgctactgcattttttttttgaacttaaggtgttgatgttagaattatgggtcctaggattactatatggtctagtagaggttttaataaatcttaaaggtaatatacctatattactcgtggactttactgtttaatttcatgagtagaggtaaaaaaatgtataataccaattagtgttgtagtgctagttgatgtgcatcgtagtgctaatgtcagggtataaaaccctgggcccttgggcccactggtcacgaggatagaagatggtcctaaacgattgccatgatca

SEQ ID NO: 2155 - DNA, 1683 bp, Zea mays
  misc_feature (1)..(100): optimal_loci_82808_G1, chr2:186178492..186180174, Cluster 12
attactgtgcctgctgacactgtcacactgagagtctcagacgatgagccccatgttgtttgtacacaggaaaaagctgcagccttccgcagtaaaaaagtcggcgacggcagctgccatcttctgagcaactgcaagtgtgttaacactcccaacggcgaatgaacagcgaaggctgatccatccacaccgccgaacgctttgctgggtccgtccgtgtgcagtggtaggaatgggcaggtgagatcgcagaggagactagggttttgggatccctctcgctcgcatgtgcggacgaccgactcctgcggcctcgtgctcgtgcgggtgaagtttgtcaaccagagcaggtggggccgtgcacgtgcgaccatgtgcatcagggccgggaggaccgcgtttcaccgtttcggacgtgcctatagggtataaattaataataactgcacacgggcgtatgaacttcatccaagttttcttcttgggcctgagatctcgcgttcggaagaggaatgtaacgtagttttagaaaggcttgcttcatcgatttttcttgggcctttctacctcattaggttgggccatggccctagggtatggcagcattcggccctgggtcatcgttactcttggtccgttagccctgttatatacagaaaaaaaaaagcactctgcgggcccgccacaataggttttctgttctttttttccctgacacatactgccagtacatacacagctgtaacacacgatatacactaagcagtagtactgagcgacggagggattctattcagcagcttgctcatgtgatctttgactatgtctgttttatttcgaaagtctgtaacaagtagcagggagagatcagagggaacaaagaatcggcgagacggcaagttcggactccctacctgcagccaaattccggtcctggaccttcacaaagtcacactagtttgaaccgctcggcggaaagccgcaccaagaaaaaaaaagaagacatgcacccccaccccatatttccagcttagaagtgaaacggaacacctagcagggccagaacccttctccagcagcaccactatccgctatccatagatcccattctcgtcccttctcgcgtgagatgagcaagagaggaggccagcttgcattctggcttgcttggcagccttcggtttggaccgatcagcaccggccggcctgcaaccaagctgagatggatgcgcgtgggggtggctccaaaagtcagcaacctgtcgcgtggcatcggtcagctagaccaccttcccccggcccgccgctagcctcattttctccacccagcttctgtatcagttggtgaggcgtttacttggcgatcaccgagttggacaagcaaagcaaagcaaccaaccaaccccccccccccccccccccttcgtctagactacttccgttccgagacaaaaacgcgtcgcctgtttcgagcttagccatggcggggccgggagacgatcgacgtggatgtggatagtacctgctggctgctgctgtgtttgtgggggggtcggtgcatacctgctgtactctagagtggcgtccggggagcactactttttggttgccgcgtgtttcggcttcgagtacgtgttctccgtgcacacagagacacgatcctgatggatgctgctgtcccaa

SEQ ID NO: 2156 - DNA, 2713 bp, Zea mays
  misc_feature (1)..(100): optimal_loci_83708_G1, chr2:191149939..191152651, Cluster 12
aatccaagccatagagatgcttctaaaccacactggtgatccccaaccatttgcctactgtatatgctacaacagcagtatgactttgcgtgtctagaagaagacgatgagaaaaggctgcgtctgcgactgcgatggtgtccctcagcccctgacctccctggggaagttgggagagagacacaggggaagctgggagctgaaaaggctccctcacatcacatgggttgtttgttactttcagtgcccttgcctcaggaacaggatcccctcgggcagtcgggcactccatcccaggatgacgcgagggatcaggatcagggctcgggaaactgttccatctctactccactcctgcgtgcctgcactgcatctccagttttttcacttcacctgcagcagtagtagaacctgcaacctgtggccagcagcacaagaggagaatgtctccaacaaataaacctgctctctctttttttttatccgagtgtaaaaatttgtccgggctagtctgtctaggagctgacactaaccccgacacagataccatttgtcttagtattttttttttgctgatttgattgatggttatcctggtcacttgactctgtcactaggacgtgggtccagacaattgcaagtggaaaaaaaatgataccgacacggagtagtacttgctactactagtagtgtgcggagcgcggtaaatgttttcttctgtcttttttttcccgcctccgcatgcatggcacggttggcttgccaaccaaccaaccgttggcgctccacatttctatcgtcaggtaacagtagaatccaaggctacatgctgtaatgtgatgtgcgtacactggccactgggcagcgaggtaaatacgtgaaggactcggtctttctttctttctttttttccacggccccctcattgatttaccctcccgtcttcgcgccaattacagtctccgtgacttgttcaattccgtttcgtgcaacatgtaaataaataaatgaaaaggatctgtaccatcatatctgtttcaaaccattctagttctggtcccggcagaaatgcgcgagctgtcacagcctcacctgcaacatgtcaactagtccaattttattaagcctgcaacctcctcaccttctttgttctgttgggatccagatcaatctcgctcggggctagctgccggctgccgttttgggatcgacacgcatttatttgcttcagttcgcagcaataatctgttgtcatttcaaaagagaaatggaagagagaaaaaggaagaagaaaaaaaaaaggaaggtaaaagaggggatcgtccaacaccagttataatttggacgctcgtagctccgagcagcaatttgcaggagcactgcagcagctgcacgcgcgcgtgtagtagctgcacatgactgtctgtcagtccacccgaaacaaagatttgggctgctaattcgcggatccaaacggccacattaaacccagccaccaccaaccagtcctctgcaacggtacggcttccaccacctagctgccgaccctttaattaatatacacacacatataagcaatttattgccaatccataaaaaaacacacacacacaagctttgatttttttttaaaaaaaaaagaaaaagaagtggtggtggggttggttggtattggtagcagtaggtagcaccagagacaagatttgaggtggaaaaaaaagggttcaaatttattctctggtggcaccgtgcatctttcaagttaaagagggagctctgcatattaatttgtgatgtgtactgaactactgacgcgtagtttcgctgcctcaacaactgcagagagtgccaaatggcgcgcagccaccacctacgggcccgtgtacgtacgtgtgctctctctgctcaccagccagccagccaccacctacgctacgggcccggagtgacgagcgccaccacggacaccggcaaagatccagcaggcaagcagcagccgccgaccgctggtccccgcgaccccgcccggctcgtcaggcttcttccattcctttcttcagagaaggaacatgatgctgtgtgttgtgttcagtctggtttcccgtcgttgcgatctttagaggagaaagaactctctctctctttttttcccctgacgatctcacctcaccaggaaaacgtatacgtaaagctagcacagaagagatgatggtcgagtggcaagcacatcatatcatcgccggggaccggtcgtcgtcgaccggattggatccgtttctcagaggtaacgaggacgcatgatgatggtgccgatcgagcgagccttgccatgcaagcaacgtgatggatgctgctgctccagcccagcccttctttaggctcagcttttgaccgctaaacggaagccttttgcctcgcagcttaggattccggtgtggcgtacggtaggtcggtagccatgcatcgtccgtcggcggcccaaagcagctggatgggtatgtagaagagacaggtcagggattgcgttctcgaagacgactgttctattctgcatgcatgcatgctcgctttccactccacaacataacatataagcatagcacgggtggtgtagtactgtagtgtagcacggttagttggcggatctatagagcactagactgatttcaatacatcaaaagtacaattacaaaacataatgagtcaaataaaa

SEQ ID NO: 2157 - DNA, 3245 bp, Zea mays
  misc_feature (1)..(100): optimal_loci_83889_G1, chr2:192437773..192441017, Cluster 12
cgcgtaggttgttaccggattcatagaatattttatgtatatgttttatatatgtatatagattcattattattcatttatagaacataaacggagggagtagttaatagctttaacctctgcagagagccagtgtatatatcttataatagcgacagctataacacgttggattataatgttgggctttgccactcggctcggcgatcgagatgctactatatatattgcacgcatggcaatgacctcgccgacgccgacggccacctcggcaggtcctcacgtcgacatccgcgtccagtctagcctcgcctcgcctcgcccggatgttggttccaccacacttgctgctcgcgcgtgcatgcaatgtactagatggagttgatcggcttttccattccatcacggtcacggctcctcctccactctccacgtccatccggcctggaaactgtagactcaccgtgggccgtggccactgccgcactagtagagcagagcactacccccatcccgccgccgcacccgctcgcgttggcacgggaacaagaacaagcacgccgcccgtctcccgtagtagatagagcacggtaggcgatgccccgatcaacgagcgtcagccggatacgaatgaatcccgcacgcacgcacgctcgcgcgcccgtcgatcggtccacgcttcggcagccgggatgagagcgccggccatttaaaactcccctgcccttctcggtttcggctgccctgttggtggcgatccgcgccggcgcgattcgatttatgccacatctgagtttgacccgtctacgcgtgcgtggatggatcggccagttgccaggttggtcccagtgtcccacgcggaccaacgactcggggacgcgaacgggaccccggatcctcagcagtcgcgcagtcgactactgggaggctgacaggtggggtctcttcgtgtcgacgcgtgcgagcagtcgtctatcgaggatcccaatccgacgcgaacggctataagaattggcatcatccaattggaactctgagtctgagaagagcaaagcaatcccctcccgtgcctcgtcttctctgccggcctcgcaatccactccgcaactgcacatctttgaccttgaccccggtggtcgctgttcataaaagcagtgggtcgctgttcataaaagcagtgggtcgctgttcataaaagctcacgtacgtggacgcattacccgcgctgccgctcctcctccgcgtcaaatttctctcgctcaccggcaccggcaccggtaccgtcgcctcatagctgctctgatctgagtgacggcctgcccttctcattttggaaaacacacacaggcccaatcaaaggccgtagtaatggacgcgggacgcctgaaccttccgccgcagctgcagccttcaggcgtactactatatatataacttttctgcttcaaagaccggggccatgactgcgattctgcgaagaagagaaacagctcaagaagtagccacctggcatggcaacagaatcgctcacggttccagggcaggccatttggattttgccaccttctccagaccgatcgacgcggtggctggcgcagcgcacgcaggcgatcccgccggccgccggcggccggctccaatcgatggtgatccctcgcggtcgcggctggctgacagcactagagtttcgtctgcagaagcatttacctgccactgccacgcgtgggaactgcgtactgtacgtcagaagaaaggggctgtacaaaatcttcaagcctggcctgcccacctggagcagggagtacgttattccaaggatccaacgagacgacgaccagagcgagcagagaggtgaatgagagagccattatatttttaactttagctaaccttggctttctccctatttcaaacccatcaatttcgaaagggcttcgtgcagcagtaggcaaagcacggcatgtcttctgtcagttaatcagccggccaacagatgttaaaataatcaaggtgaaacacgtctatggtaaccggccaacagatggtgaaatcaagagtatggtagcaataccgactggcattgctaactgttgttgggaggtagccagataggcaatgctaactgtaccacctatcaagactgttatcaatactgtacaccgaaagctcaggcctcatgcaatgcaatgcaaaatattgtagaaaaaaggttcccctgcaatgcaaaagacaatactgttcccgcaaagcagcacagcaagctctcgtcgccctacctatgctgctggctgccagttatgggaacggcgaaatggaatcgctctccctaggaaagcttctgcttacatgcaaggccgagctcgcgaggctgccgagccggtcgctgataaatggtgcaggcttttttttaagctacaattgaaattaagcgcaatgtgtatagtaattaaactatatgctgttttcgaatgaaaattaggggtccaagtcccgcacgtttgggtctgaagtaactgtgcgcaagaacgacccaaagaaaattaaagaaacaccaactagagctgaccatgagagatgccgaaatcacgatgctaagttacatgacgaagcgccattgagatcttgtaatgttccatcattcttatcccatatagatcagataagattagaaaaaaaaataacttatctgaaatttaaagccacttaatctcactcaatcaatatggattaaaaacaaaacaaacaataagtcctcaaattgtgccaccatcccattatgggtaaggttttacttttacacacaaaatgcaaccaccagtagattagggctgggagcctccaaactagaatgagacacgtcactggagtctagatgaatccagaaatgaccggccgcacacttcaaattcaaaacggtacgtagcaaaagcagaagaactagcaaggatcggtatgcaaatgtgatatcacaaatgaaatggccactgctacggtaccacttcagattggctggcagtaagtcccatacatgatttggttggagggtgtatggtttgccgaatgatctaaagaaatcgtcatcatcatctcactctaatatatattttttcatttggtgtgtagaagtagaatggagagttgatcgatcactcgtcttattcctcgtgagctaataattagtactagtttaaagaataaacgacatgtttagctcaaggaatcatcttattctcgaggtggtgcat

SEQ ID NO: 2158 - DNA, 1653 bp, Zea mays
  misc_feature (1)..(100): optimal_loci_84201_G1, chr2:194498232..194499884, Cluster 12
ggctgtcgaagcaggattggcccaaaacgccgcgaccgcacgagctcatcgggatggtcctgcagcctgcctgctttgagctgttcgcgtcgcgcgcgtgccccagcaggtgaaccaatcaaggcaggtaggcgggcgggcgggagggagttgcgcgcacgcgcgactgacgatcctgtggtcgtcgttgcgttgcgctcgctgcaactgcaagcccggccggcacgggctccccgcgcccgcctgcaatgctggcttggctttcggcgccggccatgcaacagcaccgctagctagcagctgctggtccatgccatgcatatgctgcgacgccctgcaagacctgaacggtgtagacgtgtagtacgtggcctgggcctggctctgcgacccaatgcatgcccccactcccccagcgcgcggggacgacggccggccgggaagatatatatacacacacacacgtacgacagggacggggtagcgaacctagctagccagctagcttcagcctcaccatcatcgagagttgcattttttggtttccagctcgtaaattgatcatcaggcaggcgcatgcatgagctgtagcctggactggagtaggttagcaggcacggcggcgctgccaggcttagctaatcattatgacgctaatccatggcgcatccaggtccatccgaaccgaaccgtgcgcgcatgtcgtcctatccgaccgtccttgaccacatgggctgcgcctacgcgcgacggtcgtgttcctttcggtgttcgccggaactaacgtgacgtgcttcgaggcaaaagaataggacgcgatggctcactcacctagctatcgatcgacgatcgtcacctctccaactccttggggttccacgaaaacgacgagccggccgggaacagcttttggttgctccattccatcacgtcacgtcaggctcgatctccctcggcgagcggagacggcggcgggcgaccgcgtagggagaacggcgtcgtcactgcgtgcgtggcagcccgcagcccgacgagctgtcgccggaggcgggggaaagtcaagtgtccgcgaaggaggagtaccgagtacctgacctgtcgcccgcacgtgggggagacacgtgcgtgcgcgcggaagcggaaccagcaatgatgatggggaagtgcggaaccagccgtagagcagtctgctctgctggcgacagagtgaagagaatgcacggggacatgttacttttcacctcggaaatggcgttccagagctgcaacggtacggagtagtagcactggcgcagacaagacggcgatgcgggtatgatgagctgacagtctgacacacacactctcacacgcgcgcgcggccaggcctggccagcgccgagtgcggggcatgtgggcgccggagggcgagatgagatcgatcctgcagttccagctccacaccgacaaaagtttggaggcgggactcgtacaagtgcgagctgtgtgtcagccttttggcccacacggcagtctcgtactgttacctttggattaacgttggttgttttaactgctgcaagctgctaatccatatagacaaaaacaccagtaagagtccatacagattaaagtcaagcaaacgtacttcttcgtccaaagaacagataccct

SEQ ID NO: 2159 - DNA, 1903 bp, Zea mays
  misc_feature (1)..(100): optimal_loci_86505_G1, chr2:208541596..208543498, Cluster 12
caatggagacaacatggttgaccccttgacgctgacaagcttctctagtctctacgcatatgcagtatgctgccatctccgtcaagcctctgcacgttcactgtgaatgattgcgtgtctttgttgcggattgctgcatagatccgcatgcgagatggaaagaggctgtacacgcacacgtcccatgtggcctgtgggagggagggagcaggcagccatgggctcgtagaagctgctgcatgagctgcgactcgccgatgattgaccgggcacacagcgtagataatttcgaatatttgaccccgagcacaaccgcatagtcaacggtgcaccgctcggtagaaacttcaacgggacgactttggaatttcggaatcgtcctcttagtatcccgtccgtcgtcgtcgcgttccaaaactgcgcgcggacagtggcgtagacaaacaagggacggaggccttcgattggagtactcctcgtactgttttgtgcacatagtgttgctatgaatttgtatgcagatacgactcccagggaactgtctggaacaagaaaccgagtcaaatccaggaagattcctgctgtcgcatactgccgccgcctcctcgacgacgacgatggacgttttcttgctctcacgcttgtaaaaaactaaacaacaacatttctgggctgtcgctggcgtgcatgtctctgcgcagacctacaggtgtagctgtcctgtcagtcagtcaccactcaccactcaccatatatatactagtactagtagtagcgcgggcaaaggagatctgggcaggggtgcagtgcagatccccgcgaggttaagtttgtcttgaacatattataaagattacactatctatagagtgagatttaaaatataagaaaagataagataacatggagaagatgcaaactgctagagataggacgacatgtctgtgtcagtgtgtcaccactgacactatgccgcgcgccccggaggtcccctgctgcaaagcaaaggtgccgcaataccaagggttagactacgagtctacgacagcaggtaatgtgatcccaaatccaaataatgtaaaaagaaattaaacgacgacaggtattgtgatcgtgggtaagctatacttttaaagcgacaagggaaaactaacaacgcgaaaaggacatatgaatatgattccctcgtagtatatatgtccacagaaacggcccgggtgttgggaattctcgtcaccaaaccccgagtgtgcatgaacaccaccgatcgccgatattccaaaataaacacgggtcgttcttttgggaaggggaaacaaacataacattttcgctccaagttcggtcgttagctctccctacatctgtctctgtctcgaagttgttgggccctgcagttgatgtgatgcgtcgtgcgtcacgaagacgatccctcttctttgaaaggatttcttgccatcgtcgtcgcctctacttgttccctcttctttcaaaggatttctggtcgttctgtgtcacctctgctgtgtgccgactgacgggtgtgaggctagggcgttggagtactacagttcttttttccccaaccccctagatatgcatgtaaagcaacaaccatagcctctgctcctccggataattccaacaacggacagtcattcaaggcaggcagtggatgtggtggcgtaatggatatatatggtttggtttcggttgagggagtgatggatggcgcctacctgacgcatcggaaccactggcggtgacctctctctctctctctctctcttctctcgttttcgatcgcgacgtgcgatcccgcgcccatatcatcctgccgctcgtcgcacgggccaggacactggatgatgtgaggaacagcaggcaggtcgccgaagctctt

SEQ ID NO: 2160 - DNA, 3205 bp, Zea mays
  misc_feature (1)..(100): optimal_loci_877_G1, chr1:4596911..4600115, Cluster 12
tgcgcacgctaaattttatcggacgttttaccggttgttgctggaggcatagaggagtatagcatcgctatatttagcggacagtgcgttttagcgggtcttgctggagccagccttattcttcccatctttgctcgatttctaatgacccccaatcaattttgggccacaaaacaattattttgtgttatgtaaacccttgctatgtgtctgctaaatgcaacaacacatgtaagaactaacacaagaaactaaaaaatcatatatgtaaatgttctacacattaaacaaataatggaatagaactaatctctattccactactagacgcaggatctgaaaatcgcatgtttagacttgaaggagagcaatccgcaacagaaacatcatccattccatatgaatgagcaccagcaacaatttccgcgccaactggtagtccaggagaaatcggagggagagatattagtggttgctcacaatcaaagaaagccgctaacgacgctggctgggcgccctcctccatggcggcatcgcgagacggctatcagtagcttcgcacgcaccctcctccgatctgcgtcctcggtggcgacaccgacgatcggcggcgatggaggagtacctcggctgcgcccatgacgaatagatgggcaaattagtcgcaggctcggtggtctgggcaccccgcgcaattagcgaattctaatgtcccgctcattcggaaatcatccttttctgtccaatgcttcttttcaattataccaaaagggcggagccatcatgtagagtagtatagtggcgaaggcagacaacgaggctgttacaatcccaattaactcagggtcctctcatcagccacaagggttcccaactattccaaggtacaaggggctcacgtccagagagccgtgggcaccaaaacgtatttaatatgcacatagatttaatttgaattaattaaataaaatgagtcgtttgtatattgaatttatcaaaattatggccctatcctcttattagcgaggtgaaagacggagatagttctatccattatctaaaaacacaaaattattataaaaccgacacgaagcagtttttgcaaacgtttgtagaatagcttcagctatatttagagaaattattttacaaggggagtcgaagccctttcacaaggatccggagcctgacaagagaaaatgtcctagtgagttgtagatctagctagtttgttttttagatcatgaagctgtcgcgagactcataattaattgtttgggacataacatagatggcttttgtgtgtatatatatagcataactgcatatgtacttatataacttatagtatagattattgctgcacgacggccataaaagattggcgtgccgcaacacatacatgaccgcggcacgagcacgggctacggggctagctagtagtactcctagctacaaggctactagtagcagtactcctagaagcagtacagtacagtggcaagtgcagacacgtcacctggatggatgggactgacggctaccgtcttttggcgcaggcgggccgggtgatgaatccgccgacgccggaccttcctgctgccctgtccggctgtccctctacagctagcgacgtctcgtcgaaaagacaaggaccgggagaaagagatcaacaacgagaggctagctagggcaggctgctgcaagtagtcaaggacggcggcgacttttgccatggcgcggacgcgcggtggcggcatgcagcaaagcgagtgccgccgctgctggcaaccaccacgtacctcagaagctcagagctctctgcaaagcgagtgcagcagatgcagaccggcagacgacacacacgcctgcaaaaaagccagaaggcgtctttcgccagcgaacgaacatatcgacccccccatgttggtttgcacgtactgttcccaagcgcgcgcagccgcgcacccgtcttcgatcaaactcatcagaagctgctgctgctggtggtggtcactggaaagatcgcgcgagtaggtagcagctacatcggccccgccgccgtccgtccatgtgatgtgggaaaggaatggaagccccgcccagtccagtcgagtccacactccacaacgacagacgcatgatttgatccccatgaccgagcacatgcgttcatcgctgtgtgaattggtcgtcactgctcgttaggtcaggccaaactgcagactgtatgtatgtctcgctcgacggagacgccgcggacggggtgggtgggtggcatctggaaggattcggcggggagctagacggaccgatctttttaatgcacgcacgcacgcacgctaatggtctcttcggtaaacatgggccgccggccggggcagtacgtggtcgtcgtcgtcgtcgttcctgcacgcacgcggcacggtttccttccacacatgcagctttcagggtttccaaccacgcacattatagagtacgtaagtccatgcatctgctatcttcagggaggtgtctccgtggaagcagcaaaacccggccggaacatcgatcgatcagacgacttgagagagagagagagtcagtcccggctccggcggggcggcacttttgtgcgcgtggtggatatatgattgccttggtaggtacgtactgactactgaccagcagcgagagcgagcagtagacgcaacctctctgtgtcgtacaaggcaacatacacagctatgtacagtggtgtgtacgcgcgcgcgcggggctggagagatggaccctagcctacctagctgttgtagctgatgatggctagggccgcgcgcgcgtacgttctcggctcgacgcatcggtgtcgactgctgctgctgctttcagtttccgagtccaaaagcaccggcgacagtagcagacgcagacaacgtacagcggtggcggataacgcaggcaggacgaattcaagtcgcgtctgaacaacaacgaccagcagaagctagccaagggacgtactgcgactgtatcgatctctgtatgcggccatgcaggcaggcagccatcgatccccaccgcaccgcaggcgagcaccaatcgcccgcgcgatccgatccatggctggcacactgccagccaccgcaccgcactgcactgcactgcactgtgtatcatgcatgcatgctgcgcgcgggtgtggctgccggcgacggcatgc

SEQ ID NO: 2161 - DNA, 3271 bp, Zea mays
  misc_feature (1)..(100): optimal_loci_8870_G1, chr1:46682894..46686164, Cluster 12
ttcgaaaactgaagcattataaactatagtaatgtcataactaaagtatactttagtatttaaaaaactgcagtttggaaaaactgtgttcctaaacagggctgtagtaagtagaagtaggattgaagaattgaggagtgttttatggtacaaatagaacggtgatttttgtctggttcctatcaaaaccatgtggatttttagagagatagccatttttaggagaaattgcttcaagtgacgctgacaaatctagcagtgtgtttgtgtgtgtgttggggggggggggggggggggaggtgttggattgttttattcttggactttgaaccactagacaaagatatggttgcggtaacggaaagggagtggattggatcctgtcgtcgttgagagcagaataggacgtctacatgagcatgcaaaacatatgaaagtatgaaacgaaatcgaaatgcggtggtggggaatatatgctcccattggtgggaggaagcaagagcgcagaaataacggtccacgtgtgccgggagtaatccgaatgaatcgctacactttgggggaaaacaatttggggaaaaaaattctacacaacctagatgcaaacgtggcctttaacagccccgcacatccaccactccatgcagcgccacgattttactacgatggagcagcgtatcattcatagcgctagttttctccacgcatcgaatgccacttggattttctatgtccccgtgcatgcatactggatgccatgggacatcatagctttcgtcagcattgaagaaggccttttttttagttgcgaaaggccatgtctgccccgttcgccgcggcttcatcgcctgcttccttttctctagaaaagagaccaaagcttcgctccgctcatcctccacgccgcatgtgtcctaggtctaggaatatatcctccactagcacatttttgttcggagccaggggaggaaaaaaaaccaggcttccaggaggacaagaagtacactccacgagaatacacgaaacccgcgagttggaatttggcatttcggaatccctaaccgcagccgcgcgtgcaacgcgtgcgcgcggctcgcgcagaaaaaggaaaccccacccgtaagtcgccggcagaccggcgggggaacagaagcaacggcggtctcaagctactaagcatggcactcaaccggaaccggacaggccaggatcgctgtcgcctggtctgagggggcgccaacacggaaccgccggagcgagaccggcctggaatgcaccggtgggagaaccggccggctacttgctctggttgggactgggcgtacgtgtatttgctctgtctaccacccgtcgtccggtcgttccggcgtttaggatgttgttgctgttgtcgaggggatcctactcggatgccgtgacggcgacacactttacagctgcttaactgcaggaccaggagaattttcttgagaccccccagaccccaggttctgtccctccgtgaaatctgccctggcgggcgccgccgccctgatgaagcgaacggcggcagtgcagtgcagtgcaggtgcatgctgggcagtgctcgtccaacaggcgagtgtctctcaggattggcgctcggtggagagacctcggagcgataaaattcgattcgctgccgtcgctgccgccgcccgcccccagacaaacggggcgccggaggccgttgcgcttgtccgcttgccggcgcaggaatccgaccaggcttctcgtttctggttctggcgacgggactgcgacggcgacctggttttcggctggcgccacttgcacgaacccatgccgccggggcatctgtcaccttggttttcttggtttgtctaccggacgacgtggtactacgactgcactgcacgagtgttccggtgatccctcaattaaaccacccgaattcgtcacatgtttccctttgaaattaatggaccggtgggcaaaagccgcaaaggctagtcgtatcccatactagctttttcttctttttgattccaactttattactggagccttggacaagtgcaactgctgtgtagtacccagtggccgatggtacctgacgcccgacccgacacagcacacaggacacgggtcgcgtcgcgtccttcaggcgcgcgggccacggacgccatggcgggcggatagaatcagacacagccggacccctacccttcgtcctggccctaccgctctgctactggctagcggctaccgccggccgccgccgtgtcaaattgaaactgtcaatggagcagacgaacagtgcacgccaacgatcccccccctgcgctccctaggccgcccctactcttcctctctgccggtctgtccttgtagcacggggggaaaacgctgcgatatcgtgttcactgttcaccaagagcggcgcggcacggcgggccggcggcaaccaggatgggtcgatggagtgggacaacggggaggctgggagcagagtacgatgctgccccataggctagcatgggctctccttatgttccccatgttgtccctgctgtctatcaatcagtcagcgacttgcctgagcgagaccgagacggacacggaccagacaacagcagcagaggggagaactgatgcatctatagggattcctagcagctacgactttttcctatagccgccaatatcagataagacaaaaaaaatttagataataggacagctaaaccaagaaggaaaaaaatagcagcaaaagaactaaggcatgacaattagcaattatggattcttttcatagccgccaataccacatagaaggtgcaattaagcaggacaaccgaacggagataaaggtaatatagggattcttttcatagcagttgatgcattcattgtccagatactcgatctcctgtcgctacagtatgtgccttgtcagcctgtaatccatcttggctccagaatctcgtggaaggatgtactgcaaatgatcctggtggctcagaaactgttgattgagttagccttaactgctgaaaatgacaagggcctataccttagcttagttgatggagcgagcagatataaaaggtaggattttggtgggatctaatcagctggctcaacaccatgctattcatttcaatcttttggcgtagcagtgccactggaggtcgttctggatttcatgccactcatcatcgtattcaaagcctatttgctatggcgcaagacgaaagagactgtcataacatacgttcaagctcacgtc

SEQ ID NO: 2162 - DNA, 2097 bp, Zea mays
  misc_feature (1)..(100): optimal_loci_92769_G1, chr3:3471818..3473914, Cluster 12
aatatggggactaaaaggaaatcaatctgatttctactcctctttttagtcctatctttgataattttgagactaaacaagaggaactaaagtttagtctcatgtaagtatgtaagcaaacatgccctaaaggcctgtttgatggactaataaactagtaaactctagtgcatgtttaggacgacgccaaacagaaggtctaattattactaactgattacgatccttaaaaaaacaaatactaatactgtagagttaatttgatgcggtacagcagcatggtcttactactactacatttccttggcgttttgcggttggagtggagtggagtggagtggagtgtgtcggggttgtcgcgtcgatggcgcctgcggaccgtggcgcgtgtagcctagctgtgccgctgccgccagggccaggccagcatgcaggcgtcagtgatgagctagctagtcctagtagcagtagtgcatgcaacgccgacctggctgtagcgcgcatgcatgccatccgtcagtcacccgtatggccctggccgcatgcccgcccggggcccggccggccgtgggctactgggctgtggctgaacgctagctgatcattagtggcagctagctagctatggttggcgcgcatgcagatctggagatgcgtgtgtggttggtgtgcgtgcgtatggaatgcaatgcaatgcatatgcatatgcatgcgcgtcgaagaaaagtggggagcgcgcgcgcagccgcagcgaagtgagtgcattgcaggggcacacgccgcaacactacactacacatgcgtcgtaggccagccgccgccgccgccgccgcgctgcccctgcgcatgcatccgacggacggtggcacgctgacacaactggcgctgtccgtgcctaccttgtgcctactatggccacctatagtagccctatacctagctcctgacgagcgccatgccatgcgacatcatttggctcggctttcgcaggagcgcgcagcatgcctgcgtgcatgcagcggcctgccaatgccatgcatgccgatcgatgcccccatcgcctgcctagctaggctaggagtgttggctcgtcatgagtcaatcatggatcctcttgcctagagtaggactgaggaggagacgaggagctagcccagctcaaaatccgacggcggaaggccggaagcaagcagggactgtgagctctagctagcagcggagcaggatgccgatcatgctggtttcgcccgcccatctctcgctcccagccgagattccaggaagggacgcgcgcgcctcgctttttcattccctttcccaccacacgggccgctcgcgcgcggacgtgtctgggtgcgggccgtgcgtcaccacgacggaccaggaaccggaccgcgtctctttcggcaaagcagttcaaagcgtggcgtggcgggcgtcgcgcagacgcgcaaaaggcaatccaagtaggccggccggcggcgggcgggggactggacttgggattggatcacgcacactgcagagcctcctcggctcctccttccccagtccagtcctctcccgccgccaccgcaacgcaagctagtacgcccagcaaagcgtacggaacgcggatcggagcagcggcttcagccttcttctcccggctgcaatgcaatgtatgcgctcgatcagggccccccttgtgcggcggctgctgctgcgcgggagccagcaggcaccgctgggaatcagccgaactcgcagtacagtcacgcacaccgcccggccgtcccgccggcggcacggcgtgctctttggctcatccgcgttgttgcgccaccgccggggctgtggcagatttatcttccagtcactcggggagcgtaccctgcccgtcgtcgtctattttccactggcctgtgctccttgtctgtactagtcattttgctacagcgaactgcggttgtttcgaaagccgtggtgcaagcattcatatcgaattttcacccttccattggccaaaacttaccgcaaccactttttagccaggtggagctactgcgaacagaacgcatgcaggcactatatgatttcgtgaaaggtaaggccatt

SEQ ID NO: 2163 - DNA, 2043 bp, Zea mays
  misc_feature (1)..(100): optimal_loci_92773_G1, chr3:3499492..3501534, Cluster 12
gaactaaaaggctatattgttattggtggtggtagaattttgcgcgaaccagatcccttgcgctttccatgaggaaaaagaagggcttcgaggcaagccaagaaagtgtcctggacatgtggcggtgtggatcgtgtcctgtggactgtggtgtgctactagtagggtgctgtagcatcagagccggcaaccaccaggcctgccgcctgcactgcaccaccgcgtgcatgagcctgccgggcaacggatcacatgcgtttgcggcaaggccatgctcgcatgcgcgtgcatgctaccaaaacaaacctgacgggagcccccagcccagccgctggccggtgtgcgatcgagacgactggagccggaaacgaacaggtcgtcagattcgccgtggatcggagctccacatgcatgcatgcatgcagccacctcgcggtgaacagcgcacgacgacgacggagcgggccggccggcgggcgggcggacacggacggaccccgggcgaccgacgcggcagccagcagtaccagtacttcacggctgctagctacgcctacgaccatggggcgggcccgtggatgcagtggacaggacacaggacagcgatgcatcatgcatgcatggcacagtggtgttcgcggctgccggtgtatcacggcaactccgacacaatgatggccggcagggggtacgtacggtgtctgcacacgagaacgagaggcgggcggggcgctgggtcaggcagggtcatcagaccacgttcccatatgcgcagcgcaggcaggcaggacagcggcgtcagggtgcacaggcggccccggccggcgatttgattgatgtgatccgatccgcgccccccacccccctggcctggccccggaccgccgctgtaccctggccgcagaacggagcatgagcgccgtaaatgcggccggccgtcgtccaggtccagtcacgtcccgttctctctcgctctggtgagtgatgattgatgcagaggctctgacgctgacggatccggcgggagggcgggcacgtacgtactaccaccagtgaagtagtagtacgttgtacgtacgccgccgcgctggagccgatgaatgagatgccaatgccatgccatgcatggcgtacggtacgtccgtgcattcgcgtacgcggcgctgattgctgccgtgcgttcgcgcatcgtcaacgcatgcacgcatgcatcggcggccggacacagccgcccggacccggtcgcgcaccctccgaccggccagcagcggcggcggcgggggcggcgggcgggagccggcgcgcggccggggtcgggatcgccggggagggagcagagagagctcctacgacgctagctgacagggtgaaagtgaagtgtgatggtctggaccaggaccgatcagttcgctcatgtgcgagactgcgcgagtggtggtggtgatcactgatgtgatgagtagtgatggcgcgtcggatcggagtactgtacacgtacgaaggtggcgatgcatcgatgcccaggacagagggggcatggcgctgctgacctgctgtagtagacgggcactctactgtgctacagctctcagagacaacggtgggggcggggctgggggctgggtggctggctgatcatcgatctgggccgcagggcctgtcctgtcttacctgcagtccgtatgcccgcagcgaccagtagtggcctcaaaacgagaactgtcacgacgcacatgcgcggatagcaccacaccactgttcccggttgttcactcacatacggaccattactactgccaccacctcccgatctgattgtattttttttcttcaaaaacaaaaaaaaaacagaactgtgaatgcatgaatgaaacacgacattaccgcgctcccatgcatgtatgcatattaattaccgaagcaataatgtcgctgatgacgttattcttcagacgtttcacaaaatgctggtttcagatcgaggctgcgtcgtcttcgtctctgtcaatctcaggcacctggagtaatcaatgaggcagcgcc

SEQ ID NO: 2164 - DNA, 1508 bp, Zea mays
  misc_feature (1)..(100): optimal_loci_94134_G1, chr3:10269592..10271099, Cluster 12
ctatatttggaccaacacgacatgaagtgaggcacgaattagaaaactaacgttttaaatgctccagtaaatttatctcttcacaaaacttgaatcaacgtgtcttttgatagcgacgagaggagataggtcaagacatattgagctttgccttcccaatcttcgttactccggattgttcatcttgttctcttttacatcgacacccttttggaagattttgaccaccgatgtcttgatctcatcgactagctaggaagccgagcagctttgcttgcggatagtagctctaacttgtgcatgccatagcgcacggttggacttccacagattcgatagaccgaggacaaaagattcatggaggtaaatgatggaggtaaatgatgatgaactcttcgttgctctaattaccatgccaattgtatagagacgttttaaaataatatagcccacaatccgaatccagatctttatactttgcatgttaatgtattaggtgaggaataacctcttagaatgatgaacatatataggagcatattttaaaaatcgtagatacatacaatacgaacttataatcctatacaacaatatgtaatccacccggcccggcctgcaggttctcttctctttccttcctgctgtcagtctgtcaccaggcagttaaagccgcaccggtcccggacaggtataattggattctagtttcgtgcgagatgatgcgcctcttggggcgttccaaacggagctattgacgatgacgtacggcgacggcgacgacgtgggggcgggggtaattaactgcagctcgcaattgcggttggcgggagctagccatggcccaacgccacccatcgggaagaagccagacccgcagttattggggcgagcgagagctgtgccggggccaccggccatgttccaagacaagcgaagcagagctagctgtactggcggcccctctgctgcctgtctccagccctgatctatctccatctcttcccccttcccttaattccttccaaccctcaccatcagcaagtctccgggttgtttgatttgctcactagtcactacgcatggtactaccgtactactcacggcttgaagattgaaggagtacatactgcgagcgactggagacagcagtgtcaacagtgcaggctagcataggtatactgttggtaaggaggagtgaatagcagcagggcagcactgttattcatcacatgagctgagctggaaataaaatcgcacgggccggccgggtgcttcttcacgtgcgacgggggtgcattatccatggcgccaacctgttgccgctggcaaccagctcgggcttgtcgcgcaactgtacacaaacgtctacgatgtggtgccatgctgccatgacatacaacaaacgcttgcgggcacatcaaaacgactcatcatcatcacacgtcggccaatgcatcatttgaactctagacttccatcgtagagaaatttgtcaatagctcagtgtg

SEQ ID NO: 2165 - DNA, 1421 bp, Zea mays
  misc_feature (1)..(100): optimal_loci_95783_G1, chr3:19463210..19464630, Cluster 12
gaatattacataattttttttatttggagctattaatcgatcgtatgcatgcatctttcgaagccccagtttggcagcacgtacggtgtgggggtggttttatataaaacctgacaagtggcgaagtcgggactcgggagtcagctcctcctggaagacgtgtatacttaaacactctctttcgccgtcgtgcggatttcgtaaacgtgtcaaaattaggcttcagccgccaagctagcagcaaatgtcatcctccactaatattattactagtgtataaataaactactcatcagatcacaaaactcacccccacacgcagatagagacgtatgcatgcatgggcacacaatatttgagtattggctggtatggtatccataccgtacatgcgtcgatggggacccaatcaatggtagtaccgagaccgtagtagtagtcggccatcgacgacgacgacgaggacggcagaaatgacatgcatgctgccctgcacaacaccatgaatcagacaggtcctttgaaccttgcaaagcaacaactctaccacactcctccagctgccatgcacgtcagacgaaaggaaacccaaaaaaaaaacatgttgcgcaagtggcatctatatcatgcgttatttgaaccaatgcaatgcatatgcacacgcacgcagctttaacaattatcaagaggcgcatacagacagacagacagacacagggagcggcagcagcagcagccagcagctaggggaggggagggggacagagctatagctagctggctcaggctacgctgcccagcagtccactccactctcgtttgcaacagcaacagcgactgcaagtgcaaaccgcaggccgggagccggagccagggaagaggaaacctgggcaggccgggcggcattggccccggctagctagctgcaagctgccgcctctctctggtcggaaaccgtgtgcccagcaggcagcagcctcgtgcgtgagtgtcctggcgggcggctcttggtcttggatggaaagctgcaggtctagctagctagctagcttctgctttcttttctcccccttccctcttggccctcttggatggaaaaggcacacgcacaagttgctgctgcctgcctgcctgcatcaacacaaccacggccaccaccaccagccacagactacgtacgtgcagtggttatcctccattgcctttgaatctcatgagccgtgcacatgcatctctggttacttacttacctatagtccaagtcaagtctccgatccattaattgacaatcaaccgtgttgaatcgccgagtgattaagctaacctaagcaccctttctaacactgtacgtatgcaagtttattttactgatgatttagagactgaaagtttgaaaatgcctatatataccgtcgtcgatc

SEQ ID NO: 2166 - DNA, 1750 bp, Zea mays
  misc_feature (1)..(100): optimal_loci_95846_G1, chr3:19757952..19759701, Cluster 12
acggagagagagagggtaggtcggcgtcgctaggtggaacacgcgcgcagttactctctgacggcgagataaataaaccggcttcagggcaaaaaaataacaaatataatcctcacaaacggatgttaaatatgtaaccgaaaaacgacgctccgttgtgggaccgacgatgcaattacagaagggtggtgctgcatcatgacgcggccgccacggccatatatggccgccgcttggttacgtttgcagcacgccgtgtatctagcgaaggacgatggagcaggagaaagcgagaagcacagcggcggcacgccggcactcccccccccgccactggccacactgcatgcacgcacccagctggcctggccaggtccccatcgtgctcgatgtccttgttctcgagtccaccacacgccgggggtcggaagtcggaacggctctctggaaggtccgtcgacagtccaccgacacacaccaccaaacagcatgtccggtccccaccccgtccggtccgtcgaggggcaggccagctttgcttgctcagttgctcgctcctgccttttctgattttcttcccctcccctccgcccgttgctttcgggtggggaaaaaaaaaagagaaacctttcgactctcgtgtccagggctgagcacgagctccgaggccccaagtccggcggccgaagacgcgggcgccggcggggtggaggaaaaggaggaaggggtcgcgcacgcccccagcttggtgttcctcgctcgcacagctgcgtctgcgttgcatcgcgctggtgtggtggctggacgcttctcgagtctcgatgcttcactgctactgctggttgtgcaggcaccatttcgccatagaggggccggggccggactcccccgcccagcccaacagggaacaggcccaggcggatgtttcttcacgggccgactggcctgatttgctgagtggtatggtagcaactagagacatgatgactatatcatgctttgtggcccaggctagtaataactcccgtgctcgataaaccgagcagaatttcgttcggcaacggcagtctatttgaagggccagttttttccctcaaaaaaaaaacgagacaacgtgtgcaggaattattagacgatctttttggtaagcgaaagagagtgggaaccgaaattgtgttctggataatatggatggctgtgagtcgtttttctctccctgcctgcgagtcccgggcttcatctcatacgggaagttgatgtggtattcataaatcataaggcccgtctgctctgatgagtccttggatcgacatggcaatgcggccagtcctgttgtggaaggcagccagcctggaacaagtgcgaaacggaggagttactactgtactgtacttggtagtactgtacacacgagtgcatacccggcaggtcatggcagacactttccgcgtcttcgccgcccgtgactgtacggcgcgccaaggattgctgttagtgttagatccttcgctattttttatttgctgctcatttctcaaacctgtctcgttgtctgctactaatctaagtttatttattttggtcctcactcgatggcacgcacgtaggagaagctctttccctttttttttcccaacatttcaatcgaacatggtccatcacgtgattaatggtaatatatgacgtggttgcaaaatccatgtccatgtccgcgtagctacactgtcatctctaaaccacgggttgctcc

SEQ ID NO: 2167 - DNA, 1833 bp, Zea mays
  misc_feature (1)..(100): optimal_loci_95872_G1, chr3:19929850..19931682, Cluster 12
agggaatgaaaaaaaaatatcctgtaacccaaaagagctataaacatgagtaagcatgaaggtctaagttgtgctgcgttcaggggctgtcccggctcacctgcgccaccgcccctgcatctgcctcgggatacgagggttaagttgtgctgaagtgaatggtgagacggggaaacaggcgacgccgaatggtggcaccaccaactccgctggatgcagaaaagggcgggaagcagcagcggagccggggggcagaggagacagcaacgagctcctgtcccccctcccacctcgtcatctttactagtagctactagagtgcagaggacagcaacgagccaatcgacgccccctttgtgcagtacgtgctgccggctgccgcttccatcgggccgagccaaagcgttcagcgcacgacgtgatggtgatgccgcaaagcgggggggccgtaccggacgtgcgtgctgacattataagacttttaacttgtgtttgtaattcctgacattaagacaacaccatgtatctatggatggacgctcggactgatgaccggcggaggatgatgtatacatactgaaaacaagcttgtgtttgtgcatcagtcatcacggagggagccacgtcaggcccacccaccaccatgtccatgtgttgctggccttcggttccatgcggcgacggtttgggcgaccaaccccacttggtgcctaccagcggtggtggcgacctcaatgataggaagcagacggtcgtcgtacgtcgatcttcatctcgtctgtggccgatgtcacggtgggtgacgtgtcgcctttacagcgaccgagagaggtaggtcaggtagagaaatgagactgtacaagccgtgactctggctggttacctgatgcgcacgcgcacggaacgccatgctttttacccggttcgccaccgagagcgtgtggaccccgatcgtgtgttctgctgtcggtgtcggccagcaataccatctgtatctgtcccctcccagcgcactctctccagtccacggcgatcagaagcagtctgcgatcagcgagatcaccgtctttgaacaaacgggccggcaggttggtcagactcagacggaggaggttggggtcagttgttagtggcgcaccaggatgaaccaacatcatctatgttctttgcctccgacaggagagtatcatatcagggaattacgtgggaaccggcctgcatccattccacgacacgtcgctgttgtcgtcagcgttcatttctctcctcccaccccaccccatctaggcccgttttgagatttattagcgggcttaatctcggcctcttagcatggaaggcagaggaaaggagacgttcagtaataggagagctccttccgttgacacagagttcaacttttgcagctgatctaccaatcaaagctagatcttccggactttcaactaaccatatattatccggaggttgtctacaatgtcaacaacttgattttttttaaggaccaagcaaagaattggaggaggttaaataggatcaagtattttttcaggtaagggggagtagatcgaggggatttcatccctctcaatccattcctaaccgacttacttctacatatttccttcactagtctatcactatacctgccacatgagtagttatggtaagtcgcatcttcgaacgtcgaggcccgcatcgtttagtactatatagttagtagtcattagccagtgtagccttttatattggatggttttttcataatgcactttgtgtgtgcatgtacaacctaagtcatggcaacatgtttgttagaccaataatgttaca

SEQ ID NO: 2168 - DNA, 2060 bp, Zea mays
  misc_feature (1)..(100): optimal_loci_96348_G1, chr3:22562366..22564425, Cluster 12
atttctttcgatattcccattgcatccaccccacgcaaactccatatagtggcttcaacgtgtttctttctctatcttattttcttttgctcacaattaagtagtatctacatatacaaagttcaagatgggtttcaatttcagctctattcttaataaaaatataagtcaagtcaccaactatccttaaagctctgtagagatgtcatcagactatgtaaagtttgaaaataaatatttggccctctaaggtcgcggctgttttcgtctagattcaaatgaacgtttacccaaccagttatacctacattcctacatggcatatagatccattcgatacttttattaatatgataaaagggatccatgtgtcagcggcaaggcatcaccgtagaaatatggtaattttttttcatataaccttagatgaagataatttttgtatataaaagttgtgtgctcaaagagtcgtacaaatttctaattttgatttttttttttgagattgttaagatgctcaaaaaataatgtagagttccatcagacaaacaaaagcccacgtaaaaattggaggcaaggaaataacgccccacctttggcatttcgaggttagttgggccacggtctatccaatggaacaaacaaaagcccacataagattggctttttacaaaaaagaagttgttgcggtttttagatttggcgtcctgcgtcctctacccgatccctcctggtccggctggaccggacacagccaggcaaacaaacacgatcgtgcgccacacacccaccgtccttccgttccgagcgcgaggagcatgcatgcaaattgctgctccacctgcccgggccggccacgcgtgtcatcgagatctcgcaggctggcagtggcaggccgtgcagcggtgcgggtgcccactccaactccaccaccttcttttaaaatgcctttcgccacgaattaattgccacctctggtctgctgttgcagcgcctctctgtctccgctactagcgtgcagaggccccgggcagtcgtgcgccgccgccgcggcgcatgtgatcacctcccctaccccctgccccgatgggcgatggcaactacctttccaatccaaccgacgggcgacggtgccggtgcatgctgctcagctactgcgctgcgccgactcaccgagtacagctccaatccaagctaacggcaccagtgcagcgaatcgaatgatttgggtggcgtgatcgtccacgacggcaaggccgaaaccagctttggcgatgacgaaaatagaatccccgtcagctacttgagcagcgcagtcgcataccaccgcccgccgcccgttgcggggtggagatggatcggccgtgcacgccgcggcaacttgggtgggtccggcaagcagaccacatgcgccggtcggttcggtccggttcgatccgatccggtgcgctggactggatggactggatccgtttcgtctgagcgagaggaaaggaaaaggggtggacgggtggtagtggtagatcgtagaccgacgggctgccccggctccagtcgttcgttccctggcgtgcccaccttttgtacgggctcggaatgactccacggcccgcggcatgtgtctttgcctggtttcgtcggacccgacctatcgggttggtgacgatgcttcggtttcagatcgactccttttcctctctgaaaaaatctgaatcaggtgcagcagcatatatatcggggaggaaataccgaacgtgagattcctggcgtctttacaaaaacattcacaaagattaacaagactagaagacccgtagttgccatacattttcccaacgcgtcgtccgccacgagtgaagacaaaaaggccacgtcttatagacgtgttcgacgcgcataatatatcgatatgtgtatatgtagaaaaggcagtcaatatcacgtaaatcagatgtcccgtttgcgtcgtgcactgaccgatctccggaacgaaccctatttgttcagttatataacttttgactaaaacttagtccatcatcatgatcatgataatacac

SEQ ID NO: 2169 - DNA, 1448 bp, Zea mays
  misc_feature (1)..(100): optimal_loci_978_G1, chr1:4977853..4979300, Cluster 12
catggtaaggtacggtttcgattacaataaaaaaggcaaggttttgacggcccaaataaaactaaaccaaacatggcctaaaaggtacgaaattgcattagtgggatcataagcacagtaccctagctagttagggtattgttttctgtgaaataagaaactatgttgaaaagtccatatttaaaccttttttatctaaaagatagcagtatcacttggtggcctatctagtatgtttccacggtggagtttcgtcgtgggttgttaaattcctgcgcgcaagtgatgcgcgtgcatcgaaccagagaacatgtggcctgtagtaaacagcggagcaaaaactagctataccttgaagaggccaagagacattgatactagcctttttcgtcgtggacctcgattcaatcttaggaatttcttcatatttcacatgcctaaacatacaaagaagcatgcagttgtttttagtccagaagtcatataaacacatgctagctagtgtctataaacagggctgctgccaaataaaaacatcaggcgcttcatggcatttatacattggagacttggattttgtgttgtattgtcccatctatctatattcgtcatggtcgcggacgcacgctatagccttgtatggtggttccagttccacacttccactggagacatcgccgcgcgcactttgtttggcaaggaatgggtggcaaggcaatataatgaaccaaaataggcgacgacatactacacctatgaggcgggttggtgttgtttttgtttatcgttttgggaagttattattcatcatctatacaatttgtcaaacctacgattagcacagtgaacgaaatgaactgcaatagagatagtaggttaggagctcgatcgatatggaaagggacgacaagaacagcagcaccaaagcccagtcaaaaagatgcccagccaagcaatcaatctttcccgtcaagggtttgcagaagatcatcacgagggaaagagaatcgcacagatgcccaatatcagcagcttagtagtacgtcgcaaatgtgctggtacgtacacgctttagttctttcttccgtgaagattttttttcccctttcacctttcgcgtttaatgactgagggtccgagagcatggcaagctgactagctgaaaaaaaaagaaaagaaaagaaaaggtgaggatgtgcaaaatagagaaaccgcgagggggcaacgggaaacatcacgtggcagggcgggctggggctagggctagggacggagtggccaactggccatgagacggagtgaccttccccgtcagattgtcgccccgtcggcccagcgtcaactacgagacctccgtcattggccacgacagtcaatgacgtgtggggccagagacaggagcaacccacatgtcatccagggtaaacagtgagcagcccgtgccgtgt

SEQ ID NO: 2170 - DNA, 2168 bp, Zea mays
  misc_feature (1)..(100): optimal_loci_9940_G1, chr1:52923359..52925526, Cluster 12
gtgagagacggacggagaaggggggtgcatgcgacgcactcggcttcagcagtccggatcttggcttattcattgacttgcgtatacaaaaaaaggtgtttattttatgcacgccactctaaatgcagtagtcgtttactccggagtagtactacataaactatggcgccgcggtccctgataacacgggagaagaaaaaagaagtatagaagtgtggccacagttaaccggtacacgtttaacaaccgagggccaagagacccagggatagaaaaaaacgtgcagttgggtctgtctacgtgtcttcccatccgcttacatttcgtgacatgttgacatatacatgcatgcattcagctgatgccgccccttcgcaaaggcaaagcttttctcaccaccagttttttcgtaaccggattgttttattaaggataatcgactcggtacgcgttgatattttcgtgaactaaaggtaatatatggtcagtaaagatatattatataacaataggtggcatgaaaggtaaagccaagtatggatttctcttttttttttaagaaaaaaaatcgcgctggcatgagaagcactgaaacctaaccctggaatcacttattaaagaacgctcgaaatagcatgacaatgccatttactgtgtgctagcttatcgcccatatcttaagaaactatatatatataatagtataatgtcgagaagacgacgatgacaccaataagtttggtgcattgtatgcattgtactcgtggacaaataccacacacactgtgcctgccgtgccggcagtgtcaaggccaaacgtcaaaccacgaagcggacggccaaggccaagccaaactcattcaacgaatagcctctggaaattaaaaattttaaatggactctctgtctcttttttttatgcgtgtgtgtgttagagacgtggccgaagttttgtgccatatatatactagtatatcgcgtcggtatcggtctcctttatttggtcgatggagtctttgcttatctgaaaagcaccttttgattcattagtctttgttaaaactgggccgcctcgctcgcctgcctgcctgtacgctacacggtcagaataaacgacagtaggtatcgaggtggcgcggtcacgtcgagcgcttataagaaattgaccatgcttaggcgcggtcttagcttagcactcgccggttaatatataggacaaaaaccgctgccatagaagatagagtacgcgagagagcagactgcggcagaagatggcataaaactaagacggcgcgcgtgtttctcttccatctttgaacgagagaaaagatgtgcagtgctcctagctggtccagagttgggccggtcgtcttgttaggttttctgcgtagggcgttgaggcaagaaccaggtccaaaacatgaacatcgttggccagactgaaattgggcagcagcagcagccagcatcaaccttgaatgtttcctggaacagcctctgatgaagttgggcacttgggacacggagataccgctgttccgttcctgttcccacagatgccatagatgccagtttgccacgtgtgcggaaatagatagactgatgagaggaagaggaatgccttttacgcagattagttacccataattacgtacgactggattgcaaatcaagccggggtcgaaggaggatttgccacgctatggggctagggcagcgtgatcctttttcacctatgctattcaccgtcgccatgcttggatgtcctcattgtattggtggccgaggagtaggcgcatgcagtcatcagctctcgtcaagttcagagcttccctgtacgcggacacccttgtcatcttcggtgagatataatcgcgcgttcagtgagacagtggaccacatgttgcgggctgccgggccgtgtattcaccagggaagcttattggagcaggcgactcagcccactgggcttttattgtcgccagtgaacgtcgacgctggctttcttgtgcagtggtggatgtggatcgcttgcagtgggaagggacagagcaagggggttcgacttcgacggcctttttttgctagttcttgcaggcgcgtgttcgacgtgttacaaaacattgtacagtgatcaaatcccatatatccatttgtaacagttattc

SEQ ID NO: 2171 - DNA, 1195 bp, Zea mays
  misc_feature (1)..(100): optimal_loci_282323_G1, chr8:100763204..100764398, Cluster 13
tagcaatagatatttgtcttcgtttgcaaattcatttgcagttcttgccctcctccaaatgggctcctgactcctgtgaatccgaggttaaatccacaggcgtaaaaatgtcaccacggcgtcacagttcacaggtacgacagcagccgacgaggtaggggaaacttcaagctttgaaccgagcatacattgcattgcatattttgtgtgcaagaaactcctcacatttattggactgaaagacgaacataatacaaatcatcgtggctgttgaaggacccaaaaacatatactacatcatcgttttcggttgaagagcttgtcgcgaacgtgtcgccggagcctgtcgagagcatcctgcgcattcaggaagatgagctcgcctgtcctccagcagaagacgtaggcgcacacgtagaggcccgcgaagatctggtacgccatgctgcgctccccggccggcttgcgctctggcgcggcctccttctcctcctcgccttgcttcgccatcatcgccggcggcggcgcctggggctcacgctctgtctcgtcgcgagccttcgccatcggcgccgggcactggcggcgccccgttcctcgcacgctacgacgacaggagggcgcgggcagcggagacgaatggctggtgcggggaaggaggaggggccggaggagcccgtagcacgccctgttcggaaccgtgcccttcgctgcggctgcgatggggttcagcggtttcagggcaaggccccgagcgacgggcctcatcagctgcatatatatctttcagttcagcggggaccggagcggtggtgtgagtgacggagaactgagcaggggacgagtgacgttttgtaggccaaggccgtgctcgaagggaagcgcgaaaccggcgtcggcgatcgccggctcggtggcttgacgtgcaatgcaacctggcgaagcattggtgtctacgacgggcaactttgtttgttggcatgtataccaccatgtgtcttgtccatgaactggtcgttggcgtgtggatgtttgggggttattcctagatcacgcatgctctcgtagtttttggccaaggtgaagaaagttttggaaatggctcttttggtggcaacgtaccttttttttctttgataaggcgtacctttttttatttgagggcaaggaaatgcgccttaattccacacgcatg

SEQ ID NO: 2172 - DNA, 1203 bp, Zea mays
  misc_feature (1)..(100): optimal_loci_10513_G1, chr1:56320845..56322047, Cluster 13
tggcaagtttgggaaccaaaatgacatattttttgcgtatgagtacaagaatcgaatggggtcagtttggtatagtttttttaaaaatcttttctgtgaatctaaattctggataattacatagcacatttagctataagcataacctatcaaatgtgtatatgatattttaaaattattatctaaattattagttaaatacttgggaggaaaatcacgtgcgcgtgttaaaaaaaagaattagaaggtatatccattgccacctccgtttgtcgccatacacaatagataaaatagttccctcgtcattgataaacttggtagtaagaaataaaatctatgacacatatgaccgaagaggaacacgctcgcaagaaggtgcggtgcgcgacaagagtgaactgtgcaagacgcctatccatcgagtcgtcggctcgtggcgcgcgcccccgccgcacacgtgcctaactcgtcacgtcggccggccgtatgcgccgacgcgatccaatccccggaattcaggtgaaactctgcacgcggcggcggcagctggagccgcacccgcacctccatcagcggcggtcgtgtcaacgcagcgcgggggggcagcagatccacccgcgcaggcgcagcagtgcccgaaaagatttgcctgctcgtgctcggccggatcgggtggcggccgccgcgcgtggggtcctgatcgactttctctcgccgttcatgccgctgtcgcgtctcaccgtctagcggtcgggcggctggggtcgcctcggtcagccgagcgagaacgacgacaaactgcttgctagctagtagtgcagtatacaggtacagattcactgcagtagacccatttttgttgtcttgccgctcttgcgcacgccccacgtgcgaccgcccagcagccacacgtgcgtcgccgtgtctatactgattactgaaacgaagccagacgacgcgtacaaggtatcggcaagtagcatgctgcctcacctcgcgtttggggctttgggctcgtggtcgtgggctgcgttgctggttttgcaacggtgatggcgctgggccctacagacagacagatagatcggtgccggagcagtgtgacccatcacccatgcatgaatcgcgcttaatcagggtcagggcaccgcatgggcgcacggcccacgcctactggcgactggctgacagcccggccac

SEQ ID NO: 2173 - DNA, 1045 bp, Zea mays
  misc_feature (1)..(100): optimal_loci_114514_G1, chr3:139244599..139245643, Cluster 13
tatgtggagattccctactcctaatgcatgcccttgctccaagcttaatgcgtcgttatcactcttagagtcgactcaaggtttcacgggtttttctgtcatagccagttgttcggcaacacccaactaattcaaataacagtcatcgtctagaaacaactcaaaatgtgaaagtgagttatgcaatccttaaggacttcctctgtaatatcgaaggcatccactcggctcctggtctgaacaaaggagcaaatcttctcccatgccctagacatcgggcacacaaccaatgaggacctcgatggcaccaatgcaaggtcatctgaatacatcgaagcatgaacgaaacgtattagcacgacaaaaacatacttagaataccaatctacctcagacgcagtctctgctccattccttgccttgagctcaatgtcagactttgtagtccataacagacagatttgcagcacgactagtcattaggcatggccccccatagatgccataattggagaacctaaggggctactgtagccacttatgttgccatcgcgaccgcagcctctatcatcgtcattgtggtagcgggctgcaccaccttaactggtgcgacaaacctcaccacacctttagggtcctaggcccttcgcttcctcgaccaccccatcacattcatgacatcgtatactggtattggtgccttcccttagacaattccatagtggatgccatgacatgctcaatgttatgcgagtatggatatatgttaatgacctcgctattttggctagcgcaacgtcttcacacccacagactagaggtgtgtctctaaccacctaccactttacactctatgaaccaaccctcctacacactaaatctttcccaaacttaccctggtcaacttctccatgaaggtgtcgttgtcaacatcaagatcatgtggtgagctcgtaggtgatccgcacatgctgcccaaatcagtgggaaggaactagaaattgtctctgcatcaacatcacttatgcccttggttgaggtccct

SEQ ID NO: 2174 - DNA, 1127 bp, Zea mays
  misc_feature (1)..(100): optimal_loci_116937_G1, chr3:154556657..154557783, Cluster 13
catatatttgtgaataatagagggagtaggcagctctatataccattgcatcgtcactgatcactgtttgctggctgtggttagatggatagactgatctcgacaggaacgaaccgggaggaaaaactcaggttggttcagtgcacttccacttccatatcgcttaattcgctttgcttatgatttcaagacattgatgagacctgtaggtcgacagcggcggtaagattgggacgtctcctgtcgcgtcttgccgtgccccggatcggaggtacgagtgatttgagagggaaataaaagaaatatataccctgactccccgagaggattatatattgagatctcttatatatttcgcctggagacttttcttctagagcgagcgagccagcgagctagactaggctagggttaataggtagggttacgctagacctagctaacggctgactattgatgagtacccatgtcctctctcgatggtgattaggataacgaatctaatgaatgatgactaatcaatcgcctagttagctgcttattagtttagtttcgtccgtacgggctcattagctcgccgcacatatatgagcatattaccattgttgttgtcatatatttatatatatagttgcgcatagtctgtgctagcactgatgttttgtcgcctctgcctctgccttgtccggttttgttttcatcgcagctgtgtggcaacggctggcagatcgatctggtcagcacttaattgggagctcaattattattgtcgtcttattactggccatctgtaccaccagctcgttcttgccgcgcgcgcgcgcggaggctcgagacctcctcagctcctcctgatcgacgactccgtcttgtaatcttcctcgaactggaaaatggttgtttaaactagcagcggaaagccacactgactgatgctgaacagtgcgtacgatgggcaccttgttttgcagacaatacatatatgactccctgccgccgctgggttcgttcagaatttcatatttgaaacaagttcatattgtaaaactgtagaagtacggatgcgcttagctggtctgtgtgtgttgtgtgttggtctactccctcagtaccaaaatagatgtgtc

SEQ ID NO: 2175 - DNA, 1085 bp, Zea mays
  misc_feature (1)..(100): optimal_loci_117872_G1, chr3:159807768..159808852, Cluster 13
cctaaaaatttccagatcattcttgcttgcatttgcatctgcaactgcataactgcattgcatataccggccatgctgccgtgcatgcatgacagttataaataaatctttcctccctgttaaacgcctccgttaggtaaccttggctagccatataaatggccgcccaaaacctaatctggctcgtcatcagggtcgagttcgaaggattggtctttgcagattatggtaggttggctcacatatgtagccttctcctgctttgtttgtgtgtggctggccgcctggcccctcgtgtaatgaaagcatagcttgccatggatttcagggccttttcgcaagacatgaaagcgacattcttggacatgtccaccattccaactcctgcaagttaccctgatgatccggcgtatgtgtgtcactagattattcgcaatagaatacaatgatgtgcaacgatggattagcttcaaatttaatgggaagataaaatggaaatgggcccgatcgagcgacaaattaataaaaacctactcttttccccgcgaacgacgtgcttaagcacataattaaaagccatcgtcactgccactttttttctcccctacaggttcgtttttggcaatgataggggtttaacccggcaataaaggtttggtctgagataatgagagattaatgaccgcacatgtacatagtaagctatactaactcagtcagcagcaagcacaacatgcatggtttattacacttaactaaatataacccacgacaagaaacaaaactatttattatctcctgtctttaggagctgccttctgtagcccaggaacactagcacagagctcggacaggcacttgtctgcagctgcaacgactgtcaactgttctggcgcagaaacgtcttctgttttctcttctccttttatattatgtgcttcgctcgaacgctggattcctgcacgctggatcggagaaccgaagaagggatggtcttgtcgatctggagtcgtaatccatcacgtctgctcgaacggtgttgtgtggaagcaaagttcgtccagctagctctgttgctgctcagt

SEQ ID NO: 2176 - DNA, 1073 bp, Zea mays
  misc_feature (1)..(100): optimal_loci_117875_G1, chr3:159809864..159810936, Cluster 13
tgcagtgtgatctaaccacgttgcctgctgcacccagccagtaaactccagctgaaactcgcatgcgcgaacgctgatgcatgttcttgtgacgatcctttgtcggtttgtatccaaggcctaaccagtggatctggagtagtagcgatcgggttgttgttggtgctgtaaccagtcgatcgccggccgccatgcaccgacggtgtccgacgccgccggtttagcgtcgttgggtcatcacgtggcatgtacgcgcatcgggcaggaggaggggcgggggccgtacgttaaaccccttttcgttgcaagcaagtcaagccagtggagcgagcggtcgaggaggctgtagggctttgctgcattggcgcgcgcgagcaacgtaacgcaggatgcatgatcgccgccgaccggcctcttccgtgcgtgaacagtgtgagcataaataaaccacacgattaggttaaagctggactgctaacccggaccctttaccctttaggcctttgcactttatggctccagcgtgcacgttcttttgtgagttagtgttagtgttaggctgttagcgcatatgattgcatgcatgtgtgcgtgctttgagaggcagctcaagtcccggccctgctggacgtgacagtggctccactgacgtgtcaagtacgtgtagatacgtactagtgtagtacctatgtctacggcgcacgaaccggcagctttatttcgtgccgtagtgggggtacagatcggacggtgcgcgcgccaccactaccatgcactagcgcgggcgggccgggaacccggtgcgatgccgagtggggtggggggctacgggcggcggcgcaaacgatgccgagtagtggatgcgcatggatcgtggtggtggatacggcaacatcagcagccaaccgctaacctggatggataaagataggctgtctgcatggcagcagatgcatgccccggtgcagcgcacatgcgcatccacgcgtgccaggtcgccgccgtagatcgtagacggaaggaacagaaagaaccaaaaagcccggccacgcacggacgcacacacgggtgga

SEQ ID NO: 2177 - DNA, 1080 bp, Zea mays
  misc_feature (1)..(100): optimal_loci_117876_G1, chr3:159810970..159812049, Cluster 13
tggacgcgcgggggagcggtctgcccgcgcccgtccgcgcgtggggggattgggttgggttatccgctgcgcctgcgcgcaatccggcgcggggtccgggttggctgggggcggcgccccgagcgtctcccaccggtcgcctccgcggtgcgggctcatcgcgacgccagccacacgacctacgcgcgccgccggtggtcctcaggtgcggtgcggtagttttgcgtcggggcggtggatggggtttcgtcaattcccgtgctgccgcgtggtgtaacgggagcagcaaaccaatataatccaaccgcaaaaagaaaataaaagaaaaaaacgcagggggagggggaggcttgcggttgcggcttgggaaatatcgcgcgcgtttcggtggcgcctgtcgactccgtggctcattcgccgtctcgtctttgatgtgacggtcggtgctcccgtggaggtggagagaacattcccgtccctccatccgtccgtcccgatcgcaaccttgagttattggtcggggctgccgtggggttcctgtccggccaacgagatcgtccagtcgagagtgaaagggaggtgtcgtccaagacatgtatgggcttccgtctcgtctcgtcccattccccatccatccttccaaggctgcctaaccaacgtcctctcctccctgctctcggttctttgatgaacgcaacaccatactgtattcgtcccttacagaaacgtcgagtttctaatccggctccagtcgataccattgttatgtaacactgggcaggcacggaggcacccacggattgtttattcacaggccacatgcaatgcggccaagtgtgtcagctaaaggaaacgggggcagacggagccaccagctactcccactcctccgcgcacgacgacgcacttccgtgtgtgttgcccacttgcccccgctgctggctgtcctatggctatgcggcgcatggggggaatcaagcctagtctcgtgaaggccgcggcgccaccccgctcctgtgatgcgctccttggccgtagcccgtagccagccatgaggggggaacggacgatggaaacggg

SEQ ID NO: 2178 - DNA, 1247 bp, Zea mays
  misc_feature (1)..(100): optimal_loci_118265_G1, chr3:162587116..162588362, Cluster 13
catagagtggctgtgtagcgtgatttttctggcaaatatgcatgttgtcctgtgtcctgtgacccattaccacacaaaccagtaaaataccatcaacgaagaaaccaagttctgtgaactgattaatagaaccgactgagtttaatcttttgcataggatccttgcgcttgccatttcgttttatgtagccctatatgctaaaggtgacagctgattatccattccaatttgtgatgaagagcaggtgaaatgagcatgcacacagggcatggacctatcaggattcaggagggtcgttgcgaagcacccatataggctagggtttgaagtcttgctgcaagtttggaatcggagacgaaggcgtctagtcgtgtcgtctcggagataggcaaatagcagcagaagaccatgaaagtgaacctgagccagataggcacatagacagagcgtagtgtccttcgcgtggacgttttcagtcatgtcacacgctaaacgtggtcctgacctccgccggcatgtcgcgtgtgattgtgagcgtgtctggtctcggtcggaaacaatctgcaaagttgtgcccccgaaggtgcatgcgcacaaggagttgagagatagacaagtttcgccacaagggatctagcgaggctgtgtatatctgtcgatttcagatggacaaaccatgcatatatcactgaatttatagtgttatttcttgctgcccaggaaaaaaaattgtggcgattccactagctaggaaattaaaccacaaccgtcgtcgtcactttaccctaaagccatgttccatgaatgcgtggagtgctccttgctaataaaagaatccggccggcaagccattattagagatctttcggaaacaacgcgatgcatcatgtcccatggcacggacaaagctaggttaaaggcgccggtcgtacgtctaaaccgcatgctaacagcgaacaaaatcagtgtcatcaagcgagatatataatgcctgctagctcgtagcttggtgtgtgcctccgctgcatgcatccatcatgacgcgtgtatgcatgacagccgacgcctagtacatgtagagtctgtttattttgtttgaaatacatttttttggtttgaaagctagccttctaattgttgaatttttattattaactttttttaaaaaaatatcttctcagcgtaacaaaacgaaaaactcctctcaatatattttttgcctttgaagtctaatcttcttaaaagg

SEQ ID NO: 2179 - DNA, 1284 bp, Zea mays
  misc_feature (1)..(100): optimal_loci_119728_G1, chr3:171702821..171704104, Cluster 13
cctttcggtgacgtgcaaggcaacggtcgccctgccacttttaagaggctactaaagaggtggaggacgaagggagtgcgaagcactggacccacgaacgatgttaccttttttatctatgcaaattgatagcttttggagttggtgttttataagtcatggtatataggctagataatttataaacgagacaacacatgcaccagctcgttaacgatgtataaaactatatgagaaagattcgagttagactcgaccgcacagatccatgtcaatcagaagaaacacaatttttttagttgtttggaactgattgtttctgcgggttaagcaagtaagcagcagatggaaatgggccatttgcttgctagttaactagcttgaaactcagggttttctagagaagaaaaggagagaccgcagccatctgtgcatgtgtactgttgggcagcgccagggcgtgcccgtgtgttgtgtcatctcgcatgaaaagatgtcatgtaaatttggtccactataactagggctgagccttagcaccacgttgcctttgtccttgcttgtcgagctttttgagagctcttgttgagcagtactgtagttgagtgccaatttgggctggatccgcggccaggttcatgagttcatggccagtgcaggagacaacaagtgagttggcgacaagatgcattccctcatctcactccggctgcatttcgatcggcaggtagcaatgcaatgtactagtattgtcggattgcactgacatagctttgtttaatgttctctcttaacactgcttttatcagtacgggcaaagcagaccatatatgtgcttttgcaagctgcaagatcagaacgacgagcatttgcaagttaaacaaaaccaagaacacatgataaataggttctgattgtcaaggacagctagccgaggctgtgaccaatgagtggtaagttgacactggccactaggaagcaggatagagctgctggtgtcgtttggctctagccatcaatcaatcaagccatgagtggtcttcatgcattctctgtctcaagttcactgaatgtggacggctcttcggatggcctcagcttttaggttacgtcgacctttttttggctgtagaattacagcacaggtgcgtgtttggaagaattacggaacggtgataagatggtaccgaggttgatcgagataagggactgggtgtgaaatgtcagacggaacgtttcgcggagcgactcatgtatacgtgtcgaggttctataagcccaaat

SEQ ID NO: 2180 - DNA, 1262 bp, Zea mays
  misc_feature (1)..(100): optimal_loci_119875_G1, chr3:172669905..172671166, Cluster 13
tagactaggaccaccgttgtccagaaaagataacgattgtaggtccgggtaaagctaatctattttaagtctaccctaaatttatttatacagcagtttgtgcttgctggtgaagtaagatgtctggtactacaccgcacactgttgtgcgagattgtacgtacattagagagtagaagattggcagcggcgagagcaaagtgcagcgagcagcaacaggctggtggtgggtggcaccggcggtgcccgtgccccgcagcaattcgtgatacagcggcacggcgccagtgcgggcgcggggccccccgcggcggtcaaatcattgcgggggtgcggatctcgaggcatgtgggagtgggccaagcctccgcagattctgaggctgggctgctgcggctggggtgggagtggacagtggagtccgctggtgcagtgcagcaggcacgggcagaggcaggcgcatcgcctcgtcgtcttccgtctcgtccacggtccaccaccaacgaagactgctgctttgttcccgtccgcgcgctccgtacagcggcagcccataccagcggttcgttacctaacgagatcctccagccagagctcagccagaggtgtatcgctggcgcgcgcggcacgcgctctggaacgccacgtccgtcctccggggccgggccgccgtcgtccgcgcgcagaccgcagcatacggtggcggagagacaaagaccgacggtcaagactggcctactcggctgccggagaataaaaccgtacacagaacacaccagcatgcaattccgcaagctttccgcgacttaggctacagacgcagactatagcctgacggcaggacacggtaactagcaatagtccagtagtagtactgtacgcgtcgtctctagcggtctagccacatggacaaacacatgcaatgcacgcatggctcccggttcccaactcccggcccagagtagtctccagcctgacctgatctcgatccgtcagctgcaggtccggatcagagataaacaaacaaaggagacgagacgacgggccagccgccagcagggagagtatcgaatcgaacgcgacagctcagagacccatcccccccgtcgtggcagcgcgtgagcgcatcatcgccgccgggggccatcatgcatgctcgcttgggcgtcacctgctccggctcggggcatcttgcgtcccaaatgggcaaccgcgaaagatcaacaaacaactgccaccaccgccttttttctctccggcgc

SEQ ID NO: 2181 - DNA, 1132 bp, Zea mays
  misc_feature (1)..(100): optimal_loci_121921_G1, chr3:184138673..184139804, Cluster 13
aactttgtggggcatgggatgccctgaggactagtgtcataggtgtcctaggccagggggacttagcctctagtcaacatcctatgacacaaggtgccttggggtcttagagtattttatccctaggggtccctaggcaccaagtgccttgggccccataacgtgtaataggactcatatcacctagatgtggtcaccatgctttttaacgagagtcatcccacccatatatttccatgtaatgccatttagtaccatgttcctctcttggtcatggccaagggatgccctaggtcttagatcccccgagagtagtggtcccatcatagacgacctcaaagctagtgtcccaagtcatgattcttgagcatgttttactaaaatcttcttcagatgccgacatagaccttatgctctctaacttcctagaaatcggattcaagattacatgtagtggagctgcctagattgtgtatattgcgttagtgatagtggaagaccacttctcatttttcattgtggtggtattgcttgacatcatgttggttgtagacttcacggtgaagttgggcacaaatacatcgttgcatatatttcctattattgtgttgtcaactagccttcttggcatctgtctctatgactatgttgtttttgtcgcctagacacctcatagtgtatgatcttcccttctaatatggcagtaaggactaggcatttttgaacgcctattagtgggaattcttattagtctccctcctcttttgtcacaagagtagatgagataagtcttgagaccaccatctagtaagcaacaatagtattcttgagcctaaatgatagttggactaggcttggaccataattgtccgatggcttagaagttgtctttggaaacttggtcttgcccgagtctgacttgagtggttcaagttgtttccctatcatggcaggactagattgaaaattcattgaaatcctagacgaggtcctataatgtattttgatgtaaagctagagaagcttgatccatggtagtcttcatgagaaaataatgaaatatgctagagtttactatcctcagcaaacagtcgatcgcatcctcagtcacagagataggcaacttacaatg

SEQ ID NO: 2182 - DNA, 1261 bp, Zea mays
  misc_feature (1)..(100): optimal_loci_122317_G1, chr3:186126673..186127933, Cluster 13
ttaatactactgtactagtattaatcagacgcatgcaccagccaattaatcgttgccacatgagctagctagcatgttgacgacctgtttgtctccttccccgacccctccgatgggtggctctgcaactgccagacaacacggccaaggcgaacatttttctcttcgtaccgcatgttctcgttgccgttctggcctggacagcattttcatgtctatggagctgccgtctggattcctggctactgcttgaagcgaagtcaagcaagcggctttacggcagccacgagcccacatgccgtccaaccgggcggaaagcagagcagagggatggcgccttcaacctgtccgatccgggttatgtgcatcatatctgtccgatcctcgatggaaaagagcagacaaacgagcacggcagtccgccctcagatctcaactcgcaagtcaaattgcattttcgtgtgcgaccataaattagatcgaccaacgggggggcaaagcaaagtgcagacactctcaccagcagccgtcagaatgggacgttactgttctttttccgctttcttcctgatggcggcatggcgcacgttcccgatcgcggagtggcgggaaccgatgccgagacgtgatctggtgcttgctggtgccgcgtagttttcggcgaaaccgaccggagagaaacggcagtgtgcaacagcgacacaagaaccaactcggcaacagtcggatgtggactgacggatccgcggaggcaggcagacgacaccgtaccggatcgaaagttcaggttcagggcgtcgctgtctgtctcatggttcagaaaactgacgattaacggcggtccagaaccacatcctccacgaacagaacacacacacacagagacagaagagccctgtttccacgcaccttcaaaagcggttggtccgatggatcgaggcaacagcaaaagcaatgcaaaaggcttccttccgcgcgtgtgtggtggtgatggtcggtgaacggtgggggacatcagaagactggttacctcatccagcaatacgtacgggttgtcctctccttcaagttacgcaacgacgtgggtgcccaggatcggatccagcacagcttcgccatggaatggaatggagctgacaggaccaccacttgcgtaatgccgcagcggaacaggcgcgtcatgactgtgaccgtagtttgggaagcaggctactacagcacaggaatctggatggcgttggtgtccacctcgctaactagg

SEQ ID NO: 2183 - DNA, 1121 bp, Zea mays
  misc_feature (1)..(100): optimal_loci_123095_G1, chr3:190151090..190152210, Cluster 13
ttttatattagaatatgtttatacgcatggaagtttttttttcacggcaaggagtctatgcgcacgtacgatgtattaatttctatgccagatactttgaaagttttgaaaatctgactcaaatcctgtcgaaaatgtcaaacttttgcaaaccggaggagagctagtgagcatcgtttttatgcatataattgtttaacatcgatcggtacggtgcatccttcgtgattcacaccgaacttcgctcaaaagtagctttttttttgcagctcgatccagccggaataccttgtggatcggagaaaactttatatatagggtaggaacatagcaaagaagaagcagaagaaagtatatgtgtacactttgctcgtagagagctgctgcctactagtttgctcgctgctacacgagcttcacgcatggcttcttccagtaattaaagacggggtggagagagataaggctccggccggtatgtgtaatgtcaaaatgtcggtctccgtctaaatcacttcggcagaaaggttgacgctttaattgacagcttgtccgtgtgtagtagagtgtgagtcagtggctctcccaatatgtaggaggacaacatcggcaggtcaagctctagcggcatgagcacgaactaaccggctggcaagtgacgttttcagtatgctaatgtgaacgacgagagccaacaaaaggcagcgcatgcgtgtgcctaattcttagtttcgttgctgggtaagaaaagcatctctcataagggaacgacgacggcttttattactgtagttctagtttaactgcgaggagatatatgcctatgcctgcctgcttttgaaatgcagactcgggtgttttgtcgcggagatggcctgaaatattccccggccggcggggcattgcattgcttcaccgctgcggctggagctggaccacgggcagggaaaagcggggaccttctacccatcatggcatcttgcctccgaaacgaagatctggatcgcgagtttgttttgtccattatgttctcgtcctgtgcaagcagggttcaatctagctgcatgcatgccgattttccaacaaacattctggagaagagaaatcgagcgggcaggtgt

SEQ ID NO: 2184 - DNA, 1325 bp, Zea mays
  misc_feature (1)..(100): optimal_loci_123264_G1, chr3:190960284..190961608, Cluster 13
ccgctgtactactcacaaagcagcatggaatgtaggccgcttagtttatgtaggatacctaaaacggctggtaatcggtaactttattctggagaacgagtccgccgttgcagtccacaactgagaacaataagccaatgatacaacgcgtccccatccgcggttgtttaatttggtgcttaatgccaacatgggcgcttaatctgagccgatgcccgtacggccaccacggcaccacgacctgtgacggcgacggcgacggcaacggcaacgaaatagtaaagcgtcaaggcatcggcggtaatggctggctggcgggtgtgtgattatgaccggacactgaagtggacgtgcattttttggctttcaatcttgcggcacgggcaggcgctttcccgcacgcgcgggcgacgcgctatgcatgcgcagccacgctgccctgcactgcacatcgagctggcgtcggaccagcggatggtgcggatcggcgccgaacttttcctgcaccgcggcgcgggcgcttctggtctggtgggtgggcgccggccgccgggtggtgtcaaagggtgcgtgtgcgtctggcgcgcacgtccgaatcacccggccggccccgcaatcgcggctgccggcccgcgttgggttttccactggatgttgtgcggtcgctttacgctattgaccgcgccgcgcgcggccgttactgatcggctggtgggtacgctgcgccttgccgccgacacggcgtttctgtgacggctcgacgcgtagcgtagcgctcggggtcgacctctcgctcgccctcagtcccaaccatacggcatggcaggtttaagtcgtgctcgatcgaccaacgccaattatttgggcgctccggcgacattcacattccacgccaattattgggtttaggcgctcagacgatgaagccaccgtaccacgtggtataccccttccctgcacgcatcgtcgtagcttgctgaattcagccgagctcttctcatcaccctctccaacggtgaacggtccaatccctcacatctactcgctgacacagtgcggaccccctcctcccgtctcatgaaatatgtggatgccgttttgccgtgtgcaaccgaaatgcattgcatgcggccggctgaatcgtactggctgctgcaagctcatgtccagggtggcctcgctaatgcaaattagctacggagtacaaggcaactcgctcccatacatagaagaacatgcggtatcatctccaagaagaatcgtctagccggaccggacgtgcgtgcttgctgtttttactataatgcacgaggactaggagtgta

SEQ ID NO: 2185 - DNA, 1377 bp, Zea mays
  misc_feature (1)..(100): optimal_loci_123265_G1, chr3:190961687..190963063, Cluster 13
acactcctccgtcgtactgataaaaatatttcatttgcactgactgactcacgtacaagtgtacggggcggctagattcctgaacctgaggacctttttagacctgttttgttaactcaccacctccacggcccggcgtgcgggcgtttgtctgtatgtctaaaataattgtctcgagagcatatacgaccaagcccaagcgtagtatgagttatgggactgcagccatagtggtgacacggtatagctgcctatagacagtagcggattttacgttggctcatagggccggagctagtgctctactgctgctacgaactgtagcgcttgggccagttccctgcccacgacactgccgtgcatcgaacagacagagagaacgctcggagatcacgggatttgattttttttttttctataaaacaccgcgcgtgtccggtgggtgacgacgcgacggccgggccgacccagcaaaaccatcacgaaacggcagccggagccggctggactcatcttgtcacgcacccggcactcgacgacgagacgagacgaggtgacggacagaggtccattatttccgctagccaaccaaccgaccctggcctcactcccctcgtcatcatccctcggaagttgggaccggctcggcgccgcggggccccccggggttctcccttttcccgaaacggcctccgccacccgtatcacggtcacggtatcagcgccctgccccaggacagggccccacaagcggcccgggaggagcgccgcagcggggagaggtcatgccgtctcactggcctggcggggccagcggcgcggtggcctgtcacggggagatcggcgaggagcccacccggcgggggcagcggaatccagtcgccacgcctcgtccccctcgatatgatgcggcggaatacgagagcagacgcgaggtttgatttgaagcgacctgcccaacaggaagacggcgtcggattttgcactttactccctgtgtgtgtgtgttgcaaaacacacgctccgtgtctcgtactctcgtgtcccttttttttcccgacggtagcactgcctgaaatcaatgtacagccatttcctaattcctcattcacccaaactgtttaaagctacaaacaaaaatacatcgggtgcaatcatatatatcgatgcaaccgtcaaccacaacacaagaatgaggtgaaatactttttaaaaaaaatccaagaaggatagaacgattgctttaataaagatatttttaaaaattcttttcacctttatgattgtgtcttaattgtgtgattgcaccaatatatatgtttgtacctgatatgctcctttagaaaaatatcaatacttttaacgacaaataaatat

SEQ ID NO: 2186 - DNA, 1153 bp, Zea mays
  misc_feature (1)..(100): optimal_loci_124148_G1, chr3:195745579..195746731, Cluster 13
ctcgatcgatcgagatggttcatgtaaagcagcttgggcgctctcagcctcccgtcccttttgctgcatgcctaatggcaattgaccgcgacagcggagcactatagagtccgctgctgtaaagttagtcccggcgttgttcagccatttgacttttgccgcgatggatggtggatttcgatcaatcgggccctgcccgcccaggcccaggcccagggccgccggtccccatccacgcacgctcactctcgccgcgtatcttgctctttctaggacgctaccatggctcacgtcggataagaccctgtctcggagaagtaacgaaaggaagaattctcatctctgtgtcgatcgcccattcctttcatgtagtgtttttttttttgaaatttgatcccttcgaattgtatgttgtaagctgaccttgctgtatattctgtctacagcaccaaataaatcaggtcttcccctgtaccatccaagtccacttgagccgactctattgctctctatgatttgaagtaatcatcctgcagcatccgcgcgccgggtttaattaggtcgaaagaagcggcaaagtaacatccagggtgtgggaagatttataagttcagcagtgtccacggccaaagagagacgacgatccaccaccacgcactcaaagcttcagcgagaatttgggcgtatccataggcaggtgccccaaggaatttgaacggacccaaactgatgcggggtgaaggaacgtaccgatggagatggatggatatatttatggatgcaaccaatctgtcattagctacaagtcgggtctccttagcctctcctgtgaccacagagacctgagtccggtccccttcccatggcagagacgggcgaccacggcactgtgcgcgacgactccagcacagcatgcacgtactggtttcggatgcgtacatacgtgcacgcattgacgcacgcacgccaatcgacagacaggtgtggtccggctcttattgtgccatgcacacctgtgattcttggcagttcgcattaggtgcgactaataaaggtcccgtttggatagttttaccgtcgtagaaactgatttcttaaggaacaaaattatttctcgacgaatcagacccgcggttttgtgaaaaatgattga

SEQ ID NO: 2187 - DNA, 1095 bp, Zea mays
  misc_feature (1)..(100): optimal_loci_127359_G1, chr3:212253893..212254987, Cluster 13
gcaggaaacgaaacaagaagtttggatcacttgatggcgaccggtcgcaagcccttgcacagttgcactagcaattgatgcgaggtgaacgattacatcgacacatgcatgtttgacgactgtggttatagggttcaatggtggagcgatgtcagcattgttttgttgccaatccaatggttgcctgtcgcgacaacctctgcgcacaccgcagacgataaccttgagcgctcgtcgaacacccttacacccgcatgttcctcttccttccggtgcagtggtgcacgatgatgcgagcagaagaagagcattgaagcccttttgatgcatggccgggatctccagcctgcatcggatccaccagcaccagtccgccaaagacgtcatcgggatcgcgagcaggtgtggccgaggcccaagggtgaaagcagccgatgtcaggtctccaccgtgaactgtgcacactgcacagacagagagtcgaggagaagatgcatcactgtctctctgccttggccagtccacaaagcgcacaactgtcgtcgtcctgtagatggtgctacaaccttcgctagctcggctgtccatacgccactcgtgaatgtccaactagtagaaaaacgcgaggcggccctcagctcgcgcgcgccacaattctctagcgcccacaagctttgacatgccaaggagaaggtggaggagtttgcactctccgtccatctcgattatctagctggtagtcctcctgcgtgtgtcactgtcctccccgcgcgcacgcgaaggaatgaccatgaaaagagcaggcacgattatttcatcggccctacatgaactcctgcacttgttgatctccttgatggctcgcccatagagaaagatagcaatcgaaatatggattggcttggccgatgggctgaccttggtcagcatcatccttcccacttctgggagaaggtctgatttctagttccaggttggaatcttgcttgccaatgctgaaagtgtcatacgtgaactaaaatttactccagtgttatccacactcgcgttgtcatagtagacgagagagataaggtgtgcgctggagtgagtgta

SEQ ID NO: 2188 - DNA, 1341 bp, Zea mays
  misc_feature (1)..(100): optimal_loci_129622_G1, chr3:223538095..223539435, Cluster 13
cgaactggtgagagcgccctcgcgttaaggggctatttacgggagtgccactttgccgttgcgcttgcgctctgctctcctgcggtcctgcctggcgcgctgcgcgggaaggtgacaaggcgaggagcaggcctgcaggggagtcatctgggtacgcacgcacggtttgccaatggtttctgcccagtttccaactagtgctgctatacttttttattttgaaatgaatgattttataatcggtggtaagtacgtagtaggtgtttcgctccactcactgcagtttttaattgctccgagcctcggcctgcactgcaccgcgggcggggtggcgggtgcacgcgtcaagatcgtatgcagagctatcgttcgtcacccctgacgattgacgaaccacgaagaggactcggccaaacacctccaaataatatcctcctggaccccgaagcgcaaacgttttaactggtgggaaaattcgacctgttttttgaagcgagtcgaaccgaaccacgacaagctaggactctgccacactagctacggctacggggtccaaatccgtagtagtagaaccaaccaaaagggtaatccggatcgggagaggcgtcgcgacactgtgtctccgtgccgtgccggtcacgagccagcggggacgcgcgagcggcatgcacgccggccggccggcacggcagcgggaaaagggagctgcgctgcgcccatggcccatgcatgccatgcaccctggtccctgtgcagtctcaatcccagccaaaaaggaggcgggcgggcggacagcacccgcaggccgccgcagttgtaaaaagggggtgactgtgactgactgccaagcaaaagtcaggccgcagccctgtgctctttcggacagtttctagctcatgttcttgtcccttgttattatcaccatggatggcttttcgttcccatgcacatccacactctctcgtacgtgctctcttcaatcttgttgcagccaggagccggccggccgggcacgtgtgccggagagcagcacggattttagccagcgtccggagcgcgtcgtagttgctggtactcacccgtgtacatgtacgggcggtgttgcaatgatgagcagcaaatgcttcgtgcctgcatgacatatttaacgctttctctagcagcttccatattcttattttttatatctaaaacatcgctctacgacaagtgtaatttatattgcggaacaatgtaaagtaatagtgttttaggtgaccaaacggggtgtagatacggttgggtacgttcgccgtaaatgaaacgctagggtttttaattttctcatgtgtgtttggcccg

SEQ ID NO: 2189 - DNA, 1010 bp, Zea mays
  misc_feature (1)..(100): optimal_loci_129894_G1, chr3:224932173..224933182, Cluster 13
  modified_base (95)..(95): a, c, g, or t
  modified_base (96)..(96): a, c, g, or t
  modified_base (97)..(97): a, c, g, or t
  modified_base (98)..(98): a, c, g, or t
  modified_base (99)..(99): a, c, g, or t
  modified_base (100)..(100): a, c, g, or t
  modified_base (101)..(101): a, c, g, or t
  misc_feature (101)..(194): n is a, c, g, or t
  modified_base (102)..(102): a, c, g, or t
  modified_base (103)..(103): a, c, g, or t
  modified_base (104)..(104): a, c, g, or t
  modified_base (105)..(105): a, c, g, or t
  modified_base (106)..(106): a, c, g, or t
  modified_base (107)..(107): a, c, g, or t
  modified_base (108)..(108): a, c, g, or t
  modified_base (109)..(109): a, c, g, or t
  modified_base (110)..(110): a, c, g, or t
  modified_base (111)..(111): a, c, g, or t
  modified_base (112)..(112): a, c, g, or t
  modified_base (113)..(113): a, c, g, or t
  modified_base (114)..(114): a, c, g, or t
  modified_base (115)..(115): a, c, g, or t
  modified_base (116)..(116): a, c, g, or t
  modified_base (117)..(117): a, c, g, or t
  modified_base (118)..(118): a, c, g, or t
  modified_base (119)..(119): a, c, g, or t
  modified_base (120)..(120): a, c, g, or t
  modified_base (121)..(121): a, c, g, or t
  modified_base (122)..(122): a, c, g, or t
  modified_base (123)..(123): a, c, g, or t
  modified_base (124)..(124): a, c, g, or t
  modified_base (125)..(125): a, c, g, or t
  modified_base (126)..(126): a, c, g, or t
  modified_base (127)..(127): a, c, g, or t
  modified_base (128)..(128): a, c, g, or t
  modified_base (129)..(129): a, c, g, or t
  modified_base (130)..(130): a, c, g, or t
  modified_base (131)..(131): a, c, g, or t
  modified_base (132)..(132): a, c, g, or t
  modified_base (133)..(133): a, c, g, or t
  modified_base (134)..(134): a, c, g, or t
  modified_base (135)..(135): a, c, g, or t
  modified_base (136)..(136): a, c, g, or t
  modified_base (137)..(137): a, c, g, or t
  modified_base (138)..(138): a, c, g, or t
  modified_base (139)..(139): a, c, g, or t
  modified_base (140)..(140): a, c, g, or t
  modified_base (141)..(141): a, c, g, or t
  modified_base (142)..(142): a, c, g, or t
  modified_base (143)..(143): a, c, g, or t
  modified_base (144)..(144): a, c, g, or t
  modified_base (145)..(145): a, c, g, or t
  modified_base (146)..(146): a, c, g, or t
  modified_base (147)..(147): a, c, g, or t
  modified_base (148)..(148): a, c, g, or t
  modified_base (149)..(149): a, c, g, or t
  modified_base (150)..(150): a, c, g, or t
  modified_base (151)..(151): a, c, g, or t
  modified_base (152)..(152): a, c, g, or t
  modified_base (153)..(153): a, c, g, or t
  modified_base (154)..(154): a, c, g, or t
  modified_base (155)..(155): a, c, g, or t
  modified_base (156)..(156): a, c, g, or t
  modified_base (157)..(157): a, c, g, or t
  modified_base (158)..(158): a, c, g, or t
  modified_base (159)..(159): a, c, g, or t
  modified_base (160)..(160): a, c, g, or t
  modified_base (161)..(161): a, c, g, or t
  modified_base (162)..(162): a, c, g, or t
  modified_base (163)..(163): a, c, g, or t
  modified_base (164)..(164): a, c, g, or t
  modified_base (165)..(165): a, c, g, or t
  modified_base (166)..(166): a, c, g, or t
  modified_base (167)..(167): a, c, g, or t
  modified_base (168)..(168): a, c, g, or t
  modified_base (169)..(169): a, c, g, or t
  modified_base (170)..(170): a, c, g, or t
  modified_base (171)..(171): a, c, g, or t
  modified_base (172)..(172): a, c, g, or t
  modified_base (173)..(173): a, c, g, or t
  modified_base (174)..(174): a, c, g, or t
  modified_base (175)..(175): a, c, g, or t
  modified_base (176)..(176): a, c, g, or t
  modified_base (177)..(177): a, c, g, or t
  modified_base (178)..(178): a, c, g, or t
  modified_base (179)..(179): a, c, g, or t
  modified_base (180)..(180): a, c, g, or t
  modified_base (181)..(181): a, c, g, or t
  modified_base (182)..(182): a, c, g, or t
  modified_base (183)..(183): a, c, g, or t
  modified_base (184)..(184): a, c, g, or t
  modified_base (185)..(185): a, c, g, or t
  modified_base (186)..(186): a, c, g, or t
  modified_base (187)..(187): a, c, g, or t
  modified_base (188)..(188): a, c, g, or t
  modified_base (189)..(189): a, c, g, or t
  modified_base (190)..(190): a, c, g, or t
  modified_base (191)..(191): a, c, g, or t
  modified_base (192)..(192): a, c, g, or t
  modified_base (193)..(193): a, c, g, or t
  modified_base (194)..(194): a, c, g, or t
ctatgacgtgcgacggagtacgtatcccgtcggctggacgtgcgacgcgtaaagtatcgcgtcgctggatacgcgacggagtacatacttcgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaacgggcgtccgaagaatcaagcttgattcgtttgcatggttcttgcttctccaccgtacgtcatccctagctcctctctctctatgctgcctgatcaccgagctttaatttcctgtgatgatgtagcttatgaaaccaacatcttgtgctataaggatacgcgagctgttgataaaaaaaggaaacgaacgaggggggggggggggttctcccccctactccatcaccatcagcttccagctagtgctgctatggcggttcacaataacagtggcaaaagaggagcgaaaagatcgaagggcgccaagaggaaaattccccgcgcgctaggcggcggtgctgaatcagactacgatggtgacagtgccgccacatcgccatccctgtctctcgtttcatgccgcgcgcgttgctttcaggcatttgttcgcgcgcggagatgaggcatgggttttctggtacgttgtcactgctgtcttcctgttttcacctcgatcgagaggccttaatacagaatgtgaaagaataagaagaagaaaaaaacctccccgatcggccactgacaaaacttcatacagaatgcatgcatggttgcattgcacacgcgtaccctagtgacggaataatgaaattcttttaatatatatattgtgctcatgtgaagaaaaaagctggattattccatgacataaaattctttcaatctttcgacgacgacgtcttcttttctcctccacacacacgcgcaattaaagagctgcatttatcgcgcagctcagaagaaacttttgctcgacgcgagggctagctagc

SEQ ID NO: 2190 - DNA, 1370 bp, Zea mays
  misc_feature (1)..(100): optimal_loci_133813_G1, chr4:11275665..11277034, Cluster 13
agcaaaggattttgtgaatcaactccaagatgactcgagccctaggtttgtatggatggtacgcacaagatatgaagataaagaagcgagatatagtcacatctgccacgagctggataccatccgtcacaccaaaggtggtggcgccatagggccagctccaggaaccaccgaagccaaaaccctaggggcataaacaccatgataaatccattgatggtcgctgaacacgagacacctaacccgagcatgaagccattggatatggccgccatctcatagggcgtgttgtctcgccacggtcaaatgagcaccacaataggggcagggtgggagggatgattacaatatgtggggcaccaaatccagccaccgaatataaatgtagccacaataccgagtcaccatgccgcacaaggtgagaggggggacactggaccacaggccacgtgacgaggcaccaccgtcaacggcaataggatgagcccccaccattgccagtgacgagatgagcccctcctcacccccgccgccatagtacgcaggacaaaccacctcattcacaggctacacgatgagcacccgctgtcgccacatgccacagatcgagttgttgccctcgccgttgactaagccgatgaagacatgtcgagttgttcctagtgggctgatggcagccttgagctcgtctagagtgcaaacgagcagcgccatagactctagcatccgggagaggtcctgagtcaacaacgactgcaagaacgccgtgcgcaaacgcctcaacgatgacaacccggcgcagccgtctgctggccgaccacgtcgccatggactcgcgccccagcacctggaacatcgccactcctgaagcattcaacaaccaccctcacaacaccctagcagccaaaagaggaagaagccccttgctgctgtctttcttggggtctgcacagtgtctagcagcctcctatggcgacagtgagggggagaaggaagatgtagaggtggtggcaggtagggtttgagggaggagggagatggagaggcggcctgatttatattgattcataattattatatcgagtcgatatagtgaccgtgaacgcatttcaacctcatagaagcacatagcctaaatagagataaatgagagcctggtactctagtgactttaaaattgatgctgtcacaacatatgcgctcaagtgcactgacacctttgaccctgagatgatgatgactggcctatgcgtttggtccacggatagtaagttcatcgggcatcggttgctcccgcacgcaagcagaatgggtttgcaggccatttttctcgtaatgggacctttcacgatcgtctggcgccacatgaa

SEQ ID NO: 2191 - DNA, 1005 bp, Zea mays
  misc_feature (1)..(100): optimal_loci_139322_G1, chr4:41850689..41851693, Cluster 13
gctgtactgatgctgttgcactagacacagcagccgcaagtgccaagtgcaagatgggatgtactgtatctgggacacacagctcactcactgtcactatacgcaccactcactgctcgatcgcactggcaacagatcccagcgctagctaggtttatttatctacgtgttctgttgcacggcctgcatctgcatctgtacgcagtgaacacgtttgcaggatgcaggggggggtacatgatgacctaaccaccaccctcttaaaccaaatggcctacctgtttgtctgcactggaataaaaacggtggttctttctgcagctactcgtaatcaaagggctcacttcgatgcggattcagatccctacgtactcttccatctagctaggcttgcattggacgaaccataatgcatgcaggatgcagctgcatgcggccttccagtccaccgccacctcacacacatggtgtgctctgccaccgaggcattccctcactgccctgcccctcctgcatcctgttccaatggatggcgagagccaagagcccaccacccccttttttttctgttcgtttgttcgagtgcaaaatggcaaagccttgttcgcagcatcacaatcggttactctgcacagccacctgctgcaccccttccctgaagaaaataaaatgtcgggcgcagcgccagcgcaggaggaagggaagggcaaggaatagggattccagtggatagataggtcgtcggacgttggcagatgctatcgcccgtcagcgtgtcgtggatctcgagacgcgggaggatgaggaaaagtctctcgtttccagtcctgcaggctgcagctagaagaagcagtatccccctagtgctgctctgctccagcatagatgctactacacacggcgtgctggtgcagcagcctggacatgtcgtatggaagtggtattgccagactcatcgtcgtcagaaactgcttccttcttctgcaatttcctctaataaatttc

SEQ ID NO: 2192 - DNA, 1372 bp, Zea mays
  misc_feature (1)..(100): optimal_loci_141963_G1, chr4:57570389..57571760, Cluster 13
aaccaagatggcggcggcacaacgattaaaattgcagacatagttttagtaagttaaataattgaaaaacacatcgttgtaattttagcaggccagatccatcacataagactatatatacatgtatacatacttgaagggtccttccaaacttgggggcccggtgcggccgctccagttggccccctccgtctggccctggtcgtgccaccatcgccgtgccacctgtaccaattttgcccttccgtacgtttcacttcactctttgctgcaggatttgcagtaggctggagcacccaattgcgaaattagacccacctgaacacagaacctgactgacccggcccggccacaggagaggaggcgagagaatgtaatcaaccactcgtccgtccctgcaggctctcgcgggccgtatgtaaaaagctcgcgtttgttgtgtgtatcgttttgggccttgaggtcctggtcctggtcctggacgccttgttgtatcttgattgcttcgacaccatctcacgtccggtccgtggttaagccgtcactttggcccatccctctctccgctccgaagtcccaattgccaccactctgacgatgtgatgattattttcagtccgtcgtatactcagatcgctacagaaattgattgccacccatgggcgtacgcgtagcaatgcatggcaagtcgttctgcctacggtcgacctccggctatatgtaatgttcgatcttccgtgacatagccacatagggcactgtagcattaataggagcggcgaaccggcagcggtggcggacggccggtctacgcctctagctagctggctagtgcgcatcacgatttcaatggagacgtgtacgtacgacctgactgaataccacacgcgcccgcctgtgatcgtgctgagtagagagtagcatagtacactttacccgccgccgagggcatgaggccgtgaaccgccgcgcgacggcacggcacgggtccccggtgcggcggcggcggcggctgccccgtgtggccttccgttgcctgcctgacctgccctgaccaacccgaacgccctgtggcggtgtggcctgtggcttcgtggtattgaagcgcccttcactggtcaccaactctccagtggcatcgttcgattcatcgctgcacactgcagtctcttgacggttccatggcatcttctcgttggtcctgccttttttaaaatttttgggtcaacctccgggcaaagatcctctctctcttctgttacgatctgtttgattccctcggctcttaaatctggtgttttcgacactggatacgagtttttatcagtttcttatatcagtgtttgtcggacctgggcgcagtcgcgagctg

SEQ ID NO: 2193 - DNA, 1162 bp, Zea mays
  misc_feature (1)..(100): optimal_loci_142025_G1, chr4:57928548..57929709, Cluster 13
tcgccaacaactgatactaatctcttagtacattttactaataaatggctctaatcgattactaaaactaagattttagtactaaatagagctatcgacctatactaattagaatggtatacctatgttagcataatcattaattagaaatgctgtgctcgtcccgtactgtctggcatgctcaccgctcacgcatggagaaaggggatgcaacccaaagtgctcattggcagccactggtccggttcggttactgctttatcgatcgggtgagttggcatccagttcttcagggggcggtgttcttcacacagaagtcctttcgtggggttcagctcaagacagaagagttggagtccagctaacgagcaagtactccctgaccaggcacgggaagccgctgtcgcgacaagccgacaagccgcatgccgccacgcgtgtcgcagaggcattggctcgacttgccctttcggatccgttaaggtcttgatcacctcccgaccaaagtacacaaatcgtgcccctcaccccacccccaaactttcagtgattctccgctgaatcaacacttgtttttaggccatcgatggagattctacaaaagatttcaaacttgcaaagtcaaacgagacgtcccaagagaagagatgggtttgatcaggtatacagtatttccaaatctaccaaagcgtattgagactgacaatgaaagttgaagtgtttcttctcaattaatgaagagatggaccatcacaactaaacgctatgaatagtttatcaaatcgtgaaatgaagcaacgcactgtaaaccttaatagtagttccaacctgtttaaatgatttgatagtgttgaaaaccgtgaaataaaccatggcactgagaatatagccttaaagaacctgatcaagattgatgggagatgattcttcttcttccgtgagtcaagtcgcccctccttcgaagtcactcttagctctatcggcgttggcatcagtgttcccgtcttattttcattcctcttctatgatggttcaattcctatccatcaccacctatcacctcgttaatctgttgatgtcatgatatcgtcgctctagctctgtcctccgctttctactggctcttgccaccaatatttttaataatcaccaaatgttattt

SEQ ID NO: 2194 - DNA, 1298 bp, Zea mays
  misc_feature (1)..(100): optimal_loci_142752_G1, chr4:62353090..62354387, Cluster 13
atatatatatatatatggatggatcgcgtgactgctgcgtgacgaaggtcacattcaggcgggccgaccacagctaccatccacgaatcatgcaatcaggcgcatccccaaacagaagaaaaaaaagtcgtctgtttttcctggaccgcagcttgcggcgccgaagcgttctgcttctgcccggcgctatgccccggcccggcctaccacacacacacgtgcagctgatgcaggcgcccagacgacacaaatgacgggcggtggtagactggtagtggtagtaggacgtacgtaggaggtgtgtttcatatatatttgagagtgcatggaacgttctcgattcagtacatgcatgatagacccatgtctttttctttcaggaacgtgtatatatagagagagagagagttatagacccatatggatatgagctaggcagcaagttatagataaattctttcggtgtaattaaaacgcagcactgtactgatgtttcccttgcagcagcctctgctcttgtgctttgccatctctttcgcgcggtagctatcgtattaatttgatacccatgtgtctcatgtgggtggccgtgacgacacggaggacaaccaaccgagctggacaacaagttttatcacggtttcagaaacgatgatcatggagttttatcatggagatttgcttgggttgtggcatatccgcagaccgcaggttagggcggtcttccgttggagtcttgatcatgtccacctctcgtcattcaacaacgcgcttccgcagagacctggctatgctagcagataacacacatgtaaatgcaagtgtcgatataccaaaccaatgtgagggaaagggacaaactgaattttttttctctctctaaggtttggttgcttgttggcaacctacacctctattgaggtggatcctaagattcaccactccacatagaagatggtagacctctctaaacatgaactgattcaacttgagctacttttttttttgaatctcccatgggaatgagcccacagcccctcataatagccagcacatgatgtatatgtgacccgattttttgataagcttcaaaccatgtctaattttttgatagtttttttttaaatatgtaagtttgattgttggtgacaggtcaagcttgctattaccacttaccacatgtcggaggtaataattagggatacctaaattattccccgagcaaacgcacccagagaaataaggacgaaactcccgaaggtgacaaccgagctacctatagaaaccgagacatctcc

SEQ ID NO: 2195 - DNA, 1217 bp, Zea mays
  misc_feature (1)..(100): optimal_loci_155931_G1, chr4:152086901..152088117, Cluster 13
agcaaataataattgacgcggaaagcaaatccagtttgtaaccacagcacggaacggggaaaactaaaattgtataggtgactagagattgaatccgatcgacatcggtctcaggtacaaatcgccagaggtgtgcgcatgcaagattggtgccgcatagaatactgccgagtggtctaatcatgcgtagattgcgcattttgttaattcagagtgctatatcggcgacaaaaaatgccccccccccccccccccccccccgcattttgaaaaggaagattgcaagaccgcttgcttctaaacaaaacctgcgggcggccgggactattcaatagcgaatcgtcctacgctacgagttgccggaccccgccaagaacgacagatcaccaaagccggccctttcaaagctctggtaccagcagcacattaatctgctgtatgtcgatctaatgcccattcctagtcgcccgaatcaatggccgatcgtccatggttaagccctcatggccctgctcctctttatgttacctaacagaccttttcacccccggaatcatcttagcttgtcgtccaaagcatgcagcagccttcttccggggctggggcgggctcgacagagaataggattctagcgagaaagaagaagcatggcttgacttcctggcccattgcataataagctagctcacaatcacgcacggatcagacagagatcaggctttaagaaatgctatctagctagacagattcgtgcctgcgtgatgaatcatgagcgaccagtataggcacagcatggcagatgttctcagctggtttggaaaggcttgctattcgttaaataaccatgcttcgatcgatcctcggctgttgagacagcactgattcttcttgtaattgctagtgcctgtagtactagctagtagtactacttgaaaatacaaaattaggcaatcatgcagggcctaatggaacgttgaaggcatgcatgattataattatgattactatagggtggcggttacggcagtcacatctcgcatcgatgttgagaagagagtgctgactgctgggagcttccgaaagatgcaggctacgatagggaaccactgaatgtgattgctacgaccaaaatgattctagtaacgctagctccttggttagcttttgtgccagctgagttgctaccgctagactgaatattatctatggtgtgagag

SEQ ID NO: 2196 - DNA, 1328 bp, Zea mays
  misc_feature (1)..(100): optimal_loci_156064_G1, chr4:152694736..152696063, Cluster 13
gagtacaggaccctttagaagtctttgttggagctagtttaagaatgaaaggcagtctccagcagctatcttattgtattcccatctcatcctctatttaaaactccgctctacaaatattgtaacctacacttcaaatctcctattgtacacgatcgattgcggacaacttaaatgtaattttatacgaagttgtatgtcgcatcaccacaataaataacgacacggtgtccatgcatgggacaatttttgacattaccggatcacttggcgtctgaagttataatatttgcacgctattgattcaccttcaaactctccaaaggtatttttataatcatttagttgtggggctaaataggtgtggcttgacggcacgctaagactgtcttcagcgacctctctatcatcacatcttctattccaaactctacactctataagtaaattgtacagtctagtataaaataatagttcataccatatacacgttcttgtaagcacgcggatgtaagagtggtacttgcagttttggcttaggacctattcgtttggcccgaaattcatcccagaattattttagctaatcaaatgttatataaattagctaactaatccggctagaaatagtttcgggtggctaatcccaggaaccgaacgggcccttcgcgagcgcgaggcgatccaggtgcagccagtcggccagccgttcatctgtccacgcacgacgtaagcgaggacgacgcacgcgtgtgacgcgtcccgtttgggcgtttgcggtttgcccacaaccacctacctactcctgcgtagccgacgggacgggaacaccaccacctgcgctgcgctgtgcagtactcgatcggcctgcctcgcttcgcttcccagttcagctgccatgccacggacggacggacccacctaggccggcgttgcggtgtaccgctgccatcctgtcattctgcgcgccggagtagtacgagtacctgtagagtatggctgctgcagggctgtgctggcatggcaggcaggtactcactggagggactggcaggaaaaagagcaccgaactcgtgctctatcaatcccgtcgtccgcactcggcagtcggcacccaaccccccacccccaggccccagctatagctccctccgcagccgcagcacaggccaatgcaggcaggttgacgctttgactgagctgagcaaagcaaagcgaaactgaaactgaaaccgaaacgaatggagttccgcccacagtactactaagcgaccggccgtagtgccacgacagccgaatcaattatttactacccaactgttgtattt

SEQ ID NO: 2197 - DNA, 1267 bp, Zea mays
  misc_feature (1)..(100): optimal_loci_156124_G1, chr4:153047570..153048836, Cluster 13
caacgttgactaggatcacccttcagttcttcaaaatttggtcactactggaaagtggccagattggagccgacatgcctgctgttgtagcttcttgtctgcctgaggacgagagccgccgctacctgttgtggacagccggtgccgggcgtgcatctaggtagtccatggctactagggtttcggcggtggccgtgttactccctacttgctctccgttggaaccatcagctcctgcaggcactccagtacccgacgacctcacctacatatacatcaagaaagaaaaggccgcttccctgtttcacttcgtccttgcaaatgctgtgcaatgcaatcgatatacatatatgctgcacatattactgtgttggaaacgcatttaccttgatcctttcgaatgcttttctcaaagaagcacggcaagaatcacctgcggatcagacaactgtgtctatgaatgaatgctcaaacatgcatatacacgtacgccacggatgaaggtcataatgtatagctgcactaggatcatatatagggatacatgatattctctctcatcggttgagcgtaatccagatggattccctgatcaccaccctcatgcccatgacgctgaagctgctgcggcgcacatgcaaaaccctaacgacatgcccagcatttctaactaccacacctggtgaagtcgtcacgtccttcttcttcgccgccaccgcttcgttggccgtcgatgcacccattttgcttccaaccggaatctccgacgacgacgacgaagatctcatatcccccttgttggcagcaccaccatctaccacaccctatggaaaacagagagaaaatggaaacaaaacgattgggagttaattagaagtagctaaagaacttatatattggcctagatatgatacaactgttttagttagagtgtgaattagcttacataccttaggtggtgaggaagtgagcttgcttgagcagtgcttaccatggacgcggagatggcgagccttgcagttggtaacgtagagagtaaggatgaacacaactaggaggtcggtagcagtgagccttagcttccccttgagagtgagagctaggagagagcttacgctaaacatggagtggtgtggttgcttcttgtggtctcttacaagacatatgcatgggcagggacgagaatgatatgatgaagtaccatagagtggcaatgggctatgctttgtcttgcctccaagctgcgtgcttttgtatcatcgttcag

SEQ ID NO: 2198 - DNA, 1035 bp, Zea mays
  misc_feature (1)..(100): optimal_loci_156176_G1, chr4:153255444..153256478, Cluster 13
tcggatctgacggtcctactcgtgcttactacgctccggactcctgagcacgcgcacggcaggccggctggcaacgaaacagttggactggaagaaacgggcgggcggggcagctgccaaaaccgcgcggcaacaacgacgagggacggacgccgacgcgcttgttatctataattctcttgagccgtccagcgcggctgcgccttggttggggttggggcgagtgacgcaaatgcgaaaagcgaggggtggtagtttcgcactttggccggcgacgcgatatcaaggttcgttgcgtttggggaatcgggaccaagagacgattgggttgggggggggggggggggacccggctggctttggccagaaaccaaaagaggcgcccccttcgcttttgacctttgtttggatggacgttctaaaagcacggcgatatcaaatccggaaagggaaagggaaaaaaaaaggaaaggttatttattttagattaaagtcagctaaaccctcaacggctgtagagtgagaccgagggaaagcgcccccagatcgtttccttgtagctgtaggcaaatgagctagccgcttgcagcggatgcaatctttcctttataagtacaagtgtttcctgcaagtagcagcatgagtcagtaaataaaatcacagcactgtatttgcgcgccagccctctgacctgagtacctgacttggcgctgcacccatgcacgagcagcgactttggcacacagctgcgtcggccggcgtttcatatatatttttacttacatgcatgcatgcatgcatacgaggaagatgaaaacgctgattttacttttacgtgacacgacaaatgcgaatgcgaggacgtttctgcgctctggagagagagagagagagagagtcgccggcgcgcgagaggttctccgtccggatcgcgtccacggcgacggcgacggcgacaccatccaggcactgctgtgtttctagttatgcatgctctccgcacgcggcgtttggtgtgaactaattccacgacgg

SEQ ID NO: 2199 - DNA, 1139 bp, Zea mays
  misc_feature (1)..(100): optimal_loci_156179_G1, chr4:153257684..153258822, Cluster 13
ggacagaacgatttaaagtagtcatccaggcgcaagcggttcagccggcggcgttcagctccaccgccgggcacatggcgtgatggcccgccgccgacacgcacgcctgccgccggccgcctcaactgagccagcgctgcgcgctcgatcgtgctcgccctacccagctgctggaaagctacgactactgcggcgcgcccgcccgctgtgtgtggtgtccatttaaagcgtatccctggcttcagcctagctgtttatttagccgtgacaaaggtgcacgatcacgtgcatggggctgctgcagcactgcagcggcagccataacttgtgcctgccattacacacatcgtcagatagagagagagaaaggcacatgcacgttccagctcatcgaccgacccagctgggggcgcggagggacgatagggaatcggaaggaggaggagagggacacgcgatcgatgaagccggccggctaatggctgtccttgacacggaacggaaagccgggcacagggatcatgctcaagcagaagcaaaggcaaagcaaagcagccagcgaaaggcctcccttgtccttatcaaccaaggctgcaagctttttcccgctcgcatcgcatgccaagctagcgggggaaaagcggccggcggccggaagagtaaagcgtagcagcaggcggcacggcagaaagggaccggccccggccccggcccggccgtgtgccagtgcctgccagccgagcgcatgcatgcatgccgcggcgtctctgcatcgcagggcaagggcagcgcgctgtattgcatgcactgcgccatgacgcgtcgctgggaggaggagcatgggccgcgactgcgagaggggacgtgtatgtgttgtgtgtgtagggctcgaccatcgtcaccatgcatgtccgtctctgcctctccacccatgcatgcgcccactgcgcgtacgtccaccaaagtgccggagtaataatggagacgggagaggccaggtcgtgtacaacttggataagtactacccgctagccttgccgatttactattctagtcttattttttaaaaaaaatcaaatacaagtctatttattctagagatcaacgcttcgacatatgacatcgaacttaggacacgt

SEQ ID NO: 2200 - DNA, 1234 bp, Zea mays
  misc_feature (1)..(100): optimal_loci_157055_G1, chr4:157474256..157475489, Cluster 13
ttgatctcactttattcactcacgtacgtagatgaagacacataaactggtacgatggtcggcacacatcctgcttcagatcagtcgcctctgctcatttttgtccaattaacgccgagagtactgcaagcttgtcttgtaggcagtgagcaagacggcaccagcttttgctgccagcaccacagctagcatgttcatgcatgtaagggtagccgggtagtagcagggcgccttcaaaccacgggcagtgtgcagcggcgtctccgtacggcgatctgttgccggccgaggggcgggcaatgcaccatgcaatccgtccggcagatcagtatgcatggctggcgcagtggcaaatactagacgacgcccgcgtatgtgcacaaggtttcaaccggggatatgatgatggcgccgcgacacacctgcgcgcgtgtccttccaacgtatgaaatgcatgcatgggccagcgccggccggcagacggcagaccatatgcgttttgtggttgcaactccaactgtacgcatagatcgatcgatgcaatctgttggttgtctgcttatcgtttcagagacgcacacgtactgttggcggtttgatgctgttcgtcccatcacggacacggtggacgcatacggatgctgcaataaaataatgactcgataattgacgctgtgttgcttctgtggctcatgcgttattgatgatggaagcatatactgacgccgacctgtgcaggcaacactgtcacgtctgtttgctactagtgtatgacctcatgaatgaatagttgtagctagtagtaccggcccctccttttgcagacttgttgatttgctttcaaagagaaaccatgtttattgaagtgctttttataggctttctttgttgatgtgcttgtgttgaaaatccccttgatcatactcatacgtcatacgtggtatcaatatattagaaactaaacatccagaaaattggaatggaaccattttattctttctcactcaacaaccaaacttcatctggcttggagctagctagcaccaaagaggggctcggatcagatacacgctgaaatgagggcagcaaaatgaaggcacagcgctacacgctcagacaaatgcgcatgcgatttattacttctatctcatcaaatcgagtatattactacaaaagagcatctttcgcccacgtacggttgttagcctcatcttggcgccggtccaacttctag

SEQ ID NO: 2201 - DNA, 1213 bp, Zea mays
  misc_feature (1)..(100): optimal_loci_157478_G1, chr4:159657859..159659071, Cluster 13
ggatcccgcaaacgatcattgatcagatatatatatatatccacgcacgtcgtacggccggccagccgctgcgcgcacggcggccggccacgtcgcgagcgccgagccgccggccggctgatatatcaggcggagagacgccattgccgcgcgctggcagtcggctccgccgtcggccgtcggggttacctgggtgctgccacgcatggcgatattcctgattgtgggctagtagtttattgctgggcggctggacacgcgcgacgtcgcgacgggctggttccatgcgcgtactttttggtactccgtccctcgatgattgcttgcccaaactggcaaccgagcaaatccgttgagcaccggcccgatatgatcgagcattaattcgagctagctgcagcaaattaaagcatgctccagatcatcgtctgctgactgctgggacgccatgcaatgcagagagagagagagagagagatgctgtggaccggaggtccggagcggatgaaccacgcccgaccaagcgtagatgggtgcacgtacctgccgtatgcggatcgaccatccgagccatctgggtcaattcaaaggcgcacgtttgacagacatgtgagagacggatcggaggcgggcgggcgtacgcaaaggctcgcaatcattcaggacacgtatgcatgtcctgcggccgctgtagtagacgtggcccgcgctagctcgtcccggccggcgccgcaaccagcaacgtgcgccgacccctccgcggcgcgatcgagcgccggcggcggccgggtacgtacgtagttgggctatattcttctattcctcggatatttctcggtcggtccctggtgacggccggccaacacatgccctctgcccctaccctacggccgtgggacacagccgatgagagggagagcacgtatacgacgcaatggccacaacacgcggcaggtgaacgactgcggctccggaggagaggggaccgatgcagtccgcgccggtccaaactcgaccgtcagtcgctcggtcgagatggcgggcaagtaccatgcatgtgggattccaggacaagcacaccgcagcgcatgcggcgccatccatcttccattctttctcctagttgtgtccctagctcctccatcgactacgacagacagcgcgcgcgcgcgcacacacataggtgtccgtacgtggcagccaggagcccgag

SEQ ID NO: 2202 - DNA, 1323 bp, Zea mays
  misc_feature (1)..(100): optimal_loci_157594_G1, chr4:160249873..160251195, Cluster 13
ttgaagagaggccctactagatgcttttgatgacgactgattgaactgtagcaagctggctgatatatggcatttggaggtgtgtgttaattacatgggagagatgaagttagcattatactaatttatatgggttcatggaatggaacagtgagacagcctaattgagatccattggttccattctagtagcaacgttttcattttcctcttcggagaatcttcatcttagcatgcagtttgggaaaggaggtgtcctctctggtcttgccaaaaggcgagctactacttgagtagttgagtgtctcgcactctcggcctctcgctctcccacccaccaacagccaatcgcacacaatgacacgcacgacccagcagcagcagcagcagacaaagcgcgcatcggcgaaatagttgagccagcgaggtgtacatacagacccagccctgtacgagcccgttttggacggcaagctgccatttgcatttgttaagtaccatgcttttgttgacagcgcgccctagctaacaggtgtacatcagccatggtatatgagacacaaattaaactggcatgtggctagtctacctttttttgtctatctcttccggatccaccccaaatggtagcagagaggaaccaagcaatccgtgtgtaatttaggtacgtagtagcctgatagccctgtccaatgacttcatgacgatcttcaatgcatgcgccattgcgcatgcatgaatctcgtaccagacaagtagccgctggaacagacgtacatatgcatgcaggaggccgccgggcagcgctggctggagtgcagatgatccttgtggccgcgcccagcgccaagaaccggctatctcgcggtcgcggccgcggccggcgcgagacgcgtcgatggcgtgccgccgaccgaccaataaccagcgtgcgggcgcgcggccctccgatccgccccagtcggccggccagtcttcctgacgactcctcaagcgccggccggctagctggtcgtgaaggcacggcagagacatcagacatgtacagaggccagaccgcccgagaggccagtagtacacgtggccaggccgcgccacacggtagccagtaatcacagcggctgacctgaccagcatgaggagatagcacgtacgtacctccagcacgcaggcgacgcgccaacatgatggcgcgctgcggaccgggcctgctgcgtgcatgcgccatgcggtggtccatccagtacgacgtccaccgtccacgcacgcaaagcaactacatacgcaggcgccgagcgacggtagtcaaacaaacgatcagcc

SEQ ID NO: 2203 - DNA, 1238 bp, Zea mays
  misc_feature (1)..(100): optimal_loci_160411_G1, chr4:177596946..177598183, Cluster 13
ggtaacatcgtctatatataatataataatatgtcacggccaatgcaaagacccaaggacgtccacgactgattgcattatgattcgtttcgctgttccaattcatttccaggctccgatccccccccccccccccccccccccacacacacacacacacacacacacacactcccgtaccgcaggaaataaaggaacccagcacagcaaggcataaataaatggcgaaacccatccattggcctgacgtcctctccatcggcggtggtacgcgccagcgccacaccaagtcaccaacaacaacaacacacggcgggactgatgtagggtacggtacggacggcaggtgcctccgcctccgcctccccgtcaccagccaccacgccgtacgcccgcccggcgccgctgagggacaggagcaggacagccgccgccggccaagagggtgccgtagctagcggtagaaaactctcgctgggtcgtcggcactggggcgccgggctcgatcgtacagtcgtacttggccccgcccccgcgccgtggtgcaatgcaatgcaacacaggctctctctctccctctcggcttgggacggccatgggcctgggatgagcgatacggagatcggacagctgccgtcctccgctacgcgtgtacggcgcgtgtccgggggagagaagggacgagacgagatgcggctgctgccgcacgcgcacggtcctgtggtgtggactgcgggtgttgacccgtcagaggatgcgatgcgccaacgcatggtacggtcgccggatggcatggcatggcaccgtgctccactggcaacccgacgcgggggacgcgctcgcccgctgttggtagggctgcagaacaacaatgtatggtcgggtgggacgggcttgagctccgaacagaccttggagccttgttgcctcatgggccggaggtatggcttgggcttctttctttaactttacgttgggcttactttcttgagacgaccggttgggattgtggactgtgcctctgtgctcaccactagactctagttccttttttttgcctaacaatctctgtctgccatatctcatccaacatcttatttttactacatttatttttactacatattatcctacacaataaaccattttagatatacagtacaaatcagatctgtcccaaaccctagcctcttaactaaagctatctaggcctggttgtggggacagcctagccggct

SEQ ID NO: 2204 - DNA, 1233 bp, Zea mays
  misc_feature (1)..(100): optimal_loci_160559_G1, chr4:178379724..178380956, Cluster 13
agatagctataaaaaacctaatgacacttgattaggtcccgttgaaggtacatcttcggcaatatgatcaaatcgaacaggacaaagaggttcactttcgttgccatatgtctgaagaaaactctacataaaagaaaacaaaatcaaaattaaaaaaaaactagattgaatagtttattgtttgttattagttctgtgtgcctatagggatgtatgtagccactagccagaagcacatgaggagtggatgacgatggcctcgccgtcattaggtgttggtagcctaaactaatgtctaaggaaaacattgtaattatggtacgatgtgtaatggtaaaatgaaaatcgttttatgatgtcttgccaatatacacgcccatgggttgtagttctgtggcccatatatcacaaaagccagatcatactgatgtgataactgcaagcaccaattctaggtagtgtcgctgtaaaagcagttagcagctggaataactttttcgtaaagaagtttttgcgtgatagctgtcgctattcctgagtttttgcagcacgtattcttcatcatctgttttaaacaaattcttctcgagacagcctttttttgattgcctacaggaccttttgaaacggtcttgaatactgttggctgatgtggacatattatgctcatgagcagaaaagataagctgcaaatcttttcctggcgtaactcattttctgaacaagtaaatagaagacagtagcaagtagggacgcatagatatctgaaaacagtagctgcatagagttgggcatgggatctgaaccctagctaaactatgctacagagacgcaacgcctgccttgccctgcccttgctccaaggatcccaactgttaggcaagcaaagcaagtaggtaacggataccctgcaagtcctccagcccgcaagacagaattctcagcccgcaagaaacaccctccctcctcacatacacatgcgcaatagaaaacccggtccggcaacaggcagcaagacgcgaatcatctcgcacgtagccggaagcttccccgctgcccgttgctgtcccctgctcctaatgcagtccagctcctcgccgcgaggcctgaaagagccctcctgcaagcgttaaccactcccgctgtccatttccctcctcatctttgacaatccaatccatccatggagggggatggctgtggctcgtaaagcgatcgatcgcggggatcttt

SEQ ID NO: 2205 - DNA, 1298 bp, Zea mays
  misc_feature (1)..(100): optimal_loci_164911_G1, chr4:201877596..201878893, Cluster 13
tcacacaatgtcccttttgaaactcacgatagaagaacacatctaacaatgtcatcagtagagtaaacattattagccaaagcctctatacacgtctaacttaaaatatagagggggggagggggatctggcaaaaaaagatctttttggttgcacttgcacttgcgcctccgaggttttccacctaaacctttattttattcccccaaaacagaccatgccctctgaatcgtatcgacttcgattatttttattgactccccccgatcaggcgtgcgcttttggactacccctcctttaatttcttcatctcgagcgactaagcttagttagattgtgatgtcttagatagaaaacaaaacaggctacatgttgccaaaaagatgctattgctttgcatcattatgtcatcatgtgctgtaagtttaggattcttgtgaataaatcagtgcaaccaaaagagaaagcaacgaggatacatgattagcatccgatgtgacggaggccatcgaaggaaacggagatcatgcaaacgatagcacagattccatcccagccccaccatcaaggaaaaagctagctagaacatgcttggacatcaaggaataattttactggccactgttcctttgtggaggactgactatagtgtgaagcgggcagagagccagagaagagagacgagacgacacatcaacatcagtcagcctccctgcctgcgtgacgctgacgctgacgcggccagcaaattaaaagaagcaaattaataaatcacctgagccagcgacgactggttctagtagaaagtatgaagcactccaatgatcaaaagctagcaagcagcctgggagctgggaggcgaagtcctcgtacctactctgaaattacaatgctgatgaaaactctccaattcaagcgcttctggggtggagccagtaggtttctggtcttcccttggccattggctgacgcgactgccggtcctcgcactggcagcgagcgacgcgcccctttgctcctgcccgtcgtagccgtgggtccgcgagcagatcaagagatggcctcgacgacctacctctcctccttcctgtcgatgctgccatcgtgcgtccgcctgcggcgacgggcgtttgagccaccgcaccacgtcggtccgtccgcgcgtagtggttctttttccttgaccaccgacaagatctctgcgattgggtgcttcttggcctccgtcgccgactcgttgccctccggccacccagaccgctacgccgaccccctatgtccaaggttcgggtggtcga

SEQ ID NO: 2206 - DNA, 1043 bp, Zea mays
  misc_feature (1)..(100): optimal_loci_164987_G1, chr4:202218852..202219894, Cluster 13
atcacatgtaaacaatggcccgcttttatttcactagaagttaattaggtattacagtatatgaactatgtgaaataatgtattggatttttttcgataattcatgaaaataaagtagcagtttgaacgctagtatgatcttaatttttcgagggaccaaatatgttagccatctaaaattagtggccatgcataatttgttatagtcgtcgggaagttagatgtgtccggcagcaacacgagcccagcacagcagacaacgatcagaattgcgttgggccaagcaccatctggccgccgttactcccaaggtccattggcccacctagccatccttccactccgatccgggagttcctcggttcagttcacgcaacagtgaagtgaacagtgcggagacgacgagccctcggattcggacggaggctccgggggtccacgtgcgcgggggtacgtggactggacagctgacactgggcagaggcactgcggcagctagcagagggttcatagttcagaaacgcacgcacgggtcgcgctgccgacgcaaaggctgcactgcagcacacggatgctgaagggtgctggggacatgcagagacagagcccgcagcgcgcaaggacaggaggccaggagggggcattgcaaggcctgcgtctgctgcatgcatctacagtacaggcatgacgaatgtacacggtgcagaatacaggtgctacaaaacaaacagtggacgtttgagtcatcctctcccgagggaaggaaggaggagtacttactttaccttggggtgggggacatgagtgatggacatgctgagtgctgactgacaatcttgtgggaatggggggcaacaatatggcacacgtccgctaaatagctttcactttgattaaagtcagttatttaaaccgctacaattaattataaaaatattagaagccgatacggattaaactcaaacaaacagataggatgataataatgagggtggtaccatatgatggtgtatcgagcgcggatcctacgctctgtgtgtcgg

SEQ ID NO: 2207 - DNA, 1037 bp, Zea mays
  misc_feature (1)..(100): optimal_loci_167587_G1, chr4:215996137..215997173, Cluster 13
acaagaaagtaggagtggcaaagtactataagctaccgcgcgctgacctgctctgtaggtccccaactaaagaaccggaagtagggatcgacgtccatccaatatcgtcatatacaactgcacccctgcaaaggtgaatcgatgctagctaaaatggggatccaaatccgatatgatgatattgcgcgtcctggaaggcgaacgaaagcgcacgaaccgatgctctcaatatatatctccatctcatcgtcgatctgccacaagatctcgagtacacacgtcgatcaggctatcaaattaattggcagttaatatctctctctctctctcgaccagtcgatcgtcctacaagtactgacgatttagtactggttgttatggcgcacttggccgccatgaagaacagttactactgagctaggctgtgtgagggaacaggcaagcaatggaatggaccggtctatatatatagatcctggaccagaggcatctatctcggcactgatgatgaacacgatccggttgcaggagaggagggaacaacgatctgaccaggagctctgggcccgagcccaagcggatggatcggggggacgagtgaaagcgaaaggtccatgcatccctgcagctgcaagcacataaacgacgacgagactctgtaaaatcctggatttttgatcccgtcgatcggcggcagcggctgggcgagcgagcgagcgctcggcacgtgactcgtctacgccgcgccggccgccaactcgataaacgtccttttttgggaccatgcatgccggcagggcgcggcgacaatggccattccttcactctcccgtctctcctccttctccccaccctagctaccctctatctactacgctaaggattccccatcatgaagaaccccctactaagcggctgggctagtactagagctctagctcgtaggagtagatatagctgcagcgctcatgcctgcatctgcatctgcacctgcaccatcaccctatctctctctctctagagagctagactctagg

SEQ ID NO: 2208 - DNA, 1082 bp, Zea mays
  misc_feature (1)..(100): optimal_loci_169812_G1, chr4:227553593..227554674, Cluster 13
cacgcactctctctctctctctccatccagccatggcccatgggtttttaaagggtttcaaattcttggttctcgaccgcatgatgctctattgattcatcaagtttccaatctccaagcctgtcaacatatctaccatctctcagctacccatcatcaacgccgctcctcgaaaatcccttgagcgaaagaggcgctttcgactatcggattctttggaccggcggtagatgcaggggtgacggcaaggacgggcagtaagaggtaaaacccccttgcaaacaccttcgcactttccagattcataactacaattgttttttttttgttgttttttgtttttttgtagacgaacagagtgtgcattatttttgtgacgagaagagcatgcgacaatcctgtgttgcttcggaaataaaaaagaagttgcgtcaccgaaggtaccaagctctcggcctgatctgatgtccatgttgtttcatctttggtggccgccgcggcgcagcagccgaccaactgccaaccacgcactagtttaaccgatggcaagagtacggcagaacactcccagtttcatcctggctggctcagcaaaagctgactctctcaaatccatgcctgcgagcactattttgcacgcacggattcacagataccagcacaagaatagcgttccaatgcgagccaaactgtcgctgtataaaaacaaaaggcaagccaaactgtcaatgcagaactaaattaaaacatatatatatatcaaaagagacctgatcccctataatttacgaccagaaatgctgctaatgctctgcccgttttacttcgtccaaaagggctaatacatacacgacgcataggcgcatagttcttatcttcgagcaggccgtccacgaagatgctcatgtcgatgccggcgacgaactcggtgtggtcataacaaagttctgtcagctacatccaggaaactaagtaaagttctaccaactccggaagcatgtcacgaggtcatcagcctgattacatagactgagagaggcccaaaggaccatcgacaaggaacacagtttaagtgtttacag

SEQ ID NO: 2209 - DNA, 1329 bp, Zea mays
  misc_feature (1)..(100): optimal_loci_171965_G1, chr4:238385662..238386990, Cluster 13
aaacataaataacttgtcacttgtcagtacacaaagggaaatggatgcctacctcttagagaatctactgggatgggaactttcagtcttgtgacatttttcatgatctgacacctctggatcaatggcatgagtcctcttcgcagatgaagatgtggaacttggtcggtcagactctgagtacatcttgtccaccgatataggtttccttttttccgcacacccttgccttttgagattattcaaaggtaactgcatccagaattccctcataatagttttcaagagatatattcctacagatcaacaagacataaaaagggggaaatgaaaaaaaaaatgagtagtacctggcagtatttattttcctgaatgggagttaacctcgaacagaatctgttgcccacacgttccgcctgctcatcttctggacctacaaataaatgacacataacaaatcaataacagtttgtaccagtgaatgactgtaacagattcaacggaagcttcattctgattattgatattccacatggatatcatgcatttcccgtgattaatccactaacccatggcatctgactaaagtctcccaaagtcccaatccaccttttgcggctgacagaaggttagaaatgatagcatcgggaagagtggaaatcttactgaaatcatacacatccttagaaacggaatgagcatcctgtacccgaccatctgcagcctgcaaaccaatggtacccggaatcaccgatgcaacgtagctcagacctcagaaaagggacaaagacctacgcgcgcgcacgaggaacagtatgcgaagctacgacggggttttatcatccatccgtaaatcaaacaccccagttggacacagccacaggagagcgggcttacgcgcgtaccttggcggccccgcgggtccgtggtcggcgcgccccgtcatccccatgcacggcggtgtggcgctgcccgccgacggaccagtcatcgtcgatgcgcagcttcccgagcctcttccgttggtgtctgtctggggacccccgccgccgctcgtcgcccggtaacaccttcgcggcgcccaacgcccgcgcccgcgtccgcggtgctgccgacgccgacgagggggaggcgaagcagacgtcggcctcgcggtcgggggaggatgacttgccaaacacctcagtccaattgatatcgattctctgccccatcgccgccgtcgatcggcctgcgatcggggaggagagggatttaatgggggttttgctgctgccttttggggggggggaggcggagcggaggttgccgcttaatatgggaaggttg

SEQ ID NO: 2210 - DNA, 1025 bp, Zea mays
  misc_feature (1)..(100): optimal_loci_173187_G1, chr5:4631733..4632757, Cluster 13
tctgacacgtactgtgggtattcttatgcatgccttcttttttaaacggagaggaaaagtagcgacgggatcggatgacttgacttttacgaggttcacatctgggcacgcagtgacaagtagtacgtcttaccggccttctgtgaccgatggtcgtcgcctgttgtctccgtctccgtggacgacgactgcagagctcaggactgctgctagtcaaataatgtatttaagacgaactcgagggggaaaagagagagagagagagagaagaagaagagtagcagcagctatagtagtgtaaacttggaagacacaacacagcacaggaagaccgggcgtacgtcgttctgaacaaggaagtcaacccgccgtctactgaaagaaaacagcgttctatctctcaggcaatcacctgttcttcagagtgttgcggctgcatcacattgattaaaaaacggccaagacggcaccggctaacccacgacatactacctgtgtacacggaatgcgatcgcatgttcaaagctgctgaatttggaccctcattaaataacgtgtgcactggaagctttcagagagctgtatgtattcgatgtgtacagcccaattccacaacatccggtcataaaagagagtaattaaaacacgacacaaacttgacacatgagtgtcattgttaggctatctccccactagaccgtagaccgtgaacggccatgtaaagtatcgtttttcattgtatggtgcactgtttatagagtaaagtttaaaatagaaagtgagctagaaagtgaaataaggagtctgttgaagatagccttagagtccgtgaggtcatatttctacaccaagacgtattctaaaaaatgtctcgaaagaagaaactatccctggttcagttatccattttctaaaaatatggctagcccctgtcccctagagtaggatggccctcaaagttacaacattacattcaacccttcttctgatagtcttatgtctggataagactcctatctatcata

SEQ ID NO: 2211 - DNA, 1191 bp, Zea mays
  misc_feature (1)..(100): optimal_loci_174706_G1, chr5:13815668..13816858, Cluster 13
agcatcgtcttgctcttgcgtcgctgccggactacaggtgcgcatcattagtgtatggatatacatatttagatgggttggacctaatggacggcccatggtctggcacggcccaccgtcaatcatgctcgggatggccgatctgatcatggtgacgtgcctgagccttagggtagcgttactgcacgctgccagggaaaagagaccgcacatcaaaacaagtattctccatgccctggtaggtaccgcgtaggtaggggtatagcaaatccaagtggctggaggcccatgtccatgtgcggcgcgcgggggtgcacgtcacgcatgccgcggaccactcctgtgctgtgcccggccggggagcaaggtgcccgagacgagacgacgtcaagcgccggatcgcgcgccgctggacaggaggacaagcagtcagcagcgaagaagccgggcaccgtagtctactgttcacatggtggtgtcacggccgcacacggcgtgctgacctgccggcgccggggacacaccgactcaccgagcgcgcgcggccgcgttttctttgcagctgtggtcggtttgcgtgctcagcagtcagcaccgtccgtctcgtcccgtccaccctgcgtcacgcggcgaggctctgcttgcttcttgcctgcgtcgtgctgcatgccgagcgcgccgcgcaggcaggcaggcagaggcagtccacagcacggcggcaaggagatcgcggctattccgtggctgtgttacggtatatcagtagctggtggaggaaacgaacaaatatcttatataccggggtttcttctggacccagctacacagacgcgtcaatgcctcttctgtttctttcctgggtgcccagtaggcagtacgttttccggaccaccgttctggacgaggacgacgcactccaaacagtcaatactcgagacagccagacaacctgtagtgctacggctaaaattaaatatccctcattgtatctatatacataaaagtttagcgtcattgctcctcgtgtacgtctgtctcctcgtatatctcgctcctcctgcgtacgtcaacaaaaccgaaaaagataagaatcattgtacaataaatgttgcaaacgataccttgttgtaggagaagataccttgttctaggagaagaccgtctccgacaattactcttataaagaaccta

SEQ ID NO: 2212 - DNA, 1213 bp, Zea mays
  misc_feature (1)..(100): optimal_loci_175022_G1, chr5:15454494..15455706, Cluster 13
gtgcacggacatgacgtggccatcccgggcactcgcggagacgcttacacgtagtggagtgcgtgtgacaccagcgcacagcaaaaaaaaaaaaaaaaaaaaaggacggccagtccagttcagtttcgtctctaaaaatgcaatactgccacgaaacggtgactgctgacgccgtgggttgaactgggaagggctcgtggccatgcggaccgcccacccgcaatgattcgtagagaaacgttgcaaatcaaaaaccaaatcgtcctacttagggcgtagtaggctctctagtagtaaaggcttgatctcgtcgcagagacctcctactcaaggaaagcgtctccgatacggaacaaaggctgcggttaaaagtggggacttgcacagaattgttcgcaagaagccaaacccggcaaaaaaaatctgattcttgtaacgaccccaacggccagcatatctgtgaaaccgaatgcccgacctgcgcgaactgtgaagccgcaagccagacctcatcttgggcgccacccaacccaccaggtgccgggcccaaaccgggatggacgccgaaccgcgcgcgccataggagtggactgacagcaggaggacggccgacgcgactgtcaaggtcggtgagaaaggacatcaggtcgttcgatcggggacctccgctgaaacgacgcgctgatcaggcaacaccgcgtaccagttgacacgacgtggccgtcgcgtcgatctccgtcgtctcgtctcccgtatccgtcgcgccaggagcgcagcgatccgtgacgttgcgatggcctaaacctctgtgcacgtgaagaagacagacacagaggcggggaagagggcgacttctaaaacacacctacctacaagtatacatagaattttcgaacacatgcaactatccctaaaacatacagccgcatctttaaaacgtgttaaaatccaataagtacagatacgtgtattgctgcgaagtcatgatcgtaccatacgtacaggaccgacggagaggtggtccacaacgaaaatgttggacgtctcttgggctgtagtcaaattcccaagatggacaccggcccacttaacaaccaaccgctgccgccctaagctcttcttagcccataaagacagcccagcacgcagtattgttcactccattcttgacgggccagaggagactacagccttgtttgtttcggattataat

SEQ ID NO: 2213 - DNA, 1192 bp, Zea mays
  misc_feature (1)..(100): optimal_loci_184929_G1, chr5:76393011..76394202, Cluster 13
tagtaagaacgaaacctattttacaagttgtttaaagcattcgaatattggaatacaagacaatctccacaagacgaccacatcttctggtcgggacgaggaagacaccggccgcgcgctgggggaaacggacgcccggccggacggacctggtctgcggccgtgagggtgtgaggcccacgcggcggacgccgacgccgcaccggaattctcgtaagcgtgtgggtgttttcttttttcttttttctttttcctttctgcttgtcaaacgtgtagtaggcaggcgtatggacgtacgctgtggctgtgcacagtttgggacgcgcatacggacagcgatcgacgcatttgtctaaaagctggcaacaaccggatggcagcagctacttgcagccacacggtagcgatagcggtagcaccatgcattcagtaggttgtaggtacagatagcactagcagcagtacacgcaggaacgtggtcggagccatctgacgagttagaaacttaaaaacattttaactttttaaataagttactgaatggattaagtatggaaacagagggaggagacccggcggcgatcggcgcccgtgccatgcctccctccctgggccctggcaagcttggacctctcacgtcacgcacacgcacgagccgtcacatgccccggggcgcaacgtgcgcgagtggtgctcgacacgacggcaacgtggcagtgccagacggcggaggcgagtgcgtgccagttcggcggggctccagcggaccggaggcccgaaccgatcgaccgtacgtggcgagtccggccaacgcacgcacacggtagcactgggtcggtcgtcacatggtgtacgcgtcgtaccggaatgtcgtgcagtgggtgtcccggccgtcgtcgcattgccgtcgaggacggtgtgctgcactgtgcgtagttgcgccgtaccggagggaactcgtgttcgttttagtttgaggtggaagcaaagcccctggtttttcaggggcactgctccgcaattgtccagaaccattacggtacaaaaaaaaagatgaacaacaggtgacgatggtctgcaacagtgcaactaccttcttatctaatcaatgcagataagaaacgagacctaaaaataagtgcctaaaaatagaaaacatgaaaacagctaaactactgagatctaaatttac

SEQ ID NO: 2214 - DNA, 1192 bp, Zea mays
  misc_feature (1)..(100): optimal_loci_196357_G1, chr5:152834001..152835192, Cluster 13
cactatataacgttgcaaactctgccgtcacttttgtttgtcagcgagtccggcgcgcgcggccggcggtgggcctacgatcggcattattattgtaaactactgttatacacgcacggccatccaccgccgccgcctgcggcctcgctctagcctctctgggtgggtctggggttgggcgaggagttgatggcggcaaaggacatggccaaagcctgttcttgaggtgggcgcgcggcggcgaccaggacgactgtggacgcgatcgcggtcgcggcggagggtgggttgcggctgccatgcatcgcctggccgcctgcgaaatgacgacgacaggtgctgttactgctgtctgcgtgtaaaatgtgatttgcttgtcatcgccgtcgacgacgacgcaagctagctgcctagctggtgacgatccatctcaaagcttttctctctcttgcgcgcgtaaaatgactactttaatttgttctttccacgtacgtacgtacgtagttctccccatgcatccatgaaccatccattcttttctttgtagccaactcatgcatgcatggtcgtgtgtcgtcgttcccttttgctttgcttttatttggataaaaaacccatatgagctgcaaataattggggccgggtacggtgtatagataccaaagacgataatgaggcagaagatcgaggccacccgtacgtagaccttctctttattatattttttttttgcccttttacttttctgtttctctcatgctgcttttaggtgaggcaatctctttcattagtcgttactgtcacgctttcttttagaaagggcctggggggaaaccaaatgttgctttcatgcatcttgtgtagtaggccgccccatgcatatgatggtgcatatatgtagcgcaaacatgtggcagagtctagaaaatcggtcagaccgcgcagtgggaaaatcaatttaagtgatgtggctgtccttgttagttggctgatttaattaattacagcagagttgattagctagatggagatgatgttatatatgttctcgcagtcggacttaagccacacgccttattcagaggcgtaaattattctttctatgcatggttgtggtcctcgatcgcaagcgctatataagcgaagctcatagcgccaccacaccagttccgatcaacctctagcgaccgac

SEQ ID NO: 2215 - DNA, 1201 bp, Zea mays
  misc_feature (1)..(100): optimal_loci_198591_G1, chr5:165859608..165860808, Cluster 13
caacatatatgtttagagcaaaaagaaaaaaaaagggggaaacaagattggtttcgggatgcaaacatgtggctagttaattcgttctgctagcgaaattgagcttggaggctcgtcatggatcgtatgatgatcgttttcagctacccctcatcaccagttaatatatagtagtagttgctagaggaaaggctgggcctcacctacgcaaatctacatcagttatatagagctccagctccagactccagtattggtttagctgtccgtggtctggcccttaaatatatataaatattttttgggatgtccatttcaatcatatatgggggctgaatttaattgactccacttgatgccaatttcctttcaacatggcccaccatatgtggtttggttggcaccagcatcatatatgcgcgatattaagcagcagcaccgggatgattttgtgctgaagctgttccatgcatgtttgatttcccggtcttcagagtgtggtttcgagtacttggctgaatcgaaggttgttcttcagtcagtcaggcataattcaaccatagtagtatctggatcttcagttcaatttctgtgtgcttgcaatgcaagggatacacacctaacacctacttgacggacggtggctgccagtttctgtagcaccatggccagagtcagaaaaaggggagagctaaatgcaatgcaatgcaaggaccaagaagatacggagagacggccgacgggggcaggcatgatcctaaaaggacacgacggccacagagatagacaggtcacaatgggaggtgtgagtgtgtgacctgagcgatcggcctcctcacattggctgtctgcctgttgacacaatccttgctttgctttcagtgtcagtgtcaacttctgcttttttccgtgcctttgccctttcagccactagtagagagaggctcgctgctgcacagggacagggtcccccttcgtatggacgcacgtaggcgtagaggttgagatcatggcctggacgccgatattccctgcgcggggagggtgcgtgcaccgtgcagtgcggaattgcctacatgattcggtcaggactgggagacctccccttttcttttctgttacagataaactgctaaaagatgtgcagattataaacgctcggttggtatacggatttcgcatttctaagaagttcatacgg

SEQ ID NO: 2216 - DNA, 1058 bp, Zea mays
  misc_feature (1)..(100): optimal_loci_198620_G1, chr5:166045080..166046137, Cluster 13
tattcagagggagtagaggttacaagagtagatatatttaattaataatatagaataatccagaataaagattaaaaaaacagaggaagtagtactacagagcgtggtctttggaacaaacgccggagagcaacagttgcgtacggttgcataccaacgccatttcggaggcatatactccggtatgggtaaagagatatgggtagacagtaggctaggtgggtaggggtagtactatctttgagcacaaaaacacgcagctggccgccccgcccggctggacgacacgagacgcaaaggatttcccgcagctgcacctgcaccgtacccaggcttttgatccctccgaatcttccgtgtgagccctgctttcctttccccactcgcggcatccctatccacttctctgtggggcggggcccatagaggcggggccatcaggaacaggagaggggcggggacagagtcgggccctgcaacaggcgacaggttcgggtttgtgcccttcggccattcgaaagtcgaaacgagaggcgcggttaatgggcgggtcccacaaaggatcccctgtggccagtcgctctctgtgacctcgagcgttactttgtgatttactagtgcactctgtctccgtttcagagataaaacagctacgttagccgtctacgtgcttaacctttagccctaacatccatgatgccgaaaccatacgttacatgtagatatatcgcatgctatgtatatagcatatctagatagcgcatgttgttttatacatcatttggagcaagaaaattgtaccaagaagatattttatctcgtttttatcctgtacttgtggcataagtgaaccagcgcatatgacaacgcctaaatttcacaaaacatagcaactattatagggacacgtacaattcatcgtcacaaaatgtttgtcatgcaaagcttccacaccaaggtacctacttcatctcatactcaaggacattgtagctagatagatatttccatatcaacaagtcacaacaacagggaaaaagatgcatactgctccacgg

SEQ ID NO: 2217 - DNA, 1154 bp, Zea mays
  misc_feature (1)..(100): optimal_loci_199109_G1, chr5:168845116..168846269, Cluster 13
taaaatgaaaatgtctaaattcctaacaataccttgatggatccaatgccacgccggagaagcagatcgctgcatcaacggctccgggtgctgttgaagtcaccaatctagcgtaggctcgctgaccaataattattgcgtggtcttctcttttatcgatgaccgctcagcccgtaaccactagctgcggcaatggcaatatggcattgcatttgcacggacacggagacggagacaagaaatgcttgcgcgcgagagcccaccggctgtgtgttgggctagtgctgctgcatgggccggccagcattcagtatagccgaagtgatggcccaaacaagatcgcgccaatcgtgctaacgtggctatggaggtagctgcgtcgcgccaacactgacaagcagtgacgaccgacctgaccccgtaccgtggctagcatacaacgaatccactcctagcttctggtcggttcgtgcaggctgaaacagttgatgatttgagacgtgtgcgcaatgggtcgtcgtctcggttcgtgttctctgcccgtgcgtatacatgtgcaggggtatatatgatgatacattatacccacaagtacgagatcgatcgatcggtcgtcccgtccgtacgttcccggctgccatgcatgatgattcgcttgcagaatcctcttgaatgcaaggcgaatgcatcattcgtttgctagctagctagctagctatacatagggcttgtattgtagcgacggttgcattgattacatttttggcacccccctctctgtttcaaaaataaaatacatactggttaatcggttatggtcaggataataactgactagtaggtgaaaacatacttgcttcgtcgcgcgtttgaagttatctgatgttttaatatttgtaggtacgtagctttttttctatatcttatagtttagaacggataaagtagtcatcaactagcttgtattaatttaaataatgtcatgtttaaaacagtgcgcgtacaagattattatagcctcatggccattacatgtttaaatgagaatgacgaatcaaggggacagaaagaagagatgtgagcgcaagaaggggccaaatgactggtaagatttgtgtgagttagggtttgtcttgccgattttcatactctac

SEQ ID NO: 2218 - DNA, 1245 bp, Zea mays
  misc_feature (1)..(100): optimal_loci_200531_G1, chr5:176984055..176985299, Cluster 13
gttttggtggagctcgagccatgagtccgctttgctctccctacccctttgtcccatgtcccatgccctatagtgatcggaaagtgcatgcatgcagcgaggggagaaagtacccaaaaaaaaggaagaagaaaagggacgagcggagatcgatcgagtacgcgctcacggcactgttgctggaggcgtcaccaccgcggaagcgtccagcacgctgcttgtctgccgccttccacttggccaacgcggggatccgatccccacccatgtcaccccgttttgtccgtgcctcggcatcggcatcggtggcgccacgccacgccagcacccgcacagaaaaaggctcacgttgttttcaggtccagccaccggacccgcgcgcgggctcatcatgagcaatcagcacgcaaggaggctggctgggggagttagttggttcacctgacctgcttacatattaaaaaaaaagatcgtgtgccgccacgcccgagtcacgcgaggacacgtgagctagcttccggccccgtttctttcagtcgggaacagagaggccctctagatcctcccgtccgtatcatgagcaatcagcacgcaagtagatcctcacgttattttagcattatctcctcgcctttgttttactaatctgtctcgtacctttggacttttatctgctcttcctccagccttccactgcaaggtctttttccagtcccacacctttggatatctcagataaagacgcatgcatgcgcaactgattcaaattaaattaacaccttcctttctctaacaacctttttttttgcagtgaagtgtatgcccagtgatttgtactgccaggtcgtttgattggatcacgtgaacgactgttcatctcgtgattcacaaggctgtatatatggagagtccaggctgacgtgatccggtatcggtataagtggcggctcaaagcggggctgaacaatgctagtgtgtgtgtgttcgcttacagccgcagccacaccgcacaccggtgatcgaggcaaaacttacggctcggccgggccagtaattaattcttctccaacctaatctattctggtgtttcggatttaatctcgcacaacttggtcgatcgtctgccaaaacaatccgatcgaagccagcagtagtaaacaagtccttcaaaacacacactctctctcttttaccccgacaaatgcacatgatttctctatgaagtcttcttttgaatggaaacga

SEQ ID NO: 2219 - DNA, 1004 bp, Zea mays
  misc_feature (1)..(100): optimal_loci_201748_G1, chr5:184159848..184160851, Cluster 13
gcattgcgcggcacggctggattgcagtgcagctcagggcaagatcaagatggccggccgttgaagattcggtgacgggtgacagaacgaacgtggcgtcactgaaagaggaacgtccagtccagtccagtccaatccagctcgcgacgcgagcccgatctcgtgtccaatccaatcgcggtgcgtgtgcgtgtgcttgtgcgtgcggcgaagcatgcatgggatgccggccggggtcctttgtgcggctggatcttgctgccctgttgcagatcgttatccccgcccgataagtacgtccactatctcgcccgatattgtctaggggcttgcttcatcttgagcccagagcatgagattcacatgctcccaaattaacaagggccgggactcatctcctgcactactgcgaacgttcgagaaggaccgcccccctccaagatgaactgggttccagatcggctgcgatgctacttgcctccactgagaaccccgagggcgacacctcgttctgtctctcggcgatagacaaatgatgccggcttttgacggacggacgcgaggcatgttgtcacacaaacaaatcttagcgttttccgtgccagaatcgctggaaaggaccgctcgcgtacgtcaaggtggccgtggaagaacactatggaccacatcacctgacagcgccatcgtcgtggatcccggccatccggatctcggagtagacgagaacgagaccgcgcgcggcgagagcgagggcactccgcagtggggagctaactgcacgatggcgcaatttgtctgctggcggggcgggtaagatcgcgagaagattgacgccgacgatatcgcttcttttgaccgtgcggcgccggcggcagagctaggctaggctagctgacggtggaaaaaagcttgtccgctgggtagccaagccagccgcacacgtccggttctgcgatttttttctgccatcgatcggttactagaagaaggagaagaagatacac

SEQ ID NO: 2220 - DNA, 1196 bp, Zea mays
  misc_feature (1)..(100): optimal_loci_201750_G1, chr5:184161942..184163137, Cluster 13
ttccgctagctaggatctatggatcgcgggtcaaaagttgcatccatggtagtactagtacaaaaagttggcaatgatgtccacttgggatcagagctagccagtagccattaggagtcaccacactcaccagccagcagggccgcctcctgtgaatgacacggtcacacacatacggtgatccagtatcgcggaagagagagactctactctcaaaggaaaggaaataaaagcagacgccgcctgatgagaaaccctttctttctttctttattattttcttctcaggtggtcacagtcgctgttgcttgtgcgactgtgtgtggcgcccattgtcgttggagctgaaaacgaacgccttttgcacgcatcgtcgtctagttgtcgcgtggccacgctggcgagactcgtcgaaagggatatcggcggggcggtgccgcctttccggtctcggtgcttacgtacaccatggccgagatcggcgatccggcgggtctagacggcttcgtgctcgattgggggcggcggttccctagctagactttgtgtacaccatcttgttggcacggttatcacagaggcgtaagactaatctttcatctgattttgattggtgttcgcatatcgtgacacgtcagcaaactgaatgaatgtcatccgcgattagctaggttgggacggacgagacctcattctcttccggtgcggcgcagttttgagtctaaaggcacactcatgtcatctagatgcatgcccccaccccactccacccaaccgggccgggatcgatagaagaagattcgttgcgacccaaacaaagcaggcgtgtatcgcattgcttgcctgcatgcaaccagctatagctagtaggccgccgcctcggcgtagtttttacgactattcggtgcaaaaaaaaaaagggactacgacttcaatctgtacttgccacgataagttggaactgatcccacacgactttttttttgtgtgtgcatgcatttcttcttggaaaaactacagagctatgcgttggggtgcatgcatgcgtatgcatgcatgagcagacacgcccacatgcttgattgcccgtcaacccatacatgggcatttattgacgatgaatacctcatagatcgtatttaaacacaactttattagaccattgatttgactgtactgccttcatgtataacctt

SEQ ID NO: 2221 - DNA, 1027 bp, Zea mays
  misc_feature (1)..(100): optimal_loci_202854_G1, chr5:190033072..190034098, Cluster 13
aataaaatctagtaggagacccttccctcatgtttacctaaaaaagctagcttggtaagacatcgtagatgattacgacgcaagcagaaatgatgacattttgtcctaaccacttttgtattccgttttctatggtgtcgcatggtgcaatggtgatagtggtattgtgcgtgtggggtgacaaactagtgatgtttaggatgtgcttgacttagttgtggactatcgaaaagcggcccggggttatgagccaatagaaagccaaaattttgtcatatatatctcatcatctatattttttctaaccatattatcagaattagtttccaccaattttttcctaatactctattttttcaataaaatctagtatgagacccttccctcatgttttcctagaaaaagatagcttggtgcaagacatcgtagatgactatggcacaagtagagatgatgacattttgtcctaaccgcttttgtattcggttttctatggtgttgcatggtacactgctaacagtggtattctgcgtgtgggtgacaaactatttgtgtttaggatgtgcttgactcagattgtgggctgtctaaaattagctcgaggttatgggatggtagaaagccaaaagccatttagctcaacatttttgacttttaaaaaattgccagctcctctcggtaataagtgaacctccccccatcagctttgtcttctttctccagatggatcctcgaccgaggttgtgctcgtccatggcgatcgagtcgagctcgcctacaacaactgaggtcgcgctcacccgcagcgacgaaggcgtgcttgcctgtggcggccgaggtcatgctcgcctgtgacttctgaggtcacgctcacccatgacgacggacctgagcttgcctatggcggtcgaggcgacgctcgcccgcaacgactatctaaggtggtggggcatctgcatagaagagaacctagcttgtgtgaaaaaaaatcagatacgcggacgaggaaagaagagaaaaaaatgaa

SEQ ID NO: 2222 - DNA, 1354 bp, Zea mays
  misc_feature (1)..(100): optimal_loci_203149_G1, chr5:191859499..191860852, Cluster 13
gaaagaaaagaaataggcaatcatgcagggccgggcccggctaatggaacgttgaacgcatgcatgattatgattactgggggtggcggcggttacggcggccacatctcgcatcggtctctctctcaaatgcgtgctgacggctgggagcttccgaaagctcgctgcaggctgttgacagtgaaccactcgctgatcgtgactgctatgacccaaattgtgagtctctactctctagctagtaacgctacaccctcctcctcgttcgttggcgttttgtgcctgcagagttttggcaccacgcgctagctaggctgaatactatctgtacggtgcaagaatttttagcagtccacttcgtccaagtttagatgccaaagtattttttttattgtttatctgatactgtcaaggtccacgatgaaattcagtgatgggcgtgcttaaactgccgaagatcgatatatctacctgctggcccgtgttggactggtttgcatgcgtggattattggtggatagatttcattcacgtcagtaaattttgctggatcgattcggaccattcggatgattctgttggcgatcagagttcagagcatcaggcgctacacggccaaattaaggacggtcggcgagggcagaactcatgatgatgcccgtggacgattgcctcctccgtcagaaacacgatcacccggacgattatgttggaccaaacggctattgtgaattcgccactgaaagcgggatatgtccacataattttccactacaaattgctgcgaacccttgatcctgccattggtgactgggttatcaacctctcctactaacacgttcatcttacacaaatactctactctttcctgcaccgtatagaaagatccagtaaagacaggttcgaaattgttcgaaaaatgtgaaaccaaaaggcaaggttctggctaagtttgggtaaaaaaaataccagaaggcttcaccagtagaattggaatccatgattcgtcttcctggttttttttttaatttttgtagtacaagaaaagtcggaacaattcaagcaagtccccgcgaactgtttgaagttttgtcgaaaaaggcagaaagtttgcagctgaaattggctgtgatttcagggattgtcaaacaaatggattttcacggtcaaactcaattatttaaatatcatgcaaagtacatctttggtgaaattggaggaatccctttaaaaaatatagttgttgaataacttggactcgttacgacgaggacgtagattgttggcaagcaatcaaaacctcaaagatatatcttatatcatttttatctaatatgatctacgctccttaaac

SEQ ID NO: 2223 - DNA, 1398 bp, Zea mays
  misc_feature (1)..(100): optimal_loci_204053_G1, chr5:196751412..196752809, Cluster 13
cggattgtatggcctatctctttagttgcctttatgtcggattctagtatgttggcccctgtctctggttgtacgacgcgccctaaccatcacatcatataactcatgctggtaaggatgtcagggctagggcaatcactgcttggtaatactcctattaattgctgctcatctgctgcaaatcgcagcgacgaaaaaaacaataactgtcggactacgtacagttcgctggctgctctcactgatgaccccttagcattgaattggcatgtggaactgtactcgccgcacgagatcactataacaaacagttttgtacaacagcctgattattactactgctatattattcgtcagggagagtgtgtagtgtaccagcaaaaagatcgacgcacaccataatgtgatcgcgtaggctcggcgacaagcacacagtcctgcacagcagattaaatgcatgctgcacgcgatatcacttcgcgctgcaacaccagcagcaggaagcaacaaaacggagtgttcttgtgttcgttaatgtgatcgagcgtacactagcgacacgcatcatcaactcgtacgtacgttgtaccacgagggcgttctgtaccgcggccgggtgcatggcgggtagttgttcacaaacccggcctgaaattacgtctatctgtacctatcgccatcgacgtgcgacagatgaattttcggcttgcaccacgccagccgtgcgcccacggcatgcatgcatgcatgctatgcggccggctctgactctctgaggggcatacgcatacgctggtggcaggcctgcctgcatgcatgcgtccacgcgcgcgcaccggccggatcggagcttttttttgatccatgcatgatagtcctcggcgtcaggttctcgcgcgcgcagcagctgccgatccgcagctctggactgctctctagtctagctagagagaagaagtgcggcgcgtggccgtcggatgcatccagcagaaaaaggagtcgtacacggccggaaagcatgcatgcatgcatggccgcaggcatgcagtaagcagggttgcgcatggcatggcgtctgatgctgcatgcgggtgcgtgggaaggacggaggcccacttctcggtgccagagctaaccacaccgagtaagacacgcacatgacatgctgcctgcctgtctctgtctgaattctctactctacgcaccctcttgcatgaggccatggtcctgcgcccatgcccccagatcaggccggccagcaggcctgattgggtgctggagcttgctcccgagccagccatattgttgatgcgagggctcataaggacctttgtcagcccataattggaacccgtacatggtccaacctcgtcaccattatcaacacccctttacatc

SEQ ID NO: 2224 - DNA, 1374 bp, Zea mays
  misc_feature (1)..(100): optimal_loci_204729_G1, chr5:200673021..200674394, Cluster 13
taccattattccactgtacaaatcctcaaaattgtacatttataaaccataaaaatgtggtatactagtaatgaaaggtgcacactcatttagataaactactatataaactttcttctttctatacatatccaaattatcaggtgagtttaagttcaacagggtgtataaatcaaattaaaatacttctagttcaacaatcagatgtacattattttaatatcagttggtaacgtcgtccgaaattaaaggtgtccgtacagtgggggcagtgcaggacacacaggtgtccggattggagctggaggttggtcggagcgcggcgcggttgattggtttcctagctgggacgtacggtacggctacctccgcagggcaagagccagggcgaccgcgccgcggtctgggactgggattgacacgccagatttggatcgtacatttttcgcgctcgcgcggtccggtccgcagggcggcgcgccaccgaccggtgcttgcatgtgccgacgccgtctcagctctcaggggctactctacgtgcccggccgctagctggcctgccaacatctcggtaacccggcatggatgtaggcactaggaaggtagcgctgctgtggttcggcccacggccctgacaaaaccttctagcaccatctgcttgtgcttggtgcatagcatagtaatatcctcctcctcgagtgcgtgcatgtaaagccaaatgcacatgcaactagcaggatactactaggacacccatgcacggcttctcgatcggcggcagcagaatctatccgaatcaaactttccatgctatatatatgcttctagcaccttttccctgttgacgagacatagcgctagctgcatgcaccaacaacaagtacgggacgggagctgtatatatcacagatattcctgacacgtaacactgtcgtcgatctttatcgaacacgcacgcacgcatgcacttccgttttgcgctgtggcagaataatgtcgtatcttaccagatctctcgccgagataaaaaaaagaaacgcatatcaaatcaaactcttacgtgaagcatgcatgatacgtagctccgaggtgtagaaagataggtatagtactgcatatatacttgtaccccctgcagctgctagtagcttaattgtgcaatgcaaacgaacttgttcccatgcatgcaacgtctctagagtctagaaggtgaatgccctcagcgatgacataagaggagaaaaaacgagttgggtatacgtctagggaacttggatacacatacacgtacacatacacccctcgcaaaattcctgaaatggtaaaaaaaaaagcgggcatgtacgctggctcgctgccacttgtacgtcactt

SEQ ID NO: 2225 - DNA, 1212 bp, Zea mays
  misc_feature (1)..(100): optimal_loci_205343_G1, chr5:204538959..204540170, Cluster 13
cggaactgcactatgatttcaccagacgaaatctgaggcatgactgcttctgttagaggaggtaaggacgcgacggcatcagtggttgcagcttctttcgttgcaggtgcctcttttgttttctttttagccatctttaacgattcgtcgtctttgatcctcgtttttgtaggcttccttgggagttgggaccatcaaatgcgagaagcctggagtgggaggtgcagtcgactgccgagccatacatcctctctgttgccgaaacactcaaaacatagggaagacagaacaatgtttgcgcaagtgcactgccagacttgtctttttttagaatgtgtaggcaatacaaatattactttggtattctaattcgttcataaagcgattatttgacaaatcggcaatgtgaggaaaatttgaaaggcatttatcgcgggggaactaccagaaatgtatgctaagttgctaactcatctgctagtcaatgcgcacaaggaatggtcagtagtactagtacctaattaacctaactgaatgggatatcgcttcatatttccgctgtgttggccttgaaattatgatgaatttacttatggttttgatgtaccaaatcctccaagttatggctgagggatcttgcctatatgaacccctggacagatctaccattgcaaatgcagtattaggcatttggacttgaatttcgaagtaggcagagttaagaatacaatagggttgtgtgtgttgctgcggccggttcggggttgcttggttcttttgccagcccaagctagcgaccccagaattgcccagccaccctatgcaagcaacggaagggcagcaagaatcctcgcaagtttccgtagcttgaaagcaggaggtacgcacagtacgccgaaaacgagagcgaggtacacacagtatgacagtacgaacaaaggatgaaaggaggaaccgattctctcctcacaatctgcttatcccctgctgcatttttggcgttgagcacagacgccagaaggtaaagactgctgatatctctctctacttggtgattcgtttcctggttcgtcgattccttgggttggcgctccttccgtcttgtttttttttttaaatgatgatgtgatggcgctcaagacctccgaaagaatgggagggaggtatagaagggagtactagaagaagaagaaaaaaaatgaatgcagtagg

SEQ ID NO: 2226 - DNA, 1016 bp, Zea mays
  misc_feature (1)..(100): optimal_loci_205657_G1, chr5:205824255..205825270, Cluster 13
atatataatctggaaaaaggaagtgaaacgaaacaaaaggaagtgtaggagtaaaggctcggtgcctgaatttagttaggcacgggagacacggcagcgagcgaaagtggtgccgggtcagtgatcaggtgatgggttctgagttctgaccgcggacgcttgtttggtgccgatcgctagcattcccacagtcttcctgctcctcgcgcgcagagtctctctctcagcgcagtgcagcagccccgaggcaggccggtggcatgttggccggtggcatggtgtcccctgacatcggaagcggaatgccacgccatgtcgcaggcgagtgagggggggggggggggggggcgttgagagcggaaggacgcagggagaaaaaggcagcgttgcgttggccattgagtactttacttgggcccctcctccccgttttgttactaagtagctagctactagtgtagtttcaccacatgggcggcaccgcggcactatcatttgcctgctgcttcccgtccgccacgccggcgcgccggccatggccatgtccccgccttcctttcttggaccccgggaagaaaagaaaaaaaaatccctagcgatcatcaccccccctgccacagcgtccccaccaatgcgctacgcctgctacacgcctacacgtacaccgaggtttgctgggggcactgcgattgatgtgacggcctttttgtttttgctgtacacttcaagagagaaaaaaacgcatctcaagagatcatcgaatttctgcggatgctcgatcggcgacgaggcgcagcaggttggtccgggaattaataaattctcgttttgtcgctgttctcgtggacggcgtcgatactgctactgctgctagcactagcatccacagtgcacgctggagcgttggaaacatccattcaccgacgtccgtgatcccgtagcactgtgtgctcagcagctcaggtgttgttggcgtcatctgtacaccaatcactagggttactgacctctattgc

SEQ ID NO: 2227 - DNA, 1175 bp, Zea mays
  misc_feature (1)..(100): optimal_loci_209732_G1, chr6:13190096..13191270, Cluster 13
gaattggctcgaagtgcttcctatctgaagaaaagggatggcgtgggtccggcgcccactgcggtgaggagactggcaggctgactccggtcgcctggcttgtcgcaacgcggcccggacagctgcgcggcactcgtgcagtgtccgactgcgcggttgagctccccagcgcacgacaaggccgcagcgccataaacagcaagcggagttccacagcggccacaacgtcgtggcgcgggaggaacagcggacccgacgcgatgactccaacgcccgcaacgtcgcgacgcgcatcgcgtgtctaacagctgcatcggagaagcgaggcaggagcagcacgcaggcgggcacagcggcgcccacgcacgacggtcggtgacgtgacgcgtgcggtgaccgcgaacacagagccaaaaaccgacacgggtgctgtgcatgctttttaaagcatcgttttcgcccaaaccaggtcacttcgcgttcatccaactggacaacgctgaacttggtacattaagctactcaatggagcatcgtactcgagccatgatcaaccagagaaggagacagaggcacgtcaagttggcactgccaactgccggctgagagcgcgcactagctgatccaacagcgttttctcgagctcttgaggaatttattaagcgaccaaaacccgagctaacccaggcaacatctataccattgcgaagcactcactgcgacgcaagcgtttaaataaaaatacagcactagtgtttagctaggtttttcgcaaataattcatcaatatagcattgtcgctgaaatccaacacttaggcaaactccgcgttcggagccgaaaccagcaataaattccattttcaagctattaaaaatgctaactagcaaaaatatttttcaaaataaaaagttgcatcgtcatctataaactttatatttcaacttttattcacatatcatacatatgtcttatattatttttgcttgataaaaattaacttgaagcactatgtattataacaaaagctatagaaattgtttttatttaacatttcttttatcttttcaagccacaataaattatttatacacattatcacaaatgttaacatataaacatgatgcgcatgccatgatttgatgaattgttaacgtggtaacaccgagggtgtt

SEQ ID NO: 2228 - DNA, 1117 bp, Zea mays
  misc_feature (1)..(100): optimal_loci_220850_G1, chr6:85193335..85194451, Cluster 13
tgatctggcaccatccaccaccgtcgtctcatgtgccctgctgcaacgcgcgcgaccccattcattcaattcggaaggttcaggtccaggtccaggcagcaggcaccggcagccgagatggctggctctggctctgggcgtctggagcctgctcatccatgcatcgtgcctgttgcctcgccgccgccgtctccggtaaactagccggccgggtagtaagcgcgtgagagcacggcgtgcagagagacagacactgcttgccggccgtccggcacagtatctcctgtgcactcactgttccatgtaaaccagcacgcgcttgcaacagtgaacgcacgcatcatctccatccatgcatgagggatgaggcaatgagctgctgatgcaagcaagcaagggaatcggagcggggcgctgaaagagaaagaaaagccatgcagccgcgcgcgcactgcccgaggccggctgcttgcgaccacgcccgcgcctacctacctacctaccacctctagggtagggtagcctctgctgtgtcaagggcagcatacaactccaatcaactagtacctgttagagcagcgaagtttctaacgtagtagtgctgaatttgtagaaaccatcaaagaaactggcatgtttcaataaactaatctgagctcccgcgcaagggaatccttgttgttgcatcaattgcgggattgatgactgctgagacttgaatatgatggaaataaacataacaagaggcaacgaattaatctaaaaaatttggagacagttatgaaaccgtagactaaaattattgtcattctttctctctctctacatgaatccaacggaattacgccgcgcgctacatgaatcatactgctgcctaggcacctagctgctactatatacctaccctatatattaattgtagctgtggaccaattaatataactaaacctcatcctcatgctctcgccgattcgtgacaaattaagctgctaataagtagaacagccggcatgcattgcatgtgagaagcaggcatcacccatagatcatcctttatactactacaaattaaagttgtctcccccccttcttgcattgcactgggaccatccatcca

SEQ ID NO: 2229 - DNA, 1217 bp, Zea mays
  misc_feature (1)..(100): optimal_loci_222471_G1, chr6:95701261..95702477, Cluster 13
tgtttctcgtatgtacacactgttctattcaggtgggctaattgtataagagagcgacgacatggacttagactaattgtgggataatagaacacaactcccactggcaagcatgggtgccaattagagacaaaaccatgaaacatttaacaaacaagggtcttcctttagtaggtatgaggaactatatatatacatacacactaggaagatatacctttagaggttggtaaagtgttttataagactatcattaaaaggcaggcttggtgggtccagttgaggtctgcctagcattcctaggcccttcaccctagaggctaagattcgaaccaaccaggttccaggatcttgtaaagatctcacagacactcttatgatgcccctgggatggcacgatgctggtgccatatgatcccctaaccaagccaacatgcagcgcttggcaggtgagataaagctctcgtccatcatatttattgcgtagagcgatgttatggtcaaaagcgtgtcactattgtcacacctaaagatgaaaccacactagctaaggttgcactcgtacccacaagcttaataaatggtatgtgactacaccgaataccaaatatgtcatgcttgacgacatggactctcatacttgtcactatgcacaacatgctcgatagtgtggagtccctcttccatattcacatggtgtctgacacccgcgaggaagctaaagaacaacaacaacaagaagaagaagacatcgctatgttcatataattgtgatctagatcgacacgacatctatctcaagccatgtagtctcattccacattgcctgcaacaaggtatgacatgtcatttgtgtgctttcgtgcaccatccatgatctgacgggacctggttcttgaggacttatcctaggctctagagctacaacacaatgctccacttcctccttagtcacaacctaaagatctatgatgctatttgcactagcaacatgatccatagggcatgcaggttactattgggccccgagtgcaagcatcattgcaacaaaagggcgatattctgccactccctcatgaaatgtctctacatgcatgctcgactgcatatagctatcccaccccataacggctaggtgcattgcgatcacatctacacttcaccatgctatgtggccacacaagttcctcgcacacctcttggattaattccaccat

SEQ ID NO: 2230 - DNA, 1232 bp, Zea mays
  misc_feature (1)..(100): optimal_loci_225454_G1, chr6:110800379..110801610, Cluster 13
aattcgtgaattcatagcatgagtatataagcatgccataaaatatttaactgattttaccaaaaacaatactctagattttttttttcacaaatagatatatctctagcttggtcgcattggaggcaggaagaataatggaacaatctccgtgcataaattttagcgcacaaagactgtgggtcgagttaaacaaagcgaggaagaaggagaggacacgggcgcatgcagacacggacccgtatatactccagtccagtagaagggcgagccgacacgcgggcagcccccgcatgattacgttgcgtcaaacaaacagaacggaaaagcccacgaagaatccaagattcatcatcttttcgcgcccgcccccgctttttttttttttgttttctaatgagcgtttgtctcctcgcggagggggagggggaggaggagaagatctgggacggcggttgtgggggcgggcgaggcgaggcgaggtagtacgccgaggtacggcgaggccggcatcatggctgccgtgcgccggggctcatgatacgccgcctcggggctggtggcgggaaccctcgcaggcagacaagccctcctggcctcgccagggacgatcggcccggatcgggggcaaaaagcgcacgcatcatttgcctagggagaatgtgccatgccactcactcactcacccatgtttctggcagtggcagtggcagtggcagcgtcgtcttgttctttcttgtgtgtgtggccgttccccgccacggccaaatgtttctcaacctggaattgtttgattaggctcacacggcttgacacgtacgaggggtacaagcaatatgcttttgtttgtggctgtgcaagtgcggaggacgacggcgtgcgcagaccaagttgaccttgcgaccaaatctaataaaatgttaaatcgaattgttccatgatcacaaaaactcagatgcgaagaggtggatagattattaccgataggctttgtcacttgagaagacgtggtaaatgactgaaccttggcgaattgccaggaccagcggagcaatttattacttgtttcattcttagaacaccaaatctggaagcaccggtactctctgacggtccgatccatggatagtccggcctgttagcctggaccgtctgagattagatcaatttcctggaagactgatttgtcgcgagatcttttttattttttgtgatattttattacactccgt

SEQ ID NO: 2231 - DNA, 1071 bp, Zea mays
  misc_feature (1)..(100): optimal_loci_226475_G1, chr6:116772410..116773480, Cluster 13
ctcgtgctgaccgctgtttaaacatctataatcatgcaacgagttaatttaaaatagttgttaggggttatttaaaaaaaattactcgggccgttgtctgctatgtctatttttccgcctcctactagttgagaagccaaggcaatccttgagagagagagctgggattcatccctagctgcagctggcagagtggagagagggggagcccctttttctcgtgacgcgatggcctgatgagagccacaataagtgcaatggaaatgacgagtggagagagagatagaaacgaactggcctggccggagtagcaagagctgcagtaacaggcagccagctgccttgcgtgtttgtgtgcgccgggcgagggaggagcggcaggcagcagcagaattgcagacgcagcagctcagcatccggagcctgtccgtgcccggataaacagggagataggacaaaatctaaacgaaggtcgcttcgccttgcccccgctggcccggcccactccgagcccaatccggcgctgaacggaacggagaattctccctcgcttctgcactgctggccctggccgctgacgctgagtgagtgagtgaggaaagaccagaccccgtctggcagcgtgccgcagatgctagtgcagcagccgtgcagtgcggttccactcccacacactcacggctgccagctgccagccgtagcgtagcggcaggccgcagctcagctgggcactcgatcgatgcgcgtcacggcattgtaaacttttacgtgcacgatcgcccacggcgggatacagagccatccaggttgcagtgcaggcccgccatcaatggctctgcgctgcctgcatgcatatgtgcgcgtgcatcggcgtgcgtgctaggcccgccggactcgatgccgggagctcggtgccgctggctggctggatatcatgatggtccactactgcctgcctcctgcacgtttatgttgccaaggcggagggccgacgcttctgtgtctgcgactgcgtccgcgaccgctggtccagtgctctttgtcgttgaggctggccctcttaatcactgt

SEQ ID NO: 2232 - DNA, 1041 bp, Zea mays
  misc_feature (1)..(100): optimal_loci_226609_G1, chr6:117585901..117586941, Cluster 13
tttcttgtagtaaccgagttttagaggcaacaacctcattttcgagaaaaaaaaaatgaaattgatgcatcggtgcctcttccggttccgggcaccatgcattttttaggtcctaaccaaatacgcccttgactcgctgtgtctcctgtgattctcacggttggcgacactcgcatagtcgcatgcgttgaattcgtcgttcttcgtctttgcgaacaaaatcgacgttggacattgcaggaggcattcacacacaggacactaccaaacctggagctcgatcgtgcgtcatacgtggactgcacagtttgacccccaccaaccgtgctgccaagcatccatgcgcccacacctgtcacgccggcagggttcagggcttttcaggcgcttcaactttgccgggccgcagatgagatgcgagaaccctcctccgccgcgccatgtggcacgaggcgtctcgccgtccggccggcacagcgcggaactccgccggcaaaaaaccatcaaggcctcgagaggcacacatgatgggtgtggaaaagaagaggaaaacggccggacgacgatggatgacatgcatggtgcccctgctggccgctgctgccgccagccgccacgacaggagagccagcagccgtctctgcaagtgcagccggcgaaaacgacgagggaaaggaacatccgggcagcagcacagcagtaggcaacggcgcctttgcttgcattgcatgtttgattgggaaacggttacagattcccctggcaaacggaccgatgcggagccgacgaccagccggcataagcactacgtcatctgcagccagggtcagttacgttgggggtcccgaaagaggtcacatccgtgtgtccggtaggtcatacggctagctgtgagtgtgacgattgcggcagggtttggtagagcggaggaacgtgcggccgttaccgccgaaattacaagattccgtttacaagaaattagacgattccctttacaacgagtgacaggcgagtagctagagtgccgaggtgaggaactac

SEQ ID NO: 2233 - DNA, 1375 bp, Zea mays
  misc_feature (1)..(100): optimal_loci_229111_G1, chr6:130149524..130150898, Cluster 13
caagggtaccctctaggaaatatggaaagtttggaataggaaaatctttgaaggcactgaagcttctgtcaaccttcgaacctagtgtttaaaaaaagaagctcgtcagcaaagcctgcattttagagatatcgatgtcctgctattcttttgatggttcgacaacatgtagcctttgttgttttgtttgtgtttaactaaaatttctatttttggttataaataaaagaactaaataaaatgaatgttttaatggccaaatattaaaaataggttgcttgtaatttaaacaatagaaaattatgagtttctaaaaaatatctatagttaattatatttaattgtttgcatccactactttaaataaattttattaagtgaaagtaaatttataaaattcgtgaaaggctcgaataggttttatcctatttctaaaataaagtattaagtcttgtttgaaaaataaatctaaatctaaatttggaactatgtttaaaatcacgcagttttaaaattttagatggttgagataactttaaaaacttacttgactcaaaatatttgtatttaagtttcaaactgagttacagtatttgaaaatgatagaaaccctcctctctctctatttaggccgtatctggcccgcacagcctcccactgctgtgatctctctaggcccgcatctgtcagtcgtgcgggaagataacccagcaggctggcccaattcccgtgcagaagccagcatgcacctctctctctcattcactgacagctaggtccggcgctcctcctgctgacggatggaccctaccgtcagggacacacccttcctttggctccctccccttttcgcctgccatcgccgcgcgccggagccgcgcggcgcgagtgcgcgaccaagcacctgcgtggaccaagcccccatgctcccgctgcgccgatcccatcagagcacgccagatcttctctctcttcatgctccccaaccgacgcgatcgcaacgtggtccgctctatcgtgcgcgctaggtcatggccaccatggccgagctccacggccctccttttctccctcgtctccgcccctacattcctacaagagccccctatccggtgcctagagtgcccaggcgcccagcgtcctcccatacagcatattccactccagagctccaatcaccgccgctgccaccattgatagctcctacttctccctattccgcttccggccatctccgttgcccctgttggactctacaattttgtaggaacacggagaaccagcccacaacttctcctcattgattcgtggatgcaaccccaccttcccgagcctccaccgctgttgtgcttgtgcacgtgctccacccctcaca

SEQ ID NO: 2234 - DNA, 1331 bp, Zea mays
  misc_feature (1)..(100): optimal_loci_229482_G1, chr6:131980285..131981615, Cluster 13
ttttgtacaccgtttttctagattaaaatgcaactaaaaatacctgtttttctaacatttctcgcctcccaagttcccgtttcaaaaaaaaatcgtttcatcttgatagtgatgtttgaaacactgaagacgactctctagagagtgacaacttgccattttcctccaccaatggcacagcggtggatcatgcaatgcaacccagcattttactttaccagacgtacccggacggggaagtttaaagcgtccctccaactaagctcactgagctggatgagaggcatcagcttttgctcacttttccaaagcgctcgccaccttcgccgctttccattggcgcaccgaaatcgctcaaatcattaggcccgacctcgtctactacgcatctcccagctcccgtacgtacctttctagccaccagcagccggtggccagagctccatccatggctgccgtcgtctggtccttatcctcgtgacctagcttcctctctctctctctcccatcagctttctttccttttcccttgccacggatgaatcccgcctctctacagagcccagacatgatcgaacccatgacagccaagtgtcaccaagatatataaattcatgcccttttcgccacacgatcggcgacttcttgaaacactaacaagattgtttcttttttagctagctagatgattcttcattatatactaagctatatatctcttaactgttgatcaaatagcaagtgagaggtttgaagttggtagtagacatcagtttcttcccaaccatgaacaccttttatttcccagagtcacacaggggtacagccgggatagacgattggtctagccctgggggaaaaaaggcagaaagagatgagggtgctgctgggctgcttccctgtttggtcctccgatcctccatgtattcgcccggcttcttttgcaatttaatcccctttatcttctggccagtactgcataccaacgagaaaggtcgatccgtggaccaactcatttacgtacgatggaccaatatatgcctctttcttggtatgtatgtagtgcgtagtgctgacaatgatacaagcagaagagaacatcatgcatgcaaactacactgaagcataatcgatccatatgagtgagaaactgagaatgaacgcgcaccagactcaagctaaaaccagcaaaatagttaacaagtatacttaatttttttgggtgcaaacaccaaaacataagaaagaactaccacactactactaaccgaaaataagtacttgaggtgttcgtctattcacgcgcgtatctgcaagtgcgcactatcatt

SEQ ID NO: 2235 - DNA, 1082 bp, Zea mays
  misc_feature (1)..(100): optimal_loci_230824_G1, chr6:138306407..138307488, Cluster 13
atctttaggaggagaaggaaaggaaaggaaagcttttgaatgaaagtgaaagtggtcagcttgagaagcttgataacttgatgtcttccaaaacgacagaatagagggtccattacattattgatcacggcaagggcggtccgccgccgccgccgccgggggaggagggtggtgagaaggccgtggtggagaaggggagcacgtgcaggaggagctaacaacatcgaagcaacaacgacagctatcgcttccaccgacgacctccacccccacaccataaggcaggtttgggaggtcggtagatcggcggcggccgtgctccggcgtgtctctgcacgtgccctgcttctccaacagggaccttctcaccaaacacacaagcaaaagcagatcggtccaccggatcgacgtacgcatgcatcaagtgctctaacggcggtccttctctactcttttttttttaatatgtgtgtagcttgagagatggatgagagtggagtgggagtgagcggagaacatacaaggagcaacgtctgttgctgggtttatatataggcgtacgtggagcggggacgccggcctggacactggcacactgcaggacgtacgcctaggggaagtggtagaccggtggagtctgaagtgagtttgcgcgagaaagctttgtgtccatggagcgctgctgctgctgctgcaatgcagtgcccggaaaaaaaagtgaagccgtttatgacatcatggttccactgtgtacttctcctctccctccattttagatttaaaattgtagccaactctacccattcttaaaactaagatattttaggtttttttctacgtgtattgttttgaccaggatatacttttgaactacgtataaaggcatagtgtatatctgtagcaaaacctatatatatctagaagatctcgagaagtcttataatctgtcacgaagcgtgtttttcttttttcaaaagccctttttaaaaaagagcgcaaaaataagcggctactaatttattcatgattatctaaagattgtctatagctccaagcttctaattggttatgtgaggggtttt

SEQ ID NO: 2236 - DNA, 1220 bp, Zea mays
  misc_feature (1)..(100): optimal_loci_230874_G1, chr6:138576935..138578154, Cluster 13
ttgctaactctaactcagctccgatgacaggatgttacgattcccggcgagctcaatcactgcacgcgaactgaacaactccgaaacgcacactctcaagtctcaaccgaatggccgattggagacgaacacagctgcgctgcaaaatctcggcagcattttctggtgtgcgttgcttaatatataaagacacaaaacacagtatgttgcactatagttgccttccctaatcgccaacggccggccacgccatgccatgaccacacgaacgtacgtgttgcgcttgcttgaattctaggacgcgccctgcacgatcagcatgcgacaggctcgctctcaaagagtgggccagcataacaacccggtcggatcgacgttattttggctagcaaactaaccaagtgacaggattacaagtatgcctgcattagttaattgcatcacatatgtttaattcggtgcttgattgagaaatgtacaatatgcatgcgttaactattgtgccgcctctgtatggctgtatcttggttatcggttgatgaacatcacgtgttgataaagcggaggtgcttgatcgtccgccaccgggccctttgcatgcacctgatcgtccgtgtgctgtcctgcagcacgcactctgattgtgagtggcgaaggctgacagtggtgcagtgcagcgccgcaaagagctgcttagtagcttctgcttctctcgagctaccggaatgttcatcgactaccgtaagagcagagcactcttgttccggagcagcaggaagctagctactggagcaccatgttagcatcctttgctgcacggaaggggccttcccgcagacgtacttgggtcgtcttcttcctctctccaatggaaaactaaatctcagtgccttctctccggttatctcgaaagcagacaagtgtctttcaggatggtgggctagctttactcgatcaccatgggcggcccgcgcctcgtgctcgccaatgcagttcttgatagcctcccggtatggggcgctccacctccagcgtcccctgggagtgattgttgacgtgttggacgacccacgaccgtacgacggcaccgcgcacctttctttgggctggagaggaaatgctgggacaaaacatgcttacccaaaaaaaggcctgatggtgtgtccttggcgttcgtgaccttcagctccaaaacacctatctgctgatgatgaacgaag

SEQ ID NO: 2237 - DNA, 1083 bp, Zea mays
  misc_feature (1)..(100): optimal_loci_232707_G1, chr6:147034948..147036030, Cluster 13
tctgtaaaccaagtctccgagggtgaaaaaagaagaagagaaaaatcatctgaaggaagcttcacaggatctgatgggcatcaccccaccggctaggtaccacgccagatcctacagatcgtgggagagtatatctgcaataagcggaggagacaatagatgcttcttgcctaggagtacatctaccagaatatattttagttagttaccgaaagatgctggcattagatatcttattattgtaaccccagcatatgccactaagtgatattaaacggttgagctcagctcgatcgagatggatctcgcgcacactccgcacccgcgaccgcgcgccgccattagtttatgcgcccccgtctatccacgcgataagatatgatagtgtactggcaatcatggcaacgagaatctgattgcgttttataataataatgcgcacccacgccacgccaacgccacttggtgcgtggcactcagctgatggcacagcaagtggtgttactctaacctaatctcgtctaatccagggataggatatgggctcaacatttatgtatagatcccacaacaaagtgtaaagaatgtgctgggcacgttgtctcgtggcatgtttgatcgcagggccaacgaatttggaggcaccaggaatctacgagtaataatttattaaaggtgcccattgtttggatctccaagaacaactgtcatgacattattttgcaggcctgctgggctgtctaggcgacgagactggcccttgcaggcctccacgaggattgagagttgggaaagcgagctgatggtcttggtgccgtgcgtgcagcgtgcgggcctgggcgcgtctggatttgggccgagggtgcggctgttctgactgagccgttgaggcaagataagaagccagcccagcctcgcacggtggaccgtgcacccaggtgacgcgcgctaggcctcagtgtttgtgtttcttctcccgtgggctaatgatgcaccgagcagccgacgacaacttccgttttacattctccacggcccagtgttatgttttggcccaggcaacagccatatcgccatgccccg

SEQ ID NO: 2238 - DNA, 1000 bp, Zea mays
  misc_feature (1)..(100): optimal_loci_232717_G1, chr6:147051586..147052585, Cluster 13
tatactacgaggcaactttgcggcattaagggcccaggtgacaggcagatatattcggaggcgcacatgtccacggcgacgaagggactggatgtgacgcggcggcgtccatccatcatcgacgttacgttgccgcgtgtgtgcgcgcgcgcgcacataggattccgtatgtggccgtgcggcggagaggagccatcgagaagtcgggagcccgccaggcgagtggcgaagcatgcggtaccactacttgtgcagagcaaccagatgtactactgactcctgaatcctgatcccatgcatgggcacaagaaccgtgtgagtgcgtgcgtgttgtgtttgggaccagcgtcatctactgtactgtagtagcttctagcttccctcctgtggcacggatgtgaagccccttgtcctttttttggcctatatatacctacctacctatgggaggaaccgtgaccgtgagattggggatagcgatgcgggcgtcagtgagacagatgcctgtgtggctgtgtgtgcgcgcagcaggtcagtactgtacgtagacgggagtagggttgggcgcccggtgccgtgacgtgacagggcagatagacataaggcatggtagcgcctcgggtacctacggctacggagtttgggacgtacggtcaggcgtggtggcaagaggacagcgacgctctgcacaggcacagcacacacacaactgtagggccagtgggccacgtacgtgcgatcgagtacgtacgtacgtacacgaacgaaagaatcgccatgtctttccaagaagctactactactagtacgtactactccgccagtagtcacgactcacgagctgaaaatatataggaccggcacaggcgccacacggcgtggggtggcgtggcgtggcgaaaaggaattgccgatcgggtgattattgcctctctctcctagcgaacaggtactgcacgggggtgacaagaagatattgctattcatttctctatggtat

SEQ ID NO: 2239 - DNA, 1168 bp, Zea mays
  misc_feature (1)..(100): optimal_loci_234050_G1, chr6:153206397..153207564, Cluster 13
ttgcaccgtactatatagatagcagacaaaaaaaaggcaatgtaaactatgtataagggaatgcttttagacacattgttggtgccctaatggcggtgaccagatattcggagtctatatatattgttcgtgaatcttcaacgaaacactgcacagcaagaagcaaagtattgaggaccatgaatcgtccgctcctgcaggagtgatgaaactggtggtcctctctgcactgcagttgtggcctgcggccgtgagaccaccagacgcgagacgaaacgcgtctctctgctcagaagagggcagagcctggaagtcgaagccgaagtcgaaacgtggacgtacgatggatcggcgctggcgtgggccaccgggcggcggacgggcctgccgaccgaactgacacgagctgctcctcgagccgacgagccctcgcgcgttttctctcgttcgacggggacgtcccggctaccgtacgtgccgtcccaggtgggcagtgctagctacaggctagctactgagctgctcacgtcccgtacgtgtcgttgttcgtgcatgcgattgcgatcgacctcaccgccggcgccgggtgctggcagtggaaggttttcagttctctgctcggctcgcgccgcgtgcgttcgatgtagagacaggcgttcctgatgatcagagttgttggtgtaaggcggcgtgtagtcgtgcgaggtttcgcgcgcttttcatggcaatgcgtaggcgttgtatacctatatatatcgtcgtacagctagatatatagcggggatgcgtcatcatgcgtgctgtcggtgcacgctgatggtacacctagagacatgcacttgtgtgacgaaccaaaacatgctgatggagtgatggtgcgcgtccgtacagccacaagctgtgcgtagtgttgtctctcgtctctatgtagagacagaatacgacaggctatctgaaatctgatggcgggcgcgtgacatattctgctccacttgacatagttattgcagcgattatgctaagctatattcctagattcccggtgcatgcagcttgtgtttggtcgctgtcctactacatccattgttggccgtctccaggcatatagccgtgccccgtgcaaaatattatgttgactgtgctgtttgcagcgtgtgtagctagcatg

SEQ ID NO: 2240 - DNA, 1215 bp, Zea mays
  misc_feature (1)..(100): optimal_loci_234265_G1, chr6:153836278..153837492, Cluster 13
ggatgacccttccctcgccctcttctagcatcttttctttctttgcgctcgcctaaaaaaagaacatccttcaatagtacggggtgttgggtttaactgagggagaattgccaatacttagtctgccctttgaagactacacacaaatcttggcatagacattagttctatatcaggaaccatgccctaaagttgcctgagttctttggctagtgtccaacccctcgcctagagaggatgggtgacataacattcgctcactctgagaccactctgagcgtgatgactaggattcaagagttgaaggatcttggtctcaatgttgtacatgtggtggggaattcaattgagtgtcgtgttctctcattttgtcagaaggaaacctacacttgggagcatgttgggatgattgatccgtcctagccctcaaatgaggcaattctgatgccgaaggtgaaggcctagcttcaccaactcttctctttgattagtgattggctaaaatggtgttagattgaggctttctccctgaccgagcctcgttgtgagttaagctatgcaacttggctattttacaaaaaaaagtctgatcttgttgattttgacctaaccattctagacctcaatgttggaattgcactgacttttgcataacatggcttgggtagtgaaggacagcgacaggccagaccgagttatttcccagtgctacttgccaaacaagcacccaaggagtatgtcccctcttggcctctaaacactccctatccactaaagaagcagaggtggaggatggcctgagttagcaacttagatgaagacgaagatgtgtctcctcatccatctcaaagtcccaggcgctccaaatgcccccaatccatcttgcgaatcaagactcctctcattctctaggagacaaggtagaggtgtcaaaaaagtgaagaccatcccccattaatctctctcactaagcctaagggttgggatgaattggcttctagggctaaatcccaaaggagctctcttgtttggttgaagaagtttagaaaatctataaagtgggaccttaaaatatagccattattttgaaataacaaaaatgttatgtttatattggtcatgatatggattcaactgagctacccaaggatgggactagatccattatgcctgaaaatgactcgagcgttggcactcctaataggctaagtcttc

SEQ ID NO: 2241 - DNA, 1194 bp, Zea mays
  misc_feature (1)..(100): optimal_loci_234817_G1, chr6:156392617..156393810, Cluster 13
atctagttctcacgagaatatagatataacgtggcttgcatgcacgataacttatattgttcatgaacctagattcttagaaaaaaactcttcggtaaaaagttgacacaaataagtttatagactaataaatggtgaacgatggctgatgtgataatatatatagtctttttttctaaagagatttttttaaatctaattcccggataatacagttctcacgagaatctggatatcatgtgacgtgcggaaaatacgaaggtgtctatacgggttaggattttaaaatcggtcgatttcttgacgactcagtaaattctatatattttttaaaaaaactattgttaccataggttttgggaaaacgaaacgtttctcgatcaattacctacaaaatcttggaaaaaaaggcacatagtctgttagctctgtaaccagcctaaaggcttcctacacacgttaccatggacagctttcaaaccgtctcgcccgtgctacgtccacggcagccgcacacaaccacggatggccggcttttacagctcccggtaccggaaaccctcgccgcgggggtacagtaccgcacgcctgccaaccaacgtactgcacggggcggcactccccccccccccccccccccccgacctgtcccgtccgatgacgcccgccacacgtagcacgggcgcagcgcagtacgcgccacccgccgccggccgctgccactgaccgcacgggcagcggcgcgcgcggcgggatcaatcgatccgattcccgcccgccgtccggtactcatgctgctacagtacccccggccgcgcgccgtaacttccccgccgctggccacttctgactcgcggcgccccggccgctgccgagagaaaaacgcagacgcagcagtgccaggcccaggcgccgtgccgtgcccgtgccgggtggcccgcccgtggtccttcaggtcgccgctacgctacctcacgtgatcctggattcctgttcctgggcagggctccagtgcagtgcagtgcagtgcagtgcaggctgatgtcacgctattgtttaggcttgctgcacgctactcgaatagcccggatcgggccgcgttcgccgcaatcaaggcaccaaagccgctttgccgtattccgcgccgagcgccgccatgcgactcctttgggctttggagcagcagcgtgcagc

SEQ ID NO: 2242 - DNA, 1344 bp, Zea mays
  misc_feature (1)..(100): optimal_loci_235397_G1, chr6:159223573..159224916, Cluster 13
ccagcagcatatcagctggagacgcagactctgctaccactctagctaagagatggatggcacgcacaagtggatcgatcactcgatcagctgcagatctctttggcctttgggcatgcagagagaggcactattttgagttttgacaggggggcgttatttttttgcagtgacgaggtaaaagataaaataaaaaggcgctgcaaatctggggagagatacatgtgtcgggttgaaaccccagaaatggcagacccagcaaccgatccatcacctcactgagatgccagtgtgggtgcaaaggatcatgtgataaagcgtgctggctgcctgcctgcctgcttgcagtctcgtcgttcgtcgtagccagctcgcagtgcatggcgatgtggtaaaaaaagggccccgtgaaatcttgctctccttttcggtgaagattcatgtatacagtgctgcatgcatggttcctttcacagggtgtatatatgtgtattacacctggatattaattagttacaccagtagttaaactgtagtagtatgtagacaccaccacaccggtgcttatcgctgttgttgttcatgtaattaatccctccagtcctgtgtaagtgcatgcaagctgttcagatgcttccactagctagcaagctacctgcagtacagctctatataccatcaaaaataattttaaaaatatatatcaagaaaggcatgccattacacggttgatgcgctagtagtagtactacttgaccctgatcgagtcttgaattaattagcaatcgatgaaatataatatatgggctagctaggatcatcatgcatatatgaactcgatcgtttgcttgcattcattcacggaaagagggtttatattattaatatatgcaatttgtttagtaaacccgccagtccagcgatcgtgcacgttacgttgacaatgccgccgctgattagagaggccagtgggggtgaggcgcctttcatttagcttagcttagcttagggcaaaaacaattgctttaaaaaacatggcctctgaatgtgactaaagcctaggggcggcatccaatcgcgtcgtagccctcttcgtcgtcgtcgtcgtctccatcttttggtcgatgcgcgcccgcccgcgcccggtcgtcgatgtgtgcgtgcgtggatgcttccaaagctggcaagcagcagctagtgtgtgtgcaattcctcatcgcctttccccgcaataataatcctatcgaaaacatcgaaagcgggggcaacgcatttggaaaaagacgatcgtcgtcacctctaattccttgggagctaaggtttttgctggaacacatgatacgt

SEQ ID NO: 2243 - DNA, 1273 bp, Zea mays
  misc_feature (1)..(100): optimal_loci_235409_G1, chr6:159232083..159233355, Cluster 13
aggttatataaaattgagggccccccggcctcagccagcggcggtgtgtgtatctgctgtagccgttagctaagctgctggggcctggggggaatggaacccgattccgcgcgcgcatccgggccgtccctttcctcctgctgcgcgctgatacgaatcgcccccacgcgatccgataagcatacgagacggtgcggtgcggtgacgggacggggaatatacggggcctggcgcgaaccctcgcgcgcacagcagcccggcagctttgctctctgcctctgcgggggtggggtggggtgggcatggccgctgaacgctgagcgtccaggttgcctccacgtacgccatctatctatctatccttcgtgctcctggataaacaaacaggaggccaagggtccatggacgactaactgcaatattctccggccggccaacttgagcttgagcagtgctgtcgaacaaaagctcggcgccgcgcgcgccggtgagcgacagcgaccacctgaggtcggcacggaattccaagctcggaagctagcgagggccttcgactgtggaagaaagggctccgagctaacaaaagcatgagctacttagtgcacagcatctacaattctactgatagaagagaatgaagctactagtgccgaaacatcgtttctatcatcggctcggcggccggcagagcagctgggctggaactggaagcagagagagagagagagaaagaagagagagagagagagaggtgttggcttctctcccgagaactgcatgcctccgtggaccatcccagcccgataacccgccacctcatcactgctacctcaggacggacgacatgcgcggcggcgtcgcgcacggcgatatctatcttggcctttttttttaaaaaaaaaagtcgatcaataatgtccagctagctagcgcccagctgtctcgagagaaagctgcaatgcaaatacgagcttgcttgtgtcccggcctgcatgctagcagcgtacgtgactatcatatcatttcgtatatcgtgcgacacattatgtgcgtgcatgtacttcctttctttccgatgattccctattccgccctaacgctgcttgcctgagaacaagccaagccctgcgttgtactacttcagtacttgtgccgctgtgcaacaagcctgcgtgcgtgagcatccttcgatacttggatgccatcatatatgcactctcacgtctcatgcacctactcgagtcctttgacacccaagtcgttctattccttc

SEQ ID NO: 2244 - DNA, 1302 bp, Zea mays
  misc_feature (1)..(100): optimal_loci_235589_G1, chr6:160176741..160178042, Cluster 13
aaagaataattgcgcactaaaaattgtgaagtcatagagaaactcgagacccaccagaacaagggactctaaacgcccaggacacgcagtgccctgagacaatccagaaaaaataaaatatgtcccaaaaaaaccttatacctcgagtaagccatcaggacacctcgcacccagggtattcacgagggtaattctctagggccctcatgtcctatggagatgtgaagtataggtggtcgaggtagtttaggcaccgaggcattcaacgacaattaggcactaggggcactctagcccttaagggctggttttttaaattggagaaaacatcttcctattcaattttgaatagcaagaaattttcttctaggaatccccttcaattatgtggtcaccaaactagtcctaagaatgtccttatggattatgtaaattaggagacacagtcacaccgcccgaggtatccggttggcactccacttccactgttccacacaaataggagtaaaatagctgacgggctagcggtttgagcctgcgcaaccggccaccctccactaccgtgctctgctgactggacccaggcctgcggccggttggccgggcacaaatgggaaatgggccgtgcataattctttatttattgagatgggcaaacggagtaacggacagacgggccaaatagtactttcctggctttcaaaaaacagctcccaagacaatgtaattttctacctagaaaataacaagatttataatttaaaatggaggaagtagtattgattatgtgagaattaatatggctttaaacgagtggctcacctctggtcgcaaatcgcagtctgatgagtggctcacctcagtcagacagtgagtcacacacttctttttgaccaccatttgggagaccgaacgaagaacagagaaccggacgccgccggtggagagctgagcacctgcgcccgcacgtgcagcagtccagaagggaagtttcttccgccgaagcagattgcacgtgcaagtgaaagcagctgcgagaagtcatctcgaatgatggaaacacatgccacgatatagatatagatatatcacaatttaatgtatatcctcctcattgtccttctgtagtgagtacagtatgtattaacatcgataaagacaaacatgtccacggttgcgatcaatcctaagcacagcgagaacacgctgtagccgacgctaatcccggtctgcacacgataaactattgagcatttcctgatcggctgatttcctggtgaattggccttttagcttaggtta

SEQ ID NO: 2245 - DNA, 1129 bp, Zea mays
  misc_feature (1)..(100): optimal_loci_236364_G1, chr6:164315753..164316881, Cluster 13
tatgtacgggcactttggtcatataattgaaagtttgattttaatacaacttagtgtcctatccattttggactctctgttacaagaagatacgactctagctggtacttgggtacttggtgtgttggaccgatgaacgtggatgcattgagccgagccagaccagagcccttattgtctactcctgctcatgtcaagatttctccagagcttcaataacaacgatagatagccatgcatgcatgggcaatggagatagaaccttatctatcaccaagatacatcgtactgtactattaattatctccatcgtgagttagttggtgacgatgcacacgctagctccacacacacatgaccgttgttggtgatgactgatgactccgccggttgccgcgagagtacatacgtgccagccgcgctcgcagctagctacctagtaggaacatatatgcatggccggccttctccctagctagctagaccgtgaccgtcgcgctggctggctcagcgcctcagcctcgtcaaggccacgtgcgcggggcagccggccggactagtcagctccgccgttctcgctgccgatgcactgcactggcgggccggcggcgtacacacacgacgaccggccggacggtgtatgtgtaaacgctagctaacgcaccacgtatgtatgcacacgcatgacgatgcatgcatgtcagggcctacacgtcgatccatcgtccctaccacataactataggagagggaagacgcagctgcatgcatacatgcatatatgcgactgcgccctgcgtgctacgaacgagctagaagagctagtccaggccgccggccgacacgtacgccgtctttagctaccttgttgcagtgaacgcgaccggccgccgtgcgcgtcagactgtgcatgcgcgtccacgtgagcctcacgcggggaccagattgcccagtcccggcgggtggagcggatcacgacagtgacacgtcgacggcgccacgtacgtacgtcatctactagtataagtgcacacgtcgttttagtatcgacctattactacttgtttttttttttaatttctgtctagaaaatcaaaacaattttacagacgcctcatttatagaaccg

SEQ ID NO: 2246 - DNA, 1061 bp, Zea mays
  misc_feature (1)..(100): optimal_loci_236597_G1, chr6:165554695..165555755, Cluster 13
ggctcagccaggtgcccaggtgacctgcactgcagatcgtgctgctgctggctgctgcctgctgctgctgcatttgcccagacaggcagagaggtccacggcgatgcagggaggggctgcatgcttgcatgcatgcatgttcttccttctgcatgcatgcatgcacggccgggccgggggcggaatgggtatggaattaacgccggcgccgcacacagggaaagtaaaccaaaacaaaaaaatatataaataatagtttcctttctgacgcgctgtataaatgctgtgccgggccaataattctgggagcagcgaaacacagcacatgccgggtctgtgggcgtacactcgaccgaacgcaaccgtattcatttctgcatgcctgccaccagacaaaggcacgtacgtacgtacctgcacgactgacaaggcagcgtgggcatcaaccagcgcaacgcatttttcctcgagccatcgtgtggtatcggcaggagagcgaggcagtaccagctgctggccgagtcttttgcttgctttgcactgtggaactgtggctagattgtggtcgtccctctcgactctcgaggcaggcacttttcgtatcgctcctcggcgcaaagtgagcagcgccaagatctggcatgatggcaatggcattctgctgggactgggatgcgcgcggccgcggatcctcggatccagccgtgggtccggtccgcccgcggcaccgtcgcgaggtgccacggaggtgtggaggttgggccggcccggtcacagcagcatcagcagtcaggtgggtgtgatccggcccccaccacgttgccgataccctcccgacaggaccccgtgggccatcgccccacgtggcccgaccctggcgccccagggcccaccacgaccgttggtagttacagggccgtcgtggtcccatcccatcccatcctgtgcggccttcgcagtgcgagcccaactccatccatcccaacctcccccaatcaggccaggcaatgtagtctgtaaggctgcggcagcttaaatacacggcacgcttaccagattgg

SEQ ID NO: 2247 - DNA, 1091 bp, Zea mays
  misc_feature (1)..(100): optimal_loci_237323_G1, chr7:718462..719552, Cluster 13
caaccggagctgaggaattgtatgcaatactactagtagactagtagtgcaacgcttgcagtagggtttgtgtgtgtgtgtgtgtgttgggtaggaggaagcatgcagtcttgacagagatgacgtgcattggcaattggcatggatgcagagcctgctgcaagaggagccagcagcgaggtggcagtgataggtagagtagtctggtgtgcttgcgtcgcgtgcctgcttgatgagcagcacgcatgtaataatgctgcagggagaagagaagagaagagaggagtaggagcgagttgaaagagatggacggcaggcggccttggttggttgctggttgctgactgctcgctcgatcgatgaggccgtagcttgaaaggaaacgagagccaactgcccgcccggcggacggcaccctgttcctttgctttcctttcctttcctgcacggatcggacggaactggcccttcaatccagccggccagccggctctgtaagattaatgttcaagctagctaggatcatatgtatgttctgtttatagaggagttacttccaaggcaacttaacaaacaggcggcagttctgatagatagatacaatatgcatatacatacagcatgcatgcagctatatatatatctgctccataatacgtatctacgcgtacgtactaataacatacatacatgcagctaggcaggtacgcggtcgctgtgatgaggttgctggccgccccatcatatccaatatccatcgtcgatgctgattggccgctcagagagttccgagaattcaggcagctagcaggcgaccaactggagcagtagtaagtgttactgcaagtcacccaatatctagagcttgcttagtacataccacgcctcgacacatgtattcccaatatatctagtttgcttaccactactgtctatcttgaaccaacctgctagatctagtaactagcttttcacacccggcccattaagactagctagtttggtgtacatgaaaatagaggattgaatagcaaggggattcttcctctatcgacccattccatttccctagtcaccaaatcagctttaac

SEQ ID NO: 2248 - DNA, 1017 bp, Zea mays
  misc_feature (1)..(100): optimal_loci_237959_G1, chr7:4066398..4067414, Cluster 13
gcagtgctgcagcagcggcgctgtgcaggatggaaagagaaggagatgcaaggatccaaaaaaagcgcaagatgctgcctggaggattcagtttcctgactccgcattcagttccccgccagtctcgtgttttattttacctaccaaacattttgactggcattcagtttcgcccactgtggatcagtgtctgaatgtccctccctgtacagtctcagaacccgaagcaaagatcctccttgacgttcttgcgaagccagtccgagcaaatcttctttctttctttctttctttctttctttctttctttcaaaattctgaatggggtctcgtataacaaacaggaacagtacactggtaatctccttgagagttttagcatcagacgcggccgagccaatgattagggtttggtggcgcgtctccattatattggatcgatgaactgcttgttgctcccttccatcattccttgcttccttccccgacagtgacagccctcgatcggtggcccttgacaaagcaagcccagacgctctgctgcctgcctgtggagcttctggaaaggagtgcgcatgtcttcactgccatccgtcggaagctaagtgactccacgctcgacgaccatccatgctcctgctccatggcttggaactgaaactgctccagagcaagagacacgcggacggaatgagtggccggttcagccattcaggcacgcacgctccagctgtgcctgtgccgtggaaagcgagcgagcagtacctgacagtccaataatgctagcgagtagcgacgcatgcttttgtctgagaaaacatgattgggaaaggccggtaccggtacattgccgacacatgcgatgcttccttttccttgcgaccgaggcgaggatctgattctgatgcatcacgatgtgcacgagggccatggactgactactcatgggtgctgcagacatcttctagcttttgttgtgaaaccaaattatataactgtagagcccagaaaatgatc

SEQ ID NO: 2249 - DNA, 1307 bp, Zea mays
  misc_feature (1)..(100): optimal_loci_2451_G1, chr1:12862207..12863513, Cluster 13
caaggagcgggggcagtctacagacgagtcttaatagttgtagagatttatttatttatttttgtcattcatgatgcccagccctatcccctcctcgcaccggacctgacagtacgtgtgggaggctttttgaaaccgcaggggcggggtgcgaaacagccccgtccgcggaaagggcagggccgcaggggacgcccatccgtgcatcgcacaatcaatggctgtggctcccattccgcctccctctctctctctctctcgcgcgcgcggtgcacttgcaatgcagaagtgggcagccggcgagcctgcctgcctttccttgtttccggcgacacggggtggtcgccatcatctcatctcgtctgcccgttcctctctcctctctacgtgattctttgtgtcgctgccagccacagcggatcaggccccgcagttcctgacatctgagaaagaggaagagaaggagcctattctctgaaccccgtccaatacaaaattcctacgagtggttatgtgctcactgctcaggtttaaaaaaaacgaagctactcctggtacagtactacttttgattacttttctccaactataaaatactcgttcgctcgacgaagtcgcctccaggcttcggttggcaggtttttttttatatatagtatattcgttgcttgtcctttcagttggacgcaagacggacctgccgcccccctgctgccagcttttgggtgagcggagcatctgatgcatgacaatcctgttcatgtgcgcgaaacggggacaggcagtgatggtacgcttatccggatcatgtactggtagtactagtacatgttactactcactcctacgagtaataagtgtttcgtacggactactcactcctacgtagctttctctgggtagggtcgggtagggtagggcactgtcctctgaactatgagagtgtttctccccgcctccttttcagtaagatgctgttgataaagtgttcccaatatcacgaaaagaaaagaaaaaggcacaagagaaatcattcatggcaacaaaaaaaatataaagcacgtcacggcgtggggggggggggttcgtagattctacgccgcgcgtggcaaaataaagaaacctcgcattgcccctgctgcacgcgaaaccacttgacttgagaacatgcccgtgcctggccggcctgtgtacagtggcctaagaaagttgatgcagtccaagagtatgtgtgtgagtgatggaacaaatattaaatatataacttatataattagacgttatatatatatatatatatatatata

SEQ ID NO: 2250 - DNA, 1043 bp, Zea mays
  misc_feature (1)..(100): optimal_loci_2453_G1, chr1:12863947..12864989, Cluster 13
cagctacttacatcatcatcacacgcgcatatgcctgcctgcctgccttctatagctgactatgctagctatagtatacctttgattagattagtcccacagctgctgtgctatatactactagtacttactattgtatagcacaactactaatcacatgctcgatacatgtgctcatcatctgttaatccttgtttgtttttttattgcgaaaggaaaaatccatctgtcaacatgcctgcctacactgtcgttagtactgaagcaaaacggcaaaaggtagcatttgccggtttgccgcgcgccggggtaaatctcatcccttaattcccgtttggttttgtttggatcgctctctccatccgccgcatctgcgtcatcgaccacgccgacaggttacttgtagcagcaacagtcagtggggggttttccgtgccataaataaattaaccagaagagaggaccgtacgggtttcagctcgttgtgcgcgtggctcgaggcatcatatcgtgccaagctttgcacctttcccttcgcttttcaccactccttgacggaggctctgtccacgtaaacagtctgtgtatacgtcccttatacccttccctgaatctagatgttgtttgtttgttattataataatatatattcagattacattatctaacttatattaaaccaacactaagtttgaaaatcatataatttagatagatatcccaaacaaacggctccaatccatccagtacgccgtttcagttccttcccaagtttcgtttcgtttggtggtccttaaacccaacaccagaaaatacattacccagcggcagcggacagcccatcatatacaaggcccattcaagaatgtgcctcgttgacccacggtcaggtcgactggggccgagcccatcctatccgagaatcgcacgactggggcccaactcaccaccggcgcgccttcttgcacgcgcgtttcttcttgtttccgggccgcatccagacccaggcgcaaggaccaaggagggcttggcgttcggtagtt

SEQ ID NO: 2251 - DNA, 1106 bp, Zea mays
  misc_feature (1)..(100): optimal_loci_24777_G1, chr1:150187317..150188422, Cluster 13
cgattcctaagagaagtcggtctttagaaatcgttaaccttaggcccagacaaaagtgaggagagtggttgccaagagggcatgtaaagagacatgatcattgtcctcagtccgcgaagcctcctcaagtacatattttcccgcatcgctttctcgatgtttgtacaccattgttgactgcatttcatgcattcctcaagtcgttgccattgaaacatctagtggagaagaacaagcatcctgaggatgttcgtccctggaaaatgtcgatgttttgaccaagacctttggtactctggttgttctttaggatctgtgtgggccggtcatttctatgctagccatcgaccctgtgctaggatgggtaggttgatctacaccgcacgatacaggatcgacggtcatccattatccccccattacgacggccacccaggcggcgacggcacttggccccacagtggaggccatcaccggagttccggatctggtgctccagaacacccatcatggtcccgacacgagcaacacgatgcgaacgacaaagcgaagattcagggagggttcgtacgacgcgtaatgaagggagagggagccagccacggtgaatggtggtcccacagcgagcaccccactccgacaaggaattccaacgaccaccacccaaaccacagcttgacgataagccagacaggttcgcaagaccccgacaatcacatccatttcccctgcgaggtctatgctccgcttctccttgacttcaatcgtgtcggatctatggtggcagtgacactctccctcgacctcctatctctcaccctctgcgcatgaatagaccctaacacccacggattttgacggaggaagctcccgacccgagctggttatataccccgaggaggcacgtgccagacaacctccagtctgacacccctggcgagaaccgcggagtttgttacgatcggtagggaagaagatgaccagctggacccacgtgtaggtgacgcgaaagagtgagtgtggctgaccggagggccccagcagcagtgaaaccgaacatgcgcacaacgtttctggctgagtggcccgccggtcaggcaccggac

SEQ ID NO: 2252 - DNA, 1390 bp, Zea mays
  misc_feature (1)..(100): optimal_loci_251259_G1, chr7:91704090..91705479, Cluster 13
cagtaagcatctgctctaatcttattcgttcgtttttgatcgagcgaccctatctcctcctccctcacccatcagcaacggaggcaactgcggtggcgttcatgagctctatggcggaggcctcacccgtgcgccctgtttaagtgatttggagtccctatgcggatgcgtcgaggtgctaaacggaggggggaatgcggggaatcttaccatgtattagggcgcctgattgtgttgttcacggcgagcagcggcttgatgacggaggtaaaacaccggcaagcaatcaccagttcccggattgccccacgtgcgtggagaccccacgctcatgtaccctggactcttgtaaatctcctaggccttatatcggaagctgagcgacgacgagaaggtgtaatggcggtggcagctcccggtgtgctcggtggtgatgtcctcggggacggctgcttcgacaccgcaccagggcgccgatgagatgggcgagagagagtcgcgttcggtatttacgcctcctgctgattcgagcgcacgaggttgttgcgttgctgctgtattttcacgcatcgggtaacctgaggaagaagctactggccactggggcccgcgtgacagcgagacgactccgcgcgtgcgaggcaaccgccgcccgggcccgcttgtcggtgcaagaaggcagggtgggccatacggttggtattgcgaactgagccaaaattgtgggtgcaagcctagttgggtttctttccttttcattttttcttttccttcttattgtatttttggtttttatcccaaattttctctttttttaatcccaaacttgtattacaacttaaatacacatgcaacaacataaaaacccaacatgtgatgcacacttattttaatcattggttgttttaatcaagcttaatattgtaatatgcataaagagggaaaataaataatcacatatatttttataatttccaagacttatatatttttttatgctccccgaaatttgggtattacatgcaatccacgtatacttgagacaacatcaatgtaaatatgattctagaacatcaatcttgaaagagattaagctaacactagccacttcaaactcctagtaacaccagcagagttgtgtgcctacattatgcaataactcaacaatttgtcctattattgttgcaattgctctattgaaggagaagaagcaagattaaataagaagaagcaatctgtcctgttgttactacaataacaacaatgagttgaacgagaagaaatattactggctagaggaatgggggaaccatatctgccagcaatgtcttggttggtcagagctatcgagatggccgcgacgacaagcacatgccatccacggaggttt

SEQ ID NO: 2253 - DNA, 1358 bp, Zea mays
  misc_feature (1)..(100): optimal_loci_254422_G1, chr7:109543286..109544643, Cluster 13
gcgtgacgtgagtgcgacacacacacataccgacgcacggcgtcggtgaaaattgcgggacagcgtgaaaggctccgaacgaaagagctagcgacgctctgtcggcaattcatcaacatcaaggctagaaaatggcttggcctgagtgaccggtgtggtcagctggtggtctcacccgcacgcacgcacgcggtttccttcgagagtcctgacgtgcagtctcgacgcattttccggcctcaccgtcgtccggcgaccggtggagagtccccttttacactctctctttttttcccgtcggtcagcactgttcggcgatcgccgtggtccggaagaaacgcgcgccgtctagcgtgtgccgttgttgccgtcacacgtgtgcaggcacagctgccgcgccatagactcgtacgtgcgcgtcgtcgaccccaccacctggcagcaggatacgtatatagaatttccaacggaacacgaaaaacaacgatcctgaataatcctgatacacacacggacgaacatgacagacagaaagaaagatcccacgcgcgatcccaaagaaatcctcgcgtgccagggttttccaaattcttgccccgttttcaaactaaggtcctgttttggccggctcctgcaaaaatgactctggttttttcttctcttcaagagcagcacctagatttgcctacgctggaaacagccatcatcgtcactggccactgggacctcagtcagttaacaaattaaaatggcatgtataatccgctgctctccacctggtgcgcagtgaggaaccacaagagtgtatacagatggcacatcagatggatttcgagaatctctcgatcgacagcaggccgaagaaccaaaggggctctgacctgcgggcggcgcaagagatttgatttctcttctcgtcttgccttgaaagctaccagccgccagtctttgtccgcgtaatcatcgagagagaaaaaactagcgagtaggctgtatcaacatatgattctctcccgggacttttaaaagatgcgcaaaagtaaggagagagagagagagagagctcgtgaaaaagcgcgcgagctttggtatgaaattctttgggcaagttgcgccatatctccgaaaccctgtccgccattaagtcctcggcaattaggcctggatcattagctaggtctccgcacttgcttactcgtgcggtcgtgccacgcatcgttgctcgtttcggacaagaacaaaatctcgtgaaaacctttttatgcggaacaggaaactgaatcgcagtaggaacctgagggccgggaccgggacgacagccgccgaagggaagatggcgacgtgctttcttttctcgt

SEQ ID NO: 2254 - DNA, 1139 bp, Zea mays
  misc_feature (1)..(100): optimal_loci_255827_G1, chr7:117529855..117530993, Cluster 13
tttttgctagctctttcagctatgatggctctaggctgctccgagtacttccttgtcaggtgttacgaatatataggatatatatagttagccatggaaaaacgctgcaaatgcaaatataaagtctatcagaactagtttcacatttttagtatttttatgcaagtttatatgaaatttacaaaatcactggttttaaagaaaaagagaaaacgattaaaaaggtaaaaggtatccagggtcgagggattggctctgcctagaccctaaataggccggcccacgtgaggccgctgcggcctaggcggggagggcggccggtccagtggcaaaacggcccaattgtggctcagccagggggcgtggcaagcgagatggcaactgcagcccgcaagcgcaaggtgccatgtctgaaccatgcgtcctcgtgtgtcaccgtgatcggctggccactgctagtgctagcctcacaccgcgacccaccaaggatcctctccgtcacaggctcacagcctcacaggcacagccacaccactctcttgccgagggaagtggagcccaccacctgctcgtgcaaatgcgcaagacgacggccaaaatacggcagcgcccctcatcgtgcgccagattactagggaaccacagtgtgtaataacggggtccgaggagaggattggtattaactattaggggaaccgaattccagcagccagcactcagctacacttctgctttactcatgctctgacctaggcaattcgacaagaaccagggacatgtagctccttgctgacgatgggcgcgcagggacagaaattttcgcatgtgcagatatgctgtgccattgcgaccataccatggaacaacaggttgacgtctccgtagtctgttgtcatggatccagggatcttttccgttcttttactacctgtgaatgacccttctatgaccacttgtattccttatgaccttaccagaagaaagaaatggagatcttcactcattaaagtggatggcacagaactggcacgcggttacgcgccgacggctatggcctaccgcctatggctcacttcgattgtaaaggtcataactatcaactgccagttcgtcttgtacatgtttcactgattatatca

SEQ ID NO: 2255 - DNA, 1116 bp, Zea mays
  misc_feature (1)..(100): optimal_loci_260241_G1, chr7:141451953..141453068, Cluster 13
acctcgccattaactccaaatcggaggaccagtcccttaatcaaccaccgccattatatggtccctggctagaggagccggccggtccatgaccacgacgaccgcgaccacgaccacggatggagacgagcccaaatttgaagccgctcgctgctggttggtgttagtggagagtggcgctggcgccgcgccgaccgtagacgatctgcactcgtgcgggtgcaatgaaaaaggtgggggactggggagccccgttcgtgcggcagcgtgtgcgcgcctccctgcagagagactgcggtgcagggcgctgccggcacccaccggcccatatgcagaggtcgcgcgacaggcccgtgcgtgcacagctgccgcattgcatgacgctgtcgcgtcgcacgtacggtgcttacatgatcatgggcaaaattatatgcaccgatcggtacgtctggagttagggcactgcttggcaactacactcgcagtactggacttggagatcgaagtcgatagatcgagaagcaagacaacattattgtatggactggctatccagtctgaccgtctgtctagctagtacaggttgaacagttggagaggtactgttccagggtatcgagacaagccgaaagaccactgcacgcacaccagcatacgatacgcgagcccaggggggggccgcgcacgcatgtgttagatgccatgtccctctctcattccagtagactggggaagccctgccttgggtgggtagatcgatccagttgagtgagcccctacgccactgacaccatgaagcctttcctcggcgcatgtgctagctgcagcggatccctcgcctggcctggctctcaccgaatctcgacaggccaaggaccgaccgctttctttctcgttcgcgcgtgcatttatcgaccagcccatcgacatcgacatccaccagtcgtcgggtacacgccggcggcacagtcgagcaggattggattggaccaaagagcaccgcaaccgcacgcgcgctcatcagctcattcataggcatgcacgcagacgaacacgcacacgctcggggttgcgaatccatggtcctgatgagcgcccctactcccgtccgcccgc

SEQ ID NO: 2256 - DNA, 1018 bp, Zea mays
  misc_feature (1)..(100): optimal_loci_262782_G1, chr7:155759080..155760097, Cluster 13
acggaacgaagcagattccaaagacaaaattgctcttctgctccaaggcccgaggaccacgaccacgcttgcgtcagggacagggaggccagcaggctactgtggtcaggggacggagggagggagcatctcagggcgggcaggttttgaaggaccccaaaagggaccaaaatttgcttgcttgcttgggaagggagcaagatcaaaacagacagtggaacattgcttgcctgggcctggggttctggagcaggagcagaaaggcacaacaccaaagcatggggcatgggcacaggttgcaagctgcagtctgcagcaagcagctagcattggtccactggagaagcagtgccggtacggcgtgggtggctagctttgaggttctcaaaaagcttgcaggtgacgtaaacggtggaccatcaccatcttgtgcgtgcccatgtatgtatgtagtagtctactgctgtacgcccggaattcgcgccacgaagcacacactgtcagagagattgtcaatggatcttaattagattatatgctcattatttaaacggtagagatttctactgtacaatgtagcagcagtgtcacctcgctattcatcactagagtcatggaccaaatgtctatcacctggatcaaactaaacgaaccttgacgtgttaaccatccgccgcacccgatcgaaccacgccctagaccacccaccgcgcgtcacacgcttcaactagaacatgagacctcaactagaacatggatgccaatatatataactcagatctcagtggtgtttctttttctacttctcgagaatgagcttttagttaatcagtagtagagtgcctgattccgctcacccttcactgcattgctcgtatgcagtcaatgacctgctactaatcttgcctttgaagcaacataacatgcttatgaagcaatcacctgacaattaatcagatggatgaatgaacgtcatcgtcacctggcacctgctgtatgcaatcgattatgtatacac

SEQ ID NO: 2257 - DNA, 1013 bp, Zea mays
  misc_feature (1)..(100): optimal_loci_263252_G1, chr7:157632206..157633218, Cluster 13
atcaagtagtccttattagcctaagctcatgctggtcgatttttacaagacgatgaactaatttttagccccataatccaaacatgcctatgctcaatcggttaacaactctgttatgggcgcactttaatttgcatgcatgcgggtaattagtattttgacacagcgtatttgacggccgtttgataaatgaaacaagatctgcggtgcattgaagcactagctatcttttgtatcaaatgctatcttacaaaaaaaaaaagatgtaaaaggtaataactgcaccacttccgaaaactggatacattgaagcactagctatctcttctttttttttatcaaattgtatcttacaaaacactagctaggcagaacattgcatacatatcccacaacaacgaaatcgaaacgacacgccaagcaccgggacccagacaatcaaccactacggaaaaggacctggccggatctggcgttttgtgttatcgcctgcttgtactgcaggagagagcatatgcacacgtacacgtacgtacggggccgttccgcgtgcagtgcaatcgcatgctcgtccccacaagtacgtggaattggcacggtgagacgtaactgcacacgtacagggtacgccgttttggatgatcgatctggacgcgcgcgcgcaccaccaccaccattgatccgtctaatcggtcggtcggcgattcggcatgcggcgtgtgcgcgctctcggacaggtggtgcacacaggctccctagccaactttgctccctcgctccctttcgtgcgcgtgcgcgtacacccggcgcgtcgacgctgtgctgtgctgtgctgtgcgccttgcggcggacacgatcttggcgtacacgcagtttcgctagccccgcgcgcggtcccgccactaagcactagtactagctagctccagcggatgctgcaggcggaaggaaataaacaagggttgcgtcgcgaaccaccacggcaccatgcttggtttggttcccttgggagt

SEQ ID NO: 2258 - DNA, 1101 bp, Zea mays
  misc_feature (1)..(100): optimal_loci_263359_G1, chr7:158103200..158104300, Cluster 13
catgtaatcaattgtacgacatgtaatttttatgtataaaaacagtgtctcgaagcacttttaaggagctttaaaaattcataaaaactggtctctagctttagttttttttttaaaaaaaaactgagcttatgagttagttctatttagataaaagaagctaaaataaatttaaaatttttgaagtgaagctattttccatgccggttccgatggcccggcgttgggctttcggtttctggcaaacgtcgatggctttggcacatgccaacggaccaaatggattgggaccacggactgatcgcgtacgcgcgccctcctacctcgtgagcatctcgtcccgtctttccatcccgattcccagcgtcaaattacccggggagcaattccagctccgtcacgtcatctccgaacctacactgcacatcggattggcatgtcactggcatcccctccaaccgagcacatggtgtcgtcgcgcgtgcacgcgatcgggcgagcagcacgtggaattttgtccctctgctttcttcgtccgtgccatgcagaataagcagcagttcctttcctaccagcattgccagcaagacaggcatagaagacgaagacgaagaacaagggaaaggacactcgaattcctaccggcgaagagcatcgcactcgaaccagaaccaacaatgcagcaaggcgcacgacgctacaccgtcggatccacgccagaaggggatggggatccgtggagcttttgagctcttggcgtgcatccgctgggcgatgtacggtacggccggtgtagtgtgactggctatcatcgtcaagtgaccgtgtttgttatttaagtaggagtaatatttttggtcgcggccaggggtggtggatagccgtcggtttccggttgtaacggctactaaacggccctgcatgtgttttttttaaaaaataagtaaacaatggccagcggccagccgccagtgctaggcctaggcgtcggtctagtagccgtgtcagtcccggacgccggcgatccgcctcgagtcgaacccgtgctggcacgacagggaccgcatgttccaaatccaggaatcctgaccgaatccaaac

SEQ ID NO: 2259 - DNA, 1075 bp, Zea mays
  misc_feature (1)..(100): optimal_loci_264584_G1, chr7:164752249..164753323, Cluster 13
cgcatggatcggatgtcaggccgtgatttttctaggatttttttggcggctgcgtcagcggcctagcttagctggataattgccaaatgccaacccaacctttaccttctcgcgccgctgtcgaatgggaaaaataagggaaaccaccgatgcgagcatggcgacctcactgcagtctgcatgcatggcttttcttagtcaaatccagacctctctctctctctctctaaattgtagatctcgattcgtacggtgcttgatatgatcgatgagcgtggtctctcgtttcctaccattcctgtcgcgtcatccgatgatgtcccgtccatggtgcaccgcgccggccggtgggtagattagatggatggatcgatcgatcgagcggcggagcccagcaggcactcgatcggatcgaccgacgaccgaccaaaatagcgacgcacgattgcgctccacaccatcatggattcatgatgttcagcagtactgcatgaattgtacccacacacacactgcttgctgctgctcctgctgcatcgtctccatgcaacaaatatctctcatctttgctgactgctgctacggattcgcgcgcgtagtactgtcactaccggaggggggacgtctcacatgtgtgtatcagtgtgtgtgtgtgtgtgtgtgtgtgtgacatttcatggaccgaacgagacgagcagatccatgcatgcatgggctttatttggtcacttgaattccatttccattccaccaccaagcagaaaatatggcaataatatgtggatactacgtttggcgtggctagtactgcttcaggtggcgcgcggtcggctgcctgccagtgccatgcatgcccaaaagaacggttgactctcgcgtgacttgacagatcctttgcgcattcctcattgagagatcattagtggaagttgcacgacgacgacgctcaacgctctcaagggtcagctagctaccaaagtgctagagcatccggaattttaatttcccctgcttttcaattccctctttcccctgcttttcaattccctttagaaatgtcgtcactgcttgctcg

SEQ ID NO: 2260 - DNA, 1068 bp, Zea mays
  misc_feature (1)..(100): optimal_loci_264911_G1, chr7:166737712..166738779, Cluster 13
aacttctttctagatttaataactaaaaccaattttaatttaggacggacgaagtaaccttctagacatctacggtgtcaggactcatcactttcttatcaatctttataatcgaatatgtttggtaccctgatttctttgctacgacaatatataagtgatccatcatacaaacccccctcgaccggcttgaatgcttgatctagcttagctagcatacatgggcatagttttagtttatcccttgccgtggaagcagcagaaacgagccgaggcagatcagaactcatcagaacgctttgcttggatgccctgcaacgtccgtgcgtgcctgtcagtgtccagctcacgcgcactggccgccggtgccctcgccccagctccaccatcggcgccgacgtctagcgggcgaaacgaacggggaagaagcctccagaaaagcttctcctcgttggcacagccacaggcagacaggccaccgcgatcgatcggtgagggaaaaaaaaggcgtggcgcttcacttcacgtgccccgctttttctttccccacgccgggcggcggggcccggcccgggtcgtcatcgacgacggagatggagccacgaccggtggtgcggagcacatgcatggggctcgcagatcaggctcagcagctagctctcccttgtcggccggagtggacggatctttggatgcggtgccgctggctcagctggggcggctgctgctgccggagacgcagacgcccagacagcgccagccagcagcctgcaggtcggtctggacttttgatcggctctgatctgtctgctcagagctttcagctgctcgcattgggtctgcacatgcaccatctcttcgcatgattgcaagtcatcggaatccaacctctcatggaccaagccaagccagagcccagaggaaagcggttgggaccttgttgacccatacaggcccaaagtttctattgggcaaacaagctcagacttcaatcagtccagagaggcggcgcctgcagggaacaaacgggtaaggatgaaaacgatgggtaatggtgttaaaaaatct

SEQ ID NO: 2261 - DNA, 1226 bp, Zea mays
  misc_feature (1)..(100): optimal_loci_265963_G1, chr7:172371849..172373074, Cluster 13
ttcaggagcagagaacctaatgttgctcagtattgtttgagcaataccttaatttaaccaataaaatactattagtaaaaaaaaatctctatccctaatcatatcattcccagccgagtagccgactaggagtccaggaccacctccgctcagcttccacgcttccgctccatgcgcccagctccgcgcgtgcctctgtagcctgaccagctccatgcgcccagctctgtgctccgccatccgccctagcttctcctacgcccaactccacttgtgtagcgtgcctccgcccaacgcccatcttcgcgcacacaccttcatccagtctagcttcgcattccacccttgaccttggttccgcccagtgcccagctctggtctcgttggtttccactgtattgcagcctatgtggttgtccgcccgtctctgtccacattcatcgcttattttattttatagatatgaattgctttagattttattgtaattttttgccgttgtgttagcaataccttagtggcttagttcatccttgtcactgggtcttttgacaattatgttcatagaatttcaatccagtttaaattttagtcctctactaccatatcgaccgcgggtgattgttgagtgtactgtatacggattgcatgacctcttcgtatggtggccgatagacaactatcgacaacacataccaagaaaccatgcaatatgtctagtaacttgcgtccaagccgagacctcgaaagatctcaattaaaaagagagaccacttagattgttctttgcactccaatgccacattcaaaggcgcagcgataaagcagctaggagtggtacacatccaacactcgcaccatatatatcttccatcgacaacaaaaaggcgaataaaccatagagaaagaggggttagcttcgcccgacaaagatatgggctcgtacatgtgctgatcaagctgagaacggcatcatcaaagatctcctgtttggtgacaaatatcgccacatagaatagggcaaagctttgaacgaccatgattgcacgccacatgagaattgatcccctcaagctatttagcataagatgccaccataacctattattgcctcctgacgaaacctagcataaataatgatctgcgcctgcaacctattttattcccaaggcaggagatgatggtatgcattcttgtgtggctttgtcgattctccacttgatggc

SEQ ID NO: 2262 - DNA, 1063 bp, Zea mays
  misc_feature (1)..(100): optimal_loci_271952_G1, chr8:29913007..29914069, Cluster 13
tttatgttttatttgtgagacatgttccctatttgataaatattaaataaaattatatttttgcatccattttggaattttggttgtgcatttagcttaagttgagattttaaaaaactggatttgcaattcggatttgaaattagaaacaaaaataaaaatgaaaatagaaaaaaacaaataggagaaaaccttactttggaccatgaaccattccagtcggcccaagccctctcgcatcggcccagccagcttcctggtgacagctaacttgtcctcctccacgcgctgacagctgcgagccacgatgtcagtcacccctgcgtgccaacgtgcggggccattgtccagtccgctcggcccagcgtcaccccgcgtgctcacggccgtgccccacgacccccactgacgggtggaccgtctttcggtatctccccacgcccaggcagtgtgccgcagacctacaggcctgtgttggcagggggcttctcccacatcgtgtccgagacagaaacgaactccgagacccccaatgatctcacgcccatggcactagatcttgcaccgccccacacgtatatatatatgcagccgccaactccccatggccgcatcaatccatagatcatcaggacccaggaaaccatgagctaccagtaggcaaagctagaagggagagaaaagagaagccgtcgccgctggggattcattttttgcctgcgttcggggctagaatgtagttagggaggttcgtggttgcacatactatgcctttgcatgtgcgcagtggatggagggtcaaggcgcgtggcgatttcctcaccggagtgagtccaccaccatgccgccactctccacagatctgttgtccacgtgaacctcgtaccctaatgccctaatctgagataagaagctctggatcaattcgcggcgttaccctcttcgagtaggacctagaagtattggggataagtgactagagcgtcagacgcctgcttgccggcgtagtcgccaccgtggggagcccggcagccgctgtcagatggttggacgaagaagaagg

SEQ ID NO: 2263 - DNA, 1084 bp, Zea mays
  misc_feature (1)..(100): optimal_loci_283898_G1, chr8:109262964..109264047, Cluster 13
gagatggaatggtagaggttttgatgcttgtatgatgtggaggcgttggaacgtatagagatgccatcattgtttctaggcgaattgggctgcaaccgattcattaggattttgctattttctttggtggtactatgctgttttggtttaaatttcatgatccttctgacaccgttggctaagattttgctattttgtttcttgtaaaactgctcgtgctgagatctggtgggccgaaatccaataccggagggtccagtattgcacccttggcgatccgtgtgaggctttctctggttctcgtctccggccgtgttctcagaacattcttcaaactactagttggcatgcgtgtattcgtcatggtaacttttgatgctttctagcggtcaggatcaaagccaaacatctctttgagagaaaaaaaaatttattgaattccactcgcacccatcggctgcccatctgatggcatgttcggtgcttgaccatggtctgacctgctttcccaccgatattgacttgttgaatcttaatcactaatgaaggaaatactgaacgtgacggtgtgcaatttcagtttccctcgacgaatcttttgttccccagcatctggattcgttctggaatgaacatgcatgggcatggggcatggaggaggcccagcgccggtggcaagcccacggaaactgaacgtctagattcactgtgacaaaacgggaattaaaaaccaaccaacgcagtgcactcacatgctcgtcttcctctcgcggtgtcgcaacgtacgtttctggactctgaccgcccgccgtgacgtcgtctcgtgtgacaggagaagaggcacgcggtccatgcatgcctggctctttttttttttaaatttcaggaagcagcatggaaggtcggacgacagttgcgtgcggaagacacggagacgaagacgaacgcgaggcttggtggtctcgatggacggctgccttgttgttgttggtttggtccccgggtcaagaaagaaacagcggttccggttggtgggcaggcgccggcggttctcggcggcgccaggcgaggccaagtgcggagc

SEQ ID NO: 2264 - DNA, 1066 bp, Zea mays
  misc_feature (1)..(100): optimal_loci_284638_G1, chr8:112759468..112760533, Cluster 13
gtggagactttatatcctatcttgtttgtagtatttgttttgcacatcataatagtttattatgcatgcgcgagccagttaatgaatgttgctcatgaacaacactgggcatgcatgatggagctatcgaatgcaaaaggagcaaccactcgtacaaatcagcctccttgaaccccaaaagggaaacccagtttacacacacataatgcttgcgtgtccccagtccgtgtctccatagtccacgctagggatgacaatgtgtcctccatttctgattctccacgaggatgtgaaagtttttaccctacggaaatgtaaacgaggatagggacgaataagcatttctaatcttcgttcccgacgaataagcatttctaatcttcgttcctgcggggacatgttaaacctatacgtagcgatgtttttgcgcgaacatgtatgtgaagctatttaccgccggcaattccctattgccattgctagtccacaccactagctatcctcatggggacaataccttatttctgccgcatgacacggaggagtgtgcatcaccgaaaaaaaaaagttggtggcgcagacaggaccaggaactgctgcatgctgctgctacacgaatcatggcttgattatctgaggccggccggcggcccccaaccaaagtcaaaaggcgcaaacaaaaacacacggctcggcgcatgcatgcatcaaacgacgcgaaaaaagagcagaaaaaaaacggactctctgcatgtgcttatgtgcatcatcattgttcggctgctgcccagtgcccaccatgaatcgcgccaagcattccggacgattttccattcaaacctcagcttcggaaaacgcaccggtcagtgttcacgtcatgagattaagtttagttagattagagtctccgtaaaacacaaattgatactagaaaaaaaaatatttaaactcagagatgttactaatatgtacgtattttcctacaccattatgcaaaatcagagaggtttggtttataagtaagtatgtgttatcgaatgaactacgtttgtacttgtactccatg

SEQ ID NO: 2265 - DNA, 1320 bp, Zea mays
  misc_feature (1)..(100): optimal_loci_285972_G1, chr8:120156012..120157331, Cluster 13
tagagattaagatacatagagagaaaaatcattttatacgtggaaaagctagaatgacttagagtttggaatggagaaaaatagaaaacttcacattttatatttatttttaaactatgaaatctgaactgtttgctaaggtgagcgagagagagagagatgtacggttgtgagagtgtgtctagcaaattgaggctctgttgggaagatcttccttcctaaatcattggctctactatttgattatctagttatatagttgcattagactttttttaggagaaatcatggtaaaaattgattcgccactaattgttttgtttttatctaactcttcattattccgtttttaattaatataaagaaacaagtaacctctcgagacgtgcgtgcgtgcgagggggaatctgatgtagagggcagcgaatcgggggggaccgaagcatgccgaagctgccctacacccatcgcaatgaaagcgctgtgcgtccccgggcacgtggagccaccccgataggccggcagctgctcgtgtcagccgcggggcccgcgctgacgctggactgcaaccaatccgcacccgcccttttctcaccgcccgccatcgcttacccgcggagccgtactcgccctcccctccgcctgggaggcggggccggcctcccgcgtggcgcgcggaaaaggccagtggagccgtggagggggcgacgagcgaattgccaaaaggagcagaccggatttgcccgggcccgcgcaggcgcaagtggtgggacgctgggcgacaagacagcggactcgttgttatctgtggtacacacacatcggaagcgcgcaccacgagcctactgtatgctactactgtacacggagaacgttcagtgatacagtatgatgatacgtatacagtgcttttcgtattttgactaggtatactttccaaaagtttttttcctaaatgaattgaaaatcatgtttttttatattatatatattaggagtgcggcaactctatgatatctatgggtttacgacaaaacaaacgtacgaccgaaatggaaatatcggcgcttcctcctgctggcgatgctctttctgacagtgtttgcttttcacggccagcggcggtggcccgtggcctaaaggtgtggatactagctatttgtgattggcattcggtattaattcgatcaagcgaagagaatcatgtcctcagagggagacacatgaataattaattgtcaattagtttatgtttcttttccaaaaaaaatgatctaccccttttttcgtgtgtgttgctgatcgatgtactactgcacg

SEQ ID NO: 2266 - DNA, 1046 bp, Zea mays
  misc_feature (1)..(100): optimal_loci_286229_G1, chr8:121790279..121791324, Cluster 13
atccctgcgatcggtagatttggcgaactagaaaattatggctctggctgaattttcgtcgtgcgtcgggacgaccgtcggcgagcgactacttttgccttctcaaaagatgccgggatcgtagccattgctagactatcgatcgcctcatttgacccgaacacgtcatctccacggtcgtataggaggaagaggacgctggtgtatgtgtgcacgcacccgaggcgaggaacgcccccggcggggctggcgcgctagctgtcgatctcaccgggaaccgctactgttgccgacctgtggcccggcagcgcacgcaaaggtcaggccctccccttcccagtcccccgccgtttctgcgggccgcgctgccggccggcatccatttatttccagctcatctgctcgcctgcctcatcagctaatctgctccgataatccctcccttcgcttctgcagccggatcttctgctctgatttcaaccaccatgaatctacgtgctgcggagtgtacgtagacgatgcatggctacgacctcgttgtcgccaggagatcgatcgagatcaacagctgcttctctttgctttcccaagttatccgagaggatgaggctggctagtcccaaaaccggccgtcgcgttgaacgcaacacaaaatcctcccgctgttagggcagccggaggcaggctgaaagcgctgaatttgtagcgtctacagactacggtatcctcactccactccactccactccactcccatcccaggcaatacaggaacggcgactaccgctgtgctgtgcaagcggtgagcctttttttttataaagctactcgagcgagtggccccgcaaccttggcttagcaagatcattagtggccaaaccaagaatggcggcaaaacaaggacgagaaactaaataattgtggcccttaatccaaaatgcacaatctcaaactgccgcttcaaacagtggcgtaccagctgctatgattagagtgtgccagtaaaattatcaaaaaaaaaaggaaacatctgccttgtttttgtg

SEQ ID NO: 2267 - DNA, 1229 bp, Zea mays
  misc_feature (1)..(100): optimal_loci_286536_G1, chr8:123531111..123532339, Cluster 13
tcagctgccaatgccagtccggtcgatctcctccctgcccctgccacagctagccccagtcacagtaagtccgtggatcagctgccaatgccactagttctcaagcttctcatcgccagtaagctagggggaacggcctgtgctgaatgttccttgattagttgcttgtaactttctgaatcagctaagctatatgtatgtttcccactaacaaagtgttgtgaaactggcaatggcacgcacacacaaggcgatcagctgcagatctttgggtgtcgagctagctagctagcgcgccagcgggcagggcatcattttgataaaaaggcgctcgatgtagatctggtggggagagatacatatgtcgggttggaagaccccactgagatggcaacaacgtaacgtgtgggtgcaaaggatcattgtgtgtatgtaataaagcctgctgcagcctcgtagtagctagctaggcaaggcaaggcaaggcaaggcgcgatgtggtgaaaaagaagggccggtgaaataatatttgcccctttccggtgaagatcgaaaattttctcctttccggtgaaggttcatgcaccgtgcttaattgaatgtgtactagccgcagtacaaaagatctgctgtgttcagatgctgattgcccactgctagctattctctaatatatatatcgtcatccatatgcttcaactatagtaagctaccttgcaataaattaaagctagctccctctatatattggccaccaaaaggatatttttaaacattcctaagaaaagaagaagacgtttttcaaacatcactagctagtacgtgcaaagcctgccaagctagctaccactacggccggcagccgatgcccagtagcactcgaccctgatcgagccatgaattaacaatcggtgataatatatgctatgaggtcatcatatatatgcatgcacgaatccgtcgctgctagctcttgcatccacagaagctaaaagagagtatatgcagtttgtttagtaaaccagtccagcgagattatcgtgcatgctacattgacaataatgccactacttagatagggagagggtgcattttttttttgaaagttcgatcggagagggtgcctttagctatagcttaattagggcaaattaaaacaatcgctttgctttaaaaaacatacatggactctgaacgtgactactaaagagcctaaggcatccaatata

SEQ ID NO: 2268 - DNA, 1111 bp, Zea mays
  misc_feature (1)..(100): optimal_loci_286781_G1, chr8:124362916..124364026, Cluster 13
cagtacctcctgacaacaaattcttttaaaaaaaacttcgaacaattaactattggatgcacctgtctgtccttgcttgctacccacttcctcgatggctccaagtgacacgacgtgcttcgacgcctgcctctgtctgcacggagcggccaccggtaaatgtaacgtcacatgacaagggccgcccacctttgcgatccaggacaggacacgcatgtcctgacgccgaggcaagtcggcagcgcccagcacgcaaggcggtcgcgtactcgcgttccgttgttttcgcctcgagtacgtcctctcctccttcctggtcgctcgctacagctacacgttgctcacctcacctcatcacctgcaagagtagccaaggcgcgcgcgcggcgccggcgccggcgttcgtgtgagctagtgtgactctgcttctgggcacctgcggacacgtgacgacgttagcagtgggaccaccacccgcgctgctaagcatcgagtgacccatgagctacgctacgcacgccaccagcgccgcctagcagctaagccccatagcgccaggcggccagggtgaggagggagttacaggcaagcaggggcagggcagggttcctcgccgtcgcggcagctttcccgtgccgcgcgtccgtgactgacgcgctttaaccgtcccagagcgccctacgtgatctgcctctgaatccttactaaagattccttcagtccagtagtgccaccacgaaacgaagctgagcaacgctagaaatgccactcagtcactacacaacatgaaattctctcgagagtttcgtcgcaccaaccgttcgtgaattgtgatccagcgggggggatcggttcccacggttttccatagagaaagggggagcagaaaaacaaactgttcctatcgaaaatccgagaacgtgcgaaaaaaaaactgggcacatgtttcggcttcggaaccttctcaagtaagagactgaaagcccacgtaaagattctactcgttcgtagtatagtacggctgcccgctactttcggcccacccgcggaaggcctgctattgaattaggagtatcttgacggtaccgtacggtattatgattttattttt

SEQ ID NO: 2269 - DNA, 1309 bp, Zea mays
  misc_feature (1)..(100): optimal_loci_289908_G1, chr8:142354356..142355664, Cluster 13
tacctcactggtattaccttagagataaatttggtagaatgattataacctatacatatttatattatgatctgatatagtaatcttctaatgcttatctttagcaccttattcattttcatacctatattaaaacgtaactctacgaacagtgtaatctacggtgtaaaacaacgtttttttttacaataatcatattttttacggcgggcagccataaagcgattgaatctcgggggtcagagcgcgaacgcccttggctcgtccgttgcttttcgagacgccatccaaagtcccgagctcggtccagttgcgtccttggaaccaatcaaccaaacgctgctgggtagcgtagcggtgaatggaggaggttccgccagcacagctcatgtcactttcctcaccctcgcagcgaaaaccataatacccccgggcgggccaccatgcatgattcacgcgcggcggtgggcgatgtgaacgaagcccgtagcggaggtgacagccgctatcgatcggtaagcacgagcaccacgtgccgccagcgggttttcatgctgaacacctcttctgtgtccgtcgccgcgctgatgcttaaggcaaggcgcgcgacgcatgttgttggggaggacgacgccgacgccgacgccgacgctgccgccgcgccggcacgggcagtaattgttgcggcggccgaaccgaacgggtaaggggcgggcgggcggtcctgccgctgggctaagtgacgccttggcttgtagaggagttgacaacccgccccgaggtccaacgtgccgagccatatgcaaaacgctatctagattctagcattagaaaagtctgctgcattgcggagagctgttgtttctccggtagtttccagttggacaatgagaattgattgaataaagggttctgcattagtattttatgacataaaagctctctctctcaatgaagagtttttatatgacttctttatataatttgtactagtaaagttgtcttaggcttataaaatcgtgctagatatgtgtttttataaagacatggtctctttgtttttttaacatgtacaacccaattaaataagaagtgtcttgaagtgtctctagaagtgaaaaaaaaccaagagatgagctcttcgcaaagagcctgtctctatacacaactctctatacatgttgtgtcttgactgcatttattatttagaggctcagagttgtatcattccatctcttagctatctgaaaaccgagtcagagtctcagggttgtacatgccctcacttactctttaaaccgagtcggag

SEQ ID NO: 2270 - DNA, 1243 bp, Zea mays
  misc_feature (1)..(100): optimal_loci_291733_G1, chr8:151231239..151232481, Cluster 13
attctatatattctaggttgcattgtacatgtcctaatgtctcttacatgtatttatggtctagagcctcagaattatatcatgcaatctcttaactgtctcttgtacttagaaaattgagtcaccgtcttagagttgtatatgcccgcaacagtcacctatattataagccttgctctaaactaagttaaattgtcgtctccagcggggtagccgagaagatggttgctgcgccattgtagactcgtcgtcgtcctcgtatatgaaagatgacgttgttgtctgcatgcaataatgttgtctaattttctggcgcagagagtgtgagcggtcatcatcccttggaggcaaccaaaggtgcagccagcagcaaggtactacggcgcagagggcgcaggcagaggacgaataatcttttcacaaaagcaggatccccttggcggcttcggcttgccccgtccgtctaaaagcgcaagagctgacaccaccggagacaactcgaagcaaaacggcaactccctcagggcacgggacgcgacgatccggtgggtctcgctcgcagccggttttagttttgccgggccccacgcggacgaggacgactcccgtggatgcatgtgggctctctgcggcgtcccgtggaaatcggtgttggctagctaaagctagtactgctatattgttttatccgtcgcccgcctcatataacaacaatcaaacacgtagggatggagactggatcgtcgacgcgcggcataaaaattagctcccgagcggcgacgttgcgcccgcggcggcgggtacgtagccgtcgtctcgtcggggtgtacgtacgtagccagcgcggcctttttgcctttggactttgttcccgtgtcgcgtcgcgtgcatgggcacgcacgcacgagggcgccgcggtttctccgtgtgcccaaaacagaggcaccaacgcacgggttcggagagaaaaaaaccacaaagcatcgtttccatccagccacatggctcatgctaatgatgaaaaaggcagccagcagaattaaaattttccaaccttgcattgtgacctgcgcgccctcgcatggcatggccaagccagttttcgtttcgcctcgtcgatcgtctcccggggtgaccaacgactaccgaataacgatcgacacattcgtgcgtgcgtgtgtacactgcagacagacaaaatactagtagtaaaggccaggctgaaaggcaggcagcacgcagc

SEQ ID NO: 2271 - DNA, 1004 bp, Zea mays
  misc_feature (1)..(100): optimal_loci_292222_G1, chr8:153702619..153703622, Cluster 13
tttgttttccttcttatttcttttttctcataattattaggctcacgctctaccatcacgtagctcattaaaactaggagacgaaggacatgacgaccacccaacacttcaacttaggttgaattgtgactggtaactgccccttgtgctaagaatggcaatggtgttggaagtagcatactaagagtggataagttatggtatgcactagctctatcatagtgtgccaccactcttgtcctggttcgtcctctccttcccctttgcttagcttgagcctgctacttgtcacatcaactcacctctcatggttagccattgaagcacaaagtaaacccctagggtgtgacagatctgcttcgttaggtgtattatgagaaggttggcctcacctgtaggcttccctaggcctaggatgggaccgagggcctctatcattgtttaaggaaggtcatacccctagatagtggcaatatgtattataaagatcatgtcaccagaaaaaacctaaagtggtcctcactaatgatggttatgtaccctcgaggcctcctccccccaagggacatgcttagctttggctaaatctaggaccctctacgccatggaccagatcccaaggttctcatgccccagaagctctcccaatctatggcaccacttgggtcgagactagataatgagccttgtccctatgtctttctaagttaggactaagcccccattcgttaagatctaggtccactatagactaggacatatagctagatgcctcaaacattcttcaagatagcctcaaggccggacaacctcaaaagaagatgcctctaggatagaacgacctcagatagtacgaccctagggcaagatagccctaagcatatgggtccgatggcacgtgcgcctctgctcaagataaccttgtggaataacaaggttgtcaagataaggtttatattcatcctattaaatgtgatggatgatgttggggataaggacacatt

SEQ ID NO: 2272 - DNA, 1034 bp, Zea mays
  misc_feature (1)..(100): optimal_loci_293709_G1, chr8:161532728..161533761, Cluster 13
agccctatagaagaaaagaaaaaaaaaacattgttgcgcccatcacccatccatttatccatgtatattatactctgtatgatacaaattaagcaggcacaaggaaggacgcagcgacgattattttggctatgaagaagcaggtggtcttgctccgctaattgccagattagcggctgctctggccatcttgtcttggcttatatatgctttccctctcgctcacgctaacccacgcacccggcagcagcgttgaccgggcgcgcgccttagctaatcagtaatcatgcatcccacgcggggcacccctatcactgctgctttgcgagtgcaaaaaagcctctaaaacattaaaacattcgacaaagtatttttcgagtgatatctggtgctcgacaaataaaaaataaaaaaaaaatcacggtgacggcgacaagtaatggtgacagatactttatcagagtgtaaataattgtactcggcaaaacgacagcctttgttgagtgcgtgctcgctcgataatccgcattatcctacaccgacgtgacaccatggcggtgcctgccgggatcggtttcggggtggtggctcgtcgccgtggtcgctgatggatgtggcagcaggagcagctgccggccgtccgcgctgactagcggtagactagctcggcggagggagggacaggttagatggatgctgaaccggccggccccagccgtccggctgaaaaaaaaaatacaaatagctaggttgctatcggcctggagctgcaaagtgccctgtgcgcagtcagcctgattgtcgggaacgtaacgacgtcttttttttctcaatcgtctcctcctcctcgtgtcttggacgtaacgtatctcgctcgcttgttgcatttgcaccgcctgcaatccgctgcgctgttaacaacttgttgtaacctagccggcgcctagccctgcagtacgtgttgttgcttcatgcagagttgcagagtgcagtgagcgtttctcatcagagaacacgtacgaggggggaacgaa

SEQ ID NO: 2273 - DNA, 1153 bp, Zea mays
  misc_feature (1)..(100): optimal_loci_294928_G1, chr8:167422481..167423633, Cluster 13
cgtacccacaattaagagaacaccatcatatatatatatcgtctacgaaatctagatcgacaagcgggcctgccaaaggttccaggtaaattttgtactgatgtagcgaggggcaccacacaagtgcgttggctgaatggatcaggcacatttccaagtctaggtcacccatgcacatctcgaattcgcgacgtgtgttgccgatggattggcggaggtgactccaaattctaccccggccggtcgtccgttccgtatcctgataagatcgtggcgaggccgggggaatgaattcaattaattataaattgacgcaagttgtggaagtggcgtcgccggtcgctgtcgctcgccatgacccacatatgcatgcaggcaacgacgcaaggaattcactcatatatagcgccagccacctgacgtggtagcagcaagggcatgcgttgttcgcgatcatgcatggccacgctacggatggggccaggcgtacgcgtaccacagcgtttgcgactgttcctctgcggcctcaaagattcaggaaccttcaaccctgcgtcgtgcgtgcagtgtccttggacacagcagtagcgtgcataccatgcatggtgttttgttttatttgttcggggtaacagagacagcaggaaaagaaattaaaaaggagggccgcaccgccgctgcgttcgacgacaacgaagaacaatgctcaaccggccaacgacgacgtgctggccggtgtggatgcgagcagcagggccagccgtgcgtgcagtgcagttgctgttcgagcgtccacacgcctctggctctggctaccgcatgcatgcatgagcccatccggtcatcgccccgagcacctgacggcgggggcgcgcgccgcaaaggcaaacgccacgacaaaagcaaagcaccccgcccggagggggatcaccattcaccagccgcggctagctagtgctcctctcgtgacgttttttttattgacctcatcaccggacgctagcgtcccacttgatgatgactccacactgatgacgacagggactccgcggttgtcaggacctgtaatttccatactaccgaaaacgatgagcacttcccggcccgttacgatcacaaactagtgtattgccgcacgccctgcgcggtgtta

SEQ ID NO: 2274 - DNA, 1096 bp, Zea mays
  misc_feature (1)..(100): optimal_loci_295553_G1, chr8:170177803..170178898, Cluster 13
gtttctaatggttaggaataagaatcttaataaaaacaactttgaacatctttataaaatggttattcagatatagtatttttttttactttaaacaactttgaacaactttgaacatctttatttaaaaaaagactcctgtagatactcttgttagctttatttatagtggacggcgatgaatgaacgcgacacccttttacggtaccggtcattcagctgctgagcgtgcagcagccccgtggtgaccatcggtttaggagtatccccgcgctcctttgaaaactgcacgcacgcgaatgcacatagccgcatcctagcctagcctaggcttttacgtacatgtatgtgcatgtaaagcgacgaacgggcaagatcatatcgtatggtcgggacggacggagccggcgctgcgttgcgttgcgtgcgctttatatgtttaccggacacggtgaagagatagtccggccggtcgggcaagaataacgagccggcaaaactagctagctagggaaagtggagctcgtccggtgacgtcggttagtggtggaaatccgttcatggaaatgccggaccgtcgtgcgtgcatgagtagtagtagtagtacaagcaaagcaaagcaaaggaaaggaaaggcgccggtctgaactcggtccactggatcgggccgtgcgtaaagcgaaaagggtaggaaagggcgcgcaggaaatcaacggagagggctagaccgcactcagccagccggaccgggtgcgcgcgacagcccgtaatgcgcgagcggggaaaggaaagcaactgccgcggcgcgagcgcgagggcacaccgcccggccggctcgacacgggcagagcgcagcgttattgttgcgggtgttcgttcctaccttggtcgtccgagagggcacgggtagcttttcgtccggcagatcgcacaggccgtaacgagctagccgcgcccgcccgtgccgtccatggcaaagcgctgcccggtggaggcggtgccgtacgtcgatcctggcgtgttggcgggtcacgtcgcatcgcaccaccagtccaccacaatcgagcgtgcgccggctacggatatattcggggga

SEQ ID NO: 2275 - DNA, 1300 bp, Zea mays
  misc_feature (1)..(100): optimal_loci_295998_G1, chr8:172359163..172360462, Cluster 13
cacggtaagcacggacccaagcaggagtaggtacgatttcctctcatcacgcttttgccaaaaatgccagtgacgcgattatattttttttcagacgagctgagctttccctatcgagagagccccgatcgagcatatcatatgcaatgcagcacatgcctcacgccaattcgttcgttcgttcgcgtgcgtgcgtgcgtgcgtggacacccccgccccccggccatcgcttagtctcccatcgatatcgtctcgctgactcgcatggcacggccccggcggcttcacgcgcgcctctctttcacaaacgaaaaaaccatgtcctgctaggctgataccacctcgaaaccgtggcatgtacggtggtttcgcaagctactctagcgacgacagcgcagaaagcaagagagagagagagagaagatcttggcgcgatcctgtgcctgctgcaccctggagtggagagagacgacgacacttgcgatttccttcgaatgctcggtcgtgcttctctgcggttctgcgatctgcctggtcgctctgccctactcctactcctactcctactcctactcctacgtttggatcttgcctattctggcagatcgacccgtaggctgtagctagggcctagggggaagaaatcgataaagcgcagcggggattggtgaagacggagagaatcaacggtaataaacccgagacgctgttgaccaccgatccaaatcatatcactgcttgcaacgagtgcctatagctagctaggagagctagtactgtatatactatatattattgcacggttttcacacaagatttgtttcctagcaatgcactccggagtactactctatgaatgaatagaatagaataggtttctaaaatcaaaagtttgtctactcatactttataaaaacgggcgacccgtcagccttttccaaagcctacttatatatttaccgtatctcttctttatctcctaatccaattttaagcttcctagttgaatatatgtacaactaggacggatttggcgctgtaggttctccccgtgatctgcatgccttgcctccggtgggatgagctagctaggacgcggtcctaaaaggttggtcaagatacggaagccggacaggaaggatctctctttttctcgagtcagctagtgctcgtctcgaccgtcgtctcccagctagctgtgtgctgagaatttcctcggaaatgtaacattaaaaaccactgcgctctaattcaaaagctccacagcttgcacgtggccgcaggaaggcggataagtagc

SEQ ID NO: 2276 - DNA, 1126 bp, Zea mays
  misc_feature (1)..(100): optimal_loci_300077_G1, chr9:13931001..13932126, Cluster 13
aacgtgatgctaatgtaggatcttgttcccccatgaccacgcaggatattttttttgttctgttaaaattcccgcagtgttctcgcggaacatatgcttccccgaaggatgctacatgatcatgatgcccatacatgtggtcgtcgtggatccgcattaccatatactcggggtgtacggacccaacggtttctccagccctcccacaggccacagactgctgccctagtaggcggcgtccccgggctccggcgactctgctgcagtagctagctgcagcctcctgcaggaggaccagaagcgcagaagccagccccaactcccagagtcccagttccgctttccggtgagatcgcggctggtccttctccagttctcctccctgtcctgccactgccaccgcaccgcacgactctgaacgctggcaatgcaataggcaacggcaaagcccggagacacgcttggttttggctctgtccgtgtccgtgcaatcatccatttgctgccttggcccccctccggcctccctgctgggccctgggcgcgcgtacgtcatcacgtgtcctgcctgcgcccccggagcgagcggcagttcttgtcgccacgcctctaatggcgcgcatgcatcgcgtcagtttcgatggcgatggcaccatggcgccgccctctttaccagttaccacccgcctccacacacacacacacacacacctctaatggcggtgagaacggctggtagtggtgcgcgcgttcgcaagtggtgaggatctctctggtttctgtgcttatcatctggagaagacctataccctcgtgtcccgaaacctgcaggtgtgcttgtcgctgccgttggcgagttttatccgaaaggcgattccattattgtgcgataatggaggagagttgcttagtgcttgcttactactactctggatgtctgaatcacgtccaaccagatcagcttccattctcattgtttgttcctccaaaagataagagagctagccagttgttactggcccattggcccgggaaccaacatggcaatgggccgtccacgtctggctacatgctggctgccgcccccatcgagcccgttagatggccgctgctgatatagatgtat

SEQ ID NO: 2277 - DNA, 1143 bp, Zea mays
  misc_feature (1)..(100): optimal_loci_300092_G1, chr9:13987260..13988402, Cluster 13
caatcacctaaatacctactacctactagccagcctgcttagctccaaaatccagatcggtttcggcagttcggcggtcgacaccctcgcaagtcgcaacgcatcgatcgatcccaatccggtcggcaagtacattaaccggccaaagctagctgacgagactcccagtcccgtctgagacgcttccaagttccaagcgctaacgcgcgtcaatctctcagacagccggctcacgacgccctggccagctctggtcgccatgagtcgcagcaggttctttgcttggacgctcgcggtcgccgtcgccgtcctcctgtggtcttattgcgccgccagagcagtctgctcctcctcctcgcgtcctctcggtacatacattccggcgactaagttaagtttggttttgggtttctagctaggcgacgacgtcgagtcgtcaactaacgtatgagatgtagctgctgcggacgatgggggcggcgcgagggacgacgagccagagccatgcgccgcgggcggtgccgcctcccgtggccagagggagatctggaacagcaggcggtctttgggtggcaggtcgtggtggtccccgccgtcgccgctgtggaactcgcccaggacgatgcccgtgcccccgccgccgcaggtgtgatgtcgagctgccgagctggccggctggactctgctgctgcgacctgcgactgcgaggagtttcccgtcgagtgtgttgttgtgcctgaatgcctggcctcttctttctggagaggtatgccgtatgcatgcttcaggattgcatacgtacgctgcttcagctgtccgtctacgaacgtactaccgacgtgtgtgatcgaagtatttgtgtgcctcgaagatttgttcgacgatcctcattgattccaataggtcaagagctttatacgacatctcttggaggaaatagattttgtatggttattagatacatattattctaacatctaactcgtatatgaacacaaattatgagtttaaatcacatataaattaaatatgaataaaaaacattatcagatgtaaaaaaagacaagaaatcaattctctctttaaaactagatataattaaaattgttgtcgcccatgacgcagagcgttgtattcttcgaa

SEQ ID NO: 2278 - DNA, 1036 bp, Zea mays
  misc_feature (1)..(100): optimal_loci_300327_G1, chr9:15330938..15331973, Cluster 13
  modified_base (523)..(523): a, c, g, or t
  misc_feature (523)..(622): n is a, c, g, or t
  modified_base (524)..(524): a, c, g, or t
  modified_base (525)..(525): a, c, g, or t
  modified_base (526)..(526): a, c, g, or t
  modified_base (527)..(527): a, c, g, or t
  modified_base (528)..(528): a, c, g, or t
  modified_base (529)..(529): a, c, g, or t
  modified_base (530)..(530): a, c, g, or t
  modified_base (531)..(531): a, c, g, or t
  modified_base (532)..(532): a, c, g, or t
  modified_base (533)..(533): a, c, g, or t
  modified_base (534)..(534): a, c, g, or t
  modified_base (535)..(535): a, c, g, or t
  modified_base (536)..(536): a, c, g, or t
  modified_base (537)..(537): a, c, g, or t
  modified_base (538)..(538): a, c, g, or t
  modified_base (539)..(539): a, c, g, or t
  modified_base (540)..(540): a, c, g, or t
  modified_base (541)..(541): a, c, g, or t
  modified_base (542)..(542): a, c, g, or t
  modified_base (543)..(543): a, c, g, or t
  modified_base (544)..(544): a, c, g, or t
  modified_base (545)..(545): a, c, g, or t
  modified_base (546)..(546): a, c, g, or t
  modified_base (547)..(547): a, c, g, or t
  modified_base (548)..(548): a, c, g, or t
  modified_base (549)..(549): a, c, g, or t
  modified_base (550)..(550): a, c, g, or t
  modified_base (551)..(551): a, c, g, or t
  modified_base (552)..(552): a, c, g, or t
  modified_base (553)..(553): a, c, g, or t
  modified_base (554)..(554): a, c, g, or t
  modified_base (555)..(555): a, c, g, or t
  modified_base (556)..(556): a, c, g, or t
  modified_base (557)..(557): a, c, g, or t
  modified_base (558)..(558): a, c, g, or t
  modified_base (559)..(559): a, c, g, or t
  modified_base (560)..(560): a, c, g, or t
  modified_base (561)..(561): a, c, g, or t
  modified_base (562)..(562): a, c, g, or t
  modified_base (563)..(563): a, c, g, or t
  modified_base (564)..(564): a, c, g, or t
  modified_base (565)..(565): a, c, g, or t
  modified_base (566)..(566): a, c, g, or t
  modified_base (567)..(567): a, c, g, or t
  modified_base (568)..(568): a, c, g, or t
  modified_base (569)..(569): a, c, g, or t
  modified_base (570)..(570): a, c, g, or t
  modified_base (571)..(571): a, c, g, or t
  modified_base (572)..(572): a, c, g, or t
  modified_base (573)..(573): a, c, g, or t
  modified_base (574)..(574): a, c, g, or t
  modified_base (575)..(575): a, c, g, or t
  modified_base (576)..(576): a, c, g, or t
  modified_base (577)..(577): a, c, g, or t
  modified_base (578)..(578): a, c, g, or t
  modified_base (579)..(579): a, c, g, or t
  modified_base (580)..(580): a, c, g, or t
  modified_base (581)..(581): a, c, g, or t
  modified_base (582)..(582): a, c, g, or t
  modified_base (583)..(583): a, c, g, or t
  modified_base (584)..(584): a, c, g, or t
  modified_base (585)..(585): a, c, g, or t
  modified_base (586)..(586): a, c, g, or t
  modified_base (587)..(587): a, c, g, or t
  modified_base (588)..(588): a, c, g, or t
  modified_base (589)..(589): a, c, g, or t
  modified_base (590)..(590): a, c, g, or t
  modified_base (591)..(591): a, c, g, or t
  modified_base (592)..(592): a, c, g, or t
  modified_base (593)..(593): a, c, g, or t
  modified_base (594)..(594): a, c, g, or t
  modified_base (595)..(595): a, c, g, or t
  modified_base (596)..(596): a, c, g, or t
  modified_base (597)..(597): a, c, g, or t
  modified_base (598)..(598): a, c, g, or t
  modified_base (599)..(599): a, c, g, or t
  modified_base (600)..(600): a, c, g, or t
  modified_base (601)..(601): a, c, g, or t
  modified_base (602)..(602): a, c, g, or t
  modified_base (603)..(603): a, c, g, or t
  modified_base (604)..(604): a, c, g, or t
  modified_base (605)..(605): a, c, g, or t
  modified_base (606)..(606): a, c, g, or t
  modified_base (607)..(607): a, c, g, or t
  modified_base (608)..(608): a, c, g, or t
  modified_base (609)..(609): a, c, g, or t
  modified_base (610)..(610): a, c, g, or t
  modified_base (611)..(611): a, c, g, or t
  modified_base (612)..(612): a, c, g, or t
  modified_base (613)..(613): a, c, g, or t
  modified_base (614)..(614): a, c, g, or t
  modified_base (615)..(615): a, c, g, or t
  modified_base (616)..(616): a, c, g, or t
  modified_base (617)..(617): a, c, g, or t
  modified_base (618)..(618): a, c, g, or t
  modified_base (619)..(619): a, c, g, or t
  modified_base (620)..(620): a, c, g, or t
  modified_base (621)..(621): a, c, g, or t
  modified_base (622)..(622): a, c, g, or t
acgacgcggccggacgaggccgagcgcgcggacggccggccgagccggggcacggggtcggttgaaccgtgtgggcgtcaagctcgccggcaggcgaacgcgcgtgcccccctcgccgctccggtcgcgagcggggttccgagcgttactgaacgctttctcttcacccggatgaaggcgatgcaccaccgacgcgtgcgcggttcttaccatccgcgatgcttaggaatgactctcgactgggtaacggaaacatcaatcgccgtagattgcgcttccacataagtgcgtcgtgagagcgactcctgcactgtgtcacctaggaatggcttggcagctcgaattcgtgtcttctgtctctccagtttctacgactgaattctggtcagtataactatatagtgttctcctatgacgccgttccacgtcatagagcctgctaatgtcgtcctgattctatagagcgagacctatggggtaggatttcatactatatttttatatacttttctgtgcgctgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatcagaaaaactgcgtctctggttctgatgatcgatcgcaatgtcgtgcctggtcttctctgacctacgcagggcgagggaagcctagtcggtctaggtcgctgcacctgcttttcggagggggggaaggggcagtgtatctatcggcgagggtatgaggagatggtattctagtatatcgtctattgagcagagggcgggcgtggtgtgaattcaagtttgacgctcggtcagccttcttcgcagggctcgaaacgtgcattagctcgcgcgttaggaagtagtagctcgctatcaacctgcagataggcggctcagtatctgttgagccggggaaattggacaagggctatcaaattcctcatcagctcaccgaggcctcacggagtcagggagttggagggctcttcgt

SEQ ID NO: 2279 - DNA, 1019 bp, Zea mays
  misc_feature (1)..(100): optimal_loci_300342_G1, chr9:15401098..15402116, Cluster 13
ctaaatgagatgaactagtaactaaggccgtgtttgattatcgactaaactggccacacccgagtcccgacaacatgaggcgacgccgcaccccgcgtgtgcagcgagcaaaagctgcgcaaaacttctgcgttcgcgagaagaggagaggaaaaacacgacgttgctgtcttggtggatgctgcacgccacatgttgccgcagccaggctctcggtcgcgaagcaaacggaggctgctgatctgatctcagcttgtgtggcgagttgtggcatgctgtggagtctgggctgaagacataaagcaagcatgccctaactaaaggtgtacgtgatttttcgcgtgcgggtcggagtcgcagggagcagatgctgggccagaggggcggccgggccagccggagctgcttgtgggaacggggacctggacgtggaggtggctgagtaggcgccgccgccggtgctgctttgaactatgaggacggtccgtgccgccggccgttctgtttgttgtgctcagggtctgtggcggaggcggccatggccatgagaagttctcgggcttttgagcaggggcagagcgagagacgaaggctgctgctgctgcttgatcgaaggctgctgcttgatcgagagtgggatctccggcatgtgcacgtgctatgatatccttccgatccccggcctggtgaccgttccatgcataactccggttctcagccatactactacacctttgcgtcttctgttatctagatacgttaggaaatctagagcatatgatgaggccatatgcaccggacgtggatagacacataccggctgattggtctaaaccctagacgagtgcacccacactcgccctatccccgaaaacggtatttttttggcgtgtgagtggatgtatcaaaagggtttttaaatgatttgtttttgcatccactcgttagatatataggcaatcaaacaaatgttagataaatttaatgtatgcagtgacgtatgacgagacgatgtaacc

SEQ ID NO: 2280 - DNA, 1286 bp, Zea mays
  misc_feature (1)..(100): optimal_loci_301440_G1, chr9:21817675..21818960, Cluster 13
cgagagacagcaagtcgcatctatcacatcgcagggcgggccggcggggcgtacgcgtacccccacgcgcgctcgtgcgcgcgccgcacgccgagtcggtcgccgccacctcgcaagtacacgcgtatcgtatatgcatggcgcgcgcgtcctgacctctacatacattcatccatcattatccaccacgaactgattagataaatgaagccatccccaagaccccaactaatcgcgcgactaatcatgcgtctctctgctcgtttctgtcctcaagcttggaggagttgagccatggacgtacggcggaagcaagcagagggagacgcatcgcgcgggtcacatggttgattggagtttggagctagggaggcgggggcagggcaacctgtccttgtgaaggttcctcttgtcgttgcaggcgaccaggctggaacgaacaggaccatgcatggattcatccatccatggcgagagcgggcgaactatatacgatccatcctaggctcctaggctaggccggtggttggcgcatcttcagggagacaccgttgatccacttgtttcctgaccctctttatgcagggttgttcagtctcactattaatccatatatgtggatcgaatgttattgagtaggtttaaatctatcacatttcaaaattcatcgcaatccattccattacacttcaattgacatagaattagacaatttgattggttacccgcaccattccatactgaatcatcacgtgcattgactttggctaaacgtctatttgtttgtctgtatgtgaaaaactgtggttgcatgagtggatacaaaataagtcgttctgatgctatttacctgcatgtgcacataagctagaaatggtccggcgcagaataaccgaacgggttaatctgaagaaacgtagcaataatgtctcctcgtcaaagggtagtattattgcgggggtttcccgttcttacgtcaccttgaatgatttctcccgtctatatgcaaggcaaaagtgccgccttaattaatttcgaaaaaagggagtaaaaggtaggttacgccgagtaataaatgtgtgtggggaaaaaatgtcggcagctcaaaaactttgcagtagtgacgaaacgagtgacccttgtcactcacatgggcatgcagttgcgatagccagaggacatacacagtcatggatgggcatgatcatacacagtgcacaaccactcacgaagacgcctagctagaggacacagtccaggactatatatctacagggcagtggaac

SEQ ID NO: 2281 - DNA, 1035 bp, Zea mays
  misc_feature (1)..(100): optimal_loci_301442_G1, chr9:21820027..21821061, Cluster 13
agtggaaaaaaaacgggtttcatggttgatctttgaccggtaaaaacaattgacggataaatgcaacggacggaacaaggacaaagaagcggcttgcgcgggctgtaaagtttgcggtggttgcaattaactggaatggggctcaggtgggtgcagcccataaataaagcaggaggtggcctcgtgttggttctattaggcccattagtttctccccccgcagatttgggctgcggttggagttgttctgccacgatagccagtttgaaagaagaaaagggctatttaaattggtatacctttagatttgtactgtactcgtgatttttttaaactcagttttgtctttctgctgccattgggaaaaaaaattaaaaaaaaactactgttgttgtggccgttctttacttctttgctctcctgaaaatcaagacgaaagaaacgacacacaaggcaacgaaaaaggagttatgtacatggaagccgcatccgtgtccaccggatccgccgggacgaaccgtccccgtcgcccacgacacgaaccgtcgtcgtcgcggctgccggccggcccgcgccctccccgacatgtcacgcgccgcgcaacctgcagctgaatcggagactgcgctgccgctgcatgcgcctgatgaagaatctgggatagatgcgatgcatgcacaagtggagtagagatggttatcaggtagcgacgatgggtctccgtggctcttgattacggcttgcactgtgtacagtacaggttgggataccataccatgtagcagcagatgcaagtcagccagagaatgtcatgccccatgctggccgtagctttttacctgtcccatctgcactgcccactgcatatagacgcccgcacacgatctctgcgggccagcagcagcagcagcagcacgagcacgtaccgcagcagcgcagcttcacgcacctgccactggttctctggtagaactgtctttcacgggctcgacatgaccgcgtctgtatctccagttgcacactgcgatgctagct

SEQ ID NO: 2282 - DNA, 1138 bp, Zea mays
  misc_feature (1)..(100): optimal_loci_301874_G1, chr9:24366706..24367843, Cluster 13
tatgctttcgagcagcttcaaaactcctcccagaagtggtgaatatttggaatcgtggagcttaaaccctgtcaaaatgataggatgagctcgtggagaaagaaggtgcgggggttgacgactacatttatatatagctaggtattaatagaataataatagctgcgtcattgcagattgttagcaatgacacggaggattatcacactacttgcattggctgccctcaacaaaaggctacaagttccagtagcggacgtgcactttgcaaaaactgaaggtacttgtacgtgttgtacgtaatactctcacctgatgacaacgtacgcccaacattcctgtccgggccggtcgatcttgttcgagctgaagacagtcgcagggcaactctcctttggcaggacgtacgcgcgtgcatgcacgcatgttacactgcaatgcatgcacggctagctagcacaccatggacgaacgaacacagcatagcagagccaagcaaccgtcgtcgatggcgacgatgaccgcgcgcctgcctgccagaggagagctgcctacaactgtcttcagctagctgcatcatgctagtcccgcggtcgtcgtcatcgtcgttagaaaaccagctagatatataggtagctgctgctctcagttccatggacgatggatctagctagcttagccagcaccgtacctcttcctagctagctcctctgcttagacctcgcgaagtgttggcgctcctcttatagagtcagtccacgacgacgaccgaggaacggagtagcccgtcgatcagcaggggcgcgtgtggcagcctggcaggcgggcggcggtggcatatgccgtgctgctgctgctgctgctgcaggatgcatgggcctaccgatggatgcatgcgcatgatgcgctgcgactttttaggcccatggttgtaccatggatatccctcctccgggattcctccgcgcccatcaactttatcctattccccggccacgatgaggcttccgtcgacatggagaatcccggggccggccgatcgctggtctgtgtccagccactgtcgtccaccgggccgggcgccgatcggatggctttgctacctgctacgtgccgtgagtcgctcgtcgcttgtcaa

SEQ ID NO: 2283 - DNA, 1153 bp, Zea mays
  misc_feature (1)..(100): optimal_loci_30421_G1, chr1:187259719..187260871, Cluster 13
atttttagagcctgcccctagctggagtagatggtattttaccgtaaccaaaacgagtaagtggaggtttacccgacactttgactcggagagcaggaccactgctcctaatcccaaggaagcccgatgcaaagcaagcaagcaagcgcacgggcggcaccgcttccaacgcagcattccttcccaccaccacctcccgaacgaacgaacaagcaccgccgcggacgatgagagcctgctggtgtgaaaagcgggccgcccgccttttagcagcaaactacgaggcacgcgggcaggcaaattcctagaacgaaccagaggaaggagcggaagccccttgcctgccggctgccgcgcgcgacggggcagagcagaacaggcgtcgtctccgcgcacgcgcgtgcgccggccatgttgttcgccgtctcgtcgctgcatctgcgtgcgcgcgcgtaccgtacgtccccgcgacacgatcgagcctcgctgccttcgggatgggggggagaccccggcgggcggccgggggagcagggcccgaccgggcgccgctcgtcccgaggcgggtgccggcgcaagccccggcctgcgcctccggcttgtcgccgcgcgcggcgcacgaagcagatcgcacacacgaaacaaacgcggcgcgcatgcggggggtattggggtaagatacggattccggagcaggtcgatggatcaaccatgtaatctctggatggcaaaaggctgtggattttgtcatttgtttagtgctgcatgcgtgcgtgcgtgtgttgccttggctcggcagcaggcagtcggcagctccgttcccgttttgcatgcgcgcttgccgcctgttgtcacttgctttcagccgtttctgggctgcttcgcggcccgtggcctcggcaaccaagcacgtgtgggcacgcgcatgcagccatgcatgcaggggagttactcttgtttggcaccagctagctagctagtactagccaacgcccacaagggattgccggaatactttccaggtctctaatatataggtcaacttatgaagttgtcttaagttacctttttttctaacgtttaattgactttttatacatataaaaaataatatttactatgtcacaagattaacatagttagatataacatg

SEQ ID NO: 2284 - DNA, 1183 bp, Zea mays
  misc_feature (1)..(100): optimal_loci_313135_G1, chr9:96693645..96694827, Cluster 13
tgcatgatcatcttttacagcagtacaactccataaatcattgttagaacctatattcaagtagctagctatatgtccagtacataaatatactagttagatctcggtcaattacttttgaattagccgtgatagttagtaattaaatcatgtgtgaatagtggaagccagccagcaagagcgagcttcccacgtagatgatgattacgatatacggttccgagtcacgcagacaaagcgcaaaaggggatctatcgatggaggagaaaggaatagctactagctagctagacactgtggttgccgtgatgatacgaggtggcgtgccacgccctcactaatcagattcccacgcgctaacccaacaaaatcatcccccgcctccccggcccgcaccttttttttaccgctccggccgggtgaaacagccaatccatcatcagggtcgtccggccgatcctgttagttaccagatagtagtacgcactagctacgcacgccgccgtatatatacatataactgcagactctgaatgggacggacgtatagtatgagctttgcttgcttgctagcctagtcgctgtaatcatggcgacgacgtgcaggcagggcacacgcagcagaaaggagacacccctcgcatgtttcgctcctgcccggcaagagcggccggccgccgcggccttgtgtagcccgcccgccccgtgcgtgttcggcggccaggttccagcccctgcacatgcgtgcagacagttattagtatacggcacaagagtacgcgtagctttctcccacgccgaaatacgcggaatcatggccacacccgtccccgcccgcgcgacgccatcatggatcccagtccttcccctccccggcaggcgcgcgtcaaggccctccgtgttctttttactatcaaaaaaataaaaacattcctgcgcattattgtaaaaagaggttaaaaaacaatatcgaacgtcaatgaggacacaattgagaatgttatacatctatcatgttttgcattttctataaaaaactttaaaagttgagtcatgacagctgccatactaaccactacttgagatggagaatgaaactagcctttgccattttggcaaagtacgtcagacgactctagatcaatgtgaaagaatcgagttgtccaaaaagacagtgaattat

SEQ ID NO: 2285 - DNA, 1120 bp, Zea mays
  misc_feature (1)..(100): optimal_loci_315868_G1, chr9:111083686..111084805, Cluster 13
tattattatacatctttaagacatttatacacttctctaatttgctctaggttcaagtacgacgcgctgcagcccgcccggcccagcgttgcagcgacgacgacgccccgctgcggacctgcggtcccggccgtccgtccgtcggtatgcgccagcgccacacgcacctcacctcagcacagcaacgtcagtccgatccgtcctgcggcggtctccgggccggcctaactttgacacggctagctagccggctgaatgctgattgttgcctaccaccacacacagccgctaaatatctctactctctggagcttcgtcgtgcgtcctttgcgcgtacgtacatacgtacgtcgaccccccgtccgtacgatcgagtcaccgcacccgccgccgccgtcgaccggcgatttttatccactactacatgccaagccaaggtttcgtccttgagtcagtacaaggctaggatctaccgccagctgcgcgcgccctctagcttcttccctccccacggccatcggtttcagtcacgctcgcgctcgcatgcagtccaagcaacgctacatctcgacccggccggtctgctctgcggaagcttcacatgagcttccgaggaggcacgccgcacgccgttcctcccgccgtgttttctctctttcttcttctccgtcgagcatccgagacagacaggcatatgcaggcggatggatacgttatttctcggcgcgcgtataaatttttccgtgcgtggttaatgtatcatatatatatatagcacgtgccatatcggtcgatagaaactcgtcgcgtcgtatcgatcgctgccgtgacgacccgtgtacgttgttcaagtgttcaaagtggtcctactaaaccctaccctgcttgttgctcaagcttcaaagatctctatagccgtttaattagttcctttcgttcgtcgtcaggtgatgctactagctgccaccagctagttcttggaaatgtcctccacaccccctcttcgccgcatataccgatcgacgagtctggaagttccagctctcgacgacgaagtcacctcgctagctcggcagatcatcatcagttctaaatgcatgttccaggggacgacgacgag

SEQ ID NO: 2286 - DNA, 1058 bp, Zea mays
  misc_feature (1)..(100): optimal_loci_315871_G1, chr9:111086372..111087429, Cluster 13
atagacatatatggatacacgcacgcatcccatgcattcgcgtttcacgctcatctgctagtagactagcagttgactgccggggccggcgcggcggtgaaaaatccaagggtctcctccctctcctacctacggcacaggcacagcattccccatcgaggcaaacccatatctatatccatggtcggtcatgtagtagcttcgtggaaaatgggcgacggtcccgatggccgcaagcagtctacgtacacgccggcccgttggtctagctgccgcaagcaagcgcggtcggtcaggaaaatcggtcgcgcaattgtgtggctttctttcaaacttcactggccgctttgaaaaggaggcgcgcgcgcgcgcggaactagtggcaagactttggagctgcacgtcgtcaacttgtttggtttgtttagttggggccggagaggattatttccgtttcctccatctcagatcatctcatctcacatgcatgcatgtaggagtgccatgcatcaactgactgattagctagctaaacaatatttatacaacgagagagtactcaattaagtaggacatgagtccatcgtcacatcacgagagccttttcgtttcggacggcgacaggactttctacgtacgcacgtactagctggagctggagtagtggctcgtgatagagcgagcactcgagtataccactagacgaaccggccgccgcacgtttctcttcttcgccgtacgtgtgtcttcgaatccaaggcacggagtaatatatatatatatattacagtggcatgtgggtgcatgcggtgtgtgacactgcctctactagcctggtgctcggtagggcagggcttgagagcgaaattcgtttgctcatcatccctgcctgcagtcatggaatagctcgcacacttcgtatttgacatttgcaacgccgaactcgtgcaaattcactggctccgtaccttgtatctggtaccatcttttgcacggttccagataagcagccttctttccagattcgcagcaatccccactttgtagttttttgttct

SEQ ID NO: 2287 - DNA, 1324 bp, Zea mays
  misc_feature (1)..(100): optimal_loci_315880_G1, chr9:111097991..111099314, Cluster 13
ttaattcaagggccgccggagctagcaaccgtcctcgctctggctactactcctctccatcctatccctccccgtacatggcaatctgcatcgccatatgcatgcaatgcaatacatgcaagcggaccaccggcagatgacaagattggtctcgtttgcgtgcatgcatatgcatgcatgatgcaccggtcggtcgacacggtactggaagtcaggaaccgggcatgccatgcgggaggcaagcatggttggccgcggcgcgcccgagagatctgtttgttcagtctctctgagtgagagacgacagtttccaacttgccgttctcggacacgcaaacacagaacggttgcgtgcccgtgccggcgcccagtccggccgggaagaccaataagctagggcggccaccggcgccatcagaatcacatcagttccaggcttccagcgacctgctgcctactggctactgcacagtgcgcactccagcagtacttccgtatggcacggcctcgtcgtccatgtggatgcatgccgcgacggtgcagcgccattgccggcacgaaacgtgctcaggcgcgcgcccagccggtggtggggctggggcgtttgcgcgggaccaaagggccatccaccagcgccggccggagtcgtggtggggggcgcatcccacatggcccggtcactcatgttgtcatgggctcatctcatgcatgcatggacgcagcacgcgacaggcctctgacacggaggcgctcgcgcggccgctctttgcggcgtttggcgaggctgaagggggaaaggcctgcgctgcgaggatcgtcgaccacccccgtactacgtcctgagtcctgactccttttttttttggtggtcacgtcgggcatagtgcacggttggcagcgacactggtacggtggtgtggcagtaggcggacggtagccttctccagcgcgcaggctcggcagaaatgacctcaggaggatcgggttcggtccatggatcgacggcagggtcatacaactacgtacgtgcagaggaccgtatttgtttgtcattggttcacacgtcggcaggagcccggcacatgaaggcctgctgcacacggcaccacaccacctctgcgggcgtatcccagttccccgagagagaaaaatctttggacgtactaccaaagaaacggacagccgacggggcattggggcacgcgccggttgcgcgccttttgcccgtgcacgtcctagctatcgtgtctcctgtcccggaccgggagggggagagcagcacaccacgtggtgccatcatacgcctgcctagatcccacgatcc

SEQ ID NO: 2288 - DNA, 1186 bp, Zea mays
  misc_feature (1)..(100): optimal_loci_320417_G1, chr9:135379623..135380808, Cluster 13
tatataaatataataagtttaacatgttgtacattagttgtctttagctttagatggcttaggagaggcccaaaataagtatggattaaaagtcattttcaaaatttgaatttggataagtttgagaggttttcaagacatcggacacctatgtttcagggtcgtcggaggatagttgatttgtccaatggctccacatagatagcccgagagagcttaatcatcgaaccctttgaataatagagcgttggaccagtgaggtgggttcaacattctgtgagttccagagcatgtcagactattcctacaacgagcatcgagaccatatggcacaactatttaagttagagttccttttataggatcgtcggaccttatgaacgatggccatgtcaggccaacaagttggatctgacaacctccatttagtgacaagagagggttttgcgggtgtcggattggcctgatggtgttcagaccatacactcatgataataattgaaacaactagctagtcctgacacagtggtaccacaattgtcgtagtgtcttatcggatcggcaatatggtatgatgtgtgagcgtcggccgtcggatggtttggtccagagttctataacaactagttagccagttagggtctataagtatcacaccggccagataaattaagtcatttccattaatctaaagtgcaccacttagagctcctttggtgacaagaaaattgaggggttgaaggagaaataaactaatcgttttcgttttcgtagcttttgtttacggtttcggttcacatcgttttcgttttacgtggcccatgaacacctgaccagtcgtacgatagctccgtggcgtgcgaggggaaagaaccaacgaaaccgtgtccaaacaaagtcgccagcaacgcgtctttcttttgtccaactgcaactcagccagcaggtcgacgtcgatttgaaatgcccgatcgagaggatgatcgccgtcatgtacgtacacgccaaaaactaagtagtgtggcagctggcggcccccggtctcggtctcgctctctctgctgtcagacctagctttcatgcatggaattgttagagcgacgaggacggcatgcatggaagaatgtcggtccgattcgacgtctagtcatatctcgcgctcgtagctgttgtccagtttaacgcg

SEQ ID NO: 2289 - DNA, 1292 bp, Zea mays
  misc_feature (1)..(100): optimal_loci_320538_G1, chr9:135860439..135861730, Cluster 13
tttgaatacctttcccttttccgcgtctcccctacccagctttacccccatcgccattgaatgccttatcacgtgggcgccgccgggcgccgaggagacgtcaccgtcgtccccggccgctttattattacagccgagccgagccgagccccggccgcgcgcgccagcctttccccagttcccaccccccggccccgccgagcccacgttcgcgtcgccgtcgtccgcttccgttgctctgctgccttttccttttacgccgtcgtcgcgttccgttccgtcgcccatcgctgcatatttgttcgcttcccgcgtctcccgtttcccaggccagctggtgcatggatgtgtacgacacgacgatccgtggccgctacaggagatcgatgggggcgacgagtggccggacacatacgaacggagatgtacgtatgtgtgtgtggtcgtacgtgcagtgcaaggtgcaacgtacgcacgacggcgcagcatacgttatttgcatcagtggtactcctccgtccgggggtgccgggcacaggatcaggcagggcaatatatatgcacgcatcacagggcatccagtagctcgatggatccatctgttctgtgtacgcgcaaaggcccgctgaaagcacggttcgctcgttggtaggtaggtactactggtaaggcaccgaacggcgtgctatatatcgggccacgttaaactgagcttcatgtgtcttgcagacagcagattagacatggctttacgagatgcatggcagccacccagacagccatcaggctacgttgagctggtcttcatgtctagccgatcgacggtctaaacatgcatgatattacggggggtcgttttttgtgccaagtctcagcctcaaaagtacgagcccgaatcagcctagaatctgcaaactttataacccctcacctcattaataaatcacacataaaaaaaataaaatggttcgctcgtctattaatcaggttacttgctcggaaagcatgcatgcatgcctgcctgcaccttaattttggggctctggatcaagttgtcatttctccgaccacggatcggacggagccacacggaccacgtgacgtaacgtaaccttggggccagctagttgtagctgtagctcggcggcagttccatatcaatcaaccagcgcgtggttagttaatttactcgttcagcgagcgtgcgcaacaagcaaaatccattcgcgtgaaaaaaaaatcgtaggtggctgtcgcgcccgtgttgttgctgtttggatggggggtcaccc

SEQ ID NO: 2290 - DNA, 1300 bp, Zea mays
  misc_feature (1)..(100): optimal_loci_320540_G1, chr9:135865618..135866917, Cluster 13
ctcgctagtcacgcggatggatgcgttgcatcagcgtggagggtcatcatggcaatgcagctgctgagatgaggttggtgggcgacaggcgacgcgacaccgtgcatgggaaggggaagccgctgctgatcgaattcgtacgtaccgtagtacgctgagaaattaatggccgcgcatgcgatgcgatgcgattgcgtgtccagcggccgcagaccgcggctgggtcgtcggcgcggccccgattgacttgtgccgcgggcgggccgggacatgcatgccagcaggcgcctgcctgcagccatgatggtgctcacctcacctgagactctgagactgagacagacgagagggaatcgaaccgagctgctggtctgatcgatcgcttctctctcgatccgggctagcatcgaatgccctcacgccgtcgctgtgttgttgctagcttgcgttggttggacacaagcggggcgatgcagccgtggacagtggactgaatgcaagcgccgtgcgtgcagtgcgtgtccgattccgatgaggccggcccgccgccggcaccgtggtaaagccggcacagggtaccagcacaagggcacaggaaaaggcgtactacgtacgggctgtgggcgtacagtcacctcactgtacgcactacggcgtccgccaggcgccagcggcagtacggccggcgcgtccaatgaacggccccctggcccgcctgccgggtgccggccgcgccggcggcccctgtattacgtgcaccggccgcatggcatgccaatgcaaggcttacatttcgatccatcttatcttattctatatgttccacgcatgcaaatgcaaggcttacatttcgttgcactcccttgtgacgctcacgtacgttcttttgttccgtgaagcgcagcgaccggccgggaaagcaacagctacccaagctagcaaagcttttgcgacgacgtacgtacccgacacccatcggcgcacctgcatccatatccatggatgcaaatatgatgcccactggccactggtggcagtgcactagatagagtacagctcgccgagcacacatcacggtacgtgcctgcgcgcggtcactggcgagatgcatgcatgcgaacggcggcagtgcatgttctcgcccgggcctccattggtctagaatagatgacatagacctttggatggatcgcatgtgttggaagcacgctggttagtgttttttttttctatcgggcggctcgtcctgctagtagtgctgccgcgaaagccaagttccatcgccccaccaccagtagat

SEQ ID NO: 2291 - DNA, 1206 bp, Zea mays
  misc_feature (1)..(100): optimal_loci_326362_G1, chr10:9892721..9893926, Cluster 13
agaacctaaaaaaaaaagacacaaacacaaaaacccactgtcagctcagctctcttctcattagaacgtctgcttggtgttgagaatagcagcatcgtctcttccacaaatcgattatgtgattagaagaaagtcatggaggcgacggcgctgagcttgggcaaggcagtgctgggcggagcgctcagctatgccaagtccaaggccgcagaggaggtcgcactgcagctcggcgtcgaggacgacgtgaccttcatcacggacgagctgcagatgatgcagtccttcctgatgacagccgatgaggagcgaagccagaccaaggtggtcacgacctgggtgacgcaggtccgcgacctggcctacaacgtggaggacagtctcatggatttcggcatcgacgttgggaagaagccgatttgggggtgcatcccccgtagctcgtgcgatcgacgtcgcatagccaaggaggtgaagaagctaaggtccaaggtcgaggatgtgagcaacaggaacctgcgctaccgcctcatcaaggatggctcaagatccaagcctgccggtgcggcggagcaaactactgcctctgatggtgtagagcgtcaaaaaccaaaggcagacctgctgcagctggtcactagcaaggaggtcgacctgagggtcgtggctgtgtgtggaacaaccggtgatcgtgggaagacggccgccatccatgaggtctatgatcacccaagtgtggcatcaaagtatggactcagggcatgggttaggctgatccaccctttcaatccagaagagtttcttcgtagcatggtacggcaattcttggagaatttccatgataagcctcaaggtggagaagaagcaacaaatgttggggctactgtccttctgaagatggacaagatgaaccaaagtgatttagtgcacacgtttactacacagttgagtagcaatagctatctaattgtaatagatgacctatgcacagtagaagagtggcaacgcatcagaaggttcttccctgacaacaagaaagagagcagaatcatagtgtccactcagcaagttgaggttgcaggcttatgtacagagcaaccataccaaatgtccgagtttaagcagctcccgtatgaccaaacactttatctgttccataggaaggtaagtctccatctaacaattccttccggttattgttctgtt

SEQ ID NO: 2292 - DNA, 1329 bp, Zea mays
  misc_feature (1)..(100): optimal_loci_336589_G1, chr10:75061468..75062796, Cluster 13
tcttgcttaccgccgctggaacccgtgcctaacatgatcatgtcttttttctaaaagttgtaattgcttgatcctatggagacttcgagtgtggtgtggttggatgagagcacgagaggacatgacgcacgccacatgctttcctaattcgcctttggagtttattagtagctactagctgggttaattagccgtacgttagcccatggcgcctcctcccttgctctcttgtagccaagctagctgtgggaacaagtgccactgccttccaatggcacttgggattgggagtcggaaccagtgatggacgatggtgtgatgtgctacaacgacgcaacacaacaacacaatagaaaaaacacactgtcgtccagaacttgatttggccgcataatgagtgtatctataaaacgtttttaaaacatgtacttgctgttgacaagacagcactgtcacacgatcgagaacgcattatatgtatacatgggtgacgaaatcatttgcaggaagcaaggagcttattagttctgggaatagtttgaatggtgatcaaggcccaatatatgccaactaggcaagttgcatcgcactcctacgctgatgtctaaaccgcggcagctagcagcggctttgcctttactcatcgagctatatatatatagtgaagatcaccatccgatctgctcattcccacgagctgattttatatatatacgcatgtacatatgacatgacatatgagcaaaagatgccattcaaaagttggcgatgagcctccagaagaaggagatcgatgtgatgtcaatttaaggggagctactaggcgaattcgcgcgcttttcgccatgttgcctaccagatcactttaatttttggttgttcacttcagttaaagaagaccatgactagctagctactggtccggccggctctcctatagtatagaaagaagggcaaagagaactctgagatgtgttcgatggatgatgcaacagctagcatgcagcagctagtttacaatattatccaagcgatgcatgcacgccgaatgatcgatccagcggcaggaaaggggaagaggaagggaagtaattaacaagctacgtacgtacagcggccatgtatgtgtcctgctcctgcagcacgcagctgggtggtgaactcagcaagcaacgcaaaaagccagcacatgatgcagaagctctagggaggtttaatttgttaaagaaacccaggcaggcaggcatggggggggttttgcttgcccccccccccccccccccccccccgcgcgacggccaatggcggggcagccaagtgctctatcgg

SEQ ID NO: 2293 - DNA, 1320 bp, Zea mays
  misc_feature (1)..(100): optimal_loci_34010_G1, chr1:207370709..207372028, Cluster 13
gcagtgatatcttccctagattattatggttgtgtccagggatcctatatggtgtggattttatcttcggattaattattcatggttaccaaattagctcttaagttttcgagacttagagagaaaaattcaagcattggaaaaataaaaacaaaaatagaacgtcttacgaaaactctagacggcaccatcgcaagcttgacatgtcacgtcacagtagacatgtcacggacgtcacggtccgcatgtttcaggtgcacaccctcaagcgaccatattcgcaggactccgcttagcctctctcggcgcgtcgcggttccgccttgggcttctcgaacggcgcacacccctggcactcggagtggcagatggaagcgaagcaccgatggagtggaatggagccggtggccggtgggagagaaggagaaggacccccgtgaccgtgaggccgtgagctagccggtgaccacagaccgacctcggccgcgtgggcggtccgttaggcgttgggatccgggccggcggccggatttggaaaagacaaattcccctgcgcctcgcggggccggccgcctgctgctggctgccggcgcctgcgcctgcgcctgcgcgcggccccgccccagtctcgtattcctcgccccagcccctcctagtcctagcgtgcagaggctctctggatgccactggcaggcgcaggcagccggcgtgctggcggcctccggctgggctgggctgggactgcgagcgcacatcgcatcatcgcagtcgcccgtgccgtgctcgtcgtaccgggggttcgcggttggcctgtggcctgtgcctgcgacagcggacagcgactcagcgagtcagtcgccgtcgcccttccctttcgggctgaagagagagagagggggaagctccgtacagcgcgcacggctcgagacggacacccataggtagaggacgcgccatcattattggggccaggactttctctgcaccctccttaaaatcgctttaaacgccttcccagatgggacgacgacgaggaccagatgcagatgcgtcgtccatcggtcacgacatgatgcgcgtccggtccggccggcgtctcactgctgcttgcctgcgttgcgtgcacaggaacgttacgtacatgaaggtaactacgctggttgttacacgtcctgaattctcctcccttggaagaaggctgcacgcctgcacagggacatgatgcatgtcgctcacatgcatgcagccgcaaccaaacgctcctcctctccatggaccagaccatgcatagtacgttacacgtagcagtactagtaccat

SEQ ID NO: 2294 - DNA, 1372 bp, Zea mays
  misc_feature (1)..(100): optimal_loci_343315_G1, chr10:112317855..112319226, Cluster 13
gaatgacatgatttcatacatatgagttcgatcttcgcttggagtcttcatgctcaggtaagtcaaatcatctgtcttcttctcctttgccattatctttttttcaataaaagaaaaggtgatttcgaaccaattcgaaaacattggtgacgcgttatatttgtccgagatcaaatcgcgtcaacaggacaaattcgtattcgaacgtacttctttggctagtaaaaaatggctgaccggcggtacgacgacgtcttcatatgcatgcatgcatggccggtttgtcgatcgtgggcggcgcgcatgtgaaccggccggccgttgggtcgtcgatgcggccatgcaggtgcaggcggggcggccggcagtacgtccgaccaggcaccagggccacacgacgtccgcccggccgcccgcctgtcgtcgtcacaggccggcatgcatgccatgcatcgtcgaccgtcgtcaacgaggccgcacagagcaaggaaggcgcgaacgaatgcgtgacgcgctacaccgaccacggcaacgacgacgacgtaggacgcatgcagctcgaggcacattaaacaagccgccacacaaggaacgtgcgtgcgtgctcgcatgcatgcatgcatgcttgttgggcaccgtcaagggcgtacccgccataacgaacctcgctcggccacggccaaatgggcagcagcgtgcagtgggtgggtgcttgcttcgtcgtgggctcgtggcgggtccagcagcagctgcaggtgcaagcaaccgccgccattactagctatgactacgagtctacgatgacgatcgcgagcaagggtgcatgcatgcaggggccggggatgctcatgtctgctgggactgctgggagcagcgtccagacacggatcgttttccggtacgccaggggctttaaattcccccggccggaggagtagttgcgtggatcgatctgccggcacatgacgagaggatcatacgatatcgtccaccggtatatatacggtgtggatcagcagccatgcatgccagagatgcagcatgcaggcttgtgcccttgtccggtcggcggctgggcctggccggccgcgagatcttcgccatcacacacacgcatctcacgatccactacaggctcgtgtcacttgtcagtgaaagaaatcgtcgatcgacaatccgtcgtcgtctcaatcgccgccgtcgtctcaatcgccgccgtcgtcgtcgttccgtctgatatgtacgtatccaacctgatgcaactgccaaaactgtttcgtgatccgccggttgctcagctctccatgtatatatcgatgtattcatgatatatttggtttactgtctaacttgacacactttgtataatttt

SEQ ID NO: 2295 - DNA, 1136 bp, Zea mays
  misc_feature (1)..(100): optimal_loci_344386_G1, chr10:117466174..117467309, Cluster 13
gctagattcctgcagcggagcaacaggctctgtcccgtcgagaaagaacaggacggccgcgcgcatgtcggtccacgccacgcatgtgttgtttcctcactggtcaaaatacatgcatgcttgttttttttttcttgcccccggacgcgacaagcgctgcttcctcgccctgccgatgcccttcttggcgtccatccagcgtgtaacgctactgttgcctagctagaatccagcaaaagtgtcaccgcgcgcgcgcaaaaaaaaaagcagctttgcgcactactatagctagcactcgtaacgatcattactggtgtccaacaagacacctgctgaacggaacgccgacgtgcaggtgcagtgcgcccgggagaggtcagaggacggagcatgacctcccgtcgccgtccagccctcctccgggttggtttggggaataatcatcatagcgcggcgacggcgacagggggggcaggcgccgcaccaccgacgcctttctcctcgcgaagctaactagacgacgacggcggatccgcggagccggcgccggccgaagcagccaaccgccggcggagaatgatgatgagttgatgacacgaaccgtctcgacgccgacgcacgccatgcatccatccagcgtccagccagccagcgttccagcttccagcgatgggctccccttccggcggggccagccagggtcccctccctgagaccctgacgaggaatgggcggcggatgcgtgaacggagtgactgcctgacggggtgagggcgagcgcggccgtcaccaacaggcaacagtacttgacgcccgagtgcctggcgggcgggtcggtcgacgacgccgcacctactagcctaccactactgctactactactcgagtactgctggtggctcgtagcggtagtgcggcgacaccgctttcgagtcggccattgcttcccccttctgctgttttttgctgtacaacgagagagatgggtaacagccggaggatggaggagtcattggcgtgtcttgacgttccagccgctctcatctcatctcatttccctctgcaaagtcggctgaagcaaaaaaaaaaaggtttatataaaaaaatatatagttagataaatatatacaagttta

SEQ ID NO: 2296 - DNA, 1099 bp, Zea mays
  misc_feature (1)..(100): optimal_loci_345445_G1, chr10:123874579..123875677, Cluster 13
gtccatggcgaggaggcgcgcagacgcgacaaggaggggtttagcgtgtgggttggttggggcattgggtggtggcggtggcaatgcaaaagtaggtcggcaacactagtatttaaataactaaaaacctctatggtatttaaataacacttgtattttgataactctacctttctctagtgaaaatatacttacgccacacacatatcttttgttagaaaaatgtggctgttgaagaggaggtggccaggtggaggggcaaaacaaaaattttgttgttatggttaaattaacaaaggaggactcagatttaaagtgcacacgtgctcacccaaggaacgtgagcacatgaatatgatatgttctctttaagagatcgtcgcaggctctacttcttcggcaccaaggtggcaatcaccacgatgtgtgggttggtttggttggttgggacgttaggtggtgacggtggtaaccaaaagtcgggtatcaagcaccgcatccggcaacattggtaattacataactcggtctctatggtatataaataacactggtatttataactcgacctttctctagcatctaatattataatgcaacaatttctatggtcatcagtcgtacgtctcctcctaacctttctctactattataatgcaacaatttcgacgattaacaatcgtgtgtcgtgcgtctgctcccgcattgaaacctttcgtacgttgttaaaaccaccctgcatcatccagctccagagctccaccaaaattggcaaccaacgcccgctccgcatgccacgagcacgccatacacatcaaagccacagcctctaaggccaagcccttcttctccctcctcccctccgcacgtcgtttgctctgcatgcgtcctcgctgccccctaccgctttctcccccaccagtggttcattaacatccgcccactccctcgtgcgctctctctctctctctctctcttcctgtcgtaaacctgctagggcaaagacgtgggtggtattggcagggttcacgattgggctgtcagatgggccttgagccttggcctggccaagcattacttgaacctctggacatctttg

SEQ ID NO: 2297 - DNA, 1267 bp, Zea mays
  misc_feature (1)..(100): optimal_loci_3460_G1, chr1:17890202..17891468, Cluster 13
gtcagtgagtagtctgcttttagctagatattagtgagccctgttggtgttggcagtagtacgtgtacgtgtactgcctcttggttctatctaattaattaattaaccctgtgcattttggctgttgtggtcactggggatggcgtacagatatggcaaagccgccctcgctctcaattggatcggtactagtattattatgtttgttcagctcgcaacgagtgtactctctacttgcattgcatgcagtgccgtacgtgtgcctgtcaaccctaccctgcgtgtgagtgataagcacgggcgtttcgttcgtaaatgctacgctggttggtgactgataacgcctctctctcggtggtcaaaaaggtcgttcgaccgaagaaacacgcgcctcttttggtgatgccagcaaacttgatgccgcgctaaaagtctagcacacgtttcaaactttcttgtcagatatcgtcatttatttattaccatcattatatatacgtgtgaccgtgtgtgtacaatttcacttcaccgatctgatactttcaatcagttggcagggctccccccgagtccctggaaaccaatggcaaaccggtgattcggcatcgtttccaagccctgtttatacgggagaccctcggacccagaccgaaagcgacacggcaccgccgcagccgcaggaggacacgtccgtgcggcccgccgtcagattccgcgggcccgaccgagcgggcccacgacacgcatcgcggggcagcgggcacttgcgcccgcgggcccaccgagggacggagggaggcacagcacaggcaccccgcggaggcgggtagggatcggaccggctgggtgcggaatccgccgggacggcgacagcgccgccgcgcccgcgcccgcgcggggagattcccgccgttagatcggccgttaggtggacgcgtgtcgacccgtcggctcaggggggctgagacctgccgcggcagacgcgcaactgcagttgctttctccccctcccaagtcccattccctgtctcggggtggcggggtgcagtgcatttgtgaatcggcacgattgctacttgttttgggactcgaggtagcatcgcgcagattgtgggagactgcaattccgttccctccctccgaagcttggtggtggtaatcatgagcaatgttggggagagagagataaaaaaatcagcaatggtcacgttattactagtactgctaaaagagcaacgccgttaggtttttaaagagcaacgccaca

SEQ ID NO: 2298 - DNA, 1290 bp, Zea mays
  misc_feature (1)..(100): optimal_loci_346091_G1, chr10:127594958..127596247, Cluster 13
cagcatggcactggcactggcaggccatggcggcgaccttttgaccggaccgatgccaacgccttgctgaagcggcggtctcctctctctgcacgatctcacggcacgggttctgagcacagcagcaggacggcgacctgaatccttcagtctctgaaactgtacacttcagcctctgaaactgtaccctgtccccggtcgagcacccgttcacttgcagaagacagaggcgacttcttcaagtgcgtggaggaatcggttgagagagctcctccaccgaaactgaaaaccaggcaaatgcaaacccaaactgtccggctgtctgtctgtccagcctgcagagaataccacgggatcgctgggccctcagcgcgcgcgcggcggcggccggccggtggtccagttccatctatccggccgcgtcaaggatggaaagggtagatgcacagatcggtcggcggcatccatcgattccacgctgtgtgccgcctgctttcgcgacatgcttgcttagttagaggccacaggcctgtatggttagcgtgacagtgcagcgcggcaggggtcgatcgtcggtcgtctaaagctaaagcccatgcaacggcatgatgagcctttctttactagctcgctactagaggcgtaaacaaagcacactcgcggcatgcatgcattcatctcaataagcgtccgagctagctagcaagccatcatggcccctttttcctcctcttccttccacgcctccattcgatccaccatgcatggccctcgctaatggtggctgtcatcatgagtgcctctgcccgctgccgattatcaaattcctgcacgcatgcatgcatgtagcttaattaactgccactaattcattctcataacctccccggacataacaaaaaaaaacactcggcccgtgtatgtgtacgtgtcccaatgtacagctagctacaagcatctctctctctctctctctctctctcttaaaaaagttatgattaataatcagaacgaaatcatagtcgatttgagtaaatgtgactgctatgaatacgtggatatatatgctttgagcatgttgagttcaaaatgaatttgtgaatgagactcggtcacatgtttctagtaattaggcaagttgctactaattggatgggttgattgtagatggggatctacctgtcgccgttagtgactatgtgctgatccattccgttagctatgctttggttgggaaaaagaatgcgtatcgccgttagtgttgtgttagcaagctgttagatgggatct

SEQ ID NO: 2299 - DNA, 1083 bp, Zea mays
  misc_feature (1)..(100): optimal_loci_346825_G1, chr10:132167929..132169011, Cluster 13
gtttttttttcttggcgtcatacttttatatttatgtcaggaattcgttctgtgtcaccctcaagctccgtttctttatggctcgctacatctacagcgtggcggggtgtagccgcagcagaccaaagagcccccgccgccgcccaccagcaagcaaataccgacgccgtttaccgaacacacgagttcaccgaaaccggaaggtctgtaaaggaacatactatcgtgccttggccgctgtttcataccattgcgttcgtatagcggtaacagaagtgggacctccctatcctgagctgttgtgcttctccaccttcttctctctttcactttccggcagacagagcgtgacgcgaaaggaggagaaaggaaaaaggatgaaagtaaaaaaaaaaaacttcgacagaagatttcgcccaacaatggaaacgtactctgtggtgtacataagaccatcttggtgcattcatacatgcacgaactcaatctaagtttttcgcccaacaatcttcgacagaagcccataagtattggtcaaaactgggcctgcttcgctactttgagcgaccgtgttgcccacgcctcccgttctcccggcccaggagggatctttcgtccccgcgtctatcggttggatccgacaggcacaggcacagccgcacagcactgcattcctgaaactgaaactagagcgtccttacgatcgagttgccgctccgccctccaatcccacagtctttctcggtggctgtatctctcctcctcaagagccaataaacaacggggatacgtcacgagcgacaacgatggacatgccatagaagaaaaaaaagctgcatcacagctgacaaatgcgattgacgatggtacatcatgaggtcatgaggaagagcccaacaaacgacttttcgtattaattccaccatagctagaacagtactgtaatcttgcggagggtcttcgagtacgagttcagtatccgtcaaactacatttttttttgtatccgtgtcctttaactcgaatatacctaagtcggcatcgtttccttagtccttacatccttttctcaaaatttcttcat

SEQ ID NO: 2300 - DNA, 1384 bp, Zea mays
  misc_feature (1)..(100): optimal_loci_346854_G1, chr10:132350854..132352237, Cluster 13
ctaactgttttatacataaatgttaccaatacaagcacttaatatacttttaaaaaacatatcgaacaacaagtaaataataaaatacatatcttctaccgctcggctgccattggagccacacttacccgtttgcaattagccaactctgctttaattcggtccaacccaccaccacgccgacccgcaccatcccagcttccgcaatttctcaccgtcgcgcctctacccattcgctgcatcagttgcctctcgtcctcaactcatcaccttgaattgctagatgtctattcctagatgctctgtaaaccttaaattaccgaatgtttcttccctataagaaaagaaatggcaaaaattttagacgatgtgacctagctttgaactcttggaatatggacacacttaattaagctgaatttatttagatcgaaccaagttacttgttgcacattcttggcttcctagtctctagcctgcttgtatcatatgtagtattcttcttccccctcgcctgtttcgcacatctcatctcatttatttggtgggtaaaattaatatatttttactgtaggtggttcctccactgttccccgtaaaaaaaaagtaaaaaaaaaacgatgaataactgaagtgaacctcgaatagttgaatattttttgtgttgtatgttaaattaaattttgaatagctgaagtaaacagtgaatgactgaatttgttattgcgcggcggacaaatcgggccgttaatcgtcgtgcgggcttgtttttaactctgggtcggctggtgcattttgatataggtgattggccatgcaatccatcctgaatagtatttgagttgtgggcgaattttgcaagccgctctttacctttacgagcagcaccgaacgtgtaaactactgtatgcagtttggacttttgcacgggcggagcggctcgatcggcactcaggagtcaggactcaggagggattctctcatgccatcactgagtccagccccagcccccaggtgtcgttttgagcagtcagagtcttaaaccgcaacgtccagcgcttggcgttgggctgggctctgcttctgcctctgctctgctgggacgacgaccgacgcgacactgtttggagatggcaacagcaggtcatgtggcagcaaccacctcttggcattgcgtttgtggtttgtgggtgcgcttgcgttccacacggccaccgcgccgcggtagatccatccatccattccattccatcggcactcgggcagcatatgcattgatggggacacatgtttccggcgacggctttttcaggcttttctcagccggtaccaccctccacctgtgcggctatggcactaggctttcccccagcctgccttctct

SEQ ID NO: 2301 - DNA, 1170 bp, Zea mays
  misc_feature (1)..(100): optimal_loci_347363_G1, chr10:134590663..134591832, Cluster 13
agggctacaactgtctcctattttccgtagtagccttggtagttttaagtcggttaatattattttttagtaaatttatttaaaatgtttatttttatattaagttaaaatttaaaagagtttgccttttagctatcgctcacgcatcggtcactctcactgaccataattgcagccccatgatccatggtggcccatgggccagcctgagtccggagcagtaacaacatctaacatgcatgcactgggccggggggaggcagcaaggaataaaagaatggcgaagacgtggatcagcagttgcaggcccaagcctctcaatttgataaacatgggtgatggggttagagatatcatcagtcgaaggtttacgtggagcatcgttttggccctaacactaaatcctaattaagaggcggctctcctgcatgtacctgacaccttgtctttcacaagacttcgactcaacttgtgggcctcgtctagctcgtgggaagggttgccagtttttttcctcaaaggctgcaaaaagatgtttactctagtggcaaatggcgacaataacattgtaacgaggataagtgtccctaatagtttgaagccacctttggtcaccacacgtacagtctcacgcttcaggctggccatctcctaacacagagcattgcctccactttgttgtgtcattttttgtggaacagttcggtccccatgcattgttcaactcctgatgctctgtgatatagtttaaggtggggagcttgtgaaaaaagttttggcctgtgaaaaaatcgtgtgggatgtacttcacaaggtattagaccctagtacttgacatccaaaacatgtccttagatatatagtgccttatcttcgtcgtcttgtgagttagtcctgcacgattactgtggtcgtcatagaattggagtaggtgtgtgatagcctcaaggcaatggcgcgcccaattccactgcttctgtcgtttcgatgccgtctgtgagctcctggagagacggttaaaacggcggagacacggtaaactgactagttcttcatcactgggcagtgccacctcatcccactaccggataactaggactaatcaactttatattaattcggaagaaaataggtttggttggcttttaaaaactcacagcaacaaaatct

SEQ ID NO: 2302 - DNA, 1283 bp, Zea mays
  misc_feature (1)..(100): optimal_loci_348260_G1, chr10:139300951..139302233, Cluster 13
cccaaacgaactacaaatcaccagctccggaactgttccccgggccgcacaggatgggctacatgtgaacagcgagctcgagtgcaacgagcaggccaggacgagcgatcaactaataccgtggcccgcatggaaggaggcagctccgcacgcaaggcaacaaaagaggcggccaccaaccagcagcgcgacgaggacacggcgtacgtgtttaaaaacttatgcgtatgcgcgccgagccggcgcgacgcacggctcgtcgtatttaaccgattgatggatcgcggcacggcgtacgtacgcgcgtacaaattgcttatatatatatatatatatatatgctttggctctcagtatcaactcgacggatcgcgtgtggcctgcccctgacatagagattaaggccacgaaccagatgcgcgtcagactaatgcgttaataacactcgacagtcacagtacactagtggctactacatatcatacagtacactatagagctacacagccgtgaacatcatcctagtatacgtcacgtacgtacagagacgccggtgtacagtgcttgtactgttgccccataacggcaacttgttccctaccgccggctaccggtatggggacggggtgcggaaagggcgaaagatccaggcggtggacgggccttggatttggaaaagaaacatcgtggtcgatcgcgccaccgctccgcatgattaggccctttcgcgtcctgataatggacggacgcgcgacgacgcttcctctttttctctctctctctctctctctctcccgtctcgctgtcgctctcgcctctcgctacgggagtcgggtgcccatcacggtgatggccgagtaccttcgccttgtccgcgtccgtgttgtcggccgtacggtgtttgccagcaccgctggcccacgtgatccatcgcaaccacaggccctaatcatttatcacatcggctcctagtcctttccactccccccgattttttttacacgtacgtttggtttggtctgaaccaaatattgctatctctgatcattcattggacaatttttttagtttcttccacgtatgacttatatgttataaaagagatgttgtttttagtgaatctaaaagcatggatctgatattacaaaatctattttttttaaaaaaaaacaaatgatcaaagtcacatacgtttaatgttaggaaaaactttaacatgaatgacgtgtaaataaaaagtgagcaagacgacaacgcaggcaaagcattaatcacctcttgtg

SEQ ID NO: 2303 - DNA, 1011 bp, Zea mays
  misc_feature (1)..(100): optimal_loci_348595_G1, chr10:140843105..140844115, Cluster 13
agctcttatatgcggttcggtttgtttaggagacgctagtccatgacggtaaatatagttaattttcatgtgtttttttgtatggagagagtagaccatttatttgagacatcagtaagaacaaatttaggtgatccaaatatgttttcagtgatgattgatcatgcaattttgcttgtgcggttcctggctttgtgggcacatcgctgcagaatacctgaacactctgtgcgacttgcacgtggtcaaagattcccggccggcgaggaaagagcattgtgtggaagcgatttcacgtgcagcttcggcaggctcccgtgcttaatttctggtaaaagcctggagcaaaagtatctatagtgtagtagaagcatcagatagggagacgaaaaatgcatcgcgatgtcaaagaggcaaattgctgaagccttcgttgctgacattcctgaaggaaatgcttcgaggggagacccagacagactggttggttggtagtaacgtgaagtctaccgttcctagctttctattctattctatataacgaactcaggatctctccgatccatctccctgcaacgtactcacaggatctctctcccaactgattcccatgcgcgctaggataggagagtgagtgaccggtgacggcggccaggtgaacaacctctcctgtccatttattctaacgtgtacgccttgcccggatgttccacgtccacgtcatcgatccgtctcgagagtatgaacgagatttggggccgtgcaagtgcactgctgctcgctttcggtcagtgaaacacaggtgcttgaaaacggctcatcacgttggagacaacgtcaacatgaagcttaggtttggtctgagcgttgctgagaactagcataccgatttctttttgattgaacatataatccaacattttctttaataaaaaaatggtgggaaccagtcaaattggacttgtactggcctcctgggggctcctgacaggccgaagcgtagtgggagta

SEQ ID NO: 2304 - DNA, 1392 bp, Zea mays
  misc_feature (1)..(100): optimal_loci_35347_G1, chr1:214324096..214325487, Cluster 13
tataataaacgttattatatatatgctctcctatataaacaacggtgccgtgatctctagaggacaggttaggcccatccacctggttggccgcccatgcatgcattatggtatgcgtctatgcgatcgacagacaggccagtgcaagaatagaaagacatggcttcgcttatgattctgcttctgcatttggcacaatctatatggtgatgtttgattcacatatttacaacataacggataaccgataatgttaaatcatacttgtttaagtctaaccgtataataataagatatattacatatcgacctactcaaactttcgagaaccaaacggagccgcgaatgaacatcccatgcctcctaataatcacgttggtctgcaaaatcatgtctcctgttggaatcggattcgaaacggccggtagctatatatgttgtggaccaataatactcgcgtttcccacggaactgtacttttggaacaagagccagcagcagcaagccttcggtctggaaccatcggtctccgagaggaaaagctattattggccggcctagccagcgcgcggcgtcgcgtcaccgccggcgcgctcaggaatgaaaccgacgagcaggatgctgtggtcatcgagtgacgacgatgagtacgtacaaatataatgtgacagggcgaccgctgcgaacgagtgagtgctgcagcagcagcagagacgaccacgacgagcagagacgaccatatggcacggacgaccatggaccatgatgatcggtgtcgtcgctacgtctcgtcgtccttccgccatgcatgctgaacacatgcgcgtatatatgcgcgcggagttgcggtggtcccctcgctagctggtgtgaccgtgtgagtgatccatgcatgggtggggtagtagccagggaggacgacgacgcaacgcaacgacacggcggcacgcatgtcatgtatgggaaagctgaaaggaaacagagagagagagagagagggggggaggtagcagctagaaaagagcacgcgcgcattttgtgagtggctgtgtggcgactccggcaaccaaacggggttatctcgtattattgcagatctgctggttttttttcacagtagaattttgccaacacttgtcagtggcagtgtactgtcgcaacgtacgggattctcacatcagccgacaatattgctgatacccatacgtacgtacgtcggccggcccgaaattctatttgaataaacatttcaaatcgttttaaattaagtgcaacttgatgtctgccgcacatctctctagctagcgtctctttctctccccctttctttttctgcttcggcaaatccaccttctcccttctctcccaccacccgccatgctctcctggcct

SEQ ID NO: 2305 - DNA, 1041 bp, Zea mays
  misc_feature (1)..(100): optimal_loci_35492_G1, chr1:214979415..214980455, Cluster 13
gtaaacatagcatcacatcaataaagagaataaagcttccattcttgtcatttgtctctcgctttcgctctatactcaaacagttgccgaaggcccggagcgccgatttgcccgcggacgtttcggttcacgagtcacgacctcatcggcaatcggcaattggcacggtcacctgtccgcaattactccccgtgcagacgcgcgcggagacggcagcggccgcaaagcaaaccatcggattcagaaaacctgtctctaatcggccggccgctgatggaacaccgctagctgatactcctaatcagcgctgcgctgatgataccggcccggcttgtgcccaagcatctgctctcgggtgcgtacgtggctcctagagcatcatcacccagctgcacaccgctcgctggatccctgacgcgacgtgcccggccaaccggccaccggtacggcggagtacccgccttgccgactacgtccacgacacgatgctgcctgccggccggagccgggccgcaccaaggttaggaccaacatttgtatataataatagttctctttccggctgagaactggactgccggccgtcggtcggtggatgagtggcctaccgcgcacgcaggcgccgaatcgtctggtgcggtgctcgctcgtcgccgcagaccccagcacgccctgaccgtgccacggcaggaggcggactcgactggcctgtcacgacaggtcacaggtggcgcagtcggatcggacaggaaggaaccgttcgggcaaggccgaaaagaatcagagcggaggaggtgccaacgatttcctgcccccaccccgatctgatgtggccccactttgttgcttctttgctcgcccagcggctgtcacgggctagtagatgccgcgtgtccgcatcaatccagtcaccacggaccacgccacctcatctcatcctcgtcgtcactcgcttcaggctgcccgcagtcgcgcgctccacgtagagctgtatagctgtatcgagatagcgtaggaaaagttgctgcagtggagtactgt

SEQ ID NO: 2306 - DNA, 1044 bp, Zea mays
  misc_feature (1)..(100): optimal_loci_3595_G1, chr1:18622860..18623903, Cluster 13
tgtatagtcatgtcatgattcttcagaatccaatcctaacgttcagtacttgacgacctttagaagaagaaaaaaatataataataaacgttcagcgctctaccagttttcctaaagcaagatgccgtatcccctaattgggtgaattacgtgtgactctaggacgacgctttttgacaaatggaggatcatcttgcccgttgcagttgtttaagctcctcgcacttgtcaacctttgcgtggattctgcactgaaccgtggaatcacttctttttttttacgaaggtgaactggtgggtggcatgcaacgaaccagagcagcagacgaaccttatcctggcttacaggcaggcaggcagccttgattctgttatcctcttacttctgaaagcatatacctgcgtgtcaggatttcacaaaggatggggttggatgtggtgccttttgtggatagattcaccctgtcagctcacgcatgatcatcatgttctacaaagataagatccggtgactgcattggtttggtcgatacattacaacaacacaaaaggtgccagagacagggcgttcaaaactgcacaaatatctcgtcgcttaaacgtgaacatatgagctacagctacatcatgtgcccaccaaacaaccggcgggagagtgatgagttgcagatgtgttataaaagacgggcctgaaaccaaagctgttttttttagtgcccgtcctagatggtccacccaaagttaattgactgcacagcctgcagcagtgataaaaagaaatacagcggtaaattccaggtaattgcatccagcgtgtagaatacctcccgcacctgttcatataactacgcacagacttcgctgattgagagagaaagccgtggacgccaaaagattgcagtgatagaagagaggaccccagcaagcagcattgtgcatgcatatcctgcagcagcagcagcagcagcacaggcacaggtggtgttggtgtgtgtaacatatgcagaactgaatccaactcattcttttgaggcatgcctccgc

SEQ ID NO: 2307 - DNA, 1140 bp, Zea mays
  misc_feature (1)..(100): optimal_loci_3877_G1, chr1:19661767..19662906, Cluster 13
agtcctcttcaataaatttaaaacaacaaattatacaatatatatatagtctataaaatattttgtttgataaaaaaatataaaatatttgtacagacaagttgaagttgaaggatgaagtgtcgtatctgtgggtcctgagatgccatggaagacaattaatcctgtcgttgctacctgtggaaaactgcagagcatccattcccctgtatgtagaagaagtcgcgtgctttgctttccgcgcgagtgcggtcgagggtgactgagcacgcgcagctttgttctactactgtctattattacagtaagtactacgctacgtagtagaagaaaggaacggtgtgggagtgagacgcgcagtgcgagagtcagacgacgcggatggaaatgcaaatgggcgtgcacctgccatgccatgccgggaagctgtgcacctgctagcgggcagagtgacaacgtacccgtactgataaagatgctgaaagatcttgggcaccttgattccgggaacatgtggacggacggagcacgcacgtacaagatgtgtgctggagtcttccggcgccggggcggggagatcgatgctctatagctagttccgtggtatcggaggaaggcacatcagccgtgagccattcttttgcgacgccggggtcggaggacgctactggcaactaagccgggacgacgatcgttccgttgcgtgctgtgctgtgctgcctcgaagcaacatcaacatgtgctgcgcctgccgggcgaactgaggcgagccgttcctttgagcatgtgacgcgaggcgtctgcgcgcccagatccttgcttgtctaatctaggagaaagatatggatcgagcggcgcatgctgccattattaagcgccaaaaatcgccaaaattgtcgagcgtgtttcctacttctccagcgataatgaaattcctaatatcaaacgaaacctatttttttatcataaatactgaatcatagtgtaattttattgaaatagaaaatgcatactttaaagtatagtttggaaagggagttttctatttttttcaaggaaaattagtttattttcttaagtgtttgagcttcaccgtccacaccacaccactggctccatccatgattggtgagtattgag

SEQ ID NO: 2308 - DNA, 1069 bp, Zea mays
  misc_feature (1)..(100): optimal_loci_4177_G1, chr1:21735619..21736687, Cluster 13
ataattaatgtgatttaatttatagctagatgttccatcaacaattatctgatttatcatctgtttagattcatcgttcatctggctgacaattatcgatctaggtgcatgaaggagagtcttagaacaaggtttttgtgaccacgcgctatgagaaagaatgtgtgtttaacaaattaaaacctagacacctgtgcaacacggccgtggactgcactgattcgttggacccgccaaggctagatcgcgcgcaagtacaaaattggccaaactacgcttttgtgaaacctgggactggccaagtggcaagaccttgtacctggctgctggtcgtacgaaacatgatgcggccgtccgaacccaggcaggctatcgacgacgagctgcatgagcgtgaccgacccaacactactttctggtcgtgaagtatcggtagttttcgtctcgatctcgatcgtcgggatggagcccaagctgccattgtgtcgtggtgcgccggccccgcggtgaccacgcgcgtagtagtgtggactgtggagcccaaaaaaacacgcgtcgcggacgggcagacgacgacagtttatctccgagcaccgtgcatgcatgggcatggtggcgatcacagtcacaacaggtaagaggtttgccacgatgagggtcaatgaatcagatatcgctggtcaaaagcaaaaaaactcagtcgtgctcgtccatggtctcgcacccattagccacgccgacgaaccggccggggcctaacccgatcactttggacgcgtcggatcaggtttggtttgtaggccacgatgacctgacggctggacgcgctgactggtacacctaactccaaactgatcccatatggtagacaacctgaccggcgggcatggattgacatgtcgtgtgaccaggcattctcaccggtcggcactcatcagcagcccttgatgaattgacacctggcttgcactacgtactccatggtttcagtgacatgcttgagatatttatgcattaccatgcatttctaataattccacacgaaaatatatgcgagttagatttatca

SEQ ID NO: 2309 - DNA, 1144 bp, Zea mays
  misc_feature (1)..(100): optimal_loci_42565_G1, chr1:251169550..251170693, Cluster 13
ctgatacacaaagttttcaataccggaagagccaccacacattttttcccccttttacgaaatgcgtggctttgtgaggtcgctctcacgctggcctcatctttgttctctgctgaccggctaattaagcggcatacatatattcgcgcgcctagctagtgcaccttatctgagtgattatgtccaccatcatgcaatgcatgcatgcatgcgttccagattgtaatatccgctgctgtcaagttgcaagcctgggcccggcccccctgcagtattcacccccttacacattctgaaattacagttactattgataatattattacgtgcgtatgcctgggagatagtgggtgctgcatatatatattttttccaagatatctatcttgacacacatagcgccaacaatgcgcgcgatctcgttaattatagggggttttaaggtttggcggagtgcagcatgcagttgtgatatctacgtagtattcttgggccggggcacgcgagaaattaagatactattatatgcaaaagaggaactaaagtgcgtgcgttgaaggcaaagtggcccgctttgcgtatctcttctccactagtagaaacttgctagaaaccaagtaaccaaccaacaggccgggaggatggtgacgaggtgacaagagctcatattattagcctctaacatgcataacactctaataactccctgtgtcgatctagctaggcactgatcatttttatatacagaacgtcaagagagaccgagagggattcacttgttttgttcatcaataatctttaattgcagggcagctagcgctacgacgtgtacctgcagtagctataggccacatgtcacatatatatagctagaggcctccctagattaaacaaacgcttgcagctgcagccctacaaccaatagagggcgcattatgttaacggcaccagtacacactcggctccagtttgtctgcctgaacgccaaccaaaagtacgccccaaagtaatggtgagttgggcaactacttcagatgaagcttgcttcgcgccaaagatatggtctactatatacgaccccatctagcgtggcacgcgcgcgtgggcatatatggcggccttctatagccgatgtccttgtctc

SEQ ID NO: 2310 - DNA, 1104 bp, Zea mays
  misc_feature (1)..(100): optimal_loci_44515_G1, chr1:261596014..261597117, Cluster 13
gctgcgtgccgctgactcgtcggccatcatcgactgatcgacgacgacgacacaccggtggcggccggatcgacgggctactactacataaacacacgtacgcatcacctttgcgtgcgttgaagagagcaatgtcatcaccgtcaccctgcaaccaccccgctggaacggaaccgacccgtctctaaccatcagctaaagccgctcctcgtttcgtttccgtcaatccgccacgcacacgcagcatgcgttccagctcacgtgcactaacaaccctgatgctttgcattgcgttgcgtttgcgtttgcgtctcgtctcggcctctacatccatgagtgcatgacactaacagctgttggctgccaaactagctcgtggtgggctggctcttcgatcgatccaccgtcactccaagctaattaggaggccggaacactccatggatagatatagatagcggtgtgtgtagtgcgttattgccaggcaggaggggctagctcgatctgtcaactactactagtagcgaagggatgaaccgtgacgcttaatccgtccgcattgttgcctgtgctctggttcattgaacctgcccgcggtttgggccggcaccgttgcgtaacgcgccgggatcggaaattaaagacgtcgtgcgtgtctacttcggtggcactggcactggcactggcacgtagcgtgtgtgctcactttggtgtctgggctctggagcaagtcaggtcatcagctgggagagaggatatgccaacggctttcaaaagcgtgctgctgcaatgccctgcattggccggccgatgcccggtgcgcgttgcttggaagaaagatcctacgtaccgtaccttcgggtcggcgaaccagccaggacgatgcatatcatgcatgcttaagactttgttaacgttcttgttgagaagcatgtgatgagttaatttgcacttgcacacacacgaccacacgatagatgaaacaaacagggtgccggcggaaagggtccttgtgatgttagatacacatttgtatttgcatgaacttgacatgatcgatcatttgattctttccttctagataattgctttcaacttgatttg

SEQ ID NO: 2311 - DNA, 1313 bp, Zea mays
  misc_feature (1)..(100): optimal_loci_45306_G1, chr1:265756095..265757407, Cluster 13
catttttttctatctcagtattttccaataaaataacgcactataaaagaaaaggtccaacaatttaaccaagttctgatgaaagctagaatactagttccatctgcatgcagggtgggatctttatgtcttatactatatagcaatagcaaaatgaaacgtaggaaattatactactagataccaaatcccaattaatatggtccttttgaagtacagagagctttactgcatgcatctgctgtttcttcaggattttatacggaatgagaaaaacgagaagagaagtactaatcctgtatagtaggcggtactagtctactagagcagaagtaaaataatccattgtttttgcttatataaataaaaaacgtggaagcaatcatactatagaactctggaatggctggacggggggtgggggtgggggaaggagcctagaacttaaattgatgctagtatgcgacctggcgaggacgaccgcggaggagaggatgttaccaatgggttggatgtagaggagggaatttgacggtaacctcaccagcgtccttgagatcgaggagcgttgcgggattggcctcgctgcgttggccggggagctaatcgcgtcccaagcgagctgttcccagtgcatttcatggcgagaaggcgcacccgccggcggtggggagctccgcctccccgtagtccgtagtcgtaccccagcgcggtcacccctcaccatatcgcctcacccggccggtacattaagcatcgcccagatcaacgtcggcacggtctagaactcgacgccgctgtagcacgcagcctccaactgcccggaggcttggagaagattgacattgatctccttcccaccaccactgcactctcgacggactgatgcttcctgctttctcgacgaaatgattcagagttgctgtagcgaaaggctgcaaaatattcctttcttctccatggaagaaaataaaggaagaccaaaccaaatgcattccctccacaacgcgcgttcgcttggctttggataaaaagaggacgactggatgaggacaacttttactgttatcccaaagaatgtaaagcagcgcagtttgctaggagatgtcatttccatggcgtactggccatcgaatcaacaaaaagcactattataagtatacggaggcaaatattgcgataatgttatttatcagaatttattgtcaatatatttaatatttatcacattggagggtaaactcatctgtccatcacccgcacttaattaggttgtctcaagcattacacttagttgtctcaagcattaccac

SEQ ID NO: 2312 - DNA, 1272 bp, Zea mays
  misc_feature (1)..(100): optimal_loci_46065_G1, chr1:269915980..269917251, Cluster 13
ctaattcaactagcaaatttgcagccattagctctaatgcatttaaaaacccgtataattaccatcactccatgttttcaaactacgcccacctttttttttatttttaagacaatagagagaaagtttctaatctatgtgaccgtacaccgccaaattcttataagatttttcagctaattaactgggaaaaagaaatgagaacacaagtagatgaaaatgattataagcaaagtctaatattggttctctatccttacttgttgattcaatgcaacaactttaattgtttgcctcacaagttggatggtcctctttgcattggcacgctataacaaaacttctattgcgatttttatccaatttttttattgctaaatcaagtagggtaaattttgatcgagcagtcccttgaaccccagtcaacctggcactggcagccctccccaaccttgcccgcgtctgcacagtccttggccgccgcagcacacaccgcactcgcacacctgcaagcctgcaactcatcgcccccccgccgccacgcaagtgcgcccaggcctcagcgaaatgggcgcgcaggaggcggcagtggaggatgtgctgcgcgccgccgccgccgaggtgtcaacctcctcggcgaagcgccgcttccgcctcttccgccacaccctacctcttatcatcgcgaaggtcataggtactcaccctatcatcgtctccgccctcgtttctcgggctcgctcgctcgccgtcgtctgcgtgttttggtctccctcccgtgcgccgcgctcgtgccgcgcgcatcgccccaccttgtttgcggacctcgacagcggaagccgctcggcctgccccgatctggacgcgcctgaagcgacagcggagagtttacagcacgcccctgcctcaagtgcctgaagctgcagtggctccatcgcgccgttcgcgaagatgtcgatttgcgccgagcggagccagctcccgacaccgtggctgccgttgtcgcttttgctggtgctcgctggtgggctgaatgctagctctggcaccctattgaaacgacgacaagatctctcatactttattgatttatcaaatattttttctcacggggttcggggagatttgggctttgggaatacacgtagtggccagggaacctgtcaggagacctgatgctggttgctgaagcaaggtttggtttgcatcgtctatgcttagcgtcgagattttctactgcttgcaagttgtgtcgtccaagaaagggtccgt

SEQ ID NO: 2313 - DNA, 1201 bp, Zea mays
  misc_feature (1)..(100): optimal_loci_46437_G1, chr1:271902681..271903881, Cluster 13
catgggcactaacggttgtcttaacttccacaaccgaccacgaccatgcgctcccatgaatggctaacactgcctcgaaccggggcatgcagtcacataaaagatgtcggactcgatccaaatcggatcgccccccggccggtcctgtgcctgtgctctccaatctctgagactatcgaagcgttgtcctcgtccattactgtcctgtgcgagtgggcactcggatcctctctactcttgcagattcccacggcgagagaccgggccaagtcgtggcgacccatgtgggctccgtgtgcatgggatgggcgggcttgcattgtaacccgtacgtagggcccgtcgccgtccggggtcgatggcgcagcgaagcacagtgtcatgtcgtgcacgagcacgaccagagagcggctggacggccatttcctcctccggtgggcactagcagtatagttagtatataaccagtgggccggccagtcacgggtcacggctaccgcgcgaacgaacgagccggagccggagcggcagtcggctagtctacacgtacgatcgacgacatgcatgggggaccggggcagaggtagcacgtagggccggtggtgccgcgcgcgatgcatggccctccgtatggcgctgccgcgggacggcaggcgccaatgatggatggccgggggcgcggcagcgcgtgacaccccaacgtggtgctgcgtccacggaggcaggccataaacccaaccctggcctgccccggctccccggccggctgcctccgcggcggccagggctcggggatgtggaccgtgcgcgcggcgccggggacacgggggttttgccgtgtccggacgggatcggagacgggtagggacgtcgcgcggcgctagctgctcgacagcctcaggtgcaggtccccccctgtgctgcctgcatgctgtaccgggtcgcatgcacggcggatcctctgacgacgtgttgggtggcgctgctccatcatatgctatttcttctcccgctgcggaaaggtcaactagtacgtgctccgacttgttcgcgtcgttcgtacgttgtcacgagggttcggatcagccatccacggcccggcgcgttgtcctgaacacgaggatagcctttgcggttctgctagttgagcttcttgcatgaacttttacagcaagattaataattgtttcattccccggtg

SEQ ID NO: 2314 - DNA, 1026 bp, Zea mays
  misc_feature (1)..(100): optimal_loci_4741_G1, chr1:24300118..24301143, Cluster 13
cacccccgactggtacctaccgtgaaaagggcaggcaaacaggacgccttgaatgagcgagccccggtccggcgcgttcccgtcgcgtttccagcaaaggtgagagcagtttcctcacgcagctagaccgttgctccctgcagttttccgctgcctcggccaacgatgcccgtgctgcgttgcatccacggccacggcgacgactgctctgctctgctctgccctgcccgtttcgctccgacggaggggaaagtggggcgaggcgctcgctggttgctttcgatcggtcgccggtcgggcagcggacgaggcgccgggcctttctattctagttgcgggattcattgctcctgggggcccaggcgacccatgggcaacatcgcttccccacccgtgatggatactgtccggcccggtatatatcctagtctagattgcagcgctgagttgggatggatcacgctccgaccaccccccctgccgttggactgttttctctcccttttgggctggcccttattttgctattgaaatgcttcacaaagtgctagttagtgctgggaatttttttagggaaatggttttttttattattatcccagcaagagttaacggagatggtcacattattgtccgcccaggataggataggttcaagctgaaggttccgaatccaagctgttgaatgttttggtacagagggaggagaaggtgcccatgagctagctagctcatcagccgctcagttgtggctggcgctgatgggagggaggggccgagggcgaggggacagccgatcgaccggcgtacggcgtggccgggcgagctctcgccggtgacgacgtgttgcaacagcagaggctgtgcggactgcctgcggagcccagggcaaggctacggtacccccagcatgtccgcccatgctgctcactcgtcagtcaagctggcataacaacgtgcccgcaaactccggcaaagaaaggacggcgtacaaccggtctactgcaagtattgacatgtaaaaat

SEQ ID NO: 2315 - DNA, 1030 bp, Zea mays
  misc_feature (1)..(100): optimal_loci_47494_G1, chr1:278451215..278452244, Cluster 13
cctgaaaagcctgcgacgggagctcaagctagcagcagttgtggtgaactggtggcgctgtatgccgaagccttgcaggtggtggactggtggcgtcgacagctgcatcgcaatttttttttattcggaagcagggaccgcaggaacatgagtaccggcctaggcctaccgggatagggacacatggtactagtgacattatactggaagcaccggtttgtgttcctcatttatctatctatgacatctgtttcaaactacatttggtctaaaaatactgaaacaaaagtatagttttagtttcggtgtttatcaatttagagactaataaattggctaattgttagtcatttaaacttgctaataaggtactagctaattatctgccaggagaatctaaaacaaggcctaactaataatatatatgaaaagcatgatagtttctattagtagcaaaagtgccctgtcttataaattcgctaagcagaggatatcgagctgcctgcttagtacgaccaaaactgcaaaatcatcagggcgacgcagctttggcccttgggcaggcggcagcacaggacttgggctgtccggtccggtactgcgcccctgtctgtcagcctgaatcgatcagctctttgacccggaggggagaggtcgccagcgcccagcgggcaccgcgccgcacggcagtctgtcaggttctgggaccaagcgaccggacagggacagcagctgaggggaatttaatacgtaacctaaattcgccagttcctatcaggcaggcgggccccaccgcgagctacgtgaagtctacacttttttaattttatttattatattattatttgtcgatctcgtggtccatggcgtcagcggattattagtagaggagatgagatagacacgctttcctcgtcgtggcctacttgcatatatttgacaagcgtcaaggactcgagtgtgactggctgaacagaggcgtgtgatccatctgtgttttagtagcactaaggggccgttcggttactac

SEQ ID NO: 2316 - DNA, 1037 bp, Zea mays
  misc_feature (1)..(100): optimal_loci_47612_G1, chr1:278890404..278891440, Cluster 13
taaatcaccttcaagatcttgcacttcatcgccatggaggatggcaacttgcagctcatcaccgtgactacctctcaagcgttagcaagccaaagcatccctgaaggcaccctcgatagtcaagctctaagtagttccaccaacaagagcctagagccatggcctaagattgcccaataggccaacccacgaggtcatctaaggcaataaatatctatcatctcccccaaaagccatgccaaggcaacaagaaccatgagggcaacattattatagggcctcgggcaaccttaaaccatgtcaagactactaggggccaatgggatgatgcaggtccacattcacaattactggggaagccatcatcagccttgcacctctaaaaggtgcattagacgcgtgagtcctagctgatcgccatgatgagtcaccaccccttgtccttccacgatctcatagagacatcttgtagcgactattcctctttggaacttgagaacacctctagtgtgccatctctctatgccacttcatggccgacggacatggcacatcgaccccagtacgggcatgcctcatggggtaataacactctccctatcaggaggtggaatacctatgggctcacatcgattagctccttaagcgtcgtgaggaggccatgaaggggctaatcccgctgatgcagcctgcctctttacctccaataggatgtcgaacaccatcaatagtgccacaccaacaagacaggtgatcaccgtcatccctcctacaatgacattgacatatggggagtctgggagagcagcaagccacaacattttccacacgctagccaaaatgtcactaccgcaacagtgatgttataggtgatcttggagccaaagggcccccaagctagggccacatacctcgagcttgaggggttgattaagcatgtgacccaacaatgccagttatcatgcacccgggtgcatcaacacaacacttaggtagagtctatgacatgtacataatccttaacacacgtcactttg

SEQ ID NO: 2317 - DNA, 1222 bp, Zea mays
  misc_feature (1)..(100): optimal_loci_47808_G1, chr1:279764171..279765392, Cluster 13
aacgacgtggtggcgcggatgaagaccttcctggttacatagaagattgtggcatatgttaagttttatacgataaattgatggtataatatagatgtaattgggccgtaaccaggactgtagcccgagtgcccgacagcctcagatccgcccttcagaggagaaaaaacgtcgtacatgtatagtgtacgtgcagactccggtgcgagtgcgatctcggcttgcacagcgcccaccaaacacggccatctcgacatgggccggtgggtggtcagccggtgcccctccaggcgctgtgcctggaggcaacaccacgcgcggtgagatccacgcgtcctgccagcacccgtggtcccgcggcgctccctccacaccctccacggacgctcctcatcagtgctcacatgttggtcttgggcggcgcatgaccgatcggcgacgggaaggacgacgactgactgcgctggcacgttgaccgactggcatctgctgctgctcgcggtacttgcctagctaatggctgagcagtgagcacacagctggaaacacccccggccagcgcctctcctagtctccttcctggcatggtaaagcgccggcatcgtgccggcatgtggcccccgccacctggatagacgcagcgcagtacgttgtggttgtgcatggggtgtgtacgtgaatgcatgcttgctagccgccaaaccagtcccgccggcgtggttcaattcatagagcatcggcggacggcggtgtagctaggtagctgcagtgcaagcctgcaacgataaaggataggacttttcagtccatgcatgccgtgcaatctgccaattcaagtacgcggcgtcgaaatctttggtcctttttctctgcgaagcgaccagtagtacttggctagctctgaacttttgtgcaatggaaaaaggccaaacgcatgcccagatcagctttcctcgtgctgtactcgtacgtgagattctacagtgtagggcatgcatgcatgcatgcggcatgccactgccccgcgcggcggtgtctggtctgcggtctgcccagctctatctgtcgtcggcttaattagacctgaccatgcaagctccttcccaagtactactggctagaccgctagagtgagtgtccgtttcaaggctggataagaaagttgtctggttaccgacgggtactgagccagaaaaattaataaatcggtgagctctttctt

SEQ ID NO: 2318 - DNA, 1280 bp, Zea mays
  misc_feature (1)..(100): optimal_loci_48236_G1, chr1:281708657..281709936, Cluster 13
gaattcaggtcatggctagctaggctctagcacacacccatgtgcgtgtgtgcctgacacgaatatgcagttggtttgcagcaaattctacagtgtggatttgatcgaagaaaaggccaagatgacctactgaattaataactttacctgctgcctatgctgatgtagaggctaaggattatcctgtcctcctcctccgagaacccgccgtgcctgatgtttggccggaggtagttgagccaccggaggcggcagctcttgccgcacctcttcagacctgcgcaggcccaaatacatatgattagcctcctctttttctactgctatctgttggagtagattaaacttttgagttgagctgcatacatatgcaaccttttctaacacaatcactgaatatctactgcatggcgaattggcgattgccatgagcacatacatacctatcttctgcggcagggctatccagttaccgccggtgccgttctcctcgatgtaggacttgagcgtggcgtcctcctccggtgaccacgggcccttcttcacagtagccttgtcgcagcacggagctctccccatggcctgcgccttcttctttctcccctctgaggctctgacgactcggagctgctctatagcttgggctctcttgtgagcgagtgtggtggatcgaacaaaagcgccgattagggcctaagcttggttagtgataataacgatctgggcggtgtgtttatgccctgaaaagggaaaggtgcatgtgcattattggcatggaaaaagtggctgctctgatagtaataaaatactgtttgagcggtggtggtgatctgggtttctctctttctaagtgttgtttcttctcttggattagaatctcccatcagcagtcagccgaccttttcctgaacatggtctttgtgcaccatagacacttgttgcttccattactcgtgtggtttgtttatgtcatccggtctgatctctgcttacatgatgactaaacacgatatatatatatagtaccgggatctcatgcataggatatattgcaccggcctgtttattattctatcgtttgagctctacgtgcactaatcttgtacatatacacgtaaccacagtggccaatatgacagtctgtaagaaaaaaaaacacaagtttatttctcacaaaccacacggtcctcatgcatgctctctaccccgtatgtgcatcatgtgcattgaaatatatgtgtctttatgtgactaaggatagccggtgcgggtgaatattg

SEQ ID NO: 2319 - DNA, 1248 bp, Zea mays
  misc_feature (1)..(100): optimal_loci_48702_G1, chr1:283237537..283238784, Cluster 13
tataagcaacacccgtagttgatatcagctccatatagcgtagcccatcctagattcctaggaccaattcatgacatgtttgacacaatcatattggcattgcatcatcccaagaaacagagcttccatatactacgtatcataatctgaaaggcttcaacttgaaatcatcttctctaggaagtccaaaatcgacaacacgaagtccctatctcctatgatgcaagtgcaagcattcaactgtactcatgccaattctccagtcaaaggtcgaactattttaaagtcagctgcaattaattgcggatcccaagtactagcaaccatcctatccatggaccttggaccagcagcggggaaaatccaacagagcggtccttcctcttggactgcatcatctcttccacctactgtactgtacttgggatggctgcgcagtcttgtgagaaacaaggacgccacattcgtgcacgcacaagcccgtaccaatcaatcatacgcagaaactgagctgaagcggaccagaaaacagtcaatggagtaatgcgatgcgttcccatggcttctgacgttttttttttttttttgcaagaactggaagactgaaaggtacagcaggccaacttgaaaggaacaacccgtctctgaaccatcggcagaacagctctcttcctctgcactgctgcgaactatgtctgcttgacttcaacatgaaaatgtggccgagatagattttcctgtacactattaagcatttgtttctgctgacctagtaccaagactctagaactctggtttagactctatgactgaaatgtcttgaaccattccaagtccattcggtagcgctcgtcaatgttcgtcgtcttgacaatgttaagaggagtactgtttgttgcacgggctggcatcttccaggaattgtatacgaggtagtagaaaaaaaaaaggcgacacttgttgccgtctgtgttctgaaaatttcgagtgtcaatttcagcttgtttgttgtatggtggttgcacgggaaggttttaaagatcgatacagtacgtggtggtaagactgactctcaagaaccgcgcgtaccatttgattcggagctcgaacgttggctgataatgacaggctgcgtggaattccacaggaagtagaatatttgccatgcctaatggcactgggggggaaaaatgtcaggtatattcatctggtgattctgctttctcttgagacgaagcaggagccccc

SEQ ID NO: 2320 - DNA, 1001 bp, Zea mays
  misc_feature (1)..(100): optimal_loci_49842_G1, chr1:289500186..289501186, Cluster 13
tggttgccacacatgaacggatctgaagggtggctcggagggctccaatcccctacttccataaaactccattaaatatagaggtcaagcctggacgagcccatgtgccgccagtgcataagaacaaggcccgtcctacaagggcctataaaaaactagtcaacactactttagccagtgcatagtttagtatcaagtaaaaaatcaagttaagttacattaactaggcaagtagaacaaggtgtgtgtttattgtggcagtccggtgtcaatctctcatacaactcgttttggttatatgacgaagtggaaccaacgcatgctagtttagtatcaagtaaaaaaatctagttatgttagctcggcaagtagaacatgatgtttattgttgagccctggtagaggtggagagtgaaagaggaggaagaagagagaaaaatgagccatcaatttattggagaaagaggtggaagataaaagagaagggacgaggaagaagaatagagaaaaatgagtctccctgctagcgctgcctccgctgttgatcatgagaaaatcaactccgcctttaatctatttttagatccgccacgggatttctggcccaactgactttagtcacttgcttgatcagcttaggaaagatgaccagaccgactttcttatgcttcatcctaaatattttcctgtgtcaacaattacgctaatcaatccatcgcctgtccgaaacatgacacagaattcatgcatgctgcagctctatcgtcggtggttgcctgcgcaggcgcaatgcactgcggtatgcactgcggtgctaccgtcgctcgcagaaaagcctcgagctcttcatcatcatcaatactcctactgcagcaggtgcagcctgccgcctgcacgaagcagctgagcctcagcacatggcggcaagcggtttgtagcagtaggccagtagccggatctcaagccctggtccgatgtactaccgagcgaacagggacgga

SEQ ID NO: 2321 - DNA, 1056 bp, Zea mays
  misc_feature (1)..(100): optimal_loci_52791_G1, chr2:5499153..5500208, Cluster 13
cggagccgacagtgctcagcacctccgctgcctgtgtcgaagtctcactcgccgccgccctccctgtctgcactacctgccctctcacccgctcttgtcgccgctgcgcctaccgccattccttccgtctccctgcgccatcgtgcctcgccccactcctctgcttgctcccgcctatcgttgcccctgcctccccctccccctcacgaccttcccccgcctgcccccctgcccaccctcaccacctcatcaaccccgccccccgacccctcccctgtcagtgctccctcggagtctgctggctcgggttccctgggcggcccttgccgacaaggctccctcgatgtgttcctgccccccggccggcatgctgctgctgctgtgttcgcgtttgcttctcttacatctcagtcggccattcaagctcctacgcccttcatctgggaagcgatccgcgctgccctcccggacatcaatcttgaagtgctcccctactcgcttggctccttgcttgttcgctttcagtcggcgggcgaatgtgctgctgctgtgggtcgctcccccttgttgcacaaagacgctgtgatcactctggtacctcacgacgggttcagctccaagcgccgggtgggggtgcaagcggccctatccgtcctcgggtttcccctggcctactggcatgaggacctccttcgcctggccttcctgtccttcggctccgtcgtggaggtggactggcgctgcacctcgggctatgactactcctccgtccgggtggtagtccaggtggacgacgtctctcgcattcctgctgaactgcgacttcgcgatgcttctactggcgactgctatatctgccagctgcagctgattacctcttggccgattccagatgcttgtgcccccctcgaaactccccgtcccttttttgtcttgccgacttcgcaacctctggtaaccccaccagcttaccacgttgcgcagccctgcctgctccccctgtccgcatacccatctgcacaccaagcccactcccgccctcaccactgcctctct

SEQ ID NO: 2322 - DNA, 1119 bp, Zea mays
  misc_feature (1)..(100): optimal_loci_52810_G1, chr2:5537812..5538930, Cluster 13
agatcattccaacaggtctctctcccggcaggtctaaagcacaacatctcacgaaatacttagatcatatcctgtttaagatttcagctactatatggttcgatacactttacgggtcatgcttattgcttgggtgagcacggcaacaaaatagcacataatgatatgtagtacagtataccttttctagtattcactaacactataatatatttttctggtatttattgtattatatatctctcgtctaattctcgagggattttaaaaaactagtgaaaattttcgttgaaatagtacatatagaacagtagataaaaagctgtctactgtagttttcaggttatctctcagcagtttgtgaggcgtggtgacccgtgagcggtcaagatagcttaacgccctgtggcgatctggtcttccagagccaacaatgactcgggcagccacgcgcacatcacacatgacgccctccccatcccccctgcctgccaaagccggcaagtcaaagcggccagcagacgttttgtgcaggggagtaccttgcgtaccggcgcaaagtttccgactcgtctgggtacgccatgcatgcatgcatgcatatggtacttgagctcccagtttcctggcctctccactaatcggagcaggacgactgcatccagcttccagcagctgaagttcgtagccgtagtcgtgcccgtgtgacagcgacgcgtacgtgcttcattggaggggtgtactgtgtacatgccgccatcccattggtacgctggccgtggaaggaagattcaagaggcaaaccttttcgcacggccagcacctgcctacccaagcaaatcgatcgagtatttgtagctcaatgtctgcctgtctccctttcatttttcgttgcactgttgttgtggacaagcgagttacagcgacaggggcgtgttaatgacttggattaattgtattatatgcctccggcagagttgttttcactcaactcaaactcaaatgggtcccttgtgatactctcaccattattaccccgttgtggtggtggtggggtttgcaagcaaactaagcttgcatagttgtcgacgtacaggctaggctaggcaaatcaaacgg

SEQ ID NO: 2323 - DNA, 1295 bp, Zea mays
  misc_feature (1)..(100): optimal_loci_5301_G1, chr1:27137703..27138997, Cluster 13
aaggttatatgtacttgttgatgctagatgatttatagaaaaaaataaaatatacatttttatgattgaattaagtcattttattatagttacagtctaaaataataaaaccgttttgtgggagaaatatgggaaacgcgtttcttggttacctctgtttttttatttaatatcgataatgtaaaccctggttcgaggtcgcttggattactgctgggactgggagagggtgaagccggaggaggaggatcgaggacggccgctgaggctgtggcatctggcctagtagccgcctggcctggggccttgctgcccatgaaagtatccgtagcgagacctaggctgtctgagcctagcgcgcagtaggtgtcgcagatcggtctgctatactactggtggtggcctggtacttatatgggctctgccgttggagatgatgggcaaggccttccgaggagccgagatgaggatttaggccttccattgagttgcgctcgggccgtcctcggtggcacgaaccagtgggccaacggggccaacgggcctaactaatcgtgtctgatggatggtcctccgttccagagaaatcagacctgctggctgtgggcctgtggctgaggagccggcagtgatccatcgagtgctactgttttcttttttcagaacagcgtgcagcaaaggctcactgtgcagtttaaacacctaaaagacccgacaagtcggtgttggtactgaggacgaacccagaccgaatgattgcctcgccctcaccacctatttcttcccatctgaggtctgcactctcaccggtagtacagcacaaacaacacactcccaaagtagacaagttgtgttcaaaccgcggatcagaaacaaataaagcgaccccgcatgcacgtcaggtaccaacccaaatcgggaccctccccccggctccggccggtgtctcccaagttaaacggccgcccgcgccaataattaccaccacaccccggtagagagatggagtagaagaagaaaaaaaatcatccgccaagccgcgatccgcgaccgcagcgcatcgacggcgcacccccctcccctccggtcgtcggtccacagcagacaggccgcgtcattgcagattactgcaccaccgcatcgcatcatcgcagcggcccgcatgaacgaacacgagcccccattttccgcgcgggttgccgagccggcagcccagcgcggacacggggagctagcggcggtcagttcagtacgtcagtcacactggtcgcgccgagagcgggacgacggcacgc

SEQ ID NO: 2324 - DNA, 1316 bp, Zea mays
  misc_feature (1)..(100): optimal_loci_54151_G1, chr2:12810690..12812005, Cluster 13
agttctaagcatagacgagtaagtatccataagttctaagcatagacgagtaagtatgagataagggaaagaatatcggatcgatcgtacgttgaactcgttcaactgagcccgacaccacctcacatcctgatccggggtgtaacaaccttttgattgtgactgacacctcttcacaccatgtataataaaagtggacaagacgagtacgcgaaccaactttcgctggtattttctcgtccctacacatatatctgatctagttctatgcgaccaccgctacaccgactcaatgccggccgtcagagcatgcgtgtaactcaacgatagctgcacacctatgacgtcatccttcaatccagaagatataacccccatttttatcgtgctagtgcctaaggttccaagcttaagctccatagagagataacacgtttgttgaagtaaagattaagattgttgttagtgacctgtgatttgttcagccaagagagaaatttaacagtcatagttgtcactataagcatgtgtaagtttgctaaaaaaagttgaaatcagatgctaatgtaaccctaatttgcactaccctaatttgcctgacactacgtggccccaattatattctaatttgcctgacactacgtggccgacgattgagaaacttgtgtattttattcaaaacaagaagcaggccagggggacaaaattgatgcagcattcactcgccaatcccatattctagtattccccggtgcggtagtcgatggtgccataatttcaatggtgttcgttactagtactccagaaagtggagtgatccccaccaaccttcacatcgtcatatgattttggattttgtccatctcaggccatcaattcgttgcctccccgcgtgagctgggatttatatataaaaaatggcgaccatgcaccatcaaatcgatctgagcatctctctcgttctggggcacaaaaggagggctccctagctagctagcaggtctgcccccacacaccctctgcaagactgcatgcgtcacatatctcgaccggcctctctgatagtctgatgcatgctgggattctctgctgctagtagctagccatgcttgcgcatgcatgcatagcatatgcatgagctagtgcaagagggaatgagaagcatccggccatgtgaacgtgtgacgtgcagtgacacactgacacccgagcacatatataaaaaaagtgcaatgagccaatatgtatcaagtttttttttcaaaaaagagaagagtatcaagaacctctatgtatcactctctcactccatcccc

SEQ ID NO: 2325 - DNA, 1004 bp, Zea mays
  misc_feature (1)..(100): optimal_loci_54903_G1, chr2:16878026..16879029, Cluster 13
tgtatgatctattaattagatgagtgtaaatatagagccaacgaccaatgttcaatccatcattgtatataatatgagtaggctttattttaattaaaaacaaaaatatgtgtgttctataggttagaaatgtgtaaatgtaaaggcaataattaagattcaggctctaatttgtgtacaacctgtttagtttcggtatttgaccacggtacactgaaactgatgaatcatctaatctccgctatccaaataggaagatcgaagcggcggcagcagttcttctgggactgggagtggtggaattcaaagggaaacagcgcggccacagctcgctcacaagtgaacaaatggaaaggggacaaaaaggatgcactggtccaaccacatcccggaggtccaaagtaaagccaagccgttgccatgccacatggagctgaaagcctgaaacacaatccacgacactacgagtccaccatttttaaaacacctgagaacaaaacgttactcttatcctcccccggccggcactcggcagcctccggtcagactcagacataccgtgctcgcgcccctacgcaaattgcagtccctctgtgaaatgcccctgctccagctggtcgatcagctagccctacgcggctatacgcctctacccagcccagccacgctcggcccacgccagcctttgactccgtcatgccgaccggccggccggcgacagcgacatggacatcgggggcaccgcatggacggaacggaaactcgtacaagcgacggcgagaggccggccggggatggagatggaggcgatgaagctagtgatctgatctgaagtcgtatcaagacagtgcaggcgtatgcgtacgtctctctatgcgatgcatgcatgatgcgtacggtactacgcgcaagaagcgaccacagaatctctaggcgctggatttgccaatgccaaatcgtgtcacaccacttgctttgcatcgctagctctagccctagcttgg

SEQ ID NO: 2326 - DNA, 1179 bp, Zea mays
  misc_feature (1)..(100): optimal_loci_55493_G1, chr2:20003156..20004334, Cluster 13
ttactgttgtttcataagccgatcgggctgtgttttgttttagttaacaggaatcggccggcatctgccctctccagataacacacttgtattatggcgacctgcagactagaacacctgtcgtttttacctacccgtccctgcactgcatacgtactgtacgtctaaacaaagacaggggcatgctagtacatcaggccgggccgtgcccaatggacggcgtccagcaataaaaaaacctcatcttttttctactgaaagatacatacgattgagaaagacttcatctgctgctacaactaacaaagggtgcaaacctaatacccatcgccatctgccaattaaacgattgagctatatggatgcaattaaagtggcgtgcatgtgtgaccggtccgggattgtacatgatctcattctcaggaggtactcaggtccgagtgtttcacctaaccggctaacccggcgtgtatgagcctagctagccaatcgagtattattctaacctcgtcaatctgtgaatgtgcagcaggtaaaggatctttaatttggcatagccaaacacaataatctgtacccttattagagctagctagctgtataccggcggccgctgtactactactactacccatgcatgcttatcaatcaatcagttcattaggatatgacgtgcccgcaatgatgcggttgacttgggaggagctggcggccgatgcaaattttataaccagcgtcagaaaaatgatcacgtcgaatcagagaacagcgctatatatgcgcacacgcagcgacgacgacgacgacgtcgcctttgcattgcatgagaggctgctttcacgtagaattccgcggcccctaaaatatgaaatcgacggctgcatcgacgcccacgcctaggaatttgcccggtggcgacatggactattgaattggcggttggttggcgagggacatcagagtgacaatgcacccggcgaaaactcctccgcttgcgggtgcggcgtgacgatggcgagtgcggagtagtacgtcgacatggcaacggcacgggccggccacttgtaatttgtaaagcgccctcgctttttgaacaagtcaggtcggttaaagtcagggtaaaaaggtgaaacaagttataaattggaatggagggagtataactcatcaagtagccag

SEQ ID NO: 2327 - DNA, 1027 bp, Zea mays
  misc_feature (1)..(100): optimal_loci_55528_G1, chr2:20107483..20108509, Cluster 13
tgatatatttgtaatacagcctatagctagctagcattcattctaggcattgacattcacccagtgttactgacacagtctgacactcaactgggttaacgagtagtagtgggcactacctaaactaaccatgcatctctagctgaagcactgccactaggctagaagaagtgtgctgtgctgaccgtgtgtggtgaaggctgaacggtaagcttctgatccgtggatctcattcgtgttcagttggttttaactagtggagcatgtggcctgcagtaagacgcggcagcatgcgagtcggtcttcttcgtattcttggtggaaaatagttagtcagactccgtcccggaaaaaaactatcagtgaaccgatcaacaataaacgtgcagtgatactattagcataatcatgcaacgggagaaagagcgcaggcaagtggcggcgatgccagcatacaaaaatgcgatggcagatcgatcaaggggcggatccaggaggcaagtggcggtggcgcttgcgtacaggatgcgtatatatgcaggcgggcgggggtgcaaatattatgctcggcgcgatcgtgggcgcgagtctgccggccggcccaggtggccaggcgcgcgcccgacctaacgacaaacacggaggcgtcggagctggacaaaccaaatctcggccagcagcatttcgccggagtccgtccgtccccgacctgcgcagcatatttcgcatatactgcacagtagtgtagtagcactagtagtatagtatatgtttagaagcatcggtgagagtacttcttttctttctcggtacagatccgtaacgagagagagagagagaaaaaaaaaatgtaccccaccagtggcccttgagtaaacactagagacacatcatatcggtggcacacgtgcacggctggctggaatcaaccagccattgttaacacgcattttcaacaacgcctctccaaaccgagtccgagccgtgcgattaccgcattccacgggcgtggacgcacagttcccgg

SEQ ID NO: 2328 - DNA, 1097 bp, Zea mays
  misc_feature (1)..(100): optimal_loci_56086_G1, chr2:23117723..23118819, Cluster 13
ggtcacgatcctctgacggtttaaaaaaaaaaagcgaaaccgagatgagggaataatattgccatttgctgccaacgccagcacagagaaagagcacgcacgcgcatcatcggtagctcctcaattcctcgtctgaacgaacctgggctaggcagctgccagctagctgcagtagttagtttgcttactggtcgtcatcacatcagctagcgcctatagccctagcagcagcagctcatggagttgttggcgccggagcgagatcagcgaggccattaacaactgagcaagcgcgcgccttcgcacgagctagctttaactggctgcataccagtgcatgacgcagacgcttgcgccatgcatggcctagctactatggcttaggagagcaaaagaattctcgtaattagccaggccagccgccagtcgagaagaatgctgcacaactggctggccttagcagtagttaataccagtagcagctagggcaactgggcaagctagcatcgtcttctcggtcctgcaccacacaattattgacaagttgttcgatccgtggaaaaaaaattaaacactgaaccaaaacaggccgggtgcaggctgcggcaggattattatggttatctgatgcacagacagtggcagctaataaaacagggggtgcaggctgcggaactggtatattttaggcgctaatagtctgtgtcaacgatcaaggagcaggatcgattgctgtcaatgtcatccttttcccggcctgagttgcgtgcgcgacatctttattcctgacggacacgaactattaacgacggaaggttcgccaaagctagtaggccgccccagttcctgttcgcacagcagggaacagagacatgctggatggatcggccgtgtggagaaagggacagggacgacgacggtggaaaatgttactgggtttaatctacgtgcatgcatgccgaaacgcatcgatcagcacgcatatatgctggcaagcggcggtggagacaccatcgtacgtcagctctccaaagaaaaacaaccggcctcactacttctctaggtcacttcagggaaagcgcgggagttttctactc

SEQ ID NO: 2329 - DNA, 1270 bp, Zea mays
  misc_feature (1)..(100): optimal_loci_56846_G1, chr2:27573149..27574418, Cluster 13
caatacttgcttttacacccgttgccaaacgaggccgtaatgggattgagtaggaggtatggattcactcaattcatacctatattaaatttatgatggaatttttatcccatgtaaccgaacaagttctgtcggagcaacggaatcggaatcgatctcagagggcctcctttacgcgaatatatggaatcgcgcggccccccgcctgggcggatcggatccatgtccagagtcgcaggggcaagcgcaggctgggagcgagcgagcgagtgacagctgcggcgagcaagttgcaggcggcgaggaaaggcggccacccatagttgcgggagcaccagcgcactctgccggggaaagactgggagggaacagtgcctgggtggcctctggaatctccgtgccccaagtggattctgtcagcgtggctgccactcgctcgcgcccagcagcctttttctcctctctccctttctctcctgcaaggcctgcaaccaaggaacctgatgtgctcgtggagtggagggatctggaatactagaagcaaactataggcgttagattctgcgccaagttggtgttggtttcatcgcctctatattttgcgctgcatcttttggccggaccgaataaagcgatccgatcgtggctcctgctcccacacgcacactctctactcttctctgccctggttggaatggataaagccagcgcagcgtgcctccaagtagtccaagcatcatactacatatacccttcaccccgcccccctatttgttctactggtgctttgctttgcgcgtacgaataaataaggccatagtgtgcgtcccatcgtcgcttcggacttcactgtggttcgctcggtggatcgaccggtcgccgtctcctacctacgcggctcgggtgccacagggtggtgagcgatgacgccggctacagcttccaggcgcgcgaatcaatacgtagatagaaacgtcgtcgttgctgactgctgagccatgttgtctgagctgagcgtgacggtgcccccaggaaaacggacgtggcgctgcagcgggaaaggaagaacgcgtgcccggtggtgtgatgggctgatgggccgcgtcgcggttttcggtgggcccgggctcccacttccgagggagggaaggaaggagggggtcgagggaccacccgaaaggccgaaacgggcaacgctgggccactgctactgtagtctacagccggctggctctcagtcactcactggcgacttgtcgagtgttgtaaa

SEQ ID NO: 2330 - DNA, 1111 bp, Zea mays
  misc_feature (1)..(100): optimal_loci_56925_G1, chr2:27959842..27960952, Cluster 13
accgtatagtctttacttaaaacacgtcaggttagaattgttctatgctgacgcggaacggcggaacttggtacgcggaacggcggaacttggtggaggttgcggctctccgtcgctctcgcccgggccccagtcaccacggcccactggtccgttatttctagatagatagaggtttcttggatccgccaaaaccggggtgtccggtcctgaaacggcaacaatttcttgacgctgacacgacgggtaaccgccgtccctaccacccggggtgtcagaactgcatccatctgcatacactccaatgactcccatgccaaaaaaacaaagcgctatccaataatcggcattgctgatgtgtccgtactgtaggagtagtacgcatcatttgttccacgatggcgaccgatcaaccaaaggaaaaaaaaagtttgcggaaacagttccatctattctcccggcggcacgcacgggcagcgtggttggttaccatctaaaaacagtagtggaggtcaaactgtacccgagccaacagtgtccagctggtcacactaataacgctgtcgctgcaagaattgagatgatcttgtcccatgcagaactgctcggaatcggtggccatcacctctctgttcagagctattttccgtcgtcgtcacacatatataggtactgttcaaatgcgacaagtggctagtggaatccgcacattgtaaccgtcgatcgatgcaacaggacaagcaggcaggaacgctcttccaggtcaacacatagctgcagtccctgcaagctgagaagcgagctcactgtctcaaactctgaaattttcgtctccgacgtcgcgcggtgacaggttcacaatcacagctcgggaagtctctggctctggcatcaaaccagacatatctaatggccgatcgcgtcggatgacgatggctccagcgaggccctcctgactggtttcgccaaccggacgagggttagacaacgcatgtgcagttgtgcggtgtgccgaattgccaatcgatgacggattcacggtctcaagttcttgagagcccagacaaaatttccggtggctatcgttatctcgtatgatgcactgcttcct

SEQ ID NO: 2331 - DNA, 1127 bp, Zea mays
  misc_feature (1)..(100): optimal_loci_57176_G1, chr2:29283897..29285023, Cluster 13
ctctctgtctatatataaaagaactttatacaagatgcaaataacaatcaagtgccacgtacagctcacagggctcgaaaagaatgctttgaccgacgaactgacaaacagggctacgtcatttggaagtttccaagatgctcatgaagagctaattaaacaaatcactcgctcgctattaccagcatgcatgcatgagggcaaaaagcaactcggttgccaagtccaaatccgccagaccatttgtttgcaagcgtggaagataagagcacggcgtactaccgtatgctaatcgctgataagagcacggcgtactaccgtatgctaatcgctcacggtgtgttgtcagatgcgtacaagtgtacaatgccatgttctgcagccgatcacgacgacgacgcagcgtgcagctttgcttcgctggtgctgagtagctgcacggctggcggatagggtggtggacctgacctgcactgcacgccgtgtgccgccttcctttgcccgtgcaagtgcgcccgcgatgcataaggaccgaggatagcgcacggcggcacagcaaacacagcatgcaacacgctttttgactcagggaaattgttcttttgggctgtgtttggtttcaagcatgcttctctctgcatttactcattaatttagttttagtgactaatgataacataaaattgttatgactaacatgtgctttttaagttaggttgcagtaaacttcggatgagtgtgcccttgtactgcatgagagttacactgtgtcgggtgtgtaacatatgaggtgcaccgaacagggcactcggagagcttgcaaaagtggtctcacacattttataccaccaaatagtgatctgtatttgagaggcctaatactcaccgaatgtttcaggtgtgccaccgacatggcactagacaagatactcagagagatgtacaaactatatatctccggattatattcaccagatgtgtacgatttgacacatgtatcagatgccacgtacaataatggctagtttcataatctagctgttgcgaaagcactgacattgtatgctatagtgggttaggaaaatcacatatcttttctgccttttagatctttgcactatctacgt

SEQ ID NO: 2332 - DNA, 1363 bp, Zea mays
  misc_feature (1)..(100): optimal_loci_57183_G1, chr2:29333012..29334374, Cluster 13
caaacggtttagatggataataatttatccttactcactcaaattcaataacaatattgtttagatcatccccatctctccccacgacccgccgccccaacctacctctcccccgcgtcctctctctctcactcgtgttgtcatcgccacggctatcaaccccttctctcgtgccacacgtgtccctgtcatcctctccctcttactcgtgttgccggcgccgtggctgttaacccttctctcgcgtcaacgctatcaccgtcgacccctcttcggcatttaacacgtgctatatgctagtataggcactgttcagcggccatgcaacaagcccactaaatagtatggtgtccagcacagcagccatggcagcaacatccttctaccagccacccaggggtcaagcatagcaacctccgcaggaccaactggctcctcagtgatcatcacacgtctatgtagatctacgttaattagcctcggtagtaaattgttcactttagatgcctaatctagaaagattaaagaaagcaatagatgatataaggactatctaatagatgacgattttgtaaaatacaacaaaaatgctaagtttatgaagtttaacgataatagtgataaatttcgaattttatctgaagtcatatgtttttcacagacgtttgttcttgtgtttctcttgacaactgagaatacggctatccacgatggcagtgcgttttcagttgagcggccaaggcccatgggtgagcagcaggccgtgaactttttcgtggagaccgagcatggagagcgatgtggaacgacaccaacgatacgaattgcgaaccaaatgacgcagcgaggactgagtacccaaactagaggatgggagctgaagccatcctgcatattcaaacttccctaccccttcatttattctattaatttatatatggccatcaaatttgaaaactgttgcagtttcttaaggccatcctgcacatgtttgggctgggcgggcggtgcctccaccactgtcctgatcctaccccctttatataacaaaggtgacgttctgtctcaaagacacgatcacttctgtctcaaagacacgatcacacgagaaacaatcaatctactgcatattagagttttagacatgagagtcctcgactcctcggtgctgcacaatctcagacttctctattcctaaaccagcgtgatgactatgacaaagaggatagtgtcttcgaaaccaacctgcacggattgtggcaaattggggttttagcagcgatcacgtgactactcgtcgaattgacctgcactaccacatctatgcacttcaacatcactgtgattctgtgaactccataga

SEQ ID NO: 2333 - DNA, 1329 bp, Zea mays
  misc_feature (1)..(100): optimal_loci_61934_G1, chr2:56790074..56791402, Cluster 13
gccaggtctcgcggctagtgggcgtgcggcggtgcgtgcgtgcgtgctacttgggattcagcgtagtggaggagcgggaccggatctggaacgacgcaaggagtacgcctggatgcttccgatgtgccttcgctctgaatttctgaatctgttcctccatggtgccttggacacgggcggattggcggcctctcatcggctggaaccagaaccaccccctttcaaacggggctgctgccatgagcatgcctgcatggctgcatatgtcgagccgatcagaccaataaaccctacgtacgtgcgggtttggtaactaaaaataactagtaaactaaccttcacgtacggcttcaccttaatgttgcgaatgagctagattatcgatatccaaattggagcaagatcgacgattataaaaaataattgttagggcagggcaacagaggacgatcgaatgctcaccatgaaaaggagaaaaagagaaaagcaagtatatatatatatatatatataaaggattcaagaggagtcaagacaaagctaggcatagctatggcatttcatttttgtcaatcaagacataatagcgcgcgtgatcggatttaggacaaatatagttgtaccgctaaaaagaagagctagataattcagtatgcgtgtcggaatcatacacattacgtacagacctaagcggcacacacataagagcaaccgattgctttcataagatacatgtgcacgcttggtaaaatattttgagaattagaatgcttgacaagacatgggaaaatattttcataagatacatgtgcaccggctacaaagtcaactcatacatattgcacagatttcaaccgagcacagtgcatgcagtccgatgtttgtacgtggtgcattatacatggttgttgcatctcgtgatactagctgagcagattagactagttctactcttattactcttagtgattactgtcacctagacgatcccggatttatgggaccattgaatgactattttgtagcggagaaggataagccagtatagagcatttggtctatgtgtgtggatcaaggaggcaactagctagacccttgcatgtgtgcttcaatatgagacaacttgggagtcttgacccttcgatatctcacaaaacatcaaagttttcataaccctctttatattacgcatttatttttatgcattttacattcctagagttatcatgttagtgtagggttggtacctaaggtgcaaagcttatgtataagcaatagaacaccggttaggaacaacaggtcaatttagctaagcgatacatcccatga

SEQ ID NO: 2334 - DNA, 1217 bp, Zea mays
  misc_feature (1)..(100): optimal_loci_62922_G1, chr2:61892650..61893866, Cluster 13
gatgaatgaaagctaattaaagaaaaaaaacaagattagaatatctgctacctgcacataccaataatatccgtattatttacatccctacctgcacatcaacctagttaagagactcgttgtctcagactccagtccagcatcgcttggtctactgtgagtctgcgaccgtggcgtgttactgttatccaaaggacgaggatcactggtcacgcttcactggccaatcagcaacgcatgccccagttgcaagttgcaaagatattcacgggacgggacacgggaggcggttaaattattggcagccgaggggaggagaccacgcgcacacgtcttttccgcatgtgagcgtctgtgatcaggttttgcccggcgagccagggcggcggcggcggaaacggcaacggaacgagaggaggccgggcttgcgcacgtctttcccagatggagcggcttctttaatgacggcgacaaaagggaggtaaaggggttggtcaactcgtcgccggcggggccgggctcaaccgtcctgcacacgcacgtccgccggcggctcctttgtctcgatgagccggtgcaagccgcttgcatgcagccagttgccatgccaaagctgccgctatagtagactactagtagtgctctgctagctcgagtgagcgtgacgggcaacggtaacgcacgaggcagagaggagggcggggccaggccacacacggtgacacgggtcctgctttggtttttttttttttttgccttcgcccaccaaaattaaattataaaaggtaaaaaatatcaccaaaagttatctttcatctcagcgtctgacgaccaactccgatccttcgcaggcgtaacctcacttggcccaccaggtaggggattccatgaatatatatataccctatgctagtttgtcaacgacgactgttttggcaattattgctaagtttatcagcccaaattaccccgaccgtgttattttattttgaaacgcaataatttcattttttttctacggccgccagttgcattgtgtgtatcgtcatttgtgctccataattgcgaggggcaaattaaatttccttatctttctaattttgctccgtactccgtctgtgtctgatgaatcagtcaattcttagagctgttgtcacatttttcttagaaacctgacagaatctaaaaaatgatttattcagggagtactttcatat

SEQ ID NO: 2335 - DNA, 1154 bp, Zea mays
  misc_feature (1)..(100): optimal_loci_7054_G1, chr1:36354474..36355627, Cluster 13
tttaactttagttctcaatctcgcgatgtaccccacaaattcactgttgaaaattcctatacatttgccacactgcataggggatatcacgctgatcatagtagatatgatggtagcatgagctttccacaaggagaggagatattatttggaacctttaggttcatcgctgagaacctttagaatctcaagctttccctagaaaccccagcgactttgacattcttcatccaagattttatagatcgaatttgcacttcatcttaaactccatgtcgacaccaacctgaattcgggctaatctctgactcgaactctgacaccaactcaaattgcttgggagaccagattattttcatggtagacttcaggaattaggacggttagtcttatgaccatgacaacactgacgacaacccaatgatgagatgacagagacaccaagaagagttgtggtcaacttccaaggtcaataggtctatgccacgctgacactgaacatcatgacaatgaagctcctattagacaggattactccactgccccgtggacgagggttcaggggtaggagtctccacgatcatgcccaccatcgttgttgcagcttctgtctaggtcggactcttaggtgatggcactaatgacacctgaagaatggccaggcttccttgacatggggcctctggatgtgaagcttggcctagtgatgacagggagacctggaccccttgctcccctcgttgggttgagcaggagtggggatggccacctctgctttctttggacatgtttgggtctcactgaccaagggctcgaacaaatatcacttgatgacctcctcatcgctgaagtcgtcgtcaagatccttatcgtcattatcagtatcctcatcctcatcatcgttgatcactagcctccattagtgagaatcatcccttcgaatcttttgatcccttttcctcttcttctcatccttatgcttcttcaccttggcggtggagcggttcacagcatgcacaaccacatcttcagggagcgacacgtagaaaaggtggatgcagaaatcagactacaagcaaagaattgtaaagattcaaaaaataaagacaccaaaacaaagaggtaagaaactcacaacatccaccatgccatgt

SEQ ID NO: 2336 - DNA, 1341 bp, Zea mays
  misc_feature (1)..(100): optimal_loci_80795_G1, chr2:175707614..175708954, Cluster 13
aaggtagtgatttgacagaggaaaagagaagcaggagaaacgcgcgttggcgacgaaatgaaagcgctgctttattgcaccccaaaaaaaacattttattatttgtcctttacttgttctggtggtagttgctctccacccaccccaaaggccaaaggctaccactgtctccctgtgcttgtcttcccggccattgattggccccacatggaatgtgatggacagcagcacaagtttggcctcatcagcacaagttttttcccctcatcagtctccacccggccggcccctgccgtctccatctccatcgggctatacattgcagtagtcagtagtgaccttctttctgcttcttaccaagatatggactatatacattagcagcagcagcagcttcctgcagattcttttttgtttattttgctccgcaataaaaatgaatcaaatcaaagtcaaacacacatagcatatacagtgctatggtgattgtaaacttgatgaagaatacccggagaaaaggacacccatccagaagctagctacaggtatgcaggaaacataaccaactattaagcacatgttctcgtcaatctgaagattctccaacgattgctctgtcaaaacacgcatgctctattaactgtgtataggcacggaaactggagtacccaaccgaacgctattccctattcgtcgtgtgatgtgatgcgatgagatggtatgtgatggctcagtttccacgagtaggaacaaacaatgggccgcaaaagatgttggttctatatataagttgtcatatatttttatgctaaacttatctaatgtgtctaatcatttatagcggttcaaattctgtggtatagtttgacacgtctaagagaattctaccacaattttatatgtaagcagggagaaaaaaatcttatcggaactatgactcaaacacatttctagcttgattaaacttgcattagacgtgtcaaattatggcaagtaacgtaacaaattaaattacccgtactactcacaacagtatatacgcaggcaggtgcagcactgtttccgaccacaacactttgcaggcggccaggcgtgcgcccgacttctccctcacgtcagggcggtcgtcactcgctggcgtcatcacctatcaactctctctccctttcatcaacgtgtagcggtcccagtgattagcttccacgttacctggccaatggggagaaagagagctctgacttcaccgcgcctccaaaaatcaaagtttccaccactcattctttatccctctctactaggaacgcctactcgcaagcactcaagctcacctcgccacagata

SEQ ID NO: 2337 - DNA, 1365 bp, Zea mays
  misc_feature (1)..(100): optimal_loci_82562_G1, chr2:184911014..184912378, Cluster 13
aaataaatatatcaataactattatttgatatatataatagcggtagctaagtatggacaactggttattaaaaaaataaggctcgagcattcagattgaccaggccctcgtccctccaaaaccgatagccggccctgctgctcctccgtctacatcgctctctctctctctctcgcgtccacgatgcacgatgaggcggtcgccatggtcagaaggccacgggtcatggctagcggctccgtatccggccccgggcctgcgcgaagctcgccaactgccgcctccgtgactgtcgctgtcctcgtccggaacggccaccaccggctgcccgctcggtgtgctctgttctgagagagaaaggaccgctgcgaggcgagaatagaacgagggcccacagctgtgcgtgggccggcctccacctggttaagcctctgcgcccgccatggcactgggccggccaggcccagatgttctcgttacataattctgcaatttgaatcagtctagaaaagcttaggggccatggattgaatctagtctctattttatagtctagtctctattttataatagaaagtggaagaaaaaacatgtctcccactctctaacccctcaaaaattacttcataacctatttgccaaactgttttcgtcaaatatatttaattctgctagagaatcactctattaaagaatcgactctcgcaaagagaatcatggaacggagctctatcaaacgagtccttaatagcatgtgaatctagaaaactgaggactatagtttgatagaggttcatctgaacctgattctctattggagtcaattctttgagccaagtgaaattacagttcacattaattctctttgattatctagcattaactctaaaatcatggtagatgatcacttcacggaatcggaaaaaggctgcttctttttagttgtcagctcttggttcattttagaaaatcattccatagaatcaacggataatcactttatctctaaaatgctgaattcgttaatgaatcagctaccctaccaaagcgggcctgaaactccacggacgacgaattttggtcgcttgcatttgtatccgtgcgagaatctgacgacttgagcagcgcaagtgctagtctgcgcgatctggtggcctagcttcccgtgggatctaccaggccaggaatgcaggaccaaaccgccgcccatgcatgtgtctgacccttcgcttggtcgggcagcaagccagcctgctgtccggcttggttgtacttttactgagcagcaaagacattatatttgaataataaaaagttgtagtgctatatatacgtatataatctgcacattatctaccttggtt

SEQ ID NO: 2338 - DNA, 1010 bp, Zea mays
  misc_feature (1)..(100): optimal_loci_82628_G1, chr2:185244719..185245728, Cluster 13
tttaatatgaagtgaacagggtggatatatatccactgaaccctccagcgcaacggtcaataccaaatagttttacatgggtcgatactgaccagcggagcgggcccgctgtaccaatcgacgttgaagcaggactgatcgataccggccacgagttgaaccatgtcacatgtcgttatctcgttggaacgaggccaagggcggcaagctcgacatggaaagcatcgcctcgcctcgcctggcttgtagctttcgcctgtcgcgagcgtctttggacgcaaccacttcgtacgtaggagtcggtgcacagcacttttgccggctttcctagcaggaaggaagaacacatcaagcgtacgacatttccattttttatatttcatcctcgtgtatcacagtcagtcactttgacgcaccgaaggaaagaaaaaatgaaaaacaaaaagaacacgaaggaaagcttgtccatggagtaggtgcggtgcgagggtctctgctgctggtgccccgtgacccagacgattctcgtcgaattcgtgtgggaaacaaaccatcgtgcatggatttggtcggttagccgttcgtgggtttggaatctaaagccgatgaacgaacgtttttttttttggcccatgtcaaggtggtgacgcgccgcaggttggacttggacctgcggttccgtttccggtttgttggtggtgcatcggttgttcagggcctcgatcggtctgcgtctgcatcctcgcgccgggtagttggacggccgacgtgtgcgctgttggtgggtgggtgaaccatggagcctgccaggctggtggcaacacggccatcatcatcttcatgccgctttggtgcattgtgcatttgtgcgttgaaaggagatgagagctgccgtttcgatttttgaaacctgaattcttgggtggccgactgttgcctcgcgccctcgcccatatgtagacacgccaacacatccagtttacaagtgggcggcattgtctgatggacgg

SEQ ID NO: 2339 - DNA, 1307 bp, Zea mays
  misc_feature (1)..(100): optimal_loci_82742_G1, chr2:185783684..185784990, Cluster 13
  modified_base (1178)..(1178): a, c, g, or t
  misc_feature (1178)..(1277): n is a, c, g, or t
  modified_base (1179)..(1179): a, c, g, or t
  modified_base (1180)..(1180): a, c, g, or t
  modified_base (1181)..(1181): a, c, g, or t
  modified_base (1182)..(1182): a, c, g, or t
  modified_base (1183)..(1183): a, c, g, or t
  modified_base (1184)..(1184): a, c, g, or t
  modified_base (1185)..(1185): a, c, g, or t
  modified_base (1186)..(1186): a, c, g, or t
  modified_base (1187)..(1187): a, c, g, or t
  modified_base (1188)..(1188): a, c, g, or t
  modified_base (1189)..(1189): a, c, g, or t
  modified_base (1190)..(1190): a, c, g, or t
  modified_base (1191)..(1191): a, c, g, or t
  modified_base (1192)..(1192): a, c, g, or t
  modified_base (1193)..(1193): a, c, g, or t
  modified_base (1194)..(1194): a, c, g, or t
  modified_base (1195)..(1195): a, c, g, or t
  modified_base (1196)..(1196): a, c, g, or t
  modified_base (1197)..(1197): a, c, g, or t
  modified_base (1198)..(1198): a, c, g, or t
  modified_base (1199)..(1199): a, c, g, or t
  modified_base (1200)..(1200): a, c, g, or t
  modified_base (1201)..(1201): a, c, g, or t
  modified_base (1202)..(1202): a, c, g, or t
  modified_base (1203)..(1203): a, c, g, or t
  modified_base (1204)..(1204): a, c, g, or t
  modified_base (1205)..(1205): a, c, g, or t
  modified_base (1206)..(1206): a, c, g, or t
  modified_base (1207)..(1207): a, c, g, or t
  modified_base (1208)..(1208): a, c, g, or t
  modified_base (1209)..(1209): a, c, g, or t
  modified_base (1210)..(1210): a, c, g, or t
  modified_base (1211)..(1211): a, c, g, or t
  modified_base (1212)..(1212): a, c, g, or t
  modified_base (1213)..(1213): a, c, g, or t
  modified_base (1214)..(1214): a, c, g, or t
  modified_base (1215)..(1215): a, c, g, or t
  modified_base (1216)..(1216): a, c, g, or t
  modified_base (1217)..(1217): a, c, g, or t
  modified_base (1218)..(1218): a, c, g, or t
  modified_base (1219)..(1219): a, c, g, or t
  modified_base (1220)..(1220): a, c, g, or t
  modified_base (1221)..(1221): a, c, g, or t
  modified_base (1222)..(1222): a, c, g, or t
  modified_base (1223)..(1223): a, c, g, or t
  modified_base (1224)..(1224): a, c, g, or t
  modified_base (1225)..(1225): a, c, g, or t
  modified_base (1226)..(1226): a, c, g, or t
  modified_base (1227)..(1227): a, c, g, or t
  modified_base (1228)..(1228): a, c, g, or t
  modified_base (1229)..(1229): a, c, g, or t
  modified_base (1230)..(1230): a, c, g, or t
  modified_base (1231)..(1231): a, c, g, or t
  modified_base (1232)..(1232): a, c, g, or t
  modified_base (1233)..(1233): a, c, g, or t
  modified_base (1234)..(1234): a, c, g, or t
  modified_base (1235)..(1235): a, c, g, or t
  modified_base (1236)..(1236): a, c, g, or t
  modified_base (1237)..(1237): a, c, g, or t
  modified_base (1238)..(1238): a, c, g, or t
  modified_base (1239)..(1239): a, c, g, or t
  modified_base (1240)..(1240): a, c, g, or t
  modified_base (1241)..(1241): a, c, g, or t
  modified_base (1242)..(1242): a, c, g, or t
  modified_base (1243)..(1243): a, c, g, or t
  modified_base (1244)..(1244): a, c, g, or t
  modified_base (1245)..(1245): a, c, g, or t
  modified_base (1246)..(1246): a, c, g, or t
  modified_base (1247)..(1247): a, c, g, or t
  modified_base (1248)..(1248): a, c, g, or t
  modified_base (1249)..(1249): a, c, g, or t
  modified_base (1250)..(1250): a, c, g, or t
  modified_base (1251)..(1251): a, c, g, or t
  modified_base (1252)..(1252): a, c, g, or t
  modified_base (1253)..(1253): a, c, g, or t
  modified_base (1254)..(1254): a, c, g, or t
  modified_base (1255)..(1255): a, c, g, or t
  modified_base (1256)..(1256): a, c, g, or t
  modified_base (1257)..(1257): a, c, g, or t
  modified_base (1258)..(1258): a, c, g, or t
  modified_base (1259)..(1259): a, c, g, or t
  modified_base (1260)..(1260): a, c, g, or t
  modified_base (1261)..(1261): a, c, g, or t
  modified_base (1262)..(1262): a, c, g, or t
  modified_base (1263)..(1263): a, c, g, or t
  modified_base (1264)..(1264): a, c, g, or t
  modified_base (1265)..(1265): a, c, g, or t
  modified_base (1266)..(1266): a, c, g, or t
  modified_base (1267)..(1267): a, c, g, or t
  modified_base (1268)..(1268): a, c, g, or t
  modified_base (1269)..(1269): a, c, g, or t
  modified_base (1270)..(1270): a, c, g, or t
  modified_base (1271)..(1271): a, c, g, or t
  modified_base (1272)..(1272): a, c, g, or t
  modified_base (1273)..(1273): a, c, g, or t
  modified_base (1274)..(1274): a, c, g, or t
  modified_base (1275)..(1275): a, c, g, or t
  modified_base (1276)..(1276): a, c, g, or t
  modified_base (1277)..(1277): a, c, g, or t
atggaggtgggcccctaggatcttggggcccagggcggccgccctgacagccctgtagtcagcgccggccctgtggctgtcatatgtgtggacgtacgtacgtacgggcgtatcgtgtcagaaacctttcgacaacacaatctgcgtcacattcccgaaaggcaaaggtggtgtgcacacgctcctgtcctgtgtattacttatctgagacgtgtaataatataaccaccgcccgccggtagcggtagctgatctacctcttgtcacaaacaaacaaacaaacaaacaaacaaacaaacaaacagtgcggtgcacctatttttttgcctgtaatgtacagggaggaagcagttatctgtaaaaagcacacgcacagtatagcagtagcacagtagtaaggcaggcgcacgcagttgtccctgttcttgctgatgcaaagaacggtcgagcaatttatttgtagtcctggcctggcatgcgtgtgtagccctagctaccgaactagtacgtaccagttgtgtacacagaatctgacgaggacccgcatgcattattgctcctaaagttcctgatgggcaccgcattcacatgcgactttggttgcgagatcacgagtcccctgaataatcatgtcccccgaatccatatcgctactcgaacgttgtcctgctcctgcatggtccgggcgtgctcctgttaaaacgaacgagcgggggcagccgttgggggctttaattgaagtcatgcctctgccctaaaactttggcgacacggcacttgtgcctacctccacacgcatatttacgaggcaccaaccaacccctccgggcgccgggcaccccaccccgggttttgatgtaacgaatttaacgaccgctgccgcgaaactgccttcaccgccgtcccgggcggcgaagttctgtattccccgtccggacagacggacacacaccgccgtagtacgtcgcatgcaccatcattgcagctcctcgttgggaggagtacggatagatgtcacatgggaccgggtcagacgggcggttcgaggaactggctctgctagtcgctgctaagcctgtacccgaccgatgcgaacatgccaatgctacgcacgcgatatctacgcgtctggcatcggagctggtatcaagtcaccccttgcctgtccggcaggcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatctagagattcgtcactcctggtattt

SEQ ID NO: 2340 - DNA, 1109 bp, Zea mays
  misc_feature (1)..(100): optimal_loci_82821_G1, chr2:186260823..186261931, Cluster 13
cgtggcgtggcatatctccttttcgcacggacgtcgtcgtccatcggaacctcgcggcgtggtttttcccacggcggacgacaaaagattcaccctagagagagctagctcctgctcgttatgggagctcggcactcggcagctcgctctgtcgctcgtggccactagctgctgctacacagccaccatcgcacagcaaaggcgctgctgcatcgtaagctcgtactagaacattactttacttgccaggtgccgatgggccagtgaggaacaaatggagccacccctgcgatgcgaacgaaaagtggttcttggtttggcacgcagaataaaacacgccatagcccccgtagccttcaccgcggtggattatagttgttgggtatcaagtggggatctgtttttggaacagactcatggcgtgcgcagcaccggccaagtggtaggtaccaaagagcgcatgcatggaacctgtgcactataaactgacaggctacacactgttcttcgatctataaagataaacactgttgtaaaagccggtacaaatgaaagccaaactaacaagctgtgaagcttaataacctgcaggtatactagcggcaattaactgtatcgtgcacgcgagggacattatctctatgtaaatgagtgaaggtttgatactctagaacgatgggtctacctgactgccagttagcaaaatagagacaggcagtcaaaaagacatgagcaattcattcggctcatcaaagtaaggttacagtcgggggtttctgaaattgagcttcaggttgtactgcagcagtgcaggcggagcgaggaagataacagtctcagatcgggccaacaaatttagttttagggtctggtgaatccactcaccaagacgggccggaacagaggtttctggcccatgtgaaatggggccgaacaggttttcctgccgtaggcccgactatagcaggacacggtgctgttttaagcccaaccgagcctgtacagattaaaaattggcctaaattttttagcgagcaatggtgtatgataaggccaaatggtgtttttatacaacactcttgggatgaagggttttagcgagcaatggt

SEQ ID NO: 2341 - DNA, 1288 bp, Zea mays
  misc_feature (1)..(100): optimal_loci_83471_G1, chr2:189738096..189739383, Cluster 13
ctgatcatcagtgttgctggctgcagtagcacctctaacggctaagcaagaagttttttttgttaccttcaaaaaaagcaagggttttaccggtgtataattattatatatacggagtatgggtatggcacacggaagcgggcatcgtatagatcacacacaggcacacagcagtcagtcatcacacggaaggatcggtcgtcggggcagtggtgcggtgccgcgccgtgcagtaggcggcagtggtccccgcctccccggctccccgcacgcagcttcttttccgtggcgcctttcgcgcagctagcttaggcaaaagaatttgacgtagatgcccgtcttttagcagtactaggctaggctaggcttttctcggatagttggatacaacaacatttgctttgcttggatttggtcgctcgacgccacgcactactctctcgcgtccgctttcccttcgcatgcagtggttgtgcgtctcaaggacgaaggttcagtgctttattgaaaaccgtgaggcgatgcaggtgttgactgctgctgctgctgcccagtgcccaatgccccagtctatgaggtcaccgcatctgaatgactgttgtttgttgcttcccagtttttttttgagctcaccaacatccggaggaaactggcatcatctaccctagctccaacgtgctcgtgctcctctttggtaggcttttttaggctactgtatgcagtgctttttatcaatccatttagtagaattagttaagaaacttagaaagaccggtaaaacgtagctccacctactcaccaagacatttgtttaacctcaccgatcaattcaatagttactctcgttacatagtgccggacaaggtgttggagtgtacgataaactagtatccaactccttcactaaaagaagaatgtaaactcgatattttaaactaaaaacacctgttaagtttaactaagtacataaaaccgttaatatatataactctaaataggtaattattttacaaccagtttaatgatacttatttaatactataaacattatcaattttttatagatttttattaaactggaaagttagaattgttcgttactacatacaaatggaatatcatcgacacatcgccccaacccatgtccttaattagtccttagatgcacaagcttgtcgctacatagcccttagatgcttcacttctcgcacgggtgtcaacctcgacactgtgcctttggagttacaagcaatcggaaatccatcgacatagttcaccttcgtctgga

SEQ ID NO: 2342 - DNA, 1387 bp, Zea mays
  misc_feature (1)..(100): optimal_loci_861_G1, chr1:4556443..4557829, Cluster 13
tttgtctatatagattatagttgcagcatttgcggtcgtaggacagccgaacacgcgtgaatcaccaatgtacttataatatgctaattactcacatatctacatgtatataaagaaatatatgtatttctacaattctaccttttccgtctgtatatatatacaaacattaaaacataaatatacacgtatgtacgcatgtacattaataaagtatattttaataatgtccaataatatagtgtctggtcgctttcggtatggtctccatcgcacaccctgatcgatatgatgatgaggtcattttgccgcccgtgtaacctgagccttccctgaggaatccatacacgtgctccagtactgttggcgccattttttttcctagagcgccatgcatgtgctggtttacatgcctaattaaaactacactcgtggtccagtttatttatacacgccgcatcgacgtaactatatgctcgcagactagtatagactagtcaaacaaagctgctgtctgagtaagcatcgaagctagccttgtcgtgtgtgtgtgtgtagcactgtcaaactagcacacatcgcttgaggtcaacatgtatactttgcgtgcgtgcgtgcgtgcgtggatcgggcgacgtgtcaccacccgttccagacacacacgtccaggatgaagacggttagccggccggtagccgccactgcaacaaaggattacatgaggaagaaagcattaggcatgtatcaggaacatgcaaggctggcacatgcagcagcccacagcgtaagctacagtctacacaggagctgaaaacggctggctagctactacgcacagccgatcagctggaactgtgttgctaacgtccagacactgtgcactggtacgtacgtgtgaagcggacgtgtgtggtgccctgatgcgtgccccttccacaaaagcacgtagctgcacgcgtgtggctaacagagacatctgtgtgtgtacagtagtaacactgtaccgccgtggcactggtatactgtgctgggtaaggagtgtagatcccagcaggcagctgatcgagcagacgatcctattattaaaaaggccagctcggattcgacacgcctggaaattattattgagtaagttaagaccggatccagtgtggtggtctttatcaaccaccacgttagttatctaccgcactattaatcgtgggtagagcctttatcgtcagcctacaattaccacaacgtcacattagttattcttttacagatttttatttataataaaacacgacgttttattaggaaaaaaacatcaagcacataatttataaaactaattcaaaaagttacattacttgaaaatttttaaataatacaaataaaaagtaca

SEQ ID NO: 2343 - DNA, 1012 bp, Zea mays
  misc_feature (1)..(100): optimal_loci_86764_G1, chr2:209627468..209628479, Cluster 13
tagtagaagtttattttctttttttatctttgttcgtccatagactagaagccgacaaagaaatcggtgaaaacactttttttgattctatggtgctccagtttgtctactatatatatagcaaggattccacgaaacattattgccaaatgagcccttaacgccgacagtcagcgactagaaaccattgtgaagtacgtgcatgctatgtacaagttagatgatagatgtaccgatcgaaatggtgtcgcgtctcgtcatagatccagtagagtcctcttcagttggtggccggtctttgccacgggcagcgtcatgtcggtggttctgctctctctgcagggcatggccgccagggtgccacgtctctactgccacttcttggcttcgacctgcgcctgcccatggagatcggggcatggccggcaggcggctatctagctaataagcactgcacgacacgagatggtggtactggtggccgccggcgtaggcccctagcacacgcgccatcgccatcgttaggtgctagccagctagatttttggatcggagccatgcgatgcaatgcatgcgtcggcacggcggtcgcgcaccgcacgtcttgacgcccaacgtgagaaaggatagtagtcctatgatgacgagacgagagtgacggggaaacgctggtggttgcggtaggatcacgatgtgcacctcgattgatgggtgacgcctgcatgctattgagctgagctcccatatgatgctatagcctctgtcctgaatgcattgcggttagacaagtacactgtacacatgctggtccctgtgtgcgtgcgcgtgtatagtttgtcactgtccacgccgtgtgccccgcatcgggatcccagccggattctccggaccagggcgatgatcggtgaacaatgaacattatatattgcagcttgtgtcgctgcgtctgcactgcaccacggatacatctcgatccaaggttggagcatgctttgcaatccgtatgattgga

SEQ ID NO: 2344 - DNA, 1006 bp, Zea mays
  misc_feature (1)..(100): optimal_loci_87354_G1, chr2:212462380..212463385, Cluster 13
ttaattagcttgagagtatgctttataaaactgcccaagtcttgtcctgttcatgtgcgggcgtatcgtccagtcaaaagaaacaaaagctagctagctagctagtaattaactaggcatgcatatgaatatatgattcaaaatatgtgtgccggagcaatcaaatcactctctgcatgttgttttaggctacctactacaaacaaagagttctcgatgagtacacacaaataatccaaatctaacctacgattgtattacattagcttacaagagagagagagaaaaggttcacttcgtatgatgcatgccaccaaccactactatagctagctctagctgccatatgttcgctgatatatatatatatatctgcttgtccaagttaaaatgaaaatataacccacaaaatctacagtacatcgacctgacttttccgttgcgcacttaattaaaagcttagattaattaaatgtttatatacagagagagcgcgctttgtgattgcaagagacaaggcaggtaaagctagggagagcccatgccaacccgaagaaatgtcaacaaaagcaccgtgtgatctttccggccatatcatccaatgatatgataaaatccagtcagcttccattacactaggccggccggccaccagctagctttcgtcggcgtacttgggcgcagcattcctgctgctagctagatactagcttaatttctgcatctgcatgcatgccccccggccggccactccaaaccaaaacaacacaacacgtgcatgtgtctccatcaatctgcatctaattaactaagctagctagctctgatgaaaaggcgaccgacccgagcaaagagcctgcttgcttgtagtaattgtcagttctgattgtaacagcggccaccagagcacatcttcgccaagacagtttcaaccccgaagaaacgtcgaccttttttcgagaggccgacgtggcaaatcttcgccaagacatcgatggcgtgcata

SEQ ID NO: 2345 - DNA, 1103 bp, Zea mays
  misc_feature (1)..(100): optimal_loci_908_G1, chr1:4738983..4740085, Cluster 13
  modified_base (790)..(790): a, c, g, or t
  misc_feature (790)..(889): n is a, c, g, or t
  modified_base (791)..(791): a, c, g, or t
  modified_base (792)..(792): a, c, g, or t
  modified_base (793)..(793): a, c, g, or t
  modified_base (794)..(794): a, c, g, or t
  modified_base (795)..(795): a, c, g, or t
  modified_base (796)..(796): a, c, g, or t
  modified_base (797)..(797): a, c, g, or t
  modified_base (798)..(798): a, c, g, or t
  modified_base (799)..(799): a, c, g, or t
  modified_base (800)..(800): a, c, g, or t
  modified_base (801)..(801): a, c, g, or t
  modified_base (802)..(802): a, c, g, or t
  modified_base (803)..(803): a, c, g, or t
  modified_base (804)..(804): a, c, g, or t
  modified_base (805)..(805): a, c, g, or t
  modified_base (806)..(806): a, c, g, or t
  modified_base (807)..(807): a, c, g, or t
  modified_base (808)..(808): a, c, g, or t
  modified_base (809)..(809): a, c, g, or t
  modified_base (810)..(810): a, c, g, or t
  modified_base (811)..(811): a, c, g, or t
  modified_base (812)..(812): a, c, g, or t
  modified_base (813)..(813): a, c, g, or t
  modified_base (814)..(814): a, c, g, or t
  modified_base (815)..(815): a, c, g, or t
  modified_base (816)..(816): a, c, g, or t
  modified_base (817)..(817): a, c, g, or t
  modified_base (818)..(818): a, c, g, or t
  modified_base (819)..(819): a, c, g, or t
  modified_base (820)..(820): a, c, g, or t
  modified_base (821)..(821): a, c, g, or t
  modified_base (822)..(822): a, c, g, or t
  modified_base (823)..(823): a, c, g, or t
  modified_base (824)..(824): a, c, g, or t
  modified_base (825)..(825): a, c, g, or t
  modified_base (826)..(826): a, c, g, or t
  modified_base (827)..(827): a, c, g, or t
  modified_base (828)..(828): a, c, g, or t
  modified_base (829)..(829): a, c, g, or t
  modified_base (830)..(830): a, c, g, or t
  modified_base (831)..(831): a, c, g, or t
  modified_base (832)..(832): a, c, g, or t
  modified_base (833)..(833): a, c, g, or t
  modified_base (834)..(834): a, c, g, or t
  modified_base (835)..(835): a, c, g, or t
  modified_base (836)..(836): a, c, g, or t
  modified_base (837)..(837): a, c, g, or t
  modified_base (838)..(838): a, c, g, or t
  modified_base (839)..(839): a, c, g, or t
  modified_base (840)..(840): a, c, g, or t
  modified_base (841)..(841): a, c, g, or t
  modified_base (842)..(842): a, c, g, or t
  modified_base (843)..(843): a, c, g, or t
  modified_base (844)..(844): a, c, g, or t
  modified_base (845)..(845): a, c, g, or t
  modified_base (846)..(846): a, c, g, or t
  modified_base (847)..(847): a, c, g, or t
  modified_base (848)..(848): a, c, g, or t
  modified_base (849)..(849): a, c, g, or t
  modified_base (850)..(850): a, c, g, or t
  modified_base (851)..(851): a, c, g, or t
  modified_base (852)..(852): a, c, g, or t
  modified_base (853)..(853): a, c, g, or t
  modified_base (854)..(854): a, c, g, or t
  modified_base (855)..(855): a, c, g, or t
  modified_base (856)..(856): a, c, g, or t
  modified_base (857)..(857): a, c, g, or t
  modified_base (858)..(858): a, c, g, or t
  modified_base (859)..(859): a, c, g, or t
  modified_base (860)..(860): a, c, g, or t
  modified_base (861)..(861): a, c, g, or t
  modified_base (862)..(862): a, c, g, or t
  modified_base (863)..(863): a, c, g, or t
  modified_base (864)..(864): a, c, g, or t
  modified_base (865)..(865): a, c, g, or t
  modified_base (866)..(866): a, c, g, or t
  modified_base (867)..(867): a, c, g, or t
  modified_base (868)..(868): a, c, g, or t
  modified_base (869)..(869): a, c, g, or t
  modified_base (870)..(870): a, c, g, or t
  modified_base (871)..(871): a, c, g, or t
  modified_base (872)..(872): a, c, g, or t
  modified_base (873)..(873): a, c, g, or t
  modified_base (874)..(874): a, c, g, or t
  modified_base (875)..(875): a, c, g, or t
  modified_base (876)..(876): a, c, g, or t
  modified_base (877)..(877): a, c, g, or t
  modified_base (878)..(878): a, c, g, or t
  modified_base (879)..(879): a, c, g, or t
  modified_base (880)..(880): a, c, g, or t
  modified_base (881)..(881): a, c, g, or t
  modified_base (882)..(882): a, c, g, or t
  modified_base (883)..(883): a, c, g, or t
  modified_base (884)..(884): a, c, g, or t
  modified_base (885)..(885): a, c, g, or t
  modified_base (886)..(886): a, c, g, or t
  modified_base (887)..(887): a, c, g, or t
  modified_base (888)..(888): a, c, g, or t
  modified_base (889)..(889): a, c, g, or t
aatgcttcagattaatcagcttgattcgttcgtgcatgcacgttcaaggactcctgctacctcgccctctatgaggtgggtgagaggtgatttttttcgcttctttgatctatacaccgtacccgctggacgttctggcgtgtacagtgccgtattccggccatccccgcgagccctgcccgggacggccggtacggagctctctcgttgctctctctctctgcgtggggaaacgttccataccggacactttagccgtctgtacgatgacaacctcctcttatcgtgacaagggacgaaatgccacttaattttaagtttctctatatttccggacagcttagacctgcagtaatataccactgctgaatgccttttgctgcttcttcttttttactttggccggtgaaatgatcttcactgattatttcgttattactgggctaaaactgccctttttcaaataacttgatcttcgttgctccagatatctgcgcacttgcgcattgcacagaaagattaggaatgaatattttctcaattattcgaattgcatgaaggcgactagctagtgagtcccgcgtcagcttacgtaagtaactgactggggtgagcgaacgcacacgcagggacatggcaacttgaagattgatgatctatttcctgcttgttccaaccaaatcgcagattccacctccacagccgaaagtgatatgcgccaaccatgtgagtaatggtggggtacgccccgaccttcacgatggattgtaaaatctgtttaccaacgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggttgaaaatgtagcatgaatggagagggcaatggctaaggctgcggaccggaccgactttctgatgtaactatttggaggagcggagcccgcgaggcggtatatattgtaatgctccacccagggcgggccggtacggcagatggaacggaaggaggtgtttaagcggtggtgctggagggccgtacagtttttcccaatacaaaaaaaaa

SEQ ID NO: 2346 - DNA, 1224 bp, Zea mays
  misc_feature (1)..(100): optimal_loci_913_G1, chr1:4743114..4744337, Cluster 13
cacgctcccagagtcgtccccagactctctcagtgcaagaaggggaaaaaaaaaggaaaagaaaagctgtgtagcccttttcccttttggcatggcagacctcgcatcggctcgagcttctttcacctacggttcggcacgcaggaaccagcgggagaccggagacgcacgcacgggcacggaccgtatacctaccgaggccacagcatgtagcgcagcgcgcagtgaaaacaagttaccgctgcatgcagcgctgacgtcgtgcgggcaagctaaaagctgtgacgcgcggggagccgagccccgagggagagatggtcactcagtcacccctgctcagactcagatggagacgccgggaagaggccgggaggagggaaagggccgccttggtcgcctcggagtcggtgcagatccagagaccacgcacacgcaggcaggcagagacggcccaagattttggcttcgtctccgatgcgaaaacgcgatccaccgccaccaataatgcgagacctgtcgccgatgaggccgagcacgccgcccgcccccacagtacgtaccgctgccgacgcgcgcggatttgcaccccgtaatcgtgtgtaagtactgtgcatgctcaccgcatcggtcggtggccttgcattgctttgcttcgtccatccatgcatctcggcgagtggattatattccaggccttccagccttccaggcttcctccattccggccggccgggtgccaccgtcgtagctgtagacgacgagatcgctgtatcgatcgccggcccaaatgcatgatacagcttggacgaccgtaccgctcccaggctgcaggcaccgtcgcacatcgcgggattcacagtttcaacacagacccgtttcagatacagattccagctggtgactggtgagcacatcacatgcatggcgtgcgccgcagtacgtccaacgtccgtacatcatatcatatctctatctgaacgttgcccttcctcgaatggatgagtacgtacccgtctatatcttttgtcaaccaccataccctgcctgcgccaccggagcggccggcggtcagctgtcgcctccaggccgcggaaaccaccaagcggaccgcgcgcgacgccggcgccacatgccgcaccccccccccccccccccccccggccgttcctttgtttcgtttccatttccggcttccgggtggctgctagctgggcaccatcgcga

SEQ ID NO: 2347 - DNA, 1134 bp, Zea mays
  misc_feature (1)..(100): optimal_loci_93469_G1, chr3:6662503..6663636, Cluster 13
cacataaataagagcttaaaatgatagaggctctggttttaggggcaacggaaaatcaagagcatacatcggagcctattggacatgagttttgatgatattgtcctaaaataaagttttagaattactgattcgaaactgtagaagatgctcagcctacttattctccttcggtgcaaccatattttggaatcaaacgcaccctaatactccgatactaaagccgtcgccttctttcacttttttcggaggggaacagttttatttattttgtttgtttaaaatttcgaaggcaactccaacacggcggcgagagagttgtttggtagtcgcactagctgcgccgtgcgtacatttgccaccgcaaaaaaaaaaatgttccaggattagattatcggggtcggggggcattggaagcgtatcgttggattggataaacgaagtctgcgggatatttcttatccgaatttccatccgatgatctttctgaggaagaatccatccatcccctgctctgctctgctccagcctccagctcctgtggtgtggcacggcacgtggtggttggtggcgagtggcgaccaccggacacgcccgcgcgcgcaggtgtccaggtcgagcaaaaggcccgggccacgggtgcggttgggggaggacggcgacccgcgcgccgcggcgcggccaaccacgtcgccgagggcggcgtcaagtcagaccagggggcgcccaataatggtacgggcatggcagcgatggatggcgcgaggcaggaacgatgctgccaaggagaccaatcaggcaaactgacaggattggtttctgcccccattctgtggctgctcagctccgcgcttgtccgtttgccaacccagatcttttcgtatgctgctcctcacagaacaagccgttggcatggacggagcgctggatccagctgaaaatcctcgtccggagacgtggacagagacctaacttgggcgaggaagacagatggcgacgacatagacgaccattcagcgcgtgtgcgactcattccctctgcgtacaacgtacgtactcacagtttgattttttttttgttttgattttttttgttagagtcgacgtggtggccagcaatttagcagatactac

SEQ ID NO: 2348 - DNA, 1077 bp, Zea mays
  misc_feature (1)..(100): optimal_loci_96647_G1, chr3:23791773..23792849, Cluster 13
tctaggttatttaaattacatttcacaatgatatatgcggacttagatgcacatttatggtgttttatgttgttttcataataagaattatgtgtgtaattttttttagaaaactgaacagactaatgactagtattacctgttgtgatttttaagttcaccgggttgatggctagatccttacgtttatttaagaattttaacattttgttagcaaacatgaatatagtctctttcgaaggccttcaaataatggttatataaaaaaataaaaaatatcatcctggaataattatgatcgttccaaactatggctcacgaggtggatatgtggtaggttttacccattgttcctccgtatatatttataaggtgtctttcatttatataacataaacaaacatgagccatgtggtaggagccaaagtgctttataaatgttcaaatcctttacctctattttttgatattctttattcagagtagacaactcatcaagaaagtcacgtttaaatataatagtgacagagaattgcggtcaaatcccaaatagttttggactgggagtggtacattaaatcttagataggtggtggggctttcatgcactgcactgtagaccgtagtacaggaaaacggttgccgccaccgctggagaatcaacacgacccacgctgcactgcactgcacgcatgaaggagcgggaaaccgccgtgccatctgccatactactccgtatcttgtatccgtcacacactcacagtcacactggggatgcgatgccgagatgaaacggaaacgcgtcgtggattcgtgtcgcgcgcctatcggctcctgctgacggcgacggcgggttcgaacgaacgaggccccacggcacgggcgcacacaccgtcacgacgtgacgctaaccgacacacatagcacagcaccgaaaccaccgccgccgggcccggcacgtggtgcgcgctcgccgggccggcgtggcaccgctggcgcttcctcgcctcccgtctcccaagcgcgctgtgtcgcagactcgctgcagccacagcccaaagtgacacacagacagtc

SEQ ID NO: 2349 - DNA, 1330 bp, Zea mays
  misc_feature (1)..(100): optimal_loci_64542_G1, chr2:72203716..72205045, Cluster 14
tatatatatccggttggcgcttaaaaaaaatccaagctacgcggtgtgtgtcatcgatcggttgttgcttggagagcatggaaaggctgggcatcactgggactggtagagcattgcatgggtgccctactcgactagccgactccttccttgattgctcgccggtcgcgcgcgcggcgcgcgggcccatgcaacatgcatgcatgatgaatgggggccgccgggacagggcgcccatgctggggtgcttgacctattgatcggtcggctcctcggccgcggcgcgcgcgattccaccaccaccgtcgccggtcacccgccgaagctaactagcggacacccggcgcgcggctccggcgcttttcccccatggccccatccctctcccaaagtggaaaaggggggaaaagggataagaagggacaaaaccacggaaggtacgtggaacgtgggtgagggtctggaagccaagatagggtcacgacgcatggcctaaaaagtgtcgcgaggcagggagcagccgcgtgtccgcctgctgctgctggaatggcgcggtggccgcgcgcggtgacggtgatccatgcatcctcctgtcctatgtacaacctcaaagctactacgactactactgtggtttttatactccgtatatatgagaactacaagtcggcaaggctggtctcgcctgctcttgccaagcaaagtgagtagttacacggcgctggctgatgcatgcgtgacacggtggctagctagctgttgatcccggccggcccgtggacgaacccgtacgcgtacgtgtgtttgcgttgcatcccaaacaagtgctcggttgctgttgccgtggacgatcgatcgatcggcccacgcatcacatcatcattcattccggccggatcgatcgggcactgtggaagcaacgaaaccgcgcgcagccgccactgtggcttggccttggtggcagcaggaggacgcagctgcggccggtggggcaggggcggaggcggaggcggaggcgcggagcaagcagcacagctgctactccatgcatgcatccctgagattcaaggcatcaagcaagcgtctgcgtctctgagactctgactctctgtagcgactagtggtgggcgagggtcgagtggtcgacgcagtaagctcaggtcagggccactgggccagcatcgattttatggcaagacatgggcgcgcgcgagatgggcacccacagtcgactgcccctctgcatgtggccctggcaccccgcctgcaggcctacacaacacaacagcgggagcagtcggctgcagaggatcccgtccccagaaggcca

SEQ ID NO: 2350 - DNA, 1106 bp, Zea mays
  misc_feature (1)..(100): optimal_loci_10181_G1, chr1:54131186..54132291, Cluster 14
gggtggctgggccccgcgatcacatcctcgcttgtcgccccccggccagccagccagccagagccagtcggtcacccacggttgtgctcgtctgccactgccaggcacgccgctgtgcctgtgcgctcaacgaggcgggcgctgctctcgtgctgctgctctcttctgctctcccggggccggggccgaggtcgagggggcgcgcgtgcgaacgacggaggaggaggcggtggccgtgcccctcgactcggtccggctgccgtgcggcggggctagctctctgtgcgtgcgcatgtgccggcatgtgcggcggcccccgcggtgctgtgctgcgcccatcgcccgtttgtccctcgcgctctctcgattcggacaccccagtggcgcggggaggcacctgacctgcatgtgggttaagattagagatctcttggttctcatcttgctagctgcgctgcttcgtctttgtcactgcttgcacagatagatatccgttcgtccatctaggttggtgtggtgccgggactcgactcgactgccccttcgccgcacgtacgaagtggcacgggcacatgctgcatatggggctgatccgcgcgccacggacatacgctgttcgctgtacagcccatgacgatccaaactgtaggcggccaagcgtacgtatgcgaccaacaggagcaacagctaacgccgtcgtgcattatgcagctctagtgtagggtacaccgctgtgctgtgctctcgaggtgacccccccacgcatccatgtcgcgccgtgtgccgcgtgaccttcaatgggtttggttctggctgtcgatcgaaagcgatcagacgagctcgttcgtagaattgtaagtaggcacacggcgtacttacgctgcgaatgagcatggttcgatgccccggtccacccatccatcctccatgcatggagaccgcgctacagggatccgccggaccggaacacaaacgaaggcatgcgttccttttgttttcgatcaagttctattgttatttattttttaagtaaaattaatttagtgtcacaataaatcacgatccattatcaattctactaagcccatgttcactccgtacctcct

SEQ ID NO: 2351 - DNA, 1030 bp, Zea mays
  misc_feature (1)..(100): optimal_loci_108229_G1, chr3:98438501..98439530, Cluster 14
tgtgtggcagttggatctttgccgttttactgttgtggtagattcattactcgtttggtcagaaactagccgttctttcgtaagcatatatatgattagtaatcctttggtattttacttttaaatccttctgactttctcggcaaaaacgtgttagttactcataagatgtagccctaactggtgtgcgacagattttaataaaaaagaaacagcaataggagctctggatcaaaacgtgcacggtaattaagatggcactccgcgcaagaactcgtcggcgccacaacggcaacagcaggcagtggacacccgcgaatcaacggcaagcagagaagcttcgtggacagaggagccacatgcggacgtaccatcaccatcaccacccatccatccaatccattcactcttcacttcattcattgccgtccaggtcggccggaatggggccgcgctcctgtcctgtgctccagcaacaccgaagggctagctctttgaatcgcgcagcaaacacgcacgctcgtactcctcatcacatcacacacagacacagcagcagggaccatgcatgcattcgatgcgagcttgcaaacaacacaacaaagcacatcttcagaggttgcctccgaaccataaggacaacggcagcttggttttaatcgtggagttgctgttgttgataaggatgtgacaagtctcgctcgtgcctggcgggacatgctgcccaacgcgacgccacgctacgcgacgagaagtggagcattattaccgcgtacaataggaattaataccgtctacggagtgtccttagtcgtctcatgaacgtttgtggtcgatttgcaggattttaaatcataatcgttcatctaccagcagatggctaagattagatgggagcataacgtttcgatagggtgatccgggctgccgaccgtggattggacggtccatacgcgcccggggttataacaaccgatgcgatccgagccttcagattaaaaccggacgacttcggttatgtacccttcgt

SEQ ID NO: 2352 - DNA, 1346 bp, Zea mays
  misc_feature (1)..(100): optimal_loci_111607_G1, chr3:122068092..122069437, Cluster 14
ggaggagctttcggaggagaggagccacggccgcgctcactcgctgctgctgggtgctatgggttaggtcggtagtggcttttgataatgatcatgtgtgttgtacaccctacccgttggtgaggtgacttgactggcagaggaatctccgaatctggcagtggagactgcacacgggagacgggactactccctcccatgtgttggtcaattccagaagaccggccggtcctgtctggacacgggacctctgttttttttttgctttttacagtgtggtttacttgtttgtgcaatatatttttttaaaacaaaaacaaatattatttcttcttcgaagcctggaactttcgttttgtcgacagggctgattgcgaccgcgctttgctttgtcgcgacgcgagcctgcgcgttgcgttcgtggcgtcggggagggggggggatggcaagcgccggtttgctgtattggtcacgtgatgcggctgcgcaacggccggggccagggcggtgccgccgcggcgacgggatcgcgcgtggttggtgtgacggacgggtgggggcgcaccgagcgcatgccgcctccatgaggattgaggaggccctcccgtccggatgcatcacacatgccactggcttggctggctgggacgtgatcccctgcaccggctacgtgttcttccttctcacagagaagatgctgacaaggaaaacggcggcctcgtcacggctccgacgcgatccgtgggtgggcgggcgggcgcgtccctcgccggagctggtgccgcgtgtcgccttctctgcaacgccacgtgcctgcgtgtgtgtgtgcgcgcgcgagaggtcctagtcgtcctagtccccagtgatttcgcttggaattttttttatccgaatcttgagggtctggaggagcttcatggctaccaccctcagcccgtgcgtgctgcagtgtagtggtaggtgtgaacggagcccggttctcgtccgatcgccagctttaataagcacaaggtagtagtaggtgcgaagaggagaacggccttaactaactgctctcctcacgctgccaggaatgagcttgacgacggtgccagctggcacgaccttattatttttttattactagattacaagggaaacgattgatcacggcgcaaattaagcactcgcctcatgacccgatcctccgaagccccttcgcatcacggcgctttgcggtgcttgtctttgacttttttttttcaaaactcgcaatgggtacacacagtagccgcagtctttaaaagttgattagtcttctcaatctgacctgaattttggataagtcgaactcgagccggggaaaa

SEQ ID NO: 2353 - DNA, 1129 bp, Zea mays
  misc_feature (1)..(100): optimal_loci_120574_G1, chr3:177119944..177121072, Cluster 14
ctagtaaagtatataaatttgtccgcctcttgagtgcatggtgatgggccatagatcagttctatttctcctcacaatccgccccatatcataaagcccaaccccacttcccgtttttcatgcgcgtgagggggtgtggtgttcttccgttcggttagctcgtagccgccgccgtccgtagttccctctccgcgcgtggccgccggtcccgcggcttcctcctcccgtgcgtggctgtggcgccggtcccgcggcttcctcctgagcgggcctgctcttcccgtcaggcctccgcacccacggccggatctcttcctctcgtctccacggccgccttcctaggacagccgttgcccgcgcggtgcccgcagccgcctcgtcggcgcaacgctctcttcctccccagtccctccatcggaaccaccctaagcttccttagcccattcggttctaccgaaagaatccccatcctctgtcgcgtccgccacctcctctgcggcttaccagccggactcctcaagcctcccgcttagccccctcgccggtgatggccgcggccccgccggtagccggagaagatattaaagacggcgttgaggtgtgcctgttcgatgaatcagcagatgggttctcgagaactgtgcgcgccatctcggagctcgtcgacatagagcccgaaacagacttccctgaggcggaagttgagcggctctcctcctcaataacgttcctcaggtgaaatcctttctcctggcttcctctgctctcgcactcagtcaccacaatggaatcgacaaatttcctgtgtcagcctaataggtgatcgtagacgtgatcctatactatagagacgtgcccgattttgatggagtgtattacatggaatatttcatacatatgtgggagaatttgtttaactcatagcttcggaatatatgttgtccacaagagtgactagttatcaaattgcgttattattcatgatttatttgcttggttaaaggtctacctgttccttcctcgaatatccacaagctctgcaaaaatgtgaaaagatgcaggagttacatacctgcatttgatttctcctttctttctaaatgccctgtttttcagatatatgtttttg

SEQ ID NO: 2354 - DNA, 1218 bp, Zea mays
  misc_feature (1)..(100): optimal_loci_122842_G1, chr3:188803917..188805134, Cluster 14
cctatactcatataataaaacacattattacacaagatttcagtttttcccagccatccaaaaattactgaaactcaagaaattttgaaacgtgcaagaataccaacatagcagaaatccgcgacgccaaagaccttccaaatcctcagatgccagcttctcgaaaagtgaaaactactttctcacgtgattaatcacggccgcagaccgccgcgccgaacggatccgcgaacgcggcgctgagtttaacagtccagcggcaggaacgacggcagttcaggcctcaggcggccgccgggcgccggcctgcactgcacgtccctcgcttccttgtcctcccctggccgtctgtcgggtcgggcgctcgtcgaatctggtcagaccgcaagcgagcgcccccacacaaacacgcacgcacacacagcacgactcgaacgcgtcgcgtctcttctctcttttctcccgtcctttgtccctctgccctgcaggcctctctgcctccgccccgcagttccgcacccaccctacgctctcctccctctccacggaacgcctcgcgagggaacgcccacgcagctgccgggaggattcggcgggcgtccgcctggacgcgaaatgcccgcccagaagggcccgctcccgtcgcccacccccgatgattccgaaggccgcgtcgcagtgcggcacaccgccgccagcggtgatggaggcaggagcggagcctcacatgagatggatggggaggcctccgcgcgtcaggagagcccaccgcatcggggacctcgcgacggtggtgagatgaacgacgccgcggcacacacgtcgtcttcgatgccctcggtcgtggatgtgtctgaggtttcgtttctgtttgggcggtttcgcagatcccgacgataaggaagagggtggctgcggcggaggcgacggagtcgacaccaccagcgaatcgtctctgactccgagcgccggaagcatggacgagtaagccaaataacgcccgctctattgtcatctctcaccctctgacctctcccaggttgcctaggctatccagtcacccaacgacctcgtcgtagcctcgtgtctagtgcgctagcggctagctgctagctccagttcgtagtcgtccactcgtcctgcacgctggcatccggcaaggcacgtgctgacccggtgaactgagcggagagtgttagaatagaacaatgtgctaga

SEQ ID NO: 2355 - DNA, 1280 bp, Zea mays
  misc_feature (1)..(100): optimal_loci_124151_G1, chr3:195752552..195753831, Cluster 14
ttaataacgatttcatttcattcccgcaagggattttcagggtttttctgtactccggaggagggagagtagatatatagatatagctagctctcatgctcttttcagttttcgtttggggggaaaaagcgcggcaaagtataaaggttcctcattgcaggagcaatggatttgacgtaaagatgggcacgtacaatgtgtttcgtctccgtctctctctctctctcaatcaaacgtctccagaccactcaacaacgcactgccttatctgaaactccgagggacgcttggttagtttattcccccacgaacgaatcagcgaggtacacgtacgtagacgactggagagaggtacgtactgcgtatacataccatggaccacactggtatgatatatatatatatcaagcagctaagtacatagtatataggaatatgatatgacatgctagctagctattagagatgggatacacatgcatgctagaataatggagatatattgcttttgctgcggggtgcatgattatcgatcgatgatctcgcaactcaaccatcccccaccacccccacacacacgcactcgcctagtttattaatccttcaattttccccaggagagtgctggctatctacttgacggatttactaatggatttggaagctccctttgttgccctaatggggtgcataatcactagtttcgcgccgcttagcttcgaaaagaaacccgccccggccctaggcacgacgccgtcgcccggcgggcgccgcgctgcctcgggctcaatcgcgccccccgggccaactcataaaccaattagattagatgcaggaaaagaagaagaaaaaatctttgcatgatcattgctctggaatggaattttcgtgtggaatataatgatagtccaataaacatttggccaccggccagtaatcacacaaagctacgatcgagagcccaccttttaatcaatcagtctgctgtagaaagaaaggggagttcagtgcatctcgtccgtttcttcttctccctttcagtgcgctgatgactgatggagatcgaacaatggctgctctagccaaatttacaacgaccaaacaactggtgggcggtggctaacaagctaggactaggagtactacatgttgtactcctccacacgcccgtaaatcaaatcctggagtaactaattggcaagttctgatgggactaataatgagccgcgccctagcttgatgtgatgaagctgcgctgtctagttttgtaatgccaagtg

SEQ ID NO: 2356 - DNA, 1010 bp, Zea mays
  misc_feature (1)..(100): optimal_loci_125085_G1, chr3:201296140..201297149, Cluster 14
aacacagctcgcgccttctcgttcgcatataaaaatctgctgcatcgtgcacagggcaaaggatagcgcaccgaataaatgcactgaatcaaaagactgacactcctagagggaagagagtccggccgaggtagctggggtgaacaccgcgcagttcaccgaaatggaaatgggccgtaacgccacgtcttgatgggccggcaccatcgtaccatcctttcactatcgcgtgacccagttccgacttgcacgcaccgacgcgccacgaacgaacgccatgcatgcactgctgcggaactctgccgcccgctgcgccagcgccagtatgcaccgtggtcgacggccatgtgcaggcggtgccgtcgtgtcgtcgtcgccgcgccgagcgcgtgcacgcggcgcgacgagggttagttctcgaacagcacttcagcaagctaagggggcacggtgatggggcgtacgtcgtccgcgcatcacgtacatgcatggctgcatgcatgcgtgccttgcaggtgtggcgttaatggccggtgtccggtccattttcatcagtctcctccctccaatagttcaagaatttactctcagctagctaccatcgctgtggctccataagttccatgcgtggggcaggcagtgcgcgtcggcgtggcagagcgacacggatgtggcacctgtacgagctggactgtggcttcagagggagaaatcaatggcgcgggcagaggttgtttctcgaactgtttgtgtttggacttcaagttttcaaccatccacctagcaccgagacaccgagtacagaggcacagtacgtatttggagccagctttgtgaccatgtggtggcagcagtgccaatgtatgtgtatcagttatcaaaatgccttcgggtgatcgtctgccttggattggattggattggatgcaagatatgaatatgatgcatgtgaggatgaaaacaaacgagtaacaaaccgagtataaaaataaagtagcatgtttaggagt

SEQ ID NO: 2357 - DNA, 1006 bp, Zea mays
  misc_feature (1)..(100): optimal_loci_125374_G1, chr3:202558003..202559008, Cluster 14
agcgacctgcggccagccgtgtccgctggacgcacgcggatcgggtcagatgggtggtcaggccagtacgtgaggtgaccggacggaatagacgacgatgggtacgtacgtacgtacgtatgccgctgggctgcgcgactgctaacgctactactatacgcgatgatgcccttcttgtccggcccatggatttatcaggtggatggatggatgccccttgcgagctgcgacgagcgcgagtgggcaacggcgccgtcaagcgcatgcatcccccctctcccccgcggttgtatgagacttggaggaaggcgcggcatgatggagatgcaaatggggtcgtttgtcttgtttgcctgttcgccgaggaaccgtggtggactccgtgattgagctgtgtctctctgtgtgtgtgcatgcgcatactgcacggggtcgatatgatgcgcatgcatatatatgcacgacagagatggcagacgaactcatcacgctggtggtggtctgatagatacatggacgcagactccccgcctcccgtacgtcccgttcccaatcaatcaggattcaggacaagatagccgatggcgctgggtcattggatgccatgccatccgatgcctaaaagcggcagtactgtgctggatcgatcagggtcacatctcatgactgactgcgttccctcctcctgactgtggagacatatacgagcagacgacggtagagatagcgctatcaccactattgcgcagcgcgcggttgacgatgcagcaggattacaacattctcacgtatcagcagcaccatcatcagattcactcgtactagtcacattggttgttgatcaacacgccgctacaagaacaatgtctctacgtgttatccacacgtacgtgtagagataaaaaaaacaccgtgcacatagagagagagagagagagaaacagcgacctgcagccctaggaagagaggcagccgctaggatgagtctcactactatagtacacgt

SEQ ID NO: 2358 - DNA, 1304 bp, Zea mays
  misc_feature (1)..(100): optimal_loci_127240_G1, chr3:211684567..211685870, Cluster 14
  modified_base (912)..(912): a, c, g, or t
  misc_feature (912)..(1011): n is a, c, g, or t
  modified_base (913)..(913): a, c, g, or t
  modified_base (914)..(914): a, c, g, or t
  modified_base (915)..(915): a, c, g, or t
  modified_base (916)..(916): a, c, g, or t
  modified_base (917)..(917): a, c, g, or t
  modified_base (918)..(918): a, c, g, or t
  modified_base (919)..(919): a, c, g, or t
  modified_base (920)..(920): a, c, g, or t
  modified_base (921)..(921): a, c, g, or t
  modified_base (922)..(922): a, c, g, or t
  modified_base (923)..(923): a, c, g, or t
  modified_base (924)..(924): a, c, g, or t
  modified_base (925)..(925): a, c, g, or t
  modified_base (926)..(926): a, c, g, or t
  modified_base (927)..(927): a, c, g, or t
  modified_base (928)..(928): a, c, g, or t
  modified_base (929)..(929): a, c, g, or t
  modified_base (930)..(930): a, c, g, or t
  modified_base (931)..(931): a, c, g, or t
  modified_base (932)..(932): a, c, g, or t
  modified_base (933)..(933): a, c, g, or t
  modified_base (934)..(934): a, c, g, or t
  modified_base (935)..(935): a, c, g, or t
  modified_base (936)..(936): a, c, g, or t
  modified_base (937)..(937): a, c, g, or t
  modified_base (938)..(938): a, c, g, or t
  modified_base (939)..(939): a, c, g, or t
  modified_base (940)..(940): a, c, g, or t
  modified_base (941)..(941): a, c, g, or t
  modified_base (942)..(942): a, c, g, or t
  modified_base (943)..(943): a, c, g, or t
  modified_base (944)..(944): a, c, g, or t
  modified_base (945)..(945): a, c, g, or t
  modified_base (946)..(946): a, c, g, or t
  modified_base (947)..(947): a, c, g, or t
  modified_base (948)..(948): a, c, g, or t
  modified_base (949)..(949): a, c, g, or t
  modified_base (950)..(950): a, c, g, or t
  modified_base (951)..(951): a, c, g, or t
  modified_base (952)..(952): a, c, g, or t
  modified_base (953)..(953): a, c, g, or t
  modified_base (954)..(954): a, c, g, or t
  modified_base (955)..(955): a, c, g, or t
  modified_base (956)..(956): a, c, g, or t
  modified_base (957)..(957): a, c, g, or t
  modified_base (958)..(958): a, c, g, or t
  modified_base (959)..(959): a, c, g, or t
  modified_base (960)..(960): a, c, g, or t
  modified_base (961)..(961): a, c, g, or t
  modified_base (962)..(962): a, c, g, or t
  modified_base (963)..(963): a, c, g, or t
  modified_base (964)..(964): a, c, g, or t
  modified_base (965)..(965): a, c, g, or t
  modified_base (966)..(966): a, c, g, or t
  modified_base (967)..(967): a, c, g, or t
  modified_base (968)..(968): a, c, g, or t
  modified_base (969)..(969): a, c, g, or t
  modified_base (970)..(970): a, c, g, or t
  modified_base (971)..(971): a, c, g, or t
  modified_base (972)..(972): a, c, g, or t
  modified_base (973)..(973): a, c, g, or t
  modified_base (974)..(974): a, c, g, or t
  modified_base (975)..(975): a, c, g, or t
  modified_base (976)..(976): a, c, g, or t
  modified_base (977)..(977): a, c, g, or t
  modified_base (978)..(978): a, c, g, or t
  modified_base (979)..(979): a, c, g, or t
  modified_base (980)..(980): a, c, g, or t
  modified_base (981)..(981): a, c, g, or t
  modified_base (982)..(982): a, c, g, or t
  modified_base (983)..(983): a, c, g, or t
  modified_base (984)..(984): a, c, g, or t
  modified_base (985)..(985): a, c, g, or t
  modified_base (986)..(986): a, c, g, or t
  modified_base (987)..(987): a, c, g, or t
  modified_base (988)..(988): a, c, g, or t
  modified_base (989)..(989): a, c, g, or t
  modified_base (990)..(990): a, c, g, or t
  modified_base (991)..(991): a, c, g, or t
  modified_base (992)..(992): a, c, g, or t
  modified_base (993)..(993): a, c, g, or t
  modified_base (994)..(994): a, c, g, or t
  modified_base (995)..(995): a, c, g, or t
  modified_base (996)..(996): a, c, g, or t
  modified_base (997)..(997): a, c, g, or t
  modified_base (998)..(998): a, c, g, or t
  modified_base (999)..(999): a, c, g, or t
  modified_base (1000)..(1000): a, c, g, or t
  modified_base (1001)..(1001): a, c, g, or t
  modified_base (1002)..(1002): a, c, g, or t
  modified_base (1003)..(1003): a, c, g, or t
  modified_base (1004)..(1004): a, c, g, or t
  modified_base (1005)..(1005): a, c, g, or t
  modified_base (1006)..(1006): a, c, g, or t
  modified_base (1007)..(1007): a, c, g, or t
  modified_base (1008)..(1008): a, c, g, or t
  modified_base (1009)..(1009): a, c, g, or t
  modified_base (1010)..(1010): a, c, g, or t
  modified_base (1011)..(1011): a, c, g, or t
ccaacctccacgcacgcaaacccaggatcgcccctggaccgccagctacggggatccgatacggatcccagggctgtagctagctaggcgcccgcccgcccgtcccgatcattcgcaaatctgcgttgctgcactgtagggcacgcatgccatgccatgccagttgccaccctcttctcctgcagcagctgccgctagtcgtggtcgtaggactagtagggagggcgcttcttttattttccccttttcttttctttttttcttgttcgggttttcctctcctttgtgtttgctgtgtacgaatgttttttcctttcccctatatcgatgaggcgacactgctggaactgcgccaacgctgcgttaagctgctggtaattccccctgccaagtcaaaggaggcagccgtgccagagaaagaaagcgaaagccatatgcatgcatgtggacccctccggcggcattccgtatgcttgctgccttgcttggtagtaacggccaaagcgccggcacgaccgcctccaaagcaatgctgcggccagtggccgtgtttggtgtgtttccgttcctttcctttccttgctaatatcatgtccggcaaactttggagttggattaatctatctatctgtctgtctctgtctatgctacggatgcaaagtatttgtagtagtgctacatgatgactatactatataggtggatacgtactacgtagtaagcagtgcagcatactacgtacgtggatactgtcgctggatgaacgcttatccaagcagtccatgcatgatttggcagcagcccgattctggaatcccgacagggtctgtgacgccttgtgcttcccttttttcccctcgctcattgcgtggggccagagaggagttaaacgaatcaagctgatcatcaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatcaacaaatttcgttctgtgatgtcttaagagagggagagttgaaacaagaatgaaccaaaggcgaacatcctacatgattgtgtcatgggctagaacttggtgtcactgtcattttttgttagggtgtccatggtagcgtgttgtggcaaagggtgtcaacatcggctaggtagccaaagcgatcaaagttaccatagaaggaggccacgagggagaatgtggtggagctggttagtgattagttgagagggaaacatacattgtgaaagaggagaggaggaggtagag

SEQ ID NO: 2359 - DNA, 1281 bp, Zea mays
  misc_feature (1)..(100): optimal_loci_128140_G1, chr3:215847208..215848488, Cluster 14
actaattatattataaattagaacagagagtatattgtaattcagaacagtagtatgctcggtgagtatgcgagatgaaattgagctcagtcctctaactaaggcgatcaacctaacaggatataaataactatgcactgatgcacaataaactcgctacttgcttgacctcgctcgtccatttgaccatttcccgtcgcctgctatatgcttcctagcctaaatcccaattcctctccatccgatagctaacacaacatctccactagtgtgtactgttgcttctatataccacgagaactcgtagatactagattcttggctgtggccttatgcttccgcctattcttttgaggccctgattcgtctgaatacgtaggtctctgacgaactgaactgaaccccgatggtacgtgagaaagagagctccccatggcgagagaaaggaaactgatgagtacgcgaacgcccacctccactcgttgcatcattcgcagccgcctccgtctgcttttcctgcacgcggccggtctagggcagacgcatgtgcgtgcactagctcgtttgctcttggagacggacaggtcgatcgcgcgcgcacaacctatacaatcacggagacggagctagctcctcagccactcgtcgcgcgctcctctctctctagctagttcaccctcgtgcctagtttcccgtttcaagcatcgctcccgaaatgcccggatgcccacttctacatctggctagatgtgccttccatcaccaactgggaaacttgggatagaaaaagactgggctagctaggcacgtggcattggcattgacacattgagctcgctgctcgcctaacaatcgaaactgaagcatcggccgccatagattcttagctagctaggggcagctggctggcagctctatcttgatccaacacggtatgatctagacagtgggcacgaggtccatctgtcgatctctactgctgccgattttcagagtggtcaggaattaaaaggtagctagtgtccacgtacgtgcatgtgttgattgttagaaaccatgttcggttttttcactcaacaaattgatactagcaacaagccaataagaacatgattttatcgtcgttccacgaatcgttggccatggatatatgatatggagttattattcgactagtactgaataataatactcctataagatagtataagtgtactatatatactacatacacagatgaaacacatgcctctagtggtacacgtatgaaacacttgctac

SEQ ID NO: 2360 - DNA, 1284 bp, Zea mays
  misc_feature (1)..(100): optimal_loci_128209_G1, chr3:216260479..216261762, Cluster 14
tgaaagctggaatgtgagtgtgaaagtttgcactaataaaagaaaatgaagtgtttaccttcacggcttcacctaacaaaaaaccaggcgttccattacatgcgtgcgtgcgtgcgtacgtgtccaccggcagaagaatatccgtgaagccagcgccgcatcttggtcctgacccctcactatccacccgtgtcatttggagagcactactagttttgtagcgcatcacgacaaggagtagtgggccgcctgttgggatctcggcctttcggtggatccaaagtatccaacgcaaaagcgctgtggatgcagagcaaacaaacgaaggaacacgagaggaagcattggatcggtgatgcgatgcgagcgaacatctcgcagcagcacagcacagcagcttgtacaccgggagaaacaggctttcgatttggccccaggagaaacctacctgcttgagtggcgagtgcagtacatgaacggcggccggcacggcaacacgacgagcgttgcacacacctgactacctgcccagcgggtggttcgcccagcaatgtggttttggtgtctggggagcaccgcatccaggtttttttttggtggtactattatttggtgatgattgtgacggattggagtgccacatgcaaaaaaaaaaaaaaacagctgtggcgtgtgggttgcatactgcatctgtaccagcagcacaccaaacacgttagttctgttctgacagtgaggaggagttggaccattatttacccgttacgttacatatgacttgttgctttggtaaaagaaacaagttgcgttggaagagcaggactgatgggccttttatatattggtggtgatgtcgaagaccgataatcatttgtgtccaaaatgggaaaacatatacgtatacacacccactgagatgtgagatcacccacacgacatctgtttagctttctgccctcagacgatcgcgactcgcgacgcaaaaataaaaataaaaaaaataatgatatgataattgagctggctggctggagacttgtctcgacggatatattaagagagatcaaataatacagtcacagtggtctacaataataagctcatggttaaacaacatgtgaatgctccacacttatgcatagtttactaggccacgaagccacagcacatcactaataggagaataattcggtcattcacgctcgtataaataaaaaacaaaataacttgcacaagaactaaaacaacaagccagtaacagctcacacaattattttactgagc

SEQ ID NO: 2361 - DNA, 1100 bp, Zea mays
  misc_feature (1)..(100): optimal_loci_134377_G1, chr4:14032126..14033225, Cluster 14
cttcattgttcatccgcatcgatctccaaattaacgatgccagtacttctccctttgttttacactgatcgactctttgacaggaaccgaagctgtgaagctgctaattgaactgaattgatagcaatagtgcaaacagaaggacaggacagtcaaatttaacccgacctgtgtttgagtgccgccaaaggcggcgacagtgcgacactaccaatggagccagccgccgtcacgtcacatcacgtcctgggcgtaacgcctgccgcgatttcacgcgtgcgacggcgacaggatccgatcgacgccgagccggagcgaacccggagcggaaatggcggctgttaatggcggacggcgacaccgcatgtggccgcgccgctgtcggccacaccgaccgcgcgcgtacggtacaccatgggcccatcaccctgcgtgcagcgcggtggcgtgtgctggtcgccgccgcacatcgcgcccgcggctgctgcggcacggcggcggcccgcggctgcctgtttagggagggtacatgtggacgtgtagttgtggtagcttttgcttctaaaagcaacctacctctggccggcctgaaggtctcacggagacgacaaggatgtagttcctgtgcaagtacacttctagtatcaagtaatgtgcatgccgcggcgccatgacactactgggattacggctggctaacgacctttcaaaaattcggtatgctttctattcgatcagcagcggaaatattgagtactgtttggtatatcttatattgttccattaataaaattctatcattttttctaaagtataaagatacacagttgttgtacgtgtgttcgaagaaaaaatctttaatttaattgttttgtaatatatatttcagatatttttcgaagtatagagtttggcccaataatcctactccgcatacctcggtattggcagtagcttaagccggaactatcatgttttgtgccgtttttattcacctgatctaattccacaataacccgctagtgcgttgaatcaatgttaacctatagctggaaaattgaaacaggaaaaaataatttgacttgctaatacatggtcac

SEQ ID NO: 2362 - DNA, 1284 bp, Zea mays
  misc_feature (1)..(100): optimal_loci_137076_G1, chr4:27980731..27982014, Cluster 14
tgcgggtgacggcctgacgggcaccccgacgccgacgacgcgcacagcgatggcggatccggctggctgcggcctgtggtgaacggcgcatgctgaggtggttcccgcgcgcgcgctcggcgatgcccgctcgctcggctgcccgtggcgacggtgaccggcccccagcagcacccgcgcgtcggaggcacagcggcgccgcgcgcgtgtccgcatcctgcctctgcctgccgacgacgacgctcacggctcacgtgcccgcccgcgccctgccccccgccagctcgtgtagattttttttccccacacacgcgtgcaggtgcagcgtgctggtgctgccgttttcgcaacagggcgtagctgcaagatgcgagcatcgtgcaacccttgttgttcacgtccgccccggccaggggcgtgccggtgccgcggcggggaagcaagtgcggtggggtgccaagcccaagcgtgtgataaaagctcgcgcggatgtggaggcaagaggcgaggcgacctttttcctcttgtcgtctggtctccatggcgggtcggacgcgcgcctttctcccgctcccgccatatttatttctcttggcgcgcccaccctccgtttgacttttctctttttctttttttgtgcgcatgtgatgagatctcaccggttccacgagggagttgcgggatgatttttttttaaaaaaaaaatagtaactgatagccaatctaaaatcggccagcatcccagtttaagctattaattaaagggccagcaaaagccttttcacgagtcttgtcacatgaccgtagatgtctacggggcgcactaacgggaacaggaatgtatccaagcgtagcgttgcgttgcgttgctttgcgtcgcaaggacaaggaggacgggcgatcatgacacggcaaggacaagaacacgtgcctgctcaatgctaccgctgggccgtagcccataggcctccctcacagtcacagcccatccacaaaaaaagcagtcgtgctcccacactcgaggcctacccattttctttatttaataggcacttcatcaaaaactgacccggttgcgctgctgagggatccagtgaggctgcaatcaatcagaaacacatggtagtagtagtagtcgtacgcggtatgccacacctgataaactgtcgacgccacacagatccactattgtccttctgcctcaaatttgctttccttcgaaagacaaggctaacacagggacaccgttcaaggttcgagccagactcccttcaacattttgag

SEQ ID NO: 2363 - DNA, 1145 bp, Zea mays
  misc_feature (1)..(100): optimal_loci_137604_G1, chr4:30427232..30428376, Cluster 14
tggcccttttatttgaagctcgattcgtcgtgcaatgggatctcagcagccgcgcgcgtatggaaaagggaagtgaagacacgcatgcatccatctgcttcgtcctctcttatatatcctcttggaaataaagaaatgccgtaggcctggcatcgtcttcttcttctaaattcttctaacgacggtaaacacttaaaaaagcatgctagctatttcggctgcactagaacctgacaaatggcacaatctcagttcaaacagcagcaacaataattttctgtaactaaaactactaaaccatagacctgtttaccattcaaagctagctagctcgagctaggtccagatcgaccaaaagcatcatcgcgtcaccttcttgcatttcatatataatgcggagcagcctgcatgcatggacggctaatataataaattaaactaatccccgatcacgtcgattaattaaccccgctagctagctagctcctgcaacccggccaatatgcaagttgcccggccctcacagtacgtatgtctcgaacacactatatatatattcgtcgatctattattgcgcgagatgcgacggcacgaataaatgaataatccgtggcgcctttgaacctgggaaagggaagaaaagagaggcatccgtccgtcctcgctccccctttaatttggccgccggcctttaacttgcattgcattccattgcattgcatgcccccccggcccggccggctggcttttctgaaataacaacaaagagatgccatatatattcgaccactgcaaggagctgtagttcgtacagtagatattttggactccatccctagctaagtttttttaaaaaaaatatattttataaggaaattgatataatacgacatacatttgtggatatatatatataacatcgtctttggttatggagctagctagctagtagtccccttttaaaatttttggtaaaaatggggggtgatgtgcatctgttccgctagtagtgtgatgcccttgccgccattggtctaggaacctcaaagaccatcttggtgagatgtctttgcatcgcttgaggtgacacgggcagtggctggccaggctgtggagtatgccgtgccattgcatgctatcacaag

SEQ ID NO: 2364 - DNA, 1102 bp, Zea mays
  misc_feature (1)..(100): optimal_loci_137731_G1, chr4:31348761..31349862, Cluster 14
ccgggctggggctgcgacttgtttaccgcaggcacgatgagtagctgctgctcccctctctcctcgtcttttctttgaaaccctcgctgacaccgcaacttcagggtcgatctgccagtgctcctcgtaaactaaaaggcatgcacgccgtccaaaccctagctttcctagtaaattacctgccatatgctggcgcggagaacccatatatgggcatatatacgcagggcacgtgaggcgctcagatgattcgaaatgcttatgctattctctctgtcctccgcctgcaactgtactttattatcagtagatggtgacagtcaactgatgcagcactagctagggcttggtggatgtgtgttttattattattattattattattattattatttttgtccctggctagttaacttgctccaaggtatacgtacttacttctccggctgtgtagctctcgttcccctgctggcgcgtggtttgtggtgccagcagctaggtctagaacaagctagggcatattcttgcacttgtcacattttgacttctcgcttctgaaggctacagtacagctactccagtgagtactaagataatgcggatcgagtgattagcaataatactactagtactggttccaccccctttctgtcctcttgtctgtcctgaaatatacaatggacaagggcacatagacatttgagcctagcagaagcaaggaaggtctggtagggctgcacacgctgaccgctctgcacagccagtggatggagagactccactcatcgatcgctacagctcctactgtacgcgcatgcatggtgtgtgagaaagaaacgagagcattggcagcctcgagaggaatctatatatctaggttaaggggacgttaattattatatgacatcatgcgaagttaagatatccattcacataaaaaaaaatgcatcgctaggttttgctttgaccatatggatctatatgcatgcacgagcactgatcagagctcacgtgatgtcgttatttaataatatagcgggctacctctggatctttgtctctcgctcgtcgtcaacttgcaatgtcatgtcaccaacaacaa

SEQ ID NO: 2365 - DNA, 1267 bp, Zea mays
  misc_feature (1)..(100): optimal_loci_13800_G1, chr1:75955224..75956490, Cluster 14
tacgccatctgagagcagattttcaatagttttttttgttgaaggaaactccaacagctttgtggaggcttggcgagctgtttctccgtatcatctctctggccagcacagaaggctagcccaggtgagcaggtgtaggtgaggtgctactccaaggtagcattatatatcgatcagtatatcaccctttccaggttccagcgagtggtgagttcacggacatgatacgtctaattcatgtcatggataagggaaccaattggtgcgcgtggtgggaatgtgcactgcatctaatataaatatatatatatagcttccattattgtctagattcagattgttttttgctggacggtattgataaggccagggaaaaacatcagaaaatacgattattggacgtacggataatacatactataccaattcgcaggaaaacatatctcgtgtaaataaaatttggcaacaattaacggaattgaactcacctccacatgccggtatattgaatgtgagggcgagagaagcggcaaacggccacggagtcgacaggtatgcactcaagctaggaggggccgtccacggatccatctgtacgtacgtgtgcgtcacattcatgaaccggccggacgggatctcgcagacacgcgcaggggtagctcagtagctgcttgtaacaacaactggtcaccatttatagtgcatgcatgcatgccgccatgccccccccccccccccccccaacaccccccagaactatatattctgtactgcatgcatgtaaactgacgatgagccacagcggcattattcataattaagctgacgatgcaaccaaacagcaggagcacgatgcgtgctgcgtgcatgcacgcaggccacgtagcggccggccggccggccggcctccattaaatgtttgcatgcagtgtgcttgtgtgtgcgctgctgccgctgctgggcgcgcgcgtggggcggtgcaccggatcgatcggagctagtattccctacaacgtgcagggatcccggtctccgatcccatgcgtacgcccccaccacaggagtcggcgcaggagtcgccggccggtgctgcgtcgtgcgtgcgtgtggcaatgcaagcaaagtcccagcccaggggccagcggccgggttgaaaaccctcctccggcctgcctgcatgttgcaatatacaaggcgcgcggccgggtgattcgaagcttcattcctgcttccgggcgctgccatgggaatctctctggcgatcgag

SEQ ID NO: 2366 - DNA, 1005 bp, Zea mays
  misc_feature (1)..(100): optimal_loci_13860_G1, chr1:76239127..76240131, Cluster 14
cttcatatttgaagttcggatgccccttatgggaggtcttgtttccccttatatagttgagggagcatatagtcgtagttacatagaaaaatcgacggggtgcacctttctatgcctacagatcataggccatctcctatgctttcaagagcatgttgttactggctcgtttggcccccaaggtcctgtcacttaaaacctgatcgaaccagggcgtgttgggtcttgtagagggttgtttggagccttcttgtgaggaggcatctctaaggaagccatatgggtgattggccataaagttccttccctatcctcatgtcttattcgagggtgcctgaccgccttacgcatgtgataaggcccatcatggcctttcttcaatgtggttggtctttgttatcctctgaacagttaggtgattggacatagatgtcttcagcatcctgcatattgtacctatctcattcgatgcacacttaatcgagcatgtgcgccaaacggtcagtgagcataaatgtgttagcgctgcatagaatccatgggacctctagatcacggtgctagagtcttattgagttagtatgatctagactagtttagctcagagcgactcgagttagggttggtctggtctatgtgaccaggttgattcttgctttggcctaagattggaggctggcctagtttgaataactaggtaggggtcgactagggtgattgaggtccaacccgacatggttagtgtgaccaggttgggtttctatgataggggccaacctggttggagtaactaagtcaggatcacttggggatcgaccaacgttgaggtcgatctgatcagtgtgaccaagtcaggatcactcaaagtgaccgagattgaggtgaccaggtcgaagtcactcagaacgattgagattgtgtttgtcctggttagggtgatgaggtcggggttgatatggtcgaggctgacctgatcgtattgaccaggtcaaagctgactaggct

SEQ ID NO: 2367 - DNA, 1022 bp, Zea mays
  misc_feature (1)..(100): optimal_loci_139764_G1, chr4:44505213..44506234, Cluster 14
caattgcacagaggaccactaaaaagggcagaatagtcctgtgtagatgatgccgctggatcgatggattcacatataatgcctgcaggccgcagctcagtcgtcagggccgggccggcgtcgacgtacgtacgagtagtactatactatatactatatactccgtggtccgtgtggaggccggattcgcattccgatcttgcatggaatcttggtacatactacgtcgtagcgcttctccttcttcgtcgtcccagaggcgtaggtacgtacgtacgtacgttcttgcattgcattgcattgcattgcgttgcatggcaaaaggtggtcgatctcgatcgtcattatgttatgggtgtgttccccggactgtcctcgtcgtcgtccttgccaacagaacggcactgtgcttgtctctgcattgcattgattgcgtcggccggccggccgggacgatgagtttaagttcgatgttcatggttggttgttcgacgccctgcagcggtaggagtatacatctcgtttgttgtctcgaagacacacacaggcactcgcaaatcccaagcttgagcactccttcttcctgcctcgatcgtccctctcgtgtagattggcgcgcgtaacacgttgactcttcgccagtgacgtcacgcacggccgcatgcactcgggtcgtacggcctttctgcccgcttggacgtacgtacgtgcatgcgtgatacggccggccggagaccccatcgatgatcgatcccaggcccactggcctgtacgtcctcctcgtcagtcgtagccccgcccggaccggccccactggccactactggaccccatgcctgtgaccgtcaggccgtaaagaagtcgtcacgccggccggcggcccacctgatgatgacacacatatacatggtggagtggtcatgatgatgagctgcatgcatggcgcgcgtcgtacgtacacaccaacacaacgacgacgcaacgcaacgcaacgcaacgcaaagccgcatagcatgcagcgc

SEQ ID NO: 2368 - DNA, 1276 bp, Zea mays
  misc_feature (1)..(100): optimal_loci_14015_G1, chr1:77021647..77022922, Cluster 14
cagttaaactaggactatagaggcgccctttgtatatgtacaagtatggttagttaaggtaagggatgaagtcggcacgttagatttttaggcgccctttttgcgcgtggggtaatggccgtcagcccggcggctgcgacgagctccacgcggcggtctcgtcatcagggccactgcatgcatgcatgcatgtcatgttctggtggcggtgggctttgggccgacttgacatgaccagatcactagatcaggaacagcgactcggaagccgcatcgcagtcgccgtccgagtttgctggtggtcgctgggcttggaaccaggctgctgaggattgaggaaagctgcagatgcagagcccggactggcagtgcagagcgcgctgccgatgccgtgtgcctgcctctggcagtctgcctgatgctcccctccctccgctttggagtttggatacgcctggtccgtccgctcgtcgtacagtaacagtacgacgctcttttatatgttgaatgaatctgatctgaagaggcagggcgctccaccactagctggaccatggctgcatattttccgctgctgcaacaatatgacgatgcctgccgaaagtttgatgggccgggagggatgagggaagagcgtttcagagactggagctgcaacaatgatacgtcacttgtcaattcggagctgcagcctgcaggcaacacagagagtaaagacacagacagacagacagatagagatagagagggaacatggtgcctgaggccctgaaaactcactaagaaagtcgctgtgcaggttgggctagtttgcgtagtatgttctaccttggtacagaaaagctagctactagtagatgattagcagcataagcatcaactaccccaatcatccaaaaagggcgatgagtagatgtacatctcccggtggttcacgctgtctcattttttttgggtacatagatcatagatgtacagcaccaccgctccttttccgagggcaggcaagcaggcatgcatgcatgcatgcagattaattccagtggagcagcaagtacaggacagtgtcccccaaaaggaagatcacctcccctctatccccggtggccgtcgagtatcctagggataaaaaaaatctcgcgcgcggccggggggcaaagcagagcagagcagagcagacagcagagccctggatccgatccgatccacatccacgcatgtgtctgtgtggttcagtttaatctcgcatcatgcccaacttaggtagttggatccg

SEQ ID NO: 2369 - DNA, 1317 bp, Zea mays
  misc_feature (1)..(100): optimal_loci_144167_G1, chr4:71207629..71208945, Cluster 14
gaagaatcactagatcatgtatcactcgctttgtaccccataccctcctcaataggggaggtatggttcttatagaaagggaggacaaacacaaaggctcaatcaattggttctccaataattttagaatagcactgtgtgatttcctaccaaacatttcatcatggatgatgtaagaaactcccaaattggttattctacacaaagaacaccatactgctagaactagtggtaagaggcctaaactaggataaatatcttgtgtttatatgtgttttaagtgtttgagccaccaaagatacgcacatcaacttctaatgaacaatatgatgcttgtcgtggtgataaacccaagatagctagcatgccaggcaggagtgcgtcatgtgtgaccacttggtgacagaaccaccaaccccaccatcatagctagaggcgatgcaccaaagggtggcacatgcttctctaagaagatcctctctgtcgatagactctttagtcccaactaggttttgagatttgggaatctagactacatcgccaaccattgcagcgagctctacctctttgaggcaactttgttggatcaggatagtgagtccccaatggtgtactcgccactaggcatcttgtgttttgactcgaaggtgctaacacgatagattcaactgagttggggattaaacctcaccatgtcatagcaccatcagatgctctatgtgccaacgagtgtccatatatagcttgtgacaagggggaagattcattacctcattgtgtgtaacctatcccccatgacctccctgacaaggcccatggcactgcacccgagaacaatgctggcttatggatgtcgctaggtaggactcaagaagtacacctgagaacaatgctagcttgtggatgtcgccagctaggactcaagaagtaacaccacccgcctagctattgtggccctccttatactggtgatagtgtaagcttgtcgagtgggagataagtgttgtcaagctcgtagtgcctaattgcctaaaatagtctaaggtgtgaatcacctttaactgagatgagtaccacaacgacatgtcaagcccgagttgcttcaatctcattgatagctcaatcatcgagcacacaagcctcttaagcatgatcatggacgacgacaacatggtgaacatcccatacaccaacatcctcgattggatggggattccaaagcaatctttgcccaagtgaggctcccttatacaagatcattcctagtttgcaagtcataccccttgagagcaatcaatttcccattatggtcggggg

SEQ ID NO: 2370 - DNA, 1052 bp, Zea mays
  misc_feature (1)..(100): optimal_loci_14629_G1, chr1:80679067..80680118, Cluster 14
aagagaccctactgtgactcactgtcctctgtgcgctgccacctttgtgcataattgttaacgacacagtaggtcgcacacaacaaagcaaaccccaccccaaagctctagcagcaacttgaaatgttttttgagggctctaccggccaatttgcgatttgctttcgaggcaaggctcgctttcacaccctgtagctagctaggggcaaaagcaaaaaagttttggggtcatgttgtatatatataaaaaaatgatgaaacgtgcatacggtgggtggatgaaaatacacatgaataatggatcaatcaatcagtgaacgaaaagaggtaaagtgcaagcggctagctagccctttcttaattttaaccttgtacacctcgtgtggtttggatttccttcccctgcctgccagctgctagcctgctactgctagcatacagactgcaacgctcgagcgacggagcgaggcaagatcacgaataattcgcgaacaattagtggtacgtaacgtggtcgcgaaggcaggttggccgacgttaaccaagcgcgggcaagcacagctttcattgctgagattccggagtccaatcacagcttcgtcgttctctccaggtttcacgtcgagttgtaccgcgcacggcgcacagctgctcgggctagccggacgcttgttcacgcgcatccatgccactggcactggcactggcagtgcccctggacggaaggggcaccaacagcgcgagccctttcgttcgccggcgccgcggcttttatttcgtcggtggacgaggacacgaaactcaccgccgctcgggcagcatgtgccctccggcaaccggtcgagctagctcgggatgttgcgtgcggccacagcgagttcccgacgggcgcttagccggtgaagagatagagcgagggatacggcagtggggtcccgggacctgaactaacgaacgcgccctcgtcccttccttgacatctgagatgattagcacttgaaaattcggtgtttttgacgaagcagcaaagtcagttgtcagacatgagagct

SEQ ID NO: 2371 - DNA, 1361 bp, Zea mays
  misc_feature (1)..(100): optimal_loci_156071_G1, chr4:152717769..152719129, Cluster 14
gtatcaatcatatttgatggtacagtgtaacaattataccatacgcgaggtccagtgccaaacgagtgtgatggaccctctccgcaaaaaaaatatatttaaaattaaagtggatcttccccataaaaaaccaaaattaaaatggaccttcctcacaaaataaattcaaaattaatgtgggcatatagcctaaatattagatattaaactatagatactacattttatcttagccgaaaaaaccgagaaatgtatgagttgaaaataagacttacccttttttatagctagctggaccacttgtccttcagctagcgagttggtactatctgggaacgtgcgctgtgtgtggcttcatatcgtgttgaatttgtgtgtttttttttacaacccatccgtggaccgttagataacgacctagttagattcgaaagaaatataagtttttttttggaaaaggtacgacgatgaaaactagaaaatcgatgcttatatgagtagagattttggtaagaccaattttgatgaggtctagactactcggctaacttttcattcgattgaaaccgtctctgataaacctacagccgatgaaactatctcaaataagctctataaataatatgtaattctgctagaagtaatattcgtgtacgaccacggccatttgtggccatggttttgcgtcgaacggcacacggttttgtaggactcgccctacacgtttggaagctttccattcccccactttgtattgtactcctgcgggcggaatttggcaggtcgggagggtcattatctcgctggatttattactcctattcctcatcacaactcacaagagagtggtttaccgggcgcgcagcatgctgacgctcgctcgtgggcccgccgcgcctgccttcctgttcctctggggattctggggaagctggaggggcgcgcgccccgaggcggatcgagcgggcggaacggttggttgtgcacgactgcacgaccagttcgtggggatgggcggatgacgaccgggcccggtccgcgccaggtggaccactggccagtgggcacggccgtcgtaacgccgagacggatgggagggacgtggtggggccgcagtaaagtgcggtagtggggccgcgggagtgcggtggggcgcgcgtgacgtggaggcaccgccgtggccgtcagatcctgattggacgaaccctgatggcgacgcgagtcctggactcctgggcttttgaggccgcgtccctgtcaaccgtcaagtcaccgtcatcatcgacgatctgtgtactcgtactgccgcggttgctcttcgacagcattgccgcacgttctaccagaggaggctaagagcc

SEQ ID NO: 2372 - DNA, 1139 bp, Zea mays
  misc_feature (1)..(100): optimal_loci_1564_G1, chr1:8034572..8035710, Cluster 14
ctgttaacaaaggcttggctactagtagtagtataatgcgacggggcgatctggatctcagtcgtccaggcatatgcatatgcatccgtaccaggtcgggggtacagggatgtacgtgacgtgaggcacggctagctagctcctgcggtggcgcgcatcgtcagacggcgagggcatcagtcagatcacatctgatgtttagtgaagcactcgaacatcctctatacaattagtatgctccggctgcctgcctgtcgaaagctggtgttttttttttttttttttgcgtgcactgactgactgcagactggagaggccgggggggaagggacatctgtgtttcgtttgcctgtatgtggtggaatatgatcgatcttcccggtttggatttgcagctcaggtcggaccgcgcatcggatgcagttgcagatggctgatggatggtcctccagcctgctgctctgcactggatctattctcgcccgcccgcctgccttgccttttcttttcttttcattcattcatttagtagtactagtacctcgtccttctcccgtcctgcgctgcctctctctcctccgatttaataagtgctgccaatgggtggcttcgactagctggcgcccaaccatcgtcgtgccagcttccgtttgatgccatgccatgcatcggcttacaactggagttccagacatggcatgcgtaaaacttggctcatcacttccgtctccactcctatccacaccgcccaaatacatctaacgtatctgaacacccatttcacatacgatcgaaatctccagcaaacgtaccgatcccaactgggatttcaaatatcgcttaccacaggatgcatccgtgcatgccttcgtctctcgtggacgtggactcgtggtggtggtccggtcccactcccacagtgctcccggctttttcttttcttcgtgtgcctcatcaaccggccgccggtgctcgaccggtcgacgacgtagacagtcgtcgttgatacagctgaagcctcaagtatgtctgctatgcagttttgctccgtcggtctccgtcacccgcggaaaccgtagtgtgatttggacgagacttgccatcgaaagatataacacttgattcaatgcaccaaaact

SEQ ID NO: 2373 - DNA, 1085 bp, Zea mays
  misc_feature (1)..(100): optimal_loci_158724_G1, chr4:166907834..166908918, Cluster 14
gagcgaaaattgtgacgcagccctgacgcaacgctgaggtcattccaggtggggggaaaaaacattcccgcgacgactacacacaatgcatattgtggtggccggccagcagcagcagcagcagctaatggctggcgggccgggaagttagctttggcttttgcagacgccgatggaacgggcgccggcgtcgctttcggcaaagctccctgtcgtctcgctcgccgcccgggcgatcgcggcttcgggcacgcacatcactcctcctgcaacagccttcaggcacggtgtagctgtagcgtgcccagtggaagccggcgagcccaatcggagtgggacgacgccggcgatcgaccggccaccaaccgcgactgacctgacagctagctagctcatcgatgtaaatgcagtttctgttgtatatagagatcgagctatagtagcctagtatactacgtactcactactcaggcagtaggatttggatatatatgcaggtcgtttttcggatgtaggagtaaaaatggtttcaactttgaaggagtgatcgccgtatcttggtcacatgttttatgacgctagtactctctccgacctagtttacgacttataagacaccttatagcatgtcacaaccttctaaattatattttaactattgaccttataggaatgttttaaaacttgttagctaaattatcgatcaaatgctataaaatttgactctcttgacgttcacgaaatgcctttacaaattggtgtgtacgtagagggagcactactattatagattgtactggagaggcttgtttgttttggttcttaatcggccctgagaattgaagtctcgtgtgcagacacatttttttgtagctagccttcatccaaagaagctcttgctacctgctcgattttgtaacctcacctgtcgatcgttaaatcgtttattattccttgttttcatgcatcatcatcataagctagccaagcgcacgctgaccttgtaatctccggccttcctttacactaacactatatataaacacagattcacggctggctagggcggtagtacgtgccatgat

SEQ ID NO: 2374 - DNA, 1193 bp, Zea mays
  misc_feature (1)..(100): optimal_loci_158825_G1, chr4:167398659..167399851, Cluster 14
aacgcaacgagacggcgcgggcagccaacacccaacaacagattcgaacaaaacggcacatcgccgccgccgccgccgtcctttgtttttctccccccctaaacacgctttgaaccaacgggggtgttcctttaaacctgacagtgattacgaaaccgagtggtaacttttactggagtattattacttatcttcctccgctaaagaaattagagtagtgctaaaacttctcatgcgtgatacatacatacatacctgactgtgagccgtgtatcttataataactggatggttgaaaaatcaagtgtcgacagccttaaaaaactcaggtgtgggggtatcttggtttccagaaaggtttgcctcgtgaagaagtaccagtgcgtatattaatttgcgcaacaagaagatactagaacaacaacgctcgccattatcaggccaacttgaacaacgagagcggtagttcacttgttcaatcaaacctctcgagactccacaaaaaaaaaggaagaaagaaaagccttttgcccgaaaagaaacaaatttccgtgagtagtagctatatatacctcgctaaagatatataacccgactaaactaaggaggcatgcacgcggtggaagatccgtgccgccgacgcgtcgacgtcggcgatcatcacagaaagaaaacgagattaattaagtgcttggatcacgtacacaaaagcaaaagggcgatcgatgaggtggtgctttccatttaatttcccccccttgcttcacagaacagtttacgaggagaggagggacgtgccaacagcacgctctatatatagagagccggggacaaaaacgaatgaaaacgagcgccatgaaacgtctggttgttagcgttattaaactagtagtactgtacaataaagcatctggcgctaacagcaaatcacaggaataaagagggacgacggagactagcagcatgcatgactagcgtcgaccaattaattaagcgacggagatgcatgcatgcgagcaagaagcttccaaattccgacgacgtccgtgtccgagggacacgtacaaatcgcatatatttggtgcgaaatagaaaatctggatggactggtgaataatatgcgtgttctacagttgacgtacggtgcctggttcgtccaatggacgatggatggagacaagcgacgacggagg

SEQ ID NO: 2375 - DNA, 1157 bp, Zea mays
  misc_feature (1)..(100): optimal_loci_159308_G1, chr4:171695853..171697009, Cluster 14
tcgttcgttcatggttttcagtcgggacactgaaacaaatgagaaaagcaattactaggatttaaacatactaatgccaaagacgtcgtcatgtaattcgatggcatgtaacaaatgagaaaatcttcgttttattaattgcaaactagtccgatttttttggaagatggaagagaagatagtacgtttggttttataattaagggagagaaagaaaaaaaactgagagtctggtgatggattgagcctgcctttttcgatagcagacgactctgtgcatcatcgttactgcctgcatgcagatgcagtagccgccgattatgaccactcgagagcacgtactgctccacctccacggcgtctgggccgccggcatttactacacgcctgcgacgactgtaaaaacctagctagtagtctagtacctacagcagctcagcggcagacgacaggggccgtgcacgaagccatagccacgccaagaccatcacggctctggctgcgtcgtgtcttcttccccatcgtcctcattcctgccagatgacaagctagtaggctgagaacaatggtagcactctaggagcctgatcgcgagccgccccttgattagatacagcagtagcacttaatggctccatctctaccacccaacagagtcaataatcaaacgcatgaagaagaagaagcatgtagacgtactagatcctaagccaatcgcgtgccttcaccaaagactcaataatcaaacgcgtgaagctagagccctaccgccgtccgccggcctcccagcagagcaccggtccttgcaagcaattggctaggcgaacacgaactcgtgtaaacagaagaaaaaaaaaacatgatctttgctttggtaccgcgaaactggacagttgtttttccatcgtctccttaatatagaaggacgcactaaaaatatcagctaaccgatctttgtcatgatgaacttcacattgaccaggccattatctcatttatctgtagaataatattgagtgtaccaccgtaccgtgattcatttccgtgcaagaaagtactgctgccctgtatattagcaacaaacattgcgtctagctttttttaaatatgaaatgaagcactcctaaacaaaaaaaaaaacgtttttttgtcggtga

SEQ ID NO: 2376 - DNA, 1157 bp, Zea mays
  misc_feature (1)..(100): optimal_loci_159350_G1, chr4:171912340..171913496, Cluster 14
cttccacttttttcatcgttggctggcatgcatgatgcatcgatcgctcaggagttcagcagagttactgtgcgaaaaaagaaatccatcgactgacaatggggtacacagtacatgtactactgagctggtgcctgtagtgtatagtcggatgggggcagtgcagccttgcaggaatgcacagcacagcacagtaggtggcggatgatggatcttggatggtcaagggaacaactccactcggactcgcgtacgagtactgcgtgcgcccccccaaacaaaacagctttgcctccctttgcaggcaggagaaaaagctgctcgcccgccgccgctgccacctccccgcctccacgtcgtcgctgaactgaagaaatcatcaccgtcgtcgcttctctgccatacgagtgtcagtgtctttattcaatccttctccgttcgttcgttctcgtcgaacacaagttaagaattcacaagaggtttcgtagcgacctagatttggggggatagattattgtttttgggtgataatggatactaaacgatcgatttaactaacggtgttatgttttttgattaacattgttgccaaacaggcaggctctgagcctcctgcgacgagattagagcccaactgcgcaagctagcgacaactcttgggctgtagtcgtaacccaccccgaacgccccgggccgctatatttcaccaaggaaggaaacgagcgaagcatccagaatgtagcccaactgagaggtattgttgggcctccactagtctggccatgttaggtagcagagaaaggtagtacgtacgtttttgccatcgccatcctcaccatcaatcaagtatgtgtgaagatgtttccctatcctaacaatgcatgaagcccaacttccgccttatctgatctgatgctacactgttctgaatttttactgccagttcatgggagcatggttgcagggtgaaccacttcttggcgctcaggaaaggagaagctgacatctggtcgatgacagaggattcgagttggctgattcctaggaggtttttgggctgggcaccacccagctgagtgtgtgcgtgtgtaacctctggatcaatgttgttcagggacgcgccattgctttttcttctcaaaccgcgttctcgtcat

SEQ ID NO: 2377 - DNA, 1359 bp, Zea mays
  misc_feature (1)..(100): optimal_loci_159954_G1, chr4:174842676..174844034, Cluster 14
cggataccttggcaataaactcgagggaaacttgtgatggaccagctttggtacggagctagtagaacatgcacacataagcacatgtatgtatacgctactcatgcatttgtacgtgcacatacgtacgtatgcgcaccacacacgctgggcctgcaggtcgggccgggcgactctgatgtgcacggctccaatccctgcaggatcggccggccggttcaggtacgtacttttggtgttggcgcaccgacgccggcgcccgcggcccgccgtcatatcgtttccggtgccgagcacgagcagcggcgcatggctgggtgcgggtgcggcgggcctaccaccgtttgttgggtacttgcattgggttggtgcggtgcggagaggatcgccggaggaggacggcagcacctcatgaaaatatcggcgggcctggacacttttggttgggagcaagggtagaatgcaatcgatggactcatgtacgctagctagggagaggaccacatctagccagcgtcgtcaccaaacctggttcacatgccatgacacgctgtgtctgcgctggaaatgtatatatggccgttgtgggtggctgcatctgcatgcgtgcaatgtcaagtctctctagcaatagcatccgtcccgtccggtttaagtttggaagacggattagcacaacggcaggtcggttgactcgatcgtacggggtcgcttttttgccttttccgtaccttcgtattttaatatttgacgctaaatagtacaataataatataatactaaacgtcaaataataaaaaataaaggaagtatataataaacggaacgggtggcgtaagcgtactacaggagaacggcaaacgggcgtacggcgccgcgcacattaataactgcaacgcaacacacgggaacgggactcatctgcttgcccgccttttcctttttcctcgctttcgtacgttgtgtgtgtgagagagagagaccagtacacacgttgttccgcaggaggacaacgagagaccgccagccagcgcgcaacggcaagcagctggtagccacgaccacgacatgtggcagctagccagccgtggcggcgcagctggtgtatcgtttgtcgccggccgggaagggacgaacgacacctgctgcctctggtgcaacggcacggcacggcacggcacgacaccggcccgtacgtacgtacgtggtcgtgcacaacttctcgacgtgcgtacgtaggtaggataggatacgtggtgtggttggttaatggtcgacgaaatcatgtgtgcggctcgcgacctgtgagtgaccgcatcctttttctgggaaaacacacgaagccaccgcgtgcgcgac

SEQ ID NO: 2378 - DNA, 1384 bp, Zea mays
  misc_feature (1)..(100): optimal_loci_160026_G1, chr4:175371967..175373350, Cluster 14
cagcaaaagttcgctagtgacgactgacgacgacgctaattgcttcggcctcaagctcgctcgcgcgctcgccgtcattctgatttgaccgagttgcatgcatggtatagcacgccggcgacgacgacagaccaaaaataaaaggagccgtccctgttactgttccagctgccctctagctatagctccctctgtattgcgcggaatcagaaatttccgttggaaaaaaaacccctagaatctggattgcgcagtacgtgcacttgcctgtggtttcgagctacatgtgctgtgctgtgctgcgcacacctgttcattggtgctggggtggtggcgtcagggtttgcaagagagcctgaatacttcttctacttctccggaggtgccctgtgtgcacctgcaccgtgacgactgggagatgcatggcgagctaggtgcatgcatgcgtacgtgtccgccgcatggtccgttggtacatctatgctgccgaacggggttggagattcctctggctctacggctgttgcgtgcatcaccataggagctaagctagccagcgcagagacgaggacaaagaaaagcttggcagggctctctctagctagctggctcgatcgccactgtgtcgaattctgtcttttcagaagcgaccaaacgaacggatccaacctgtgcctcactatacaattccgggttttctgaatctcatcaagctagcctccatccctgaaccacgagccagactttgttttctgaatctcatcaagctagcctccctgaaccggagttactgagcagacaaggggaagtgaggaaatctacaggatcagctagcgtcccccaaaatccctgctctgaatcgtgagttactgagcagacacagtggtattaatcagcagcacaggacagattagttgaaggagagtgaccatgaatgtaggatgcatgaataatttgacagtagtatctgctacgtacccagacaaatcagccatccatttttttattgtcgtacatactcctgcacgaaccctaactagctactagctggtatggtagctcccctgtcgtcccggcctccctggggagcttttgacttgtcacctacgcgcacaaaccaaccatgcatggcaggcagcaaagatgcatacatatcctcatcgaagaacaattaaattaatcatcaataatcctgtactgtacatcgatcgattcagcagcagcggaacgcaacgcaacacggggaagacaacgaagggggcaggccatttgttaacgcgtttgacttttgagagtgcagtttggcgctgagataatttaagtgttagcagtagcagcagctaataatcgtgaggttcggtggacaagttggggggttcttttg

SEQ ID NO: 2379 - DNA, 1334 bp, Zea mays
  misc_feature (1)..(100): optimal_loci_160318_G1, chr4:177125550..177126883, Cluster 14
gtacaagaactgaactggcgcgtgcacgagccgtctggcgatccgcacgtgagtgggcgcatcgatcgagctcgagccccgccaggccccttctcgctgctggctgcgattgctctggcctggcgtttccattgctgcggtgcggcatgtgtgggctgtgccagcgagtgaggtgccgccgtgcagggcaaggcattattgcggcggatgaaggaaaggaaaggaaaggaaaggcgtggtcgccccgctcagacagcagcctgtagtgcagctccggcaacaatgcaggtggccggagtgaagcagtcaagcagggcgccactggtcctcgatcgatctgtcagcgtacgtcccccatccctgaccaaacctgggcaactgcgtctgcatgtggcgcctgcagccgtctagtctcgtggcacgttggttgcgggagtgatggtccagtccagtccacccgccgtcacgctctagcactaaactaaaaagctcatcagctcgggcagattgttaaaaccctaccactgagagaagtcctaaaacctcagaatccacttctcctgcaggcacggcattactgcaatggctaagcagctgctactacttagtaggtggcgaccaaaaagaaaaggcatgtctggctccggtagttaattacctcgaccatgcaagctttgtttttacttgtcgatgggcaacccctacatacaatacaatatacatgcaggacactgaacatggcggtgatgactggtgagacacaggcacacagcccagagacagagagagagcccatccatcgtcacgtgcgctcacggagtggcacacgtgcacaacctaggaatccgatattttcgcagagcgcatacgcataaactactgtcacgcgcaggcgcagcgcaggcagtgacgatcctgagagacacgttaattgccccccgattgttcgcggggggcggaccagtggtttgacgatgagaggcatgcatcgcctcgcctgacagacgcctcgggataggtggccgtgggcgtaccagcgctgctaaacaaaccgggggaggctggtcggcgtgttatgtgtagtagagagattcttgcctgcggccgtgggttagtttatcacaaaccgccatttgtgaggttgtgcgcagtggtgttcttcttgttgtcaaggggatccgatgtatgacgctgtcagagctcgcgacagcatttctcgtgtcaggtgcttaactaacctctcgatctagggggggggggggggggggggtcgtacgtaccagcaggctcgcgacagatctggatggaggcttgtatctacgtctacgagctct

SEQ ID NO: 2380 - DNA, 1391 bp, Zea mays
  misc_feature (1)..(100): optimal_loci_160772_G1, chr4:179798691..179800081, Cluster 14
ttcaatccacatgtgttaaagtggattgatgcgtagattagtttagcttacactgacatgtgggtggatactcaaactagacttgacatggcgcggcacacccgcgccgtccagtccaactattcccatccatccggccgcttcaatggacaacagtcgcacgtctctttacgagctgaatttgctctcactttctcgtagcctactaggctactactgttgcacgagcctgacgatccaccaagtcagacctttctttccagccagccacagcagtccgtccccattgtcgcttctcaatttctgcaatgatttttcacaagatggggcgacgcagtgcagcacaggaaccgattgacgggggccaggccgggccgggtagctttaccgccgcgcgggggaagggtatcgatcccctgacaggtcttaatttgatgccgcgcgcagcggggcagcagcagcaggaggaggaggtgacctgtttcccctgcctgcttgtcgctcgatgcatatgcatcacacagatagaattttgagcgaaaataatagcgtctgtatgtattatagctggatgatccaaagagacaagagggtggaggggtatcgggtggtaggtaagacgtattgcctgaatggtgcttatttgtctggattcagctggtctttgtctcgattcagaagagttcagagcacccgcatccgatgtctgcaaacatttagttccaattttcaccttcgtctagctatcaggagctgagcctacgttcttctgatacttgacccccccccccccccccccctttctttttttacacggtgactgcacgtactgcagcccctccatcgatgatctgatgccgggaatccttctgacggtggcgccattggcatgctcctcgactggaagctcgatggaccactggagatcaacggttcctttcagacaccccaagtgttctactccggctgtctgatctaatctgtggtgttgcgtggtagtacactggtactggtagcagtagttcagtgcttctgttgctcttcccataatttgtgtgcacagccgcatgtgcgtgctccttgtagcttgcggcttgcctctggacgagggaatgtataatggcgttgccagttcaggacaagatccagaggcacagaccttgtcttgctctgcaacttctacttcattcaggctcatccatacagttaagtttattaaggcaagttggagtatttctccaacagttaggcaaccttaggagggccgctttacgattttttttttcaattttttgctccgaaggcgacgcatcttgttgtcggattttagaagtaagcaggaaaatgtgccttgattgagaccgactccaattgaatattcactcccctct

SEQ ID NO: 2381 - DNA, 1165 bp, Zea mays
  misc_feature (1)..(100): optimal_loci_163696_G1, chr4:195542744..195543908, Cluster 14
cctattagacttctctctccctcccctcatacacgatccattttttttcataattaaaacacaatttgtttttctctccctacctaccacaggcacaggcacagcccacccacgggagggaaggtctctccctctttctcttcgtcttcttcctcctccttttggtttccttttgattgattgatctagtagaacacagaaaggagagagaaagagaggagaggcaacacagaaacaagagaagaagaagaagaaggggagatcgagatcgatcacgcaccgggggagcagatccttcgcctcgccatcagggtgcgtgcgcttgttgctcctaagagagataggattttgctttcgaaattcccaccgccgccgccctgccctccttctgactccgcttcccaaacttcccaaacctaatcgtttcgtcgtgtaggtggtggtggtggagatcgattgctgctgctcatttttcaattaatcattagggtcacatgaggattggatttatcggggggacttgtgatttctgtgatccatactccatccgttcgtttctggatttcgatttcatcgcagaaatccagcaatacccccatggcacaccacatgagccgagcagccccaatccatccgcgaagctgcctgggccaggcagctccccaggccgttggttttgagcgcctgctcgccggatcgacctgcctgcccgagcactcttcccccactcccaggccacatcgccaaccaaacaggccctacggttgcgaattggcgatgcgatctccaacttccaatgctgccctcctagtcggttccaagtccacttgcagtcaccagttccgatcaggctctaatctgtctcgtcaactcggcttcaaccccccttcctttgctttcccaaaattaactactgctgctccataggttcacgttcaactctacctacttcaaattcaaaattactagtaccattcttgtgctgcaacttgcacttcaaacatttctctgggagtgggagtggaaatcaacccatccgacaccgacccgttccgtgtagcagtaactgcaggccaacatgcaggatcgactgatttccttgtcactggagtgcccaaaagctgccacgcttcagcatgcacttgctcatgtgcattttttcttc

SEQ ID NO: 2382 - DNA, 1164 bp, Zea mays
  misc_feature (1)..(100): optimal_loci_164326_G1, chr4:198782503..198783666, Cluster 14
agattctctagccttcacattctagataatatctccaaaatacattatccaatagcttaacttatataaggatcttcccatatttcttatcttctttataagtgcacaaaaaaaactcaaactttaagtttgatccattttggagagtagctttgaaaagaaagggaattcttgttagcaatttttttatcagtatagtatgacaatcccaaactaaaattttgagtgttacatccagatccgttctaagaacggcgcacatgaagtttggaggcctggtcggcccatgggaacgttctgggacgcggagctgctgttgcagtgcttgcactaataaagccattggaggcttgacggttgccaatgccaatgcaatgtttggttccttccttccttccttcctttctttctttctttctttcgtggaacttctatcagaaatgtctttgccctgagcctgaggactgcctaattgtgtgtctctgtttgttgacaacgccaggggacaggaggacatacactcgtgtggaccacgcagagagtgtcacacgtcagccgccacgcgctccccgtagcgtacgcaatctcccggccacgccgccgcctgggcaggcaacggtgccctttttctctctcggcatgtgactgagtggtgcagaatgagcgcacgcgacggcctggtggcgccagccagtccgtctgcgtcgccggcgcgcgcacgacacaagcttttcgcctttctcttgacgctgcctgccgccggtacggtgacggtgactgggccggcggcggccggcggtccgacgacgatccgtgacggttttttgaacgccgacgagtgcagcaggaccgttcgatctcctcgcagtaatgcatgcgctactggtcaacgtatattctactaaagtcagtcaggcagcacatcagtaatgaatccggcacggaaaagaaaaaaaaacttgtatacgtacacacggacacagaagcgagtgagacccgacacgacggctagagcaacttgtttggtgaggggaccaaccaaaccttttggccataaacttctccaatgtcaaacaacaagagggtgctctagatattgggtaacggagacgattggacgggatattgtgtggccaaggatgcaacagtctgctttttatgtat

SEQ ID NO: 2383 - DNA, 1096 bp, Zea mays
  misc_feature (1)..(100): optimal_loci_164808_G1, chr4:201125910..201127005, Cluster 14
ggatatcacgacaccgggatcgtctcttccgctgcaccttcttgatcgccggcgccctctgccgtcactctcctgcctggcacgcccacctgcgccctcttccgctgcaccttcttgatcgccaccttcttgtatttttctttataattttagttacatttaacataatttgactctataaaaagttaaaatccttatgatggttgcccttgctactctcttctgcagtctacatgatagatacataattcgcctgattggatgattgcccacgggcgtgcaggctcacgcgagcccggccagcctcattcggccattgcgcgtatgtgtacctccgatgctccatgggtcccattatttacaaactttaatctatattgttatatgtgtgcattgttcttgagcaactttagaatttagatctagaggagtattattttctgattacaaagaaccaaatgttacaatggaaaaaaactagatacatcgttgttgtcgtcaccagctccgacagctgatacaggtgaacttgggacggtcgggtcgatggcttgtgcttgcgtaggcaagacagatcctcggtcgccggcgccggtgggcgacgctggtacagccgatcttgggacggtcgttgtgccagtgctagccccagcctcgtgtcttccttggtccaccatgtccgtcctctgcatcttctccgccaatgtctccatgcccatgtaagacaagaggagccacacgtaggacaggtactgcccgccgctccccatgctcttggcgtgcaggtagcccctgcaccctgccggcagagaagcaaagcatctccacccacacgccctggaccaccctccaaaccttttccatgtcttccccaacctgtaaaccaatgagcacctgggtgacagcccaagcgtcatgagccacacctgatcctgaattccccgtctcccttagcctacggattatactactactactagcaggctcgttcggtggaatgatgccctccagttcctcgtaggcgtctttgaacaggctgcgcctagcaccggcgatcaacatctctgggttgacgaacagtaggtacgccatgtag

SEQ ID NO: 2384 - DNA, 1194 bp, Zea mays
  misc_feature (1)..(100): optimal_loci_164988_G1, chr4:202220077..202221270, Cluster 14
gtcggatcatcgctgtcgacgacgtcggtctgcttgaccggccactgttggaagggagaattagaaagggacggcggcggagggaggaggaggaggggacaaggaataaagcccggtgtggactctctcgtactccgatgcatctcgatcgcggcccggtgtcgtcgttgatcggatgaatgagctagctagagaagagtcgggaaaagccatgcatgcaggcacgcgcgcggcctgtgctgtgcgccgcacgtccagtcgtcgctggctagctgcccggagaagattgcgcgcttgcttggagccaaacttctccatcatgacggggtacagaggaccgctacagcacctacggtttttcttccttgctgtagcttctttcattcatggacgcggccgggtacggtgcagccagtcagtgtactgcatgtgggggacccttcctagctctccacacacacacggcacatgcatggtatgcatttatttatttatttatttatttatttattgtcatagacaatacatttggacgacaaaccatacgtacgtacgtggtaccgcctatttgcactggtcaaatcacgacgtatggaaagttgagagcacaactaatgcacgacttccatgcatatgcataatacagcatatgttttaaaattataagaaacaaaatcaggcagatactaagccaggcgatcaactgaatgatcgactgattttgtcttcattagctacctgttcatgcatgcatatgcccctgcctgttaaatggtacattatgcacagcgctgcctgctacatctgttatcgtgtcgacgacgctaaaactttttttttttttggtttggttgcctgtcgtacgtgtctgtgtttgcggccggccggtacaaaatgcagagatggaaaagacagtaaaagagggtctcaaaaatagggtgtcagcaagagtacatataagagttccccttatacatacatgcatgtcgttaattactaatctgcctcatcttcctagcctcccattttacagtgcaaaataaagaagaagagacagcaagcaggctgagtaggagattatattaggcgcttagcatggtgggaggtaaagtagagaggggtcgcgtggtattttgggtctatagtacccacgcaatgcaatgcaatggttgatgacggtctcgagctgatgag

SEQ ID NO: 2385 - DNA, 1201 bp, Zea mays
  misc_feature (1)..(100): optimal_loci_165002_G1, chr4:202274701..202275901, Cluster 14
catcggcctgcaggccttcagacatgagaaccccggctgcaaacacactgcagtctgcacgcgtgcaagcaaggaacagtcactgacccacacggtgtggttgcacagctatgtcagctggcctggcatggagacggagccaggtgaggtcgggttgggtcggacggtggtgggcagtgcgtcagtcaataatggcgctggacgtggacgaaacgacgagagggaaggaagcggccaacggacgagagcagagcagtccggatccgggccagtggtggtcgcggtggcaataatattaagtgcggcgcagtgagttggtacgacgctggtccacccgctcgtgcgccgagggcgacggagcctgcctgcagcacctgcgcccatgaggaggggaggccatggccatggctggtcggtggtcggtcagactgctcttctgtgatagcatgaatctgccaccccgcccactgctcatcagccaaggtcatgtgcgctgtgctgctgcactgctgagccaaaagcggcgacgagcagcgcaggtgcggccggccaggtgtgcgtgcgtctgcgcggcacttgcacgcgcgggggcggcggataaccaaccccacttcaatgattgtgtggtacggacacggtggcggtgcaaatggggacggtcggacgatgaccctcgtcaggaggaggcggtagcaggaatcggccggaatttggcccattcctgcttatccaccgccaatctttcggcctatacacacggggacgaaagtagcccaccaactagtccctctctctcccaccttttttcccctaaaaaaattgctttctttttttttatatccaaaaggaattgttgggctgttacttattcggccacgcacaattgccgtgtccacggcggcggcagctttgtcggcccttgcgtgctagtccggcccacacacgctacgtttcagcccaaaacaaaagacatgtttgggggttctgttagcttcatcatcatcctttttgtctttcgtgttcttcgaatatttccttaacgcccagtggtgcttgtagcatttttattgttccatgctatatttttacgtgctcgtaatcaaccgaaccgtagacccttccagcgcgtctgcactcatcctaccgtaccctagctaaatcaactgattggtctcctccacggggcggtagagatagactt

SEQ ID NO: 2386 - DNA, 1128 bp, Zea mays
  misc_feature (1)..(100): optimal_loci_174696_G1, chr5:13800973..13802100, Cluster 14
aatgcaacggctctgcgatgttttttttttgtaagatctggatgtttgcgtaactataagcatgtatgctgattgtttattagttatatctaattaagttccaaacttccttcagcgatattgataatctgaaaacgggtagtaaattcgtcgttgtagtaattagctgtagcttcgcgccctgagtgctaggcagctagtagtagatacatacattatcaccatctcctgcaggacaacatagatgctgaagtttcacagatagtgccaaaactccgaacaataacccgaaaacagggattatgtacggtcgctgttcctctcgtgcagccccatgcatgtgtaataacaacgagctccctcccaccaggccaccaccccccatgggccatgccccccccccacacgctgatgcgaaaatgcaaagcggcggttagacggggacaagagggcccttcattttcatttggcgtcaggccatgggcacgtacgcgcgggactgttcggggatcctcccctgtctgtctgtgctgatccatcttgttcgcgcagcactgttccttccggcacgtctcgggcatctcgtctcatactctcttccgttgcggcttgcgggccgggggcggagccgccggggcgcacgctccggctccagcgtcgtcacagaacacgggcgcggcgcagccgtgtgtgtagccatgtgccccacattaatttcgcggcggcggtgatcgcgcgtacggcgcaggtacaccgcgcgcctccatgttcgttccatccgggtgggtgtgcgctctgctcgccgtcccgtccgtccgtccgtccgtccatccccgcccaggcccagcacacgtacgccgcacggcaccattatttcgtcttcacttttttttttgttacatatcaacaggccctgtccctgagcgcgcactggtttggcacgacacgacgcgcgtacgtgtgtccgtccgtactgggcctgcacgcacgcacgcacgcacagaggtgatccgcagcgggatttttttttgcccccttattcgagctaggccaacacgtactccctccagtacaggtttacaggtcgttctggccacgaagcgttctacaccaaaagaagtcgtggca

SEQ ID NO: 2387 - DNA, 1185 bp, Zea mays
  misc_feature (1)..(100): optimal_loci_174697_G1, chr5:13802500..13803684, Cluster 14
catacgtagtaatgcatgggagctccgggccaacaacacgtgataataatgcatatatagtacacgcatggctgctttgtcgtcaccggtggcgggatatatatgcataatcattggttaatcatcacttccaggctccagcagcagcatgtgctcccacagttgcgagctgcggctggtagcacggcgatatgcatgccggcgcaccttctggcgggcttccgtgctagctgccggtaacggtacggcacactgcccgcgtttactacgtacgtgctcgtccattctccaactcatctaccagttcgtacccattacttgccgctgttccatccttgtacactgttcgcgcgcagctacgttgccttggccagtttgggtcgtgtcgtgtggcggccgaggtgcagtttgttaatggaattgctaagatgcaaattaaccctgcaccaagcaagcgttaatcatcatacatggatggacatggactatgcacatgcaggtcaccactcaccactgcgggcgcaaattaaacacaggagacgcgccgccgcagccggcagtctgtctctgcatccactcctgctggcgtacgtgttgcgtgcagccagaggtatagacagcctcggatgcccttccacacacagcctccaaggctcgacacgacatgcctatcggaggagcaggctggtacggacacggtacgaagccaagctgatatcggaccaaaagtgcaaaacaataccgggcgggcctcgaaccgcctggtctgctcgtatcgtttcgttcggacatttcccgttcctgcagatctctctcgatccgcgctcgtcgtggcgacctctctcctccagttcccgttcctgttcctgaaatcaatccctactttcgccatttgtgtgttttctcgaggttttcgcccctcgtttggacgttcccagatctcgactgaggttttagagcaagtctaataacagagttaaatgctagctgcaagtattcttgtagcctgctattgagcccacttatctctcttacagagatcttgacagaattcgtgtcataatatcatatcatactcgatgaagaactttagctgctaggattattgggccgtgtgttttagcagtccaaattccagatcagaaagcccagcaaaaacgacatagggttcctagttccttccag

SEQ ID NO: 2388 - DNA, 1165 bp, Zea mays
  misc_feature (1)..(100): optimal_loci_175271_G1, chr5:16848007..16849171, Cluster 14
tctgttcctaattagcgcggctgccacgacgagccggcaacgcccagacgccgtcgatggcgcgcaccaccaacggcccggcgcggtgtcggcggcgcgacgacaaggacgtacgacggccggccccgggcggcaggtcaccggcgcttcggttgcagccgcgcgcgcgcgagcgtgtacgcgtggcggcctggcggacgcacgcacgccgtcgccgggtggcagttccctgccgtgcatgccagccggagggatgcgcgctcgtccctgtctggcggccggccggttgccgatatgatgccgatggctggatcgacggcgaaaggcttattatgttcagcactctctccctcccctggccgcggccggtctgactgcacacgcggagccgggcatgcacaaagcgcactccaagcaaaagcaagggaaatatgtccgtgcccggctcgcgcgggaggcccaggccggcgtcgcggtcgcacgcacacgcactgggaaagcggaacagcgtgatcggggtgcgcgtggccggcgcgatctgtgccgcgacgtcttcgcgttcgtgccgggcgcgcgcggcaaaagcagcgcactccaagcagcggagcaacaatgtatagtataacccccgacccgagagggacccggttgccgcaccagagcgggtgtggaacacgacggcaaagcacagcaagggggactaggcgaatccgtcacatttattgttcatgcctcatgcggcctgccgctaactcttggcctataggcgttcggcggcagcagcagcagcgacggcaagcgcatccacgcactcgtcgcacgaaaagaacgcgacgcacgcggcaaaaatttaaaacgggtgctgcaagaagtagaccatgtccagcgtcgcctgcctcttgcctcttggcatgcaagctgacagaaaggactcgccgcgccttttttttccccggccctcttcctgtaccccgtttatgatgtgcgatcgagcagaatcaagagcctgcgttcattcagaattcaagatccagttgagttgggcgaacagaagaagagttgcccagcagcgagccgcccgactcggaatcaagttctctctgaagcttgctccacacgatcgcaatgcccgtcgacgctggacagcatcttggaagttggaagc

SEQ ID NO: 2389 - DNA, 1230 bp, Zea mays
  misc_feature (1)..(100): optimal_loci_180081_G1, chr5:42231397..42232626, Cluster 14
cgatcgagtttctgtgcatctgtatgtgaaggggaatctgacaaatggagcagtacagtacagacaagtaggctacggatcggagtagcaacagcttgccgagctcgatcgatcggaagccacctaccatttcggaggtgttgttggccatggcaccaccacgccggccgtactaccgcttgcaaagtgtgtttgtggtagtactagcaaactgtaacccttgggtaacaatacatgcgtctgtctctctctctccctttcaccattgccgacgcggggaaggggaaaaggggcgccgtgtttgaccctgagctagctccatcggccgctcgcagggcagtaaagccaccgtcctttttccccacggccggcgtggtggacacaccggctgagagagacctagcttgagggagaggggtagagagtgatgatggatcggacgtcggtggaccatccatcggcaaggtggggagacccagagggccgggggcggggggtcccagggggagggcgcgatgaggacgagcgagggcaatggcccatgcccatgccggcccatgcatggtcctgtcctgcctgcgtcagggctctgtgccccgatctctgcgccggacctccggtccgcgtgggtgcagcttgccggccggcgacccgatcggagcagcaggcgtggcgcacgcgcgcgcagggccatggtggaaccctttcactgttgttgcagtgttgccaagcaaagctccccccggctggccggcccctgcagcagctgtatccggatcggacctcacctcaggaggccacgacgtacgggtccgtccatgcaccatcatgagacgcacgaaccagcaggagaaagccatcaaccatgcatgcatatggatggatccaggtgcttgcgatatttaggccaccatgtgtgcacactggctgccaggtgggcctaggtccctggtgggttttaatggccctcgtttgtttggtggcgtgaacaaacgcaaaccgtcggccccttgcttgttggagtggaggtaaacacaggctgcgcaacaccatgaccgacaagcgacagtgcctgtagcttcctttttttttctctcttttccgcagaccccgaacatgggcatccgatgaagtatttcttacaggatccacccgaaaaatcacaccagttatcgacctcttctccccgcatgcatccgaggccaaggcatggtataatttaatactcca

SEQ ID NO: 2390 - DNA, 1288 bp, Zea mays
  misc_feature (1)..(100): optimal_loci_1811_G1, chr1:9220443..9221730, Cluster 14
gtgaggagcaacctctgatccatgagcaaaacacatgcaatgatgaattttgcctaatttttctcttttgatagcgatagtgttgagttcaacttaaaaaaattatcctctatagcacgttcgtatatcacgaccttgatatatatactttttttctggttttattcttttgacatcatgacatacacaaatagatgtctaattaatacaaagagaaaagctatcgcggttgcacaacaccaaaaaagtttcaagtatccatcatgttcctcagagttcattgtgatcgatcagttcattttcatagaaactctgatcatcaccgaagaagagttatagctgatatatatatgggattagagccatacgcgagctagggatggatcgcccctcttcgtcgaatagtagtcatgaaaggcaacaaggtcaccatgccttgccctggtcatcatatatcgtgcagagagggcactgcgaagttatgattcacttatattatatttcgtgaaccaaacaatacctaataataagctaatacctaataataagctagctgattcagtggcaagtatatatatgcatgctagccagctgaggtgccacgtagcgcaggttacggctaggttctctggaacatcatgtgcagaagatatgcgagcgatcagcacgtacagcacagctagcacatcaaccaatccttgcgatccggaccaaatctatcgtacatgcatgcatgcaccccattgtgctggctgctggcggctcgctgctccatgcgcatcaggccggccacgacagcgtcaagatgatcagatagacgtccgtagcgcgaaaaagggcctctccccagacagtggaatatggcctcgaaaaaggacccgattaataaacaaacaaattaaagagagagctaaagctagcgatggtgtccgtgacgaatatggaggcggcgaccggccggtagctagtggttgcagctctaggtccatcgtcgcagtgtgtttattaggcatctgctggcgctggcgatggtggtgtcgtccagcaaaacacggcatccgctcgctttagcggaataagaaatggcgcgctggtacaggctactgctcgttgtgcgcgtccgcatccccccgaaagcatgcgggaggcgggcgaggtggagcactgcaggacgcgaacgcgaagatgaaaggggccggatcggagcagcgacgtctgaactggacgacgaactctggaccgatcgggtggtcggtcgaaactggactaaaaagcgtgttcaactcct

SEQ ID NO: 2391 - DNA, 1137 bp, Zea mays
  misc_feature (1)..(100): optimal_loci_186270_G1, chr5:85073867..85075003, Cluster 14
tgtgtagtgaatatggaggctaactaggtgtgccggccatcatttggatcgatgccaggtcacccaaatgattcttggacaagaaaaaaagaaaggaaaaaaatgttcattcctgccaaaattattctaactagctaggaaatttcctcactgccaaaacaggagcagtgctggccaaccccaccacccgcccatatgcatctgatggaacaaagcaaatgtgccatggagtctccatcaagccaagcaagcaagcagttcaatccggtatgtagagcagctagggttttctcggtgtcagcttgccacaagcgggaagcgtcgccgtgtctgcctcctcgtggtggctcccggccagcccgtgagaacctgccgagatcggcaacgcggaggggaccgggcggggccacgccgtcagagggtggttaccagtccacatgcccgcgcgcatggacgacggcgacgtcgacgtcgactgagaggcgggcgagagctcgcgctggctagtagctagctcgacgacgttgctttccatggcgcctttgccttgccttgtgtgggccatgcagatcgatgcttgccgcgcgcgagagctcacgcgcacgcacctcagctagccccggcctctcgctgcacgtacagcaggctgctgcaagaggcctgtgtgtatatgcatgattaattgtgcagtgcaggtgtgcatgcatccatcagtactaatccggtcctatcccatgcatgcacatgagccatccatgaccgttccatgagctagcctcgatctgaagaattagctagcccctgcttgcatcgtatgttctgtatgcgccacagggcccggcgctcgtgcatctgtgcaggaacgaatcatggcttcaagactgaagacacctatatatacatgctgcagtctgcagagatgtgagagaagcatatacatacgatacatgcatgcatatgccctgaggtagcctggactggtggaggtggtcatgccgtcatcgatcatatcattctggtgttttccttacgcgctttgactcgctgcttgttggtgcctcaaaactcacaactccctccagattgttaacacacatgcattgcaagctgcactggtagtttcaaggaaaagattag

SEQ ID NO: 2392 - DNA, 1000 bp, Zea mays
  misc_feature (1)..(100): optimal_loci_196158_G1, chr5:151709271..151710270, Cluster 14
taaccgttgcggatagcctaagttaagctgaccacactccccgcaactgagaccaaaaaaaaaaaaaagagagcagctttcttgagccaagcacccaaccgtttccatgaccgtccgtcggcactcggcacggcagggaacgaacgaacgaaagaaagcaagggcatgttttgtttcttgtcacctttgccctgcccacactgtgaccttttcagtcctgctcctgctcctgcagcccccagggaaacagcgacagcaatgcgcgctcgcaccccaacgcaatgcttgctgccctcctatgctactgctactgctgtgcttgctagtactagtacctcctctcctcctcaactggggaggaggagccgaggaggagaggagagtagctaggagacagagacagacaagagatgggagaggtcaggggtgagcacgaaaagatgccaagggtgcgtgtgtgcgtctctctctctctcgtaggagtatagtactaccatgcagccatgcacgggagctgcgagaggccggccaaaagctgggatcgaccaaatcttggccgcctgcacgcctaattatcccccttgcatgccttgacccacaccattgtcgtctcccatcgccgtcactgactgactcatcaatcatcatctcagctgttaaccgacactgctttcttctgctccgctgctaaacaggggggacgacggccggggttagtaactagagaccggcaagccttctgctgcttgctacccccgtaaaccttcagtatcccaactttgttcagtagtactactgaagctcttatatatgtttaaggaacgacaaacatgaccgaatatctttgtgtggttgggttattattattatatattggagcaggcatggcgagctatatgcgttgtgcttgtgtcacgagagccaaatccttctcttgtagtacatgtatactgcaagagaaggtcagctgcctctgagcatcatggtttacctttccgtt

SEQ ID NO: 2393 - DNA, 1006 bp, Zea mays
  misc_feature (1)..(100): optimal_loci_201813_G1, chr5:184448567..184449572, Cluster 14
ttgctttgctggctctggctgttccatgcattatggtacgaagccggagtcaatgctaaacaagccttcgtatattctagtaccactttgggcccctttggcagagcttcaaagccggctttagtacctccggcttctacaaatctacaggccctaccaaatggctaccaaaaaaacaactttgcacgagaagcagccatgaagcttaagccgtttttgttctacacatctggagggggggggggggggggggaaccggctcctcttctgtcgccagattgtggcagctgttctgtcaaacattaacttttgtatgtgttgcttcatcggagaagctgttcaaagacagcatatgcatcctagtggtacgtaaatgttcaaagacacattgaagcgtacaggaaactgaagaactacagtctacagagcacgaaattattgccaaatggtacgtaaatgagtcaaaaacagcatatgcaggtctgaacttttatgtgttgcttcttttggaaaatgatggagtgcatatagaggtgacataataatgacacaacaggcgtcatatgcgtgggcactgcatttcagtcactgaatactaacttgttttattttcttatttctccaaacaagtactgaatcataaaacttcaaaaactatcttttcaatcaagcactgaatcatagaaatgtttttacccaatttaacttcccagaaccaagcgccgactcataacttagcctgaaattactacatgtatacataccataccacgaaagcacgaatacacagcaaaaggaaatgctcggactctacaagagacaactcgaattgaatcgggaggtggcatgtcgacatcaaactcgattgtcgtaccccgcggaagtcacagcaagagagcggctcaaccacccccaagcaaccaagcaccgtctccgcgtcgcggcgagagagcaagagatgaggggggaggagggagtctatggatgataggagccggatgctaac

SEQ ID NO: 2394 - DNA, 1361 bp, Zea mays
  misc_feature (1)..(100): optimal_loci_201983_G1, chr5:185501127..185502487, Cluster 14
tccgggagagagcccgggacgcgctttgcgggaagaaaagaaaagaaaagcgcgcctcccctcgctgatccgctagcgccgcccgtcgccatcggcaaaaaagcccacggggggtgctccgggcggtgcacgagcacgaccacccttttgaccgcgccacgtcgtgccccggcgcccgctcggcggtcgccacgtccgttcctccacgcgcccggcagcggccgcggtggtgccccctgtgcggcgactcgggcgggcgggtcgtcaacacgggaggccgatcggcctaaccccaccccgcgcgcgcgccgcaatagcgcaagacgagctctgacccgcggtcagaccagacggtggtggtgagtccgcgctccgccacgccgctgcgcgggcacgcacgagcacgacgcgctagcccgctggaccgagaccgagaccgagcagcagttcggttcgggcccacagccaaacgggagcgagaggggaagaaagcgagagcgcgcgtgccgttcgtgcggtgtggccggccgtgagtggcggctgctgtcaccatgtgcgctttactctatgatcgttcgttcgtcggactgaggaggattagcacgggagggaggcggacgacggacgaatgggagcggttgcggttccctcgaggcgcacacggctgggagcacagccgtacccgtacgtgtgtgtgtgaggttcctgggggacatgatgccagaggagaaactagctcactcgatcgtgtccgggtcatgtgagtgagagcgatctcagcgtttgctagttgcgcatgatgggctactgacgtctgaaaacacccgacctagctaagcaccatggagcaacgtgttgcacgttgcaagtgccgatccacagtactgcttcctgttgtatctttttttttctacggttaattagatgctccaagcccttcaacccgtgcttcctaataatgttcctaggattgaccaaacttccgaaataatatccagtagtcgctcatggtaacagcagccagtataaaatggtgataacagacggacgacactaattctacctcatcaaatcaagcggaaaaagatcacacggtggcgatggacggccaggacggggcagtttttttttctttttcaaatcgaacattcggcagctactctcatactgtatttcatatttccaccaaaccgtttcacgaaaatacaaataggtgctcccccagccggtcaacccaaatacgagtacatcctaacgttagagaggtacttttagtagcagtttataatccagaggcaaaattagaatcagtttggtgatatcataaagtacacgcgtgattagctactagtgaagatgga

SEQ ID NO: 2395 - DNA, 1321 bp, Zea mays
  misc_feature (1)..(100): optimal_loci_202830_G1, chr5:189911597..189912917, Cluster 14
tgacgtggtccgaagtttccccgtcatgcatcatgagacaatagatacctatatcatgataaatcggcaggaaacatcggcagcgacattaacgaaggaaacatcggcagtttaagctgattaaagcgacatacagaaaacgtgagctacatcaagttcttcgatgtagttagtccctgttccaattctcctccgaggactactttccaacaactggagacagtcgccaaaaaaaaaattgttcagcgaccttgagtgacggcggaaataggatgtaagcaaggattgtggcgaggttctccgagcatgacgaccttgcacggacaatggtaaaattggctgtgctggtgggcattcggcccagcaaaactagttcgcggctccaggtttcagtagcggaagcgacgaaggaattgctgggtcgttcaagtgattgagctgggccaatcgggctgggctcgcggccactggcaggcatcgtactatactctttggcgggggaaaaaaaaactcttcggtgcagccgagccggcatgactgatttgttgctgacagaaggcgacgtgaaccccgcgcgggacacgagctggacaaaaggcaaagctgagcctgagcggcgtttttttccggttctatcaaaaaagaaaagctgctgatttgatgaaaaaagaagaaaataaagaaaagcggttttcgctcgtgcacgcatgcttcttcacacacaccaccgatctccgtctcgtatctgttttgcatgtctctttcttgtgaaacggaagcgcacaggcacatcacatagctagggtagcctccctccttgtccttggcacagcgttgaagctatgttatatgactgaccatgctaatgctactgtatcgattgacgcatcctttcactactagtttttcgtttgattccgtttccatttttgcgcatgtgaagatcgaccttgtccgtagagcgtctgcctggggagggctgcttagtttcgtgcctcgaatgtttcacaagttaaagcgaagaccaacgctcactttctctttggaaaatggattattatctttaccttttgctttttaggcagtctttactttcggcgacgacagagaagtagatttgacgatgaaaccacaggcacgctttccatgttggcatctaaagaactgtgccttctttagctagtagtgttcaaagtttccaaggatggctacgaggacgaaattgttttcagaccaatcttttgtctaatgggctcaactcctgtggcggtctggccaatgcgactacggtatagtgttccactcgtagaattcagtttag

SEQ ID NO: 2396 - DNA, 1160 bp, Zea mays
  misc_feature (1)..(100): optimal_loci_204267_G1, chr5:197960699..197961858, Cluster 14
ggaccagtgcagtgcatagctagctttgtgagacaacagacacccgggccgcctcatcatcgctcaaagtgtatgaacactcgcctccatcgatgggtccatacgtacctgaagaagaaacaaacggctttggcagccaccaaacgcactgcgtgtctgcgtcggcgcgacaccgcagagtatccggcgatcagtagtcagtaaacgagggcggcaaggctcggcacggcaggcatggcgacgcattgatgaattcgagtctatgggccatggtcgtctggactctggagctgtggagcagcgaccgtagtggtaggcaccacgcacaggcggaggagtgtagtagtagcagcggcggcagcgcccaaccgcgcgctcaccccgaacggaaatgaatgcccgcccggccattaaaccccgcctcctaccgcggcaaggtgaccccgcgtctgccgctgtagctggcttgctctgctctgcctcggcgtcctagcgtacgtacgctgtgcgcctctgcctgtgcgtgtgtgcagggatgtgatttctcgcaggggcagggcgtccttcgctttgcggctttgcccaagcccaatggaggaagtatacgtaaacagcacgagcgccatgtagctgaacatgaccgggtgggtgaagaggttcattcaataccgcgacgtgatcgagcgtcggcttgaccgtgcgcccatgcctgcgtgtacctgtatctgtatgtatgtatgtatgtatgcagtgcaagtgtttgccattgtattgtgtgctccctatgatcgaggacgttgcataggccaggccatctcaccatcatggccactgtaccacacgtacgtgagcacgttccacactcatatcccccgccttctatttcaaactcaaccgtataatggtatcatggtatgtctaccttgtagtgtttttgttagtccatatgtgtgctagctaaccttagcctaactgtgagcggtcgtagaataactgtttcattgatgcatttctctctccacggcaaatgtgaggtcagtctcctcaactatgtggaggaaaaggaagcaagaaaagaacagatatcatgagtgcacacacgtacacctaacttgtcagcattttagtagtttgtcaactctgttttaaaggaattctca

SEQ ID NO: 2397 - DNA, 1039 bp, Zea mays
  misc_feature (1)..(100): optimal_loci_205044_G1, chr5:202392294..202393332, Cluster 14
gttccaaagctgttggaggtctaggcagcgcattggcatctctccaatgacaagttttgaaagccatgaacaagttccaaagctgttggaggccttcgcgcgcgctccacaaatcatgcaaaagccagagctttactccctttttccatttaaggggctgcagcaaacagacccgtgtttgcagaattgtgcatttgtacttgtaactcggacgatgcaagatgcacggaatcgtacggtgcatattgtttgctactcctgctagagttctgccctccagcgtcatctttggtcttcgcgtgtcccccactgcagctgcaggtttgtgatacagtagtgctgcaagcctgcaacggcaagcggcatcactgagtcactgccacttcttggcacctgccgacaatgagtgctgcagtgtggatggcaagccttgagacacaagtattttttttactgtaatctggtgcacctgctagcctaggctcatatctatatagcttattttctgaggtaaaatttaaattttaaaatcttaaactcccacatgccatttccatgccacagctagctggctactaataaccaccgtcctctctggctctactcctacgtgtaatctcagacaaatgcctccagacgccattaaaaaatacagcaggttaaacaaatagggacagaccaggcttttggtatctctcctggacctcatccgtcctgcggtcctgccaagcaagtacaaaaaccagcacccatactacccgtgctcttcacgcagtaaaggggaaaggaaggaagaacttaaaatggacgcagatctctttcttgaatcttgagaaaaacacactgtacatgtccagctaccaaaaaaaaaaacaaccgtccaaagtacagagtccagactccagacaaatgcacaagatatctgtagtctagaccagttgcctacgtttcagatagtggaataggctaacattttgacctaagtaacgctaactcgaaacgtgcatgaaaatcaactaggttgaacctttcaatgttt

SEQ ID NO: 2398 - DNA, 1170 bp, Zea mays
  misc_feature (1)..(100): optimal_loci_205683_G1, chr5:206046910..206048079, Cluster 14
gtgatgccgatgtgtgaggccagatgagatcagtatcatgtttttcatcaaggtgagcaaaccctaataacgtacgtgaacgtaccaccaagaatttcacaggcttcagagttcattgttatatatataaaaaaccctcagactcagagttcgggcagcctgctaggtaggtatatactgtagcatactgcaccgaaaaaaatagggaaaacgaaaggacagagacgtggtggattatttctgattaatctgatgcttcacacgaggagcagttactgctgttgatacgatgagttcagcttcagcaatcagcattgtgcaagtgggtgagggtgattgcactgttatagtgtaggccatgcaacgccgttcgatgggccaaatcccagaaaccaggcccactcgaaccattttcccccaatcattcgaacctcagcagcagacacgtacctgcccaactgcatctaccatctatagcatagcaaggctggttcccctggctgaaccggagcgaaatgtggctgagaacgcactactcgtcttaaaggcttcttcatggaccatacgcaaattgcaacgcgatttacgtacgcaggcgtgcctgcctgattgcttgagaatacgtgtgtgaagcagatcgcaatcgcaacgtgggtgctaaccctacctgtggccttatcatcgctgtcgcctttcatgtctgtctctgatgtccattgccgatgatgcgtgtgccacacccacacccgtgctcgtacagtgacgcttggcactggcagcatccgccggccgtgcccttgtttgtcaggaggtatcaggctacgagatgagagcgtcgccaccctagctgtcgatcggtggacgcaaacgaatgatcatgcccgtggtggccctcggccagggccatatgggccaatcagacagacccccccagtttagcccgttctgcacgttgcttcttcctctttggttggttccacctacgagtcggaaacgacgagcgtaagtttgaatggaccaggatcttgtttctccagacgttcagaattcagacggcgtaggtgcatgttgagcatctaattgagctgccatcatggaccattttttttatgaagaaaaatctcgcctgcacttggttcaccaaaccatgatggactgataataaactca

SEQ ID NO: 2399 - DNA, 1360 bp, Zea mays
  misc_feature (1)..(100): optimal_loci_205745_G1, chr5:206486761..206488120, Cluster 14
  modified_base (1054)..(1054): a, c, g, or t
  misc_feature (1054)..(1153): n is a, c, g, or t
  modified_base (1055)..(1055): a, c, g, or t
  modified_base (1056)..(1056): a, c, g, or t
  modified_base (1057)..(1057): a, c, g, or t
  modified_base (1058)..(1058): a, c, g, or t
  modified_base (1059)..(1059): a, c, g, or t
  modified_base (1060)..(1060): a, c, g, or t
  modified_base (1061)..(1061): a, c, g, or t
  modified_base (1062)..(1062): a, c, g, or t
  modified_base (1063)..(1063): a, c, g, or t
  modified_base (1064)..(1064): a, c, g, or t
  modified_base (1065)..(1065): a, c, g, or t
  modified_base (1066)..(1066): a, c, g, or t
  modified_base (1067)..(1067): a, c, g, or t
  modified_base (1068)..(1068): a, c, g, or t
  modified_base (1069)..(1069): a, c, g, or t
  modified_base (1070)..(1070): a, c, g, or t
  modified_base (1071)..(1071): a, c, g, or t
  modified_base (1072)..(1072): a, c, g, or t
  modified_base (1073)..(1073): a, c, g, or t
  modified_base (1074)..(1074): a, c, g, or t
  modified_base (1075)..(1075): a, c, g, or t
  modified_base (1076)..(1076): a, c, g, or t
  modified_base (1077)..(1077): a, c, g, or t
  modified_base (1078)..(1078): a, c, g, or t
  modified_base (1079)..(1079): a, c, g, or t
  modified_base (1080)..(1080): a, c, g, or t
  modified_base (1081)..(1081): a, c, g, or t
  modified_base (1082)..(1082): a, c, g, or t
  modified_base (1083)..(1083): a, c, g, or t
  modified_base (1084)..(1084): a, c, g, or t
  modified_base (1085)..(1085): a, c, g, or t
  modified_base (1086)..(1086): a, c, g, or t
  modified_base (1087)..(1087): a, c, g, or t
  modified_base (1088)..(1088): a, c, g, or t
  modified_base (1089)..(1089): a, c, g, or t
  modified_base (1090)..(1090): a, c, g, or t
  modified_base (1091)..(1091): a, c, g, or t
  modified_base (1092)..(1092): a, c, g, or t
  modified_base (1093)..(1093): a, c, g, or t
  modified_base (1094)..(1094): a, c, g, or t
  modified_base (1095)..(1095): a, c, g, or t
  modified_base (1096)..(1096): a, c, g, or t
  modified_base (1097)..(1097): a, c, g, or t
  modified_base (1098)..(1098): a, c, g, or t
  modified_base (1099)..(1099): a, c, g, or t
  modified_base (1100)..(1100): a, c, g, or t
  modified_base (1101)..(1101): a, c, g, or t
  modified_base (1102)..(1102): a, c, g, or t
  modified_base (1103)..(1103): a, c, g, or t
  modified_base (1104)..(1104): a, c, g, or t
  modified_base (1105)..(1105): a, c, g, or t
  modified_base (1106)..(1106): a, c, g, or t
  modified_base (1107)..(1107): a, c, g, or t
  modified_base (1108)..(1108): a, c, g, or t
  modified_base (1109)..(1109): a, c, g, or t
  modified_base (1110)..(1110): a, c, g, or t
  modified_base (1111)..(1111): a, c, g, or t
  modified_base (1112)..(1112): a, c, g, or t
  modified_base (1113)..(1113): a, c, g, or t
  modified_base (1114)..(1114): a, c, g, or t
  modified_base (1115)..(1115): a, c, g, or t
  modified_base (1116)..(1116): a, c, g, or t
  modified_base (1117)..(1117): a, c, g, or t
  modified_base (1118)..(1118): a, c, g, or t
  modified_base (1119)..(1119): a, c, g, or t
  modified_base (1120)..(1120): a, c, g, or t
  modified_base (1121)..(1121): a, c, g, or t
  modified_base (1122)..(1122): a, c, g, or t
  modified_base (1123)..(1123): a, c, g, or t
  modified_base (1124)..(1124): a, c, g, or t
  modified_base (1125)..(1125): a, c, g, or t
  modified_base (1126)..(1126): a, c, g, or t
  modified_base (1127)..(1127): a, c, g, or t
  modified_base (1128)..(1128): a, c, g, or t
  modified_base (1129)..(1129): a, c, g, or t
  modified_base (1130)..(1130): a, c, g, or t
  modified_base (1131)..(1131): a, c, g, or t
  modified_base (1132)..(1132): a, c, g, or t
  modified_base (1133)..(1133): a, c, g, or t
  modified_base (1134)..(1134): a, c, g, or t
  modified_base (1135)..(1135): a, c, g, or t
  modified_base (1136)..(1136): a, c, g, or t
  modified_base (1137)..(1137): a, c, g, or t
  modified_base (1138)..(1138): a, c, g, or t
  modified_base (1139)..(1139): a, c, g, or t
  modified_base (1140)..(1140): a, c, g, or t
  modified_base (1141)..(1141): a, c, g, or t
  modified_base (1142)..(1142): a, c, g, or t
  modified_base (1143)..(1143): a, c, g, or t
  modified_base (1144)..(1144): a, c, g, or t
  modified_base (1145)..(1145): a, c, g, or t
  modified_base (1146)..(1146): a, c, g, or t
  modified_base (1147)..(1147): a, c, g, or t
  modified_base (1148)..(1148): a, c, g, or t
  modified_base (1149)..(1149): a, c, g, or t
  modified_base (1150)..(1150): a, c, g, or t
  modified_base (1151)..(1151): a, c, g, or t
  modified_base (1152)..(1152): a, c, g, or t
  modified_base (1153)..(1153): a, c, g, or t
aaaaagtggtatgcaaacaaccgatctgtcgcgtttttcaaaaaaatatgcacaactaccaggaacttatcaggttgatatctggctgaataaaaagaaggtttcacagaaaaaaattacatttaccgccaatgcagagcaacttctgcagccacagtttacggtagaacaactacgtgagctgggtattaaggtggatgaaatcccggcgctggctgaaaaagatgacgatagcgtgatcaactcgcttgaacaaatcattcccggtacagctgctgaatttgatttcaatcatcagcaacttaatttgagcattccccaaattgcactgtaccgtgatgcaagaggttacgtctccccttctcgttgggacgatggtataccaacgctgtttaccaactactcgtttacaggttctgataaccgttaccgccagggcaatcgtagccaacgacagtacctgaatatgcaaaatggtgctaattttggcccctggcgattacgcaactattccacatggacacgcaacgatcagacatcaagctggaataccatcagtagttatttacaacgtgatatcaaggcgttgaagtctcagttgcttctgggagaaagcgccaccagcggcagtattttttccagctacacctttactggcgtgcaactcgcttccgacgataatatgttgccaaacagccagcgcggatttgccccaacggtacgcggtatcgcaaacagtagtgcaatcgtgactatcaggcaaaatgtttatgtgatctatcaaagcaacgtgtcagcgggtgcctttgaaattaacgatctctacccctcttccacagcggcgatttagaagtcacgattgagaaagtgacggtacacaacgtcgctttatccagccttattcttcattaccatgatgcagcgacctggcatctaaagtatagcgcgaccgctgacgctatcgcgctgatgcaacagtgatagcaagaacccgaatttgctgagccaccgcaaatatatggttcggattatacctttacgcctggtatgccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggccgttgacagtggtgggggtgtaccagcgcggaaggtgcctcggttagttcatgtggggtcgtctagcaggttgtggtcatcccagttccagtcgggctggcggagtgttctcggttatggtctcgtgaacaaaagatgagtgctgagcaatctggtctgggaatctaccacgtcctgggacagacgcggtgcggcctcgtctg

SEQ ID NO: 2400 - DNA, 1337 bp, Zea mays
  misc_feature (1)..(100): optimal_loci_206337_G1, chr5:209467430..209468766, Cluster 14
aatctgctcaaagcctgttcagtccactccaccgaagatgcactcaacaggcgaacatcgtctggcgaccggcgaccgcacgcaaacgtccccgtcgtcccgtccacacactttttgcacggcagagggccaactactacagattagtccctggcgcgacgcagcctttctctcagctcttcttcttcttctagcactgatccggctaaaacttatattatctcccatagaattgttttgtctggaagcatggggatccccactgttcacgaagtacacccagcatgtaacgtagggctaccacaagtagaaacgctaggcctcggcaggctgaaaggctacgagaaccacccttcggcggcctaccagtaccagtacgttccgcgacaccgacactgacacgggcgcagtaattacggccggaacggggcaccgacgagacgaccgatcagtccgtagaagaaggctgcggacccgtcgggtcggggcgcagctagctgtcgcgatcaacgcacacgtttctctggcgggtaaccgagtacaagaagacaactgtacaacgtagagcactgtgcagctgggctgagcagacggctaggcgaactcacgggcagagcagtgatcctgagccggatccacggagcagggacagcgcgggcgacgagtgaccctcgtactgtacgtgccaaaccgcagcagtcgtcactccgctcgtcaggcgggcagcgaccagcgagccactggccgggggaagacgacgacgctgtgggcggctttgtgggtccggagaccagcagccagcagggaagctgggaaggcaaggggcgctcggatctcctgtgctctacgtatctgactgcgttcgatcagttggactgttggagttatctccctctcggatctccagcagggaagggaaccagggtttgggttgggcaacgtttgtgcgggggtacgtcaggccgacacgcatgctcgctccataaaggaggccttaaatcccggagactacgtaccaaagaacagttccgttgtgagatcgacctcattttgcacctcgggatttgctccaaccacctctcgtgacagtgatggaaccacgactcgaaaggtggtggtgggggaggcgcacagcacaggagcgaagcagtaccactgaactgcgtatcgtacacagtaacacagcaactaacatctgtgcccttggggatgggagaggcacgggctgatgagactgggtgtgggacgacgacgtgggtgggcgatggggcggcgcggttcacggcgactgagaatcgctttgccaggacagcaggagtgtcaatagcaaccaacag

SEQ ID NO: 2401 - DNA, 1130 bp, Zea mays
  misc_feature (1)..(100): optimal_loci_206994_G1, chr5:212522456..212523585, Cluster 14
ggctgcaggccgcatgtggccgtgtggtggtgcggtgtgcggccaatcggtcccgtgctgcccctgcctctgctctctccgtcgcgcacgatctccgtgacctggtgcgcgtgcggtgccgttggcgcctgccttccctgcctagcaacagcttgcggctccgcgaaggcaaccgggggccacacgcagatgctgccgccgcgcggggagagccacaccacacgcacgcacgggcacggttggcttggctcggatcggatttcggatggcggcgggactggaccggaccggaccggacggccgttggggatggaggagtgatctgattgggagacgcaatgcaacccccggccgggtttggctttttcgttctttgtcgcgtgctgtgctgcctgtttgtgtgctcgggaggccggcggcaacggctgcgtggcattggtgcgtcgcatccgtttcttcttctcatcccttcgttcctccactccttgattgccgaagggcggctgatgctgatacaggcagccatacggtacagcaatcctgatggccaccttgatgtacgtgccataaatcctggtaccgtgtgacgacgaccggtgaacatacacggaacgatatttcccccccctccccctcttttgcggaaaaaaacatactacacggaatgattgggggtgtgtgtgtgtagggtgtagtgcgtgcgtgtcgagtgtcgacggtaggcgtacaaggcgggagtgtgtctatgtgtgtgcgcgcatgaagttcagtacactgttcacgtattctttgctaaaaaaaaattacgggcgacgattatccccactactccctaacgatggataacgtgagtagatagtatagtctgaggggagtgtgacggagcatcatgatcttctagtgcgcctatgcatgtgtcgtgcatgacagagcgtcatcttctgcgagccgtgatatatataaacatgtacgctgccgcaaagtgccaaacaagaaaaacgtagcccatcttatccggcgtacgacaaaaggagccgagcagagcacgccccgcattagtccacgagattagattagtccttgttaactcccatcccctatcgccgtgtcgatcgttaagggagtagaga

SEQ ID NO: 2402 - DNA, 1010 bp, Zea mays
  misc_feature (1)..(100): optimal_loci_207048_G1, chr5:212788209..212789218, Cluster 14
gtcttatattaaaacatcgatgtacgataaaaatcataaaatacatataagaagtacatgttgcaattttaagggaggctctaggaaggctctatgtgctctaccattgggcaagagctcccactatagccatgaggtgagggaagagctatattctgatttttttttcagatacgaaataacttttattatataactaaatttattttataacttgaaaaaacaaaaataacttagaatttaaaacggatggagtagtttagaatttaggggtcgcgtagtcgcagatggcgaaagacacgcacgccgccagcccccctactccgggcctccactgctcagcacagcatttgaaagcattttactatttttgtccaaaaatgtcatggttctgcgcgtttgcacagttcgtcatttgggagaaactacatatgtttgagactggagagagtgggcagggacacgtacgaagctgcatgcccccagcttaagcactactgtagtagagagcacaacacaaagtggagcctgcatgcagtagcagcttgctgtgcatgggctgcatgagcatctgcatgcatcggccacttcctgttcttgccactgtcgccgtaggcacatctctgcctgccgccgcgctgcaaaatggtaccaccgtccaactccacccacctacccacccacccaccgtctgtctacaggcggcatggggcttgcaggtgtggatgttgttctgtttaccgatggcatggcagaggcaggccaggcgctgaaagcggtgaggaccggaggagtaggggagggtggtggtaaattcagaaagctgccgagtggcgtcagtggcggcgcggactttcacgcgcggactcgcatccgcatccatccatccctgaccctgacccccccccccccccacccaaactctgaaacgaaatgaaagaatgggggcggatgcagaagcaggaggcaggagcagcttctttctcctccatcgtcgattccaacggctc

SEQ ID NO: 2403 - DNA, 1082 bp, Zea mays
  misc_feature (1)..(100): optimal_loci_208583_G1, chr6:4311944..4313025, Cluster 14
atgactgctacgagctaccatgccaatgcatgcagctctagctgcgtacgtacagcgtgtagagtcgtagtagtacactacagttgtcgtcgttgtacgactgtacagctcagcaccgacaccgatgcatgcgtacgtgtgctgcatgccagcgtacgtacgtcgtcgttcgagtaggtcctccatcgtctcgcagctagctagctagctacctggtgtgtcgattcgatctagagtgcaaacaacctcttgcttgtcttttgtgctgctaactgcgctgctagctgtagagagtagtcgtctagctagctagtttatgggtatacgcgacgacggggccatccacaacacagatcgaggtcatagctagttagtaagtacgcgcaggagtacagccagatcgagccacaggtccaggtgacattttagacatgagagatgcatgagacgaattggtggtacctgccctgccctctcttgtattcatgcatgcggttgctccgttgtagtggacgtacgatgcatggccggccgtagtttggcacgttgctagctaggcttcgccgtcgccgggacggggtcaagggcggaaccgaaccgcgcaaggcaatccggcggccacgaccacgagctacctagtgtacctagccatgtgaagaggccggacgacagaactgcagtctgcatgcagcgcgggggcagatccaggacgtcggggacgacaggatggggtacggtgcctggcaaaataaccccaacacccaagttccttcctaaaccctcccttttgtagctttcccttcaacaaatgagcacttcaaatctttgattttgagtttcttgtcagaatccttgtttgagagcgtgggaaaataaaattaaaaactcggtagagccaagatctccttattacaaatatctcttgataataccttcactgctggggtagacaaggtatgtgcaaaatttcgcaaagtttgacgcggtgctatatatttgggttttgccattgtcttcaaaagctcctatgttgaaacttgctaaaactaacttaactgtgtttggatttaggccgccttgga

SEQ ID NO: 2404 - DNA, 1189 bp, Zea mays
  misc_feature (1)..(100): optimal_loci_2089_G1, chr1:10904590..10905778, Cluster 14
acttgctctaagagactgtattatacaatcttgagtctctagaccatatataaaattaagacacgacatatatagagagttgtgttgagacgatctcctcacaaagagagggtctcttattttttttttcatttagccctctaaaaaaccctacaaaatctctctaattattgtggttgtacgtgcccttaaaaagaaagcaaaacgcgaaagccaaaacactagcgcggacgaaagacaaatgcttttccgctcgactgctcaatttgtttaaagcctgagctccgttaagctagctagctatccttttcatatcgctattaatctgcaacgcctagctaggtttctatggagcatccacttagttaacttaatccacgcctctcctttgtttattacacctcttccaagcaataaactaccgcagattaacttgtggtcgctaagcgctcgcgagtcgggtaaatctcagcgtgcggccaggaactaacatgacggaagcttcgttctgcacgcagagacggaagcttgtttatttgatctgcattagtgcaacagcgagacgctggccgctcagaaggccgcggcgtgcgcacgcatcccaccaaaccggatcgccggatttcctttcgcgcaatacaacggtgcaagaatctccgggcggacgccggaagccgctagcttttgtgcaaaagctagtcggggtcaggtacgacgacgacgacgacgagtgagtggcgaacatctctagtgggctgcgaggctagtgtgtggccgtgtgggtggcctccaggtaggcgtagtgtgtcatcgaacaattggcgtttctgaatgtcttctgtgttcttctcctcgctgtggactgtggttgcatcatcgccgccgtagtgccggtctctgcgagactgcgtggaatggaatccgtcgccgtctggccaggcgatcaactgaatcgatctgttccctgacggcagagagaatttcggagtgcgccccatttgtgctcggccagtcagacgacgtgtgtactgggttcagaatcagatgatgcatttttttaataggaaaactttattaatttcaaacacatcgtatcaaattaatacaagtttttaaaaaattcttccagcctctgctcatcaagacgcacacagcctaaaattaaagaaccacaaataatctagtggca

SEQ ID NO: 2405 - DNA, 1370 bp, Zea mays
  misc_feature (1)..(100): optimal_loci_213849_G1, chr6:36949596..36950965, Cluster 14
ctgcagtcagcactgcacacatctaggtagagagagagaaaagaggaatgagacagagatcctcatgcatctgactagacatagccttgtagcagctgttcttacttgcaaataattacatatatatgcacaaaatgctgacaataataaatgaatctatacacatacgatatatagctaggcatgtagaattaagctagcagagtagacatatgcacacagcagcgcatatataagtagtgtcatgaactagtataattactctaatcgccacgcatataattagcatcttatactatatagcttatgcatgtaaggacaagatagatgctcatgatgcatggcactgctggcatagaataaagcaaaagggaaggtgggtactgaaaagaaggagaattgttcatgagtttgggatggatctggtagcagataccatatgatatgatatgacacgtaagccacagccaggtagctaggggcgcgcatgtatcgatgcgtgtggatgatcttggaatgattcgagggcatatatctattcctatatctatatatggaggagcgagaaggacgaggatggatgccgacgacggccggccggtgatgaactgagaatgcttgcatgctgcatgcccagcaggatagatcgatcatgcatgatagatgatctcagtgtgtgtgtcgtttacaagttgcatagaagtttgagatggaacaaacacagagatagcagtagcaggatgattgtgcttagagcgaagcaatatatgcagagtgtgcaaacggtgttcccgagagcacgaggccggccgtccggcagaggtgcaggtacggacgtagaggaaagcgaaaggaagcgaggcagcaaagcagcaagcagggtacggcttagaggggagagagagacgcatgacgagagagagagagacggccgggactagctaggagcatcatcagctattcagctgataggtaggtatctagctactaggacgaaggaaggagaagggtcattcatggtggtcgaccgtcgtcatgggagggagggactggactgggagttagctagaaggtcgaaagaaagagaagctgcatggtagtgctggtgcatgcatgagatcaatcggtaatggcgcgggtacgaattggatttggagttggaatcgtcggaagcgaatggtccaaggtctcgatgggattctttgatcgatcttggtacgcgcatgttactcagctcggagggaatcagattctctctgctttgcgctgcttgcctttgggggttgctttgctttgccttcgctttctcgaaggccaagggagccctactaacccacgacgaccctctcctcttcttccctggccctccc

SEQ ID NO: 2406 - DNA, 1398 bp, Zea mays
  misc_feature (1)..(100): optimal_loci_221720_G1, chr6:91307666..91309063, Cluster 14
aggatagatctaacccacaagctcacaaatcatgatagagagacagagagaggtgaatagaggcccggtccatggtattaatgggccgtaatccgtgcgtgttggggattggtcggcatgatccggcttcactgcggtgggctcctctacccaaaaaaaaattccagagctaaaacttccctcagtaactccatctaggcaaaaacagtaaggccgaagcagctaagcccaatttacgtgcctaaattaaatgaggctcgctatatacaaaggcccgcgcgcgttatggcccatatgtgaatggaagcactgcagtctcccctcgcccctgcaccctgcagtttttcgttgggagggagagagatgaagacgaaagcaaaaggagactattgttgtggaacgaaacgagcgctggtttcgtcgtgttgtgagcaggcgaaagctagcttgccgcatcggtctcatctcaatgctggatttggtaacgtacggcgtggatggcagtgccgttcgagactaccatctcatctagtccgctactagagtagactagtagagcaggtattatattcccctcccctcaaaaaatcatgatactaccggccggccaggcctaatctgtcgctcgaaatataatctcctctcttcgtttattattattcgatcgcattgggggggagtctggctgggatcattggatgcctttctttcttgaccccacttttgagcgctgttacgttcctccccatctaatctacctatctttctttcttttttttcagcccattttccatcgctgaaaaaatggtcatgtcatgtcgtggttttttttttctcccaccaccaccaccaccgtacgtaccacatgcacgcacggcgctgcacatcccttccactgctctctcaggtctaggattttgattgctgacatggacagcagcacccgtgggacccttgcccactgatcagcagcagcaggaacaggagcacactgctgttctttgttgccactgcatgttttgtttgtgtgtgtgtgtgtggcatactactagtataatgttttgtttgtgtgtgtgtgtgtggcatactactagtatacttggtacaacgtttagtttctccagcggacctcctactacgtctttgacaaagatgcgtggacaaaaaaaaacggtcttttaattactttggtgcctgctggtcagtgttcaaatcctctctgattccttgggtcggtaatgatcgaacactcttgccggcagtcgggtacaaggttgacaggagtaactctctgcgcatgctgtctcgtgcgtacagtcgacagccgtccatatccagatccaggtggcctctctctgcaggtcaggctcgttcatactgtatgacgatgctgacggt

SEQ ID NO: 2407 - DNA, 1018 bp, Zea mays
  misc_feature (1)..(100): optimal_loci_222397_G1, chr6:95316505..95317522, Cluster 14
aagcctcacaggcacagaggtatcgcgcgcacgcgcatgcccaagcggcccgccagcgaacgctagctcgcggccggtgcatgcgtacagcagctggccgtggccgatcgcacttggcacacctcagggtcggagctaggaggaggagatcgcggaactgtgcggcgagatccggcgccgggcgtacgctggttggatccggccggcagccgtccgtcccagtggatcggagtgaggtgtccccggagcattgatggagccttccatttactgcggcttgattctcactattgatgatcccacgtggccgggattcggagacggggacaaaggaagcgaagggaagtccccgcgtcacgtgctcgtgctcggtcgtcggattcttactttttttttttacttttacttttacttttacttttacttcattcaccattcaccagttcatcatcacatcgctccggcggccaaaactcagaacggccagttctcgaccagacggctcctccaaccaggaccggacgacgagtcgtgtctctctgcgtgctgcgccgctgcccggtattaggatgtacgtacgtaaagagaaccagcattttctttggcgcggcaggcaggcaggcgatacgaccagatgcgaaaaacggcgctgccacggcaggcgtctccgagtgagtgcccaaattcggctttagtagcattcagcgaggcaatccggatctctgacagtcgatctctttcgacggacgccagttgaggaacggaccgtcagtccatgacgcgcgcaggaacatacgcccaactagtcaaggcgctagctggtggacgtacgcgcacgctagacggctagctgtcgctgctgtgcgagctctcgactcatcagccggccaagttttaaattcaggcatacgggctacatacagctcacctggtccggtacgacgggcgttggagctctcggcagagacggtcaggtagccgtactcgacggaacggaagcagaagcagaagcacagtg

SEQ ID NO: 2408 - DNA, 1040 bp, Zea mays
  misc_feature (1)..(100): optimal_loci_223728_G1, chr6:102463275..102464314, Cluster 14
catatatcagggaatatagcttgttgggtctattacattttatttactataggtgtagtgtgatgtttcccctttctctcgtgcccatgaagaaggtgattgtgtcacatccttctttctttctttcactcttgttatagagagttactgcctcacaagccttggagcaccttgtcttgatgcttgatggtttactcgttactccatgtgcacttagctattcttgtctcctcacatgccgcttttgcaaatgctattctagtaactcacaagcctatgagtcatattgacaaagtattggcctttgttttcccaatccaaccattcgataaacttgcaaggctgtgtgtttaatagtagatctgtagtagatatatatactacggacggcttcagctgccgatcgatcgagttccgtgcttgcgcttgcggctgatgattgcaacccgcacagtaattttctgaagatagaggggcacacgcaggatcctgcagtacgtctcttctgaagatgacgccgttggttggaaattaagaaattccgtcctgaaattgccttgagaacatgacgccgttggttggaaattaaggcattaattagccatgcatgtcatgccgtcgcctgcccgacttcttgcatgcttccgcggcgcgctggtggggcggggccagtcatggaagacgacgacgacgacgcgcgctccgaatcggctcgctcgtcgtccgtcggcgtcaggccatgcgcgcgcggctggtcggtccgtaattgtcaactcctcggaggaaagcgatggcgtctggaacgagctagctactcacatccctcacctgctgctgtcgattaatcagtggtggcggtggtatcggatgagagaaatgttccggccggcggctgtgacttgttgttgtctacgccggacgtacgcgtgctggattgcacctttttttacaaacgacctggccttcgtcgtatgggcgtatttatataatctgtctatattctataatttagataatttagtagagagtgtttgaatgca

SEQ ID NO: 2409 - DNA, 1350 bp, Zea mays
  misc_feature (1)..(100): optimal_loci_224169_G1, chr6:104449938..104451287, Cluster 14
aactccccctaatggccctaatgcagatagcggcatgtaaccatctgcacaattttagttgcggaggcgatgcaatgggaccaccaaaatcaagaaaagagctagtttttatccatatttttaattaattattagaaccttttcccttttatcttgaatctaactctacctatttttaaaatctttttttcttcaaaaaaaaaacaattactgtttttaatctggtttcattctccttgatggattctatcttaaaacacacactgctaacactaaaaaaaaaccttccctcttctttctgttttatggagatgacaaagaagaaagaaaaaaaaagtatattttcagtcacaggctgcagaatccagaacatattagaaccattaactgtaatacagtaatgtaattaactctttcatccttagagcagcagcaagagcagagcgtggcctactactcttccttcagtgctatttttctcccccgtttgcggtttgcttcgtcttaccaacttaggacttgtaggcacggcgaattattgttaattactccatagcaactgaatagtagcaaccatggtggttgtgacttggtggacatgcctgtaatggaagaatccgttctcttccttaacgtgccgtcacgtgactttttttttttttttgaagttcacaacccaaagccctgtggccggtaaaagtatactgctacggctaccaagcgaagacaagcttaagcaagagcgctcgtgagccgagcatattttccttcttctacggggccgaccgtatcgcgagctatacttttcagcgatcccgtgtacgtaaaagctgtcacacgcgcccacagtcacacactactcaactcacctgaccctgctactgctacgtgccaatttcaatttgcccggcccgactggaactgggtctgagtgtgcaacgcagcaacggcatggctttgctactgcgggctgcggcagggggattagttggcgtgctgcttgtggtgtggtggccgccggtgccgaggaaagctggaagctgcagcaaaacgcactcgcgtcctccgacctcttcaacatgccctacctgggcgccgacagttcaacgagattggcttagatccgctgaaataatcggtcgagcttccagcagaatcaccagtctccgtgggccaattactagtagagcgtaaacccacactggaagcggaggcccaatttagctaaaacccccaaggccttattttcctcctctcgtacgttccacgagcccatagccctggatacaagcctaggcacatgtttgaatatatactgcagagagcttgctcagatgtttgaggtacttt

SEQ ID NO: 2410 - DNA, 1127 bp, Zea mays
  misc_feature (1)..(100): optimal_loci_225066_G1, chr6:108985454..108986580, Cluster 14
catatattatattacattagctacagctatacagatcgatctgacaacgacgtacacacgcacctgcgtgcttcactatttcgttccacagatctggctagctagctatatagctgggctatctataaaggacgacgtcataagcagtgaccaccgcactaccacgatcgacagtggctggactggaggcgacgacgacggcgacggcagcagcgctgctgccatgctctgccgatgatccatgcactcagcagcgtcctgtacgactgcacgcacgaaccggccgatggcttgcgtgcagacgtgttcagcgccttctctctagcgccatacatgcgcggcggcagccggttgctggtaccgtcgtccctagctaggctacagctctggctcttgaggtacatgcacacgcatatgctgcatgaaagaggcgggtcgtcgtcccgatgtcatgatccccggccgtccacccttcctgctggcggcgcgatgctgtgcttgcgttgcgtgtagagctcggacatgggcggctgtcatttgagggcgggccacgtacgtacggcacatcttttggcgtgtcttggcacaacacgaacgcgagtgtcttagcttggaacgaagaaaagatttattatatatcatgccactgccacacccgatcgatatggctcgatgtgcgtcatgtgtgtctaaagggcgcgaagcacgagagaggcagagagagctgtgccgtacgtgagccccacctctacttgcgtgcgtacgtacatgcatgcacgggggcgtctacagtacttgcgtacgtgtgtactgccgtactggggcgtacgtgcacgacgacgatatatatgtgcacggccggcagcatatgccgccgcagtacgtggagacacgctagctagctcgaggacagatttcagtcgatgacatgagtgtgcgttgcatgcatggaccacgcacgggccgaccggctggcgcgccgccgtgcatcagcgccgtggatggtgcgcggtagtatacccatgtttgtgtgtacgcttggagcgagagtcgtagtctcgggtggtcgggtccatgtgggacgcatgtgcgggccttgggtacacgtacgcgcgtacgtacgagcg

SEQ ID NO: 2411 - DNA, 1062 bp, Zea mays
  misc_feature (1)..(100): optimal_loci_226144_G1, chr6:114936540..114937601, Cluster 14
aaatttaggagcaaataaaggagctgctgcaagcagcaactatggcacggctggctaggcttgcacaaagcgagaagaggcagcaaggacgcgacgcgcacgaccggcgcgacagactgcccacgccgaccactggcactccagactccactcctactcgctctgtttctcacggccgccgtccgcgcgagacgaggccccgtgggttcagttcaggcagtaccagtacgtacgccacatgcaggtggcaactgctcgcctagcttatttttcaacttgttcatgttttcaacaaaatcttagcttggcctctgacgtctggcctagtttatttttgtggcgggcaaaaaaccggcgagatccccaactgcatgcggcggcgcaaacgaagtcacgagagcacaagggcctgccaactttggccctgtgcaagtaaaacctatggatcaactccggaagcgtacacacggacggccttttgtccagaccgatttcgcacgacgaccccccggcccccggtggctgcctagtgcctaccacgcgttcacgggcgcggacctcgctcgctggatttggcgaggcaaacgcgacagaaaggctacagtggtttcaccgcgctggatttggcgaggagatcgcggatgcatgaggattgaggaaccgtggtttctccgttttggctggttgggtggccaggcggcacggcagcgagcggatggtcatgggggaggtggcatttcaagccgccgtcttacacgcggctgcgcaggtggcagcggcagcgcgcgcacatgcttgacggcggttggccggggagggagccctatgtctgtcggataatcatcatcccattatagcttgctgcttgcctgtctcggccacggactttagccatacgcacgtacggtgataccatcctcctctgctgcatgattaatttgaacattggttagttacatgtatattgctacgatttcaatacattatattcgtagaacttgtttaaacgacatagctattcgaacatgtacatttttatttttagggttagtttaggaatca

SEQ ID NO: 2412 - DNA, 1062 bp, Zea mays
  misc_feature (1)..(100): optimal_loci_226704_G1, chr6:117994949..117996010, Cluster 14
ggtgctcactgctcaacaactggctgcctagccacggttgtcttcttgggaacatggatatacgaggattccccgccttcagagatcagaatacggaagagcgtcgacgcccgccaagtgatgagcagacgcgaggcggacgggccggtcgccctctgacgcgaggctggacgcgcgcaacggcttttgctctctccttcgtcggcgtgacacgtaggcgatcacgtatccagcagccagctagcccgcacgaacgcaggccaaagatctcgcacgatccgggccggttcggttcccacacaagcaaagcagaggtcgtggtggtgtggtggtgcgaatgcgatcgctcggacagtgtgggtacctacctagctgctagcttctggacgtttcgcccggctgcacgcgaaatgacctcttgtttactccaccggcgtcggagtcgcgcgcgtcgcgtgcagcccggcccgcgtcgctgcaagcccgtgcgattgggggctggtttacggggtaaacgggacagcgacagcataatgaaaacgggtgtacatgttggtgccaggcgtgacccgtcgacgtcggcaagcggaatgttcaagacgaaacgcaagtgccagtagggctgaaaacgagcgctgacattgtgtaggcgtcagcgcggtgggttatcgtctccgttctttaaattaaatactatactaggtatgtatcatgtacgctgcaaaggaccatcaagattgtaaaagggtaaaaaatggcgcagtactaaatccaaattagtgaaaaagtatgtaatcgcttcattatataagagtgagcagcatgtgcgttgtaacgacatacaatgtattcgataaaatattagttatgcatatatcatcgaccttaaataaaagatcccaagaagttcaatagacaactttgtctggtatgccaattaacaataggaagaagcaagaaatacaaatatgtggagcctgctcccacgaattgatcaggggaaaaaatgttcggtaaagactgagaagtgtttgttcaatggagcatgttaaagtaacttaa

SEQ ID NO: 2413 - DNA, 1005 bp, Zea mays
  misc_feature (1)..(100): optimal_loci_2288_G1, chr1:12330970..12331974, Cluster 14
agtgaggtcaagagagatgtacaacgtccgaggctttagtcttgagcaaatctagaagtagtaaccccaaatgaattttgactactcgattattggaggatgaagaagtttcagaatattgtcatgtagggcctcatctctatggacactttgcatagataatcaaaggtcgatatgacaaggatggagttagggtgatgtgactgatccggaggccataaaactctaagatatgtaggaagaatcgcgacaaagtgaaattcaaccccaccatggtaatggagtaaaataagatgtactccccacactaccttgaggtgtccaaggtggaatcatcattgcatgcacattgtttaaggctagcgatgtggtccactctaggagttgacatgtcttccccaacccctcctagtttaggatttgtgctctcagtagcgagtccaagggagaggtatctaccatggtgccacaaaggatcacgggatgagtcaactatggttggttggcggtggcttcgaaagcgagaagagcacttgagggcaagtgaagcagattgcgcagagagtgatgaaaaaggaagatggatctgcacacctaagatttagcacgcccttgtcttcgtttttacaatcactggacaacatacaaagcgtcacatgacccttatgatttgagagtcattcagtatgactactgccttatgcaatgactgttgattagggcggtcaaagctaacaatattattagcacacatgatagacttattttatcttgcatttgcgagaacgatggtcctacatgcaggcctccttgggtctattgagggtctgggagccactatcaataatatccaggaaaaggcatattccttcgtgctagcaaaatgccatctagtactacaacaatagaaaacagacctatagaggactcaactcgatggggagagcccatgttgactagacctcgaggcattgaactaggggccttatgcaggagccctttggc

SEQ ID NO: 2414 - DNA, 1367 bp, Zea mays
  misc_feature (1)..(100): optimal_loci_228883_G1, chr6:129465402..129466768, Cluster 14
ctttttcttatactcttgagacaatcacatgatataactagtcaaaggaccttcggcaacactggccccattgataatattacttttttttactatgaatactgttatttttttatagacatagccaactttaaaaaaaattaacttgtcaaaactgataacattttaccaatcaaaacatggttgcagcagcgtccaagatgatcggccgcaaagttaaaatcagtgagtgagctgagctcattgccaaggcctggaatccagggagcaagcagaagaaagcaactgccgatggccctgatgatgctcgatcatcagaacttacgtccatctgcagactggaaagagagagagaaaaaactgtagccccatgacctgacgagagccgatcgagaaattgatggcggtgaaaaaaagcgagtaggcaggagtgaatgcagtgagagatgcttttggggcgtcctggtacgttgcatttgcacctggcgctgttgaacacgctgtgtgtgtatgtgcctccttcatatcgccacagactgagcagacaccggattgaatgctccgtgcgagtgcttccgctagattgaaattcacaacacagttgatctattatctcctcagacagcaccgtgtccgcttattctattgtataagttgagtttaacagctttatggagcagtagatttttttgatattattatggaatagctacaccgtgcaacgtaacagacgtgtaacagtgtctacaggtgcagtggaatagctacaccgtgcaacagctgtgtgccaaatcgcaagaacagccgtgcaatggtggtgttaagaggaggcacgagagtgaatgagtgatgatgatgatggcgagtgctctttttaaacctctgtcggaagctcgagtgtgcgaccaacacatgatggcctgacctgccaggtacacggaagcagcagcacctggtcagtggctcatgctcagggactggcgaggttgaagagcgtagcacacccccacacagaaacgccctatactatacataatttgtagcataaattaagaatcaaacatgctaagtatatcgctcaaaattgctagtggtagactacgataaacagtgttaagtacctacacagtgtcaaaccgtgtatactgttctttttttttctttgacagattctgaatgttatattacatagtatcttttgttggaaataatagcaacttagtgatgagcaaattgattccggcgataataaaagaacaacaacgtgtttaacatatgtatagcttactagcagttcataaactagtgctatggatcgaaggaataaaacaatacacatgcttacatcggggttgttggcgctagaa

SEQ ID NO: 2415 - DNA, 1000 bp, Zea mays
  misc_feature (1)..(100): optimal_loci_228889_G1, chr6:129477502..129478501, Cluster 14
ctaggataacatggccgaacaagttggaggaccgctagtaggctctactctgaaattaaaatgaaaaggtgaatcggtggtagctgaactaatggcggacagtaaaagaactgaaccagggctatatatgatcgaatgactccaaaccacaacctacccgtcagttcggctacatgaggacaatgacttccagctggtgcaatggttgcattattggtccacgattgacttttttttctgacgtccgaacaatttagtaccggttcccgaagcctgattgatctgggtttgacttgcgcctccttcacactgtgatcattcttgcttgcttgtccatttctcgcctgctcacccacaagattcagagttggattggacacgagtcagagggcaagtgtgcagtgggtgtgtgtaaagcgtgccatgttctaagcttatctccaaacattagtacttaattcagtgctagaagcagcaatatgtcttaataagagatgtcgaaagaaggatagtctaaactaaaatcgtggcccaaacattgttggactaatgaatagtccagtccatttagcatgtgttaaaatactaatgtggaagttaagactgagcacccgctgcgctaataacttgctggctgtgataataatagctactgtaggaagcaacataggtggttctagtttgcaaatctaagtatcagcattcagcacgcacgcatgagccaaatccttttcccatgcagtagtataaagccacacccagcagtcacccacacacacacacaagcctcgtctgcctgcaatcagctgctgaggctaaactttccggttgggagatgttagaaaagcccatctccctttcagcgggcggaatgaattgagcctgatggtgaaacgttgcggtcattgacccaaagcatactaggtagtacaagtagaagtaggctagcagattactagcgactagcatcttgatggaacgaacgagaacgagacagcac

SEQ ID NO: 2416 - DNA, 1096 bp, Zea mays
  misc_feature (1)..(100): optimal_loci_229450_G1, chr6:131834876..131835971, Cluster 14
tgacaaacgtgtattattgtttgagtggtgactgctggtgatgaaacgagaacaaagcaaggcacatcacattcacggacggccggatgaatgggcccttcccatcccatgtgagccctgtgtcgtgtcctggctctggctgggcacacacgcgcgcagatgtcaacagcacgcgtaccatcagtctttaccccatctcttcgcctttgcgtctggcgccgtcgctgggcccgttgggtctcgccgtctccgtgcatgcattgcatgcccttcaccctcctccgtggggccggccggccgggggctgctgcgctagctcgatcgaccgtaccgcccggcacgcgtacggcggctttgctgcgtgcgtacgtacacgtacgtacgtctggcaagcacatgtactcgcacagcggtctcgatggacgatcggcgaatcgggggctacacctagctgtcgagcgaggtcagggtgggcggtttgcttgcgatcgaggccgggacgcgcgccgttccgggctggctggcctgcagctgcagggacgacagggtgacggtgccgcgcgcgcatgagcggcgcacccggccggccggccggtgaaacggagcaatcagagctcatggtgtggacgtgtgtgtggtggtgcctgtgtcacatgcacatgcacacatcgttattatatactggcatggaggagttagtgacatatacaggtacctcccggcccgtgcaaggctagctgcaactagctagctgcctagctagtgtatcgtagtagcggcgtacgagtagcgcgtaccagctcgcatgtactagtattgaattggagagaaaactagtttcatactatgctggaagagtaatgagatctactaatgcatggcatggtgcatgatttggtgaaatatttacctggtgtgctcgatcggtgtgtgaaggaaccgtgtgtgccatttttttatgatcggttttcttctccttgtgcaagaaggctacatagattatcttgattgctttgtttcctttttacttgttcctcctgccatgtatttcagattgttttttttttctatgtataggacacacttttggggactc

SEQ ID NO: 2417 - DNA, 1170 bp, Zea mays
  misc_feature (1)..(100): optimal_loci_231899_G1, chr6:142755571..142756740, Cluster 14
cctggcctgatgagcctaatcacgctggtgttccccgtgacgtcgggtcgtcctcccagcaatgcaagaagaccgattatgccggtgttccaggatgcttgtaaatacccaaaatgttctcatgatgcttgtaaattcacaagattttcctaggatgtttgtaaacaaaaaatgagatgtatttaaattcccaggatgtttgtaaacaaaaattccaaggatgcttgtaaacaaaaattctcataattcagatatcccacgattcagatgatccagatatcagaattcagaatttttttccagatgtcccagaattcataattcatctaaactgttgactgttgtccggcttgtgtattagaattcatgtgcactaaactgctaacaggtgcacttacattggtacattagaattcaactgccgaattcaactgccttctcagcttgtgtatgtgagcacacctggagtaagaaaaataatccaaggagagcaacatacaaactggcactgaagctgcatcaacacagattcattaatttgcaagtgctaaatctcaaaacaaataggattatacggtagaataaaacatcaaaaaattctgctacctacttatatttatttattggttcaatatgaaagtagtatgcctagaatatatatgcacatcagagaaagcaagtgtcacctgttgtcgtgctgtagcaagtgtcacctcggtggtgggttggtggcggtgatctggtggcattggtggcggtgtttttcttctctgttctttggcgtcgcagactcgcagtcgtctccaccacggcgcctctgaaaccttccccgcagactcagtttatactggagcagatgacggatcatcaggcgcgggtcgtcgatcggttggatcgtatcctctccaaggtggatgctctgtcgacccacgttgatcagctgcaggtacaggttcatctcaacaccgatgcagtggatcatgtggttcgtgatcaacagacgctggttgctcaagtggatgctacgggtaaagcagtggctaagcttaccttggaacgcatggctcgggatttggaggattctgcttcagtcatttcggtgagccctctcttcaccgtgttcctgttgatatgactcgtatgccagaaaacataggagatgaagggcac

SEQ ID NO: 2418 - DNA, 1338 bp, Zea mays
  misc_feature (1)..(100): optimal_loci_232111_G1, chr6:143980014..143981351, Cluster 14
gctagctaagattataggaaacgataataaagtttgtgtgtcaaatatgtttaataatgatagttaatttaacagaggggtctagggtttgtagggggtggagatgggttcagtacttgagaggatgagagggggtgggaggagattagcaggatacgacgtggagcggttgctgaggatggggaagacgaagatagaggtcaggtgttcatagagagtgactcgagaacctgacctcataaacatagagaaaaccaagcaattgcgtcggagtgtatactcttataagatagggttcagaggagagctaactcgactcaagccggacatgcgttctccatcacacacccttgtgcagccactggatcgaattgtatgctgtgccaaaagaaaggacaagttcaaggtcgattgcgagtagcaatcatgcattccatgcatcagcatgggcgaagcttctatactctgaccaactacgagattcgattttttttccttcttttttgtgtgcagttggtggtgtagtgctggagtagttggtctctgcaccttttttttaattatttgaggcaacaaactatataagatacctggcctctagcctagctgttcaaagataagttggacgacgcgaatagttgcacatgcaaatgaccacagaagtaggaataacagggacacgcatgtcgacctcaatcagaaaccagcaatgacgttttttttattttttgaccatttaacatttttataccttcacgattcgtgtttaggccacttttaattgggcactggaacccagattatctgcagaagttggtagccaaacattagggagccggacagaagcagcctgggaacttctgcacatgccagcccgttccaaccgcaggcgtacgtcaaacctgaaaaccccatatatattagatatatatagcgcgctagacgacgctccaccagttccagagcatttggttggtgtgcaaggtaaggtactcctctatcatccgcttgggcgtgcatgtgcgcaggccatctgtttgcattagcgcaacagaaagggggggggggggggggggggggggggtaaaataacagtattacgcaccaaaaggacgaaagaaaagatcaaaggtcgtcccagaacagatcagagcctcaagtaaagcgagggcctgtttcggatgcatggccagcccaggttgcttgggatggctaatcaggctgtgatcattcttttggctgcaaaagtaacggaacgcaacgcagtctgtgctgtgttcattgtcttccaaccggccagcgtgctgctccactctgctttcatgtttgcctccatta

SEQ ID NO: 2419 - DNA, 1266 bp, Zea mays
  misc_feature (1)..(100): optimal_loci_232698_G1, chr6:147021907..147023172, Cluster 14
gcattgctatgcagattgtaaacccttgctattattgctcatgatgtgatttatctatttagaacaaaaaaaaatatgtgaaccgaatagtaggaagagagcgatttgcaaatggcaggtgaggttgtcagcgcgcagggggcagagttttctgttttcaatcacaaagcggcataaaggcttgaacaactttgggaggatccgcaacctggtctggttcgtcatgccatttgcaaagcattagcttgattgcgtcattaccgaaccaggcccatctagtgtcactacgttaggtgctccaataatcgtccggacggggggagatctcgcccgttttagatgcacatggttcgctaacaaaaaaaaaccggggggatggctccacaagtggctgctgccccgctaagctaacgctactggtagattgtggccgcagcttccctgtccgcgcgctgatgctacctactacaacgctagtagatgagcaaaaatgtaaacgcatgatgcttttaaatagtccgtgtaggctcggggtgggaatgattggccgcgactgccaaggcaagccgctagtatgtagtatggtttaggctagcagagcggatctgaggggcgtcagcgtcaggcgcaccagatgcttgtgggggtccgggtccgtccactgccgcgccgagatgccgggtcgtagctctcgtcgccacccccacctgacgcgatgacgggggccggacgggtaatatagcttttggcggcacattcccctggcctggatggatcagcgagctgagctgagctgagctgggcacggcgcagcagactgagcagctcagctgcctgcgcgttgctagatcctagcttttgtcctggctgctgcgctgcgcctgcctttccctgattccccctccaccagaactgggcagcagcagcaagcaaaaccgggctgggcttttccgcagagcacacatgagcgcgagcagaggcagaggcagagcagcagccgtgcgcgaggaaagctgcgaaagttggattgggtggatagaaataaccaaagtaccaagtggcctttttttgctgctgctgttgttgtttacccccgcggcaataatgcagcgctcattcattccttcggtgctctaccactctattctattctattccattctattctattctattctatcgtggatggatggatctcccagggtgccaccgtgcagcagcagcacagcgtaggtggcggtgccgcctctttttaccgtttgcctt

SEQ ID NO: 2420 - DNA, 1305 bp, Zea mays
  misc_feature (1)..(100): optimal_loci_233219_G1, chr6:149126789..149128093, Cluster 14
atattggacttgtgacaactcgatcaatgaaatttgaccattacgatgtttttctctaagcaacgaacaagttgatacatgttgaaattgtgtcacttgagtttttgtggggtcaatgcccccaaaaaaagcctgcccggcttcagtgccgtattgggccttgtttttagccgtttggcccagcgcggcccggtacagaaatatttcgtattggcccggctcgcactgattcggatgaagcccaatggccggtacagccctggcccaactttgagcactagaccgagatccagcagctgaggaattcccgttttgtaaaaagattttgattggccaatgcagcagcagtggttgctgactccaagcgtctgcggtctctgaagcagtgaactagtgaagcgggcaggctcgcgtgcaggcaacgtgccgctgctccctcacatcacagtcaccggattggcatcttctccgtggccaacgctgacgcacgtggacgccaccacaagtcccctacagcagtacaccctcgctctcgccgatcgtcggatccaggtcgcgggacgccgggagcaggaagcaggcagcttcgtcgccaaattatttcctgttgcggggttcaggtcaggttcgcgcgcgcgggcgcgtcctggggcacaccaccgagattctgccaaagtgccaaccctgtgactgtgatggctcactttgccgtcttcaccagacgtcctggcccaaatggctcgctcattctgcccggtctaatcggcttccaaatctaggtgagctgttcagtcgattgatgagggactttcagatgaacataatttgggtttaagtccctccaatgataaaccggtaacacgtccagtgctcagtgctgaaagcctagaagcatattaacttaaaacatatacaaaataagacacggtattagccaagaggtaaaagaaaaaaatggataaaagcgcttagttactgtactctggttcagactaccagtagcggcaccaaatactagaggggatcggtagaaaactgcctaattttattaaaaaatgttaacttttttgaaattttaattaaaatatagaattcttaagaaacttatatgaacgtcaaaacaaaagtgccggtgcacatacaaatttatgaaggtcaaggataaaaacggaaatcgcgaaatttaggccgaaaaccgtgcactgcaccacccggagcgttagacaccaccttttaaaacgctgttaaactgctaacgaccttctaattttggttctaaaataatttttacatttcaacctccta

SEQ ID NO: 2421 - DNA, 1247 bp, Zea mays
  misc_feature (1)..(100): optimal_loci_233357_G1, chr6:149597885..149599131, Cluster 14
gtgtagggatagatagatcatagatagcgtattttactctttatctttatttattatgacgtgtgtgacaggcgtgagcaaacaagacaagcaataacagcaggaatatgtgctgccgtaggagctgcgcgcgaggggtctgaacgtactccctcgacaaggacggcgacggatcgacgagagaagggaatgtcaaaaaggcggcggcggggggatcagactcaggcgccgccgagagcgagaggtagcatgcatgcacaccccgagtgcgggtgcggccgcgggccggggaatatatctgcacgcgtcattgccacctgcatgcgtttgtcggccgcgcgccattttcctcagcccgtcagttgagttcagttcagttccatctcgcaatcgcagaattgtgctgccagcctgtgcgccgcgactgcgaggtcacaggccgacctgcatgcagcattttccacgtgtactcgcgtcgtctcgatcttatatgtaatcactgcttttatcagtacataatatgttagataaactcctatatatataatcaatcagatcgataaacatgagcttaagctacaccgaaattaacgcatcaaggacattaagacagtgagtgaaagcaacaagtcaccgagtcagacgcaacgactacacaccaccgtgtgtgcaactcgttttgcgctcacactaccagcagcataatggacggacggacctcaaagtccgtcagattccaccgagtctgtttctaccactttgcccccgatgcaaaggaaagcatctactacatatcatcaaccaaccctacactacatggagtaccatgcatgcatgcatatgctgtccggccggcggccacgcgacgcgagcgagcgagcggcacgcacgtctcgctgtctcttcccttccgtctcttccgtgtgcctctcgctatcggtcatgagtcggctagcttctccttccttcgtcgctcgtcccttgcattgcttggcctcatgcatggcctgtccatatgcgctcgagttccgtgccaatgctagcgtccccatccatcggacgcaaacgtacgtgattacggcagtggactttactccacaaattaataactcccgttcacggaccacgggcgtgggaacaacagaacaaacgagagcacaccaacattatatataccgagcggaaaaagaagctcagtgctagctacctgatatggtcacggcccctacgtcatcacaacatcgacg

SEQ ID NO: 2422 - DNA, 1076 bp, Zea mays
  misc_feature (1)..(100): optimal_loci_233536_G1, chr6:150302156..150303231, Cluster 14
cgacagaggaggtcaacccaactcgcagcgccgcctccggtacagtacagggctagagctagcgacaggtcgaccgtgtatcacgttcaacgccaggccagctcatcgttcaaaccacatcagctacgatgtcaggtctcagatggaccacagacggacggcatcgacacgttcgttcgtcgatgcacgatgcggaacgcaagaaacaaaagagccgtcaggtcaggtcggtcaacacgtcagagccgcatgttttcctgcttttgcatcgcattctccgacgtggcaagattggacaacgaagtggcacgagcaaggtagtagctgtcatggaatgaatgatccgcagtaccaaataaagtctctcgctccagtcagcatgaacgacgaagaaaacgcgtcaggaatggtgaaaattaaaggagtgtggtgtggctggcatgtggcggccgcgcgcaaggatcttacgtacggtaacctggaaagtacatatacaccctcacagtcgggaacccagcgtttgcttagcactgcaattagtagagcctgcgtttttgtttgtctattgattaacggaaggcaaggtgaatggttcacgtacgtataataataaaccgctcgagtgattccaaccaattccgttctactcccactttgccatgcagtcaacgaacaagagcaaagcaacagatctgcccgcccgactatacttactgcccccgccggtggacttggtcacttggccgacgacgtacgtgcttcaggtcagcaagtggtagtcactttcagaacatgctgcagctttgcttgccagaatgattaaaagcgcaagctttccagctgcacatgaatccaatgaaaacaaccaaccaaccattcattgcaagggccaaggatccttttgctggcgtgatcgccgagtcggaggcattatcgacaggtttgccaacatcagcgcagcaggcttcaagctccagtcccttcgcagtagtcagaatccacaagaccagcagaacaccactaagctagaaacaagagccaattctagaagcaaacaaacagttcttcgtacgtgc

SEQ ID NO: 2423 - DNA, 1091 bp, Zea mays
  misc_feature (1)..(100): optimal_loci_234042_G1, chr6:153193653..153194743, Cluster 14
ctcgtactatggtttgatggtatctataaatctatcttataataaggtcttgtcttatatgtattataataagcgtaatatagctacgcacccacctgcatggctgcatctatgtccaatgcaagcaacagcgcagaatgaataaactaacaaaaaagcaataatctagctaccaacaatatccattcagctaagggatcaagctaacggatgcaatattaccatagggcttcaaatcacagttcctaatactgcctgatatgtagcaaactatttcaactgatctcaactcatttactgacgaataagcatcatatgcatgcatatgacgatataaaggatcagcagactgctgtcagcctcgaattcgtgaagaccccccagtcatctagcatgcacgtactacagtggttggggtataccttcgtctaccatatgcatgtcatgctagctccaatacacagtacctcgatctgtactgtttgaaccacaagctgcccgcaggttctggaaaagaagacggctcgaagctttgcgcagttcccaacccattcactattgcaacgctcaaacccaaaccccgcaagagacggtgcgcagcagtttggaacccaacccattcaccgtcgccgcgccggtacgttgcacaagcgctcaagggggaaaagaagatggagggcaagagagagatgaagccggcgcggcgcacaacatcgaacttggattggagcataggatcagtccactcccggccgggttgctgcgcgtcgatggaggccgaatgcaaagcgattcgtggcacttctcccactacgccacaatcgcctgcggccggtcggccgcggacgccgcgacaggacgacctcgcgtcgcggcaagaggtaaaatgcaggctccccggcggcggcctctcacctttcttggtctgcactgcagtaggcttcagagaagcggatgcatgttcggcggagaacgatgaagatggttggattgggttccaaccagaccatgtacattgtacagtacagggccgctgaccgtagtagtctcccctctcccgccgcccgtcgcacaagaggaatgaagaaacc

SEQ ID NO: 2424 - DNA, 1095 bp, Zea mays
  misc_feature (1)..(100): optimal_loci_234047_G1, chr6:153202319..153203413, Cluster 14
tggcagccaacaaaccatggttttaaacagggggggatgagaatttgttggcggcagatctggacacagtgtgctgttctctccctcctttctcataggatgaaagtgacgactgcgttggattattagtggaacactgccaactcgatcggtggcgtcctttcttcctgcgtaaagtagtcaaacagttgaaatattaggtgagacgtccatatctgcatgcattttaattcagtccgtgacattctcgatccgtgcacttccatgagcttcagttccccaggcgcacacgtacggacgtgtctcgctactgaaacctcttgcttcgtcaccttttggggctagttagacgagggacggacaagagcgtagatgttgctcattcatcactacgtactccaattaagagcagatcgatcgattgatcacatgaaagctcacgatatcgcgcgcaagatcccatcagcagcatatgggtgcgtatgcatgtacatgcatgcatctcgatcctaggccaatatataagtgcccttttactttgcggcgcgccaacaaattaagcgcttctgtgttcgacgaaacgtgaaccatgcgtcgtcgtgcgtggtcctaaggaacagtactcagtgcttttgcttggcggagccgtcaaatacctacgacgattccccctagctagctagctaggttaacctcaccttaatttttttccatcctgaggcgacgaggcggcggcgcgaccagcgaggacgtacgacgacgacgagtcgtcgacggcgatggaaatggaaaaggctaatatgctggctggctagtgcagtccggattgcgatttccgcgtacgtcatatatagatcctccgagatcagtagctagctttaataatctgctttcgctgagcactagcagcagcttgatttgtgcttattttacttggcaaaatcgatgcggcttcttaacccatctggacaagtgaggggcggcgaaaaaccgggcaacgcaacgccgatgggcaggtttgctttctctcccccaccccctgattgcgaccgcgcgcgcgtggcaggagtgcccgtttttgttcaggtgccgttc

SEQ ID NO: 2425 - DNA, 1080 bp, Zea mays
  misc_feature (1)..(100): optimal_loci_234536_G1, chr6:155062715..155063794, Cluster 14
tcctaagctttgaggtcatttttgtgttttgcaccgggggctagaaaacccaggcccacatttgaggagttctcatacattttactccatattatttctgtaaacctgatctttctttttcccgtcaggggtaagtaataccaccatgccgtcgacgagatcggatcgggaggccaggtcggcgaccggtcgtgttgccctgccggatcctgcgtctagatgggaattagaaatacccacggtgtgacggtggtgccgtgtagtggagacgattttggtgctagtgtccgttttttttttaactacagggttttctgatcagataacgaacgccgtcgaccgtgacagtaccagagctcgagagagtgagagacacgacagagcagcgtgcagtccttttggtcaatggggggccgtcccgctcagaaaacgatacggccgtctgctgcgaaattcgttgatgggctgatggcgatcctaggctttctttcactctcgcgaccagccggcttctattacgaccaaaactgtactactataccagtgactagtccaatccgatcacaggaacaggaggtccggagcatccatctgaaaaccccaagcgaagccgaagcgtagaaactagaagacacaaggcctcccccggttttgccctgccgacctgcggttgcgggcttgcccagtttgcgcggaatgccggagtgacgtcagctcttcttccgccgcgcagaccggttctgcaactgaaacgcccgcaaggagtacagggccgcacggtgcacgccccgtgaagaagctacccgtaggctacgtcagccattgccgcagccgttttacccggcggccggcgcgcgccttgctcttgctcttgctccggtgaaaaaatttcctcggttaggttgggtattgacggcttccacgtcacgtggcgccaccgcgtttcgcccgtctgccttcctttttcccccacaagaaaaacacgtactgccgtggatggacaagcagctcggcgacggaataaagaaaaaaaggatttgacaaattcgactgctcctccaagtgcgatgcaccgcgagt

SEQ ID NO: 2426 - DNA, 1198 bp, Zea mays
  misc_feature (1)..(100): optimal_loci_235941_G1, chr6:162152630..162153827, Cluster 14
ccacctgcacggcgccactacggcaggccaggccaccagacccctccgctccgttccgttcatgtgtcgatcgtcgagcagtccagcttaaatgaacacgatgccgagatcaagcttaggaccgacacagcaggcaacgaccagagaaacaacgcgtaaaggaaaacgtgcatccacacagagagagagtggtgacgcatcacgcactttgttggatcgccgaacccagtactagctagtacgtatacgtggaatatatctgcaactttccaaagcggtgttgaacaaccgacgtcggcgtgatctcctctgcgtgtcaatttggtgcggcggcaaggcgctacgactacgacgacgacgacaccaggcgctcgatcgctgatggcgtgaagtcagccgcctgctgcgtcggtcgttgtttatccccgtacggcaggcggtccagcccgaacggcgcaacatgtgttgtgggtgaacgaaagagagaacaccacatgtgggcagcgcgaggcgcggccatgtggccggagagcgagggtgaacgagctacacgacccagctggcagtttggcacggcgctggcgtcacggatatcatatcgatcgggcggtcgatccaggagatactacggcacggcacacggcaggccaaaccccaaacaaaaatgaaaaacacacaagtgcgagttcggtgggctgcacgctagctgccaccacatgccggctcgatctcggccgcagccgcagcccgcaggcgtatcatccttccttgtatcgacgccaattagcgatgatgatggggctgcgctgagctggtcaatctcgccgcaccgcgcaggatccaaagcctccgtccgtcggagcaggggcacgcaacggttagctgcggctgcggctttgtttactagcagagctcatcattagctctcggtttgcgtccgtcctaatgattgtttgtttgttctgcgttttggacgacgacgtagtctgcttttaatattggctctgcatatacatttgcatccgtcagggtcaactgctgctgctgctgctctccggcccatgtttatgttcttcacgaacacgtaatattaataaccgagagttaactatcttgagcggcagcagcagcgagctgtacgtacctgactgacggcagcatccgtcgcggaattattattattattattattattaat

SEQ ID NO: 2427 - DNA, 1096 bp, Zea mays
  misc_feature (1)..(100): optimal_loci_236220_G1, chr6:163666644..163667739, Cluster 14
ctggggaggagaacgaaaagagcatggcgatggcggctcgacgagcgttcacgtgctgtgttttgcaagctagacgacgccacgtacgagtacgacgggcggggtggtgtatggtaagcatgcatgtgccgagaccgagatgcgtgatggcgtggtctgaggaaaccgtgtgtggcgtcgatcgtctcagatggagagagttttgcatggcttattacacagacctagctagccacctaggtaacgtagtagctagagatcgaaaacgtacggaaggccgagacaacgaaggagctagtacgtacggtacgatgcctgcagagaaagctccaaacttgggtagcaagaagaagtatgggtttttcaatgaattcaggtaataataacgataacgacgactgtgcatggcgaggtttgacgtctgagctgaacggccgggcagtgcgtgcgtcgcttcgcccggggtcgggggggggccggcctggccgcgaggcgcgagcgcgcggccgtggtcatccggcccggacgcgttgtcccggcctggtgcatgcacgccgtacgtacatcacagcggcgaccctcgcccagctggctagggtcgtcggccggcccgggccacgcgcggctccacgtcgacgctgtgcgcgcgtcagccagaggctcaggcgagccgtcacatcgaacggatagatacgcgctgcggcagtgcacaccacacctccgtacgtcctcctcctgatagctcgctccgtgtggtccaaatcggacgtctgggattcgtagtctgctttgcttgtctagttgtcgatctgggtcctaaccaaaagctgtttcgctgtgcacgcgtttgccgtgagatagatcctccatcggcacgtacagcgtcagctagctagctgcgcgacagggagggagctgagaattaagtggtgtgcgtcgttaagactctcttcaatgcaacggttgttatttgaagatcctccacaggaggcgacgacgaacgtgagacgatgtcatggcaccggtccggcactgtgatttgtttcatgtggttgacgatgacacgtcatcgcctcttatttatacttacagacga

SEQ ID NO: 2428 - DNA, 1037 bp, Zea mays
  misc_feature (1)..(100): optimal_loci_236455_G1, chr6:164795991..164797027, Cluster 14
ctactattactagctagccagttagcgtatcaagtaaatattgttcatccatctctctgcaagtgagaacgaaacccgtcaagcatgcagaaaggcttctaaaaagaatggagcaaaaaaaaagacacgctagtatatatgcttttcggtgccaaaaaagttgagcaagcagtactagtacttcgctgtccttttggccttgggctttggcaggctactcattccgatggagtctaacctacccgtgctgcatgcgtagagctgcagatcgcattatactacgagtgtaaatgcagctcgtagatccggtagtggcagttccggcctgccagtttgatttgtacgtactgctaccactgcacagtggtcggccgaccgacggggcgcggcgggcggcacgtcggccggcgtggatcgatcgatgtgagcggccggcgcgcgagagggacggcgcggcggtggactggtggttcccaaaagcaggagccgtgtctcgccgttcaatcttcaaaggcgagagagctggacgagtcgctctcttctctcttttggaaccttcccatggccgaaattagcggccaaaaagcatgtacgattctgtgtaccatcagcggctccagctatcgagtgatacttggtccggtcagaatcctcgtgctccagcagtctccatgcgtctttttccccccgtcttatcgcctgctcaaaactcagttgctaataattccttttccagcgctatcgagtttttgatttgctcgttggttttaatctcgtcttactacgagtgcgtacaccctgatgtgaaatcagagcagcatgtccgaagagggcatccttgcgagttggagtagaaacacacagatgcatgggaactcacggcggagttgatgggatgaaatggttttcttctggatcatcaccagacaggcagacaggacgacgggtgcctctggttgccgtacacggtgcggattaggggaggacacggtctttgcgcctcgccgtttgatcgacgtgattgtttgcctgtgtac

SEQ ID NO: 2429 - DNA, 1084 bp, Zea mays
  misc_feature (1)..(100): optimal_loci_236586_G1, chr6:165525840..165526923, Cluster 14
ggtccaccgatgggtccatggcccctagctacttgtcgtgtcgacttgcagaagtaaagatcatgttctcagtgctgtggttatttttttaaaaaaaatcactagatacatctctcaaatgatcgacaaattgtgataggcaaaaaaaaaattgcgtgtcgaaattttagacgccacttagtttacaccaaaatccatcaatattttatatcctagcacgtacgtgtctcgggttaaagaagaatcttcaggatatgtggacaaattcttcagcaggccagacgtactccagttagatacagtcatgccatggcgttttgtttggcgttccacgtacaggttgccgctctccgtctccggccgaagcacgcagctgcctctgcctgtaggtagcgcctgtgtcgcgcgcgcaggacacggagatcccagacgctgggcaatctcgtgcggccgcgagcccgcgacgggcagggccgacactgccaggcacaggcatccgccacgaccacgaccacgactagcagacaactagcgctcacggtgtcgaccggtccaccgcttccgtagggcgccacgccacgcatctatcgtgctgacagcaccagagcaatgcgaagggacaggccgatccagcagcctgaagccatctgcagctctcaacgacccttccgctcactcggttgccttgccgcaatcaggaacgcatttactggcgtgctctccggcaaaacttcttccctggacctgctgaatgccaggaaccaaacaggccacaatgaagaaaaaaaaaagatggtcagctcataacaaaaacttgctggacgacctgtactggatatagaggtttatccatagttctagtaatgcgtcctctcggattcagtttcttcagggtggaaaaaactgagaaatgctacaagaggggaccaatttatcccggcccctgtgattattatgtgtgctcgagcaggcctggttctttcaagtgtcaagcccaccgctcatcccttaattagaacatcatgaaatgtctaggagggcaacagagaaatggaattgccacccctaatggtttgttttggga

SEQ ID NO: 2430 - DNA, 1061 bp, Zea mays
  misc_feature (1)..(100): optimal_loci_238186_G1, chr7:5324345..5325405, Cluster 14
ccgcgcgtgcacatgcacgcatgtcgttggaaagtggagagaactcccttcgatcgatcaggtgctagttgcttcttgaggcccagatgtaggaggcccggcctgtcggccgtacgtaacgtgacatgatgcgctgatgtgcatcatgcaatgttatatttatcatataatactccagcatgtcgatcggcgaccatgcacactttgcttcaggacttgtgtcgtccctcagctcgactcgctccgacaacgacgacgacactctctcccccgtcccttgtcgctcgtccaacaacagcagtcctagtagcaagaaagccaaacgtgttaatcataaattgttggtcaaaaggctacctaccgtgtgtccgtgtcctaacaagaccaaaaatacgtgtgtcaatgttaactagtagaagaagcagtagccctttccacttttaactggttcactgcacactgaagaaacatgtatatactctcagatttttgaacgaacagtacagctgaccgggcactagctagtgttattagccgcacgcgcagacgacgtcagtgcaatgaatagcactgtacctcatgcatggaacatgtagccaacagtgtagggtatgcactgtacagcgcatgttgcttcttgctgttgacttgctgtgtggaggctggagaatatggagatggatcggagaagctagctagccctctagctatactatactactacactccgcagatgttgacagatggactgtacagctacgcatgcatgcctgcatgcgcgcgcgcgaatccacatgcacatgcatgcaccacgagtccacgaccacgacgacggacgacgagagtcgacgacgcgcggcagccggccggtcggcagcaggcacagttcaaagagcaacacagctgtggcgtgaacaagccaaggggaagcgaccaagcgtgctggagccaaggggaagcgcctatagtgtacgtagtacgtatatctagctagctgcagcatgctggcgtgcatgcatgcacggtctggttgacactgcccgaacactgcccgaacaatg

SEQ ID NO: 2431 - DNA, 1001 bp, Zea mays
  misc_feature (1)..(100): optimal_loci_241171_G1, chr7:21516121..21517121, Cluster 14
tgcaaccaccagctagcggcggcatgcagtttaaccagtgcaccgggcgtgtccagcaaggtctaccatcatcactatggtcggtgctgttgtggagcagcctgacgggtgcagtgccccggtggaacgttgtatgtatgtaggaacgagccagggcatcgacgtcttctagctagggtgtgtcgagcttagcttggtgttggtcttcagagggtcacccaaaatctggtcgtgcagattgcaatttgctgttgctcatacagacacatatacaaacactgcacgacgaaggaaggcctctagggagatctaactcactcttacaaaagcagatgcacccttaaagtgagaaacaagatccttaacattccctgccacctgcagcggaggaagcgagtgttgctcaagtattctacgatttcgctctttcaagatgccctcaccctttcccaccattcccctaggctaggctagctagcgatattagagagggctacgtgctgaggcagagaaaaatattcaactctggttccaaacctcttgggcaaataagtacttactccatggcccctccttcctccatagcattttactcaaattagcatgttatgagcgtgtttcgtaggacttctccacaacatattgtagcggcaatacatatagaagcggtttttttctttcttttatcagaataaagtggaagccaagcacacaataagtacttgtttggaatttggatagatatggattaaagagaagatcaaatctctttttattcaatttctatttaattttaaatagaaaaaatttaatccctctcaataccctctaatctccatacatctacctctaatccccatgcaaccgaacaggcgaagtaacccaaccaaacggggcctatatctgtgttgtattctcggacgcatggctgcttcaactgcaagcatgcaagctcatccacaactcacagatgctgcagttccatttagcaattatatagg

SEQ ID NO: 2432 - DNA, 1308 bp, Zea mays
  misc_feature (1)..(100): optimal_loci_253556_G1, chr7:105058062..105059369, Cluster 14
tcccaagcccccaccccacaaaaaagaaactaaaaaaaactttgcagttgcaggcctttaatttggacgatcgatgcggctagatctttaataatcctgcgaagcgcaggccggagagcaaagaggtggaagcactgggcctgggcgtatggtaattagtactatacgggcagattctcatcatagtttaatcaaaccaaggcggccgtgcgtggatcgttttttagggtgggcggagcgctattattacaccttctcgcgcttgctccatgtccatgttgctggtgtgctgcatcatggaccctggcgcgcatgagctacccagtcctactcatgagtcaaagaaaaaaaagggctccaatttcgcaaccccttttgtagctttatcgtagaccacccaatccgactgctgctttaattttaatcattggcaattctatagataatttagcttccgaataaaaagaaaataaacatagagaacaaattggaggtattattatagacatgaatcgatcgagctcgagcgagcaatgcgtgccgcatgccctctgcagcgcgccagaaagtggctgctacgtctacgtgtactctcatcctctctctgccagtcggcctgcctgtacgcaaagtcgtttcttacacgcttcaacttaagaaaaggagaaagggagatgcatcctacattttatcccgggttcggataaaaaaatgaaataaaggctatctcgctatactatacgcctacgcatgcaaatgcgatgcaaacgcaagatcgaaaaaaaaagtgtggtgtgacacagcacgcggtcggtcagtcagtcagtcagatcacagtcaccgctcgctcctctcgtatgcccgcagcccatgccgcggggcccggctgccgagagcctgagactgactgcagggcccgtcggtaggtcacgtcacggaggtcactcccttccttccttggtcatgctttgtgcatgtgctacagccatcaatgccatgcaatacgacggagatggatggcgcgtgtagagccggccggccaccagattatacggatattatttttgttttcttattttggtactcggcctcggactctcagccggttagtctatctccgacggttttttagatatcgtatatcccgttctatattttaaactaaaatctactatgtaaataatatcataataattctgtgtccctattttatgctacatactggagacaatcttacgaagttatattcactcgtaccttttctgtagaacatagacaaggaaagaccatacttcacactgcttgtta

SEQ ID NO: 2433 - DNA, 1316 bp, Zea mays
  misc_feature (1)..(100): optimal_loci_254418_G1, chr7:109538624..109539939, Cluster 14
ttcgacgttagttcaaggaaatttatttaatcccaattgttaacagcgcgctttaagttttttttttactgattcagtttgctcagtggacaatcagtaaaacccttgaaataatgaaagaagggggggacggtgtgatgagctgcgttgcaatggaagcccggttggactagagagccaccaaagctgcactcattcttgaggatttgtctagcagaggcatcgtagtcattgcagaccctaaaactttcctgcgcatccagagattctccacaggatgatggatatcacggttgactaaacatttctaggtgctgcagtgcagcctcgatctaaggtccaagtctcccccgtaggtcttcaactcggcgcgcgcggtcgatcaagtgcagcaacattcttggttgttggtattctctgtcaggagaagaggagaaaaggtgtgtgcttggtggtgttgttggtaggcagccacattttttgttggagtcctctgtcgacgagcaagcgtaaaggtgtgtgcctatataagcccgataatgacccagtttactcttggtttttaagactttaaagatgttccaatccaaatgctacctctctgatgtatatctatacttgtaaacatacagcgtacgtgaaccgaatagcagccatggctggcataatatataatgcgcaatcgtactcattaattcagtgctaaccgttgataaatgcattttaccgatgccgccgtgtgcacggcagacattattttgcaattcagatgtatactagtagccactatatggttgactgctactattccatcctgtaaagaaagtacagagagagataaattaaacaaaacaaataaaagaggcttccctgtacgcattgcctcctgcattgcagaagggacaagtatgcggtactacatacacggacaaagggatggacaaagttccaaaaccggagcactaaaggacagcgcatcgcaaaaaatgttctaatcgtaaggcttaggcagcagcatgcaggattgcaggctagcttagtttactttattagagtatcatcattattcattatattagcgtctccatatatatggactggtcaatcggtcccttgagcagcaggtcccatcacccagggggggggggggggggggggggctttattctgtatcgatctcctgcttcgctttttcaccacggacggaggatgatcctgaagcaaaaaaaggcttcccttctgaattcagattagcagcatatatagagtagtattgcagtcgtggcgagaaaaggtacttaggctatcttcaacag

SEQ ID NO: 2434 - DNA, 1016 bp, Zea mays
  misc_feature (1)..(100): optimal_loci_255824_G1, chr7:117528038..117529053, Cluster 14
ctatgagctctagtgcctaaatatctgcgtgctcttggcaaataatcccggagcagacagacagcagtacagtactcgctcaaggctgaagcagtgaagcccaacaaccgcattcaaatttgcgcacgctcgcctcggacgtcgtctggccgttctctcccgccaccaccaccaccgtaccatctaccatacgtgccccgcacccgcaaccgaaaagcgggaccccgtggaggcgtccacgttcgtcgggggccccccagcgcgcggtcgccaaccgccacgttgccccgcggcgcggcgtcccccagccccatcaccagcacagcagcgcgggcaccgccgtggtccgtaggagggacggccgacggcggcccccacaccgcgcggtcccgccgtttgccgggcgcttccgtgtcccgcctccgcgaccgcgagcggccgagcgcacatggggcgtggcgtggcgtggcgtctggggcgcacccaccgacgcagacgcagacgcagccgggagccggcctcggggcacgttctcgaacggttcgcggtcgcggccttctggcctcccgagccccgccgcgcgcgcaacgatgtcgttctttttttttttttttgaggacaagcgccctgcgactcttgtgacggaacgggacagcgacgacgacatgcgaggtgcgtgcggcgggaggggagcaaatctggcatgtggcctgtatcaggggggctgattcgactcggagtcatcatcaaccggggagctccaagtgaccaagtagcagggcaaattgcccactggcgtgattgctttttttttgttttgcagtggaggggtcgaggaacgaacgcgcgacagaggtcacgaatcacgaagatcatcgatttgtccaggatctaggaggattatccgtgatgcaatgcaaccatgcatgatcgcaccagtggtggctcctttttttattttttttgccttttttattatttaagctgaatgcttatgaccaactcctcctcatcca

SEQ ID NO: 2435 - DNA, 1101 bp, Zea mays
  misc_feature (1)..(100): optimal_loci_256641_G1, chr7:121373263..121374363, Cluster 14
actaggggggatttgataactgtggatattatattagacgttatccaagatgggaaatcatcgatgtttggatagccgtgtgaattctgcgagcaggattaagtaagtagtcgtcgatcggagaggcttttggaagagatgagaacgaagcctgcacactcgctctgcaactaactccactgcatgcagacagtagggctagacgcagacccatctgctgcaccgatctgtatctttctgctggcatcggcggcacacttcactgtcgatttgcagtgctaagcatctggatcagtagtggtggtggctctgacgaagcgacatgacaggtgatgatgggcatagcacgtagccggcctgctggcatttcacgagctaacacgagagggcggtgctgccaatagaattacaagcaagcctccatgtcacaagtacgcgcaatgatgcactccaaaatgtgcgtcgatatttggtctgcacatgaacatttatatggctggataatgtaggaaactaatggactttacggcgtgcggcctcgggccacttttcctgggatgagatcgtgctagggacggacgacgaacgaagggtaggcaggcaggcaccgccgcagctggctgcttagctttctccccatgtggtgcgtgccgggcttggcgacgagaagatgataaccatcgattcgatcggcgtcgttgtcccacgtcgtcgcgctgctggcctcgagatgcatgagccacgccacggcagatcaccctgcacttttctccgctctcgctctcgatcgatcggcggcaacggcgatgcatgcggtgcgtgcgccaaacacgaggagattttagatggaattgagttggaatccccgcgcgcgtctctccctcgcctgaagtggaaaccatccgtcgagcagtatcgggaaactttgcgaccgacgacctggctggctgagctgccacctgcgaggcgttcgtcgtaggagaataatggtcaagctaatgcgtcgtggtcccttagctatagaggactagggccgctaattatagacataagcccacaagttagcaacctcgtactagtagtaaaaacttgggtgctgtt

SEQ ID NO: 2436 - DNA, 1256 bp, Zea mays
  misc_feature (1)..(100): optimal_loci_262771_G1, chr7:155737927..155739182, Cluster 14
ttggcagtacagtgttccggacagagtaaaggcaattagctgtatcagaatggcaacatgatgcaaatggagcgagcacgtacgggcacggccgccctccggactccgttggcgcgcgcgcgcccacgtcggaccacacatcttccccccgccggcccgctgtctggtacgcacacggatgcacgccacgtgacgattggactcccatgggcgatgcgctgggcctggacctggacctggcaggggcagcgcgaccgaccatgactctgactgagggccgcgcagcgcatgtccggcgtcggagtccgcgcgacagttgagaatgtggcgtccacgaggaattaaatgctaatactccgtagtaccggacgggcggcgccgagcgagcaacgcacggcacgcatcagagacagggaggagcctgctggagctgctatctccttcgtttccggcttccggccccgagtacgtacaccgacggccaacgcctcgtttaggcatgcggtgcagcacaccaccagcaccaagcgtggcctgaccagctggttgtttgccaccgctcgctgcagcctggctgcctggtccctccctccctgcatgcatgcacagcacagcacagtccagtccacactccacagagaggtgtttgtggagaccagcacgcagcagcagcagcagctatcccttttctacacttttcaacatgaatgatggtttgcgcctcgtggtggcctttgcagacaaaggagattgggaggagaaaaggccagagtctgtttgtcacggactaggtgacgagcatattcttctccatcctgctggctgctgcggtgcgctgctgccactcctcgcctgttgattcaattcaccggtgaacgcacacacacacagagagagagagaacaccagcagttcgttcggtttcattcaaacgcacaagagcccttaatttgccaccactccgcgtctcatctatagtaggggggggggttaggaataagactgggttagatacaatcaaacagacgtggactagtgccctgcgttttaagatgaacttaacaccatgctacgccatgagagagagagaagcatttgcaagtaagcggcgtgggtagatcgatcacccgtgtggtgtgggccggatgaggcgcggccgacggtgggagggacactctgcactgcgctggacagtggacactgtgctcagcatcctttatttaatctttgttttagcttctcggagagcatccaaa

SEQ ID NO: 2437 - DNA, 1027 bp, Zea mays
  misc_feature (1)..(100): optimal_loci_26311_G1, chr1:160122583..160123609, Cluster 14
ttctgattttattttcaccttcttctgctctagttcggcaaaatagtaaggaatagggtcgttgtcgagatcgcaggagatctcggcactggggactgagcagagcagactgtcccaaggatgcttcgaccatagtgtgctcgggcgacggcaggcgaggaaccggcgatgttgtggctgtacatgaacatgtctccggtgaggtgggttggacggcatcgacgacgagcggtaggcggttccgaggaagcagagaaagaagcaccggtggcgaagggcgatgctctggcaaggggcaacagggactcgttgtcacgctgttcatgggaagcagagctctggcaagacgacgaccgacgggcagggagcagcaggcacggtgttgcaatttcagtggtggggacgacggcaagcatcgagcagcagcagcagcaggcacggaggcgagtgtgatctcggcgttgcgaacggcgacgtagtgcgtgcaaggcgcaggtgggcagaaaagtcagagcgagcgggagagaaaggagaacgaggctgtagggacaaagagcgccattgatgggcgcccctccgctacccatgtgtacgccgctgccccaccattgatcgcatctttgcctgctgcagtggagcagccgccgcctccttttctccccttccccactgagtcgtcctcctccatcgcgccattaatggcgtcgacgcttgccgcttccttccctggcaccgttactctttccctggcttataaatcgtgctgtcgcgacctcgtcgatccatttctctaattctcgatcctgctacatgcccttgccgtgctatccaacgcggccacagttccgtactcacgtcgttcaccaccgcgcgccagtcctcatcgtcaatggacgagcccgcgacgctctccgcctgctgcttttataaatttatagctaggggaaataaaccatataagcataatataacaatgcatctaatttggcttgtaatcttatctggtcccaactggactcctagagac

SEQ ID NO: 2438 - DNA, 1043 bp, Zea mays
  misc_feature (1)..(100): optimal_loci_263796_G1, chr7:160595219..160596261, Cluster 14
aactgattactagaaaattaaccctcctctagttagactatttctagatccgccggcgctgtggaccgtccaaacattcacccagccatctacagctacagttcccgcttccccgtcccacggccgcgcgcactccgcgtcgtaaacggcacattggcattgccaaatgcagcacgcgacacagggggtcggcagtgcaggagacctttttttctgtgggagtggtgggcggcggaccacaagcagaatgagtagggaggagtacctgtgtgtgctgtgtgtccgctgccgcgctcatcactcatcaggcctggcatgtactataatgagtagggaggagtatcagtgttgttgtgagagctgtaacggaggaaggaaaaaaaaagacagcacctggtgggtggagaaggagtggccttcaaagttttacagctggtctgcttgtttttatcggttattatcacaggcaattcgcgatgcccagtgctaccggtgctgcatattcctagtaaagaaagaaagaaagaaagaaagctcgcgaatggaatcctcctccgcggcggtggttgtgatttgaaagccatgccaagccaatggggtaggaaagccaagctagcgagagggaaacggaagaaaggcgaccttcgtactgtagcgtagccgttggtttgtaaaaaaaaaaaaaaaagaggagcatagtaggtaacgggaatatacgattttattgaacaagacatgtgtaccgcctccgtctaaaagcacaaagcaattctaagtcaaactactaaatttatataaaaatattattaatatctaggactgcaaatgcacataaatattatttaaatatatgcttcgtacaaaaaaaactaatgacattttgtttagtacgatatgcattaatattttgttaatatagatttagctaaactataaatcatgcgacttagcactattttagatttgtaactgtacgaagagtttgtaactataaatctctcggtctttggctcccgtatcggcgccaagagtttgcacatatg

SEQ ID NO: 2439 - DNA, 1246 bp, Zea mays
  misc_feature (1)..(100): optimal_loci_263832_G1, chr7:160749348..160750593, Cluster 14
aagataccctgacactggaatggagtagctagtagataagagataagacatggaaagcagttagaaatacgtgtacaaccaagtgcacatacgacacatgtctctttctattattagcatgccagccaatgtcgttttctccaaaccacacgagacgataagaatgtactcgccgttccaaaaaaaattaatccttgttttttattagtcaaataattttaaagttaactagacttacatataaaagtattgagtgtaaatgttaaatttaaatttaactaaccttacatatacaacaaatattttctaatgggtatcaaaccagagtattctcaaattatgatatcaaataagcattattagtagatttatcatgacatatatttttacaatctatttacttcgcattataaatatcaatatttgctctatatatttgtttacaatttatgcacgttttcaagaatgcaatcaagtttttgtttggttgttgccatttgccaagtgtaaatgttgttaatgaaatcgaattacattatattgtggccgtagataatactaaatcagatcgtgcatggtctttgtttggatttgaaaggtagaggaaatcagttgagtgcgataggctgcagtgacgaatctttacggagtgacgaacgcacgacgacggagtccacatccactcccccagcgacgaacctgcagtgctagagccgctccccaagcgacgagaaagcgtgcgcaggtccaccactttcctcgcgttgcgtcggctcttggccttgccattcccggcgaccgccgcccgcggggccgcctctacatggcgacctgcagtttctgcatctgctcggtgcacattgcgcggaggtgcgtgatgatgtacttctagcgcgcattgcttgctgctctaggtctttatcgtcaccgctcgtcaaagccgttcttctgaccatggctcctgaggaccaccgccttcttcttaatgaccacaaccactgctttaggattaggaacgacggcggcggtgttgaatccgggaacctcctggggtcgctaattttgtgggagagggacgtgacttctctgttggtcgaagcgcgtagctcgtcgaccacggatgcatctagctacgaaggcgtgctgtgtgaggaagaagggctcaaggtctatagtggcggcagcagtatcacggcggataaggcttgggacgaccgcgaacggatttgaatgattggattacaag

SEQ ID NO: 2440 - DNA, 1157 bp, Zea mays
  misc_feature (1)..(100): optimal_loci_264299_G1, chr7:162978958..162980114, Cluster 14
cacgcacatctccagcgtgaggtgagaaaatgagaccaccaagcaggtaaccagcacagggaagccaacacgtgcaaggcaacgggaaagcgagcccggtgctgcacgtccgggcgtggaaaaagcaagcgcgcgatttgattggttttacttttttttacgttgcgttgtggctgtgccgtttgctgcccacaggccacacaggtgacggacgggcaggggcaggggcaggggcaggcagccttgttttggacgggagccggtgtagggaccaggcgcgaggcggcgacggctgccttggacgggagcctgccctgaatcctgatggcgagacggcacccgatgcagacgtccacggcgccatggcggcgtccggaagcggtcacgtcacggtagatgatatagctttcgttcggttatggtcattcggatgaaagaaggaaaaaaaagtacggtgaatggttgaaatcccctcctccacaaaaacgacgggaaaacgattttcgcacaaaactggaggtgtgagtagactgcaacagttccaaagactcgagagaggggttttgctcaagaacggttccaagagcatccgctgaaatctcttttgatctaaaacttctggtaaggttcaataaaaaaagagagcatctataatatttattggatacgttttgagatgctccgctaatcagatccggttgtcgtttccaccgctggtccgctgtcgctgtagagcctgggaacgtaacgttcgcaggagattgcacggaggaggatggcaggcactcaggcagcaggcagccacgtctcacgtctggggcaagctgcaggcctgcagctccgcggaccgaccggtatgatgtcgcgcacaccccccacactggtctctctcacgctctcgcatctctcgtcagtccccgactccccgtgtgcatgggagagcgtcggcacgcgcgggtaccccatcccatcacgcacatcacatcgcacgcgtctcccaaaagcagcgcgctcgtcgccgtgcgctgaatccagtgtccctcggccctcgctaatcagctgccaattgatcaccgaagaaattattcgcttcacatcaagttttgcggcactcctcctgccttcttcttgaccggtcacattagggcccggtcaca

SEQ ID NO: 2441 - DNA, 1339 bp, Zea mays
  misc_feature (1)..(100): optimal_loci_26476_G1, chr1:161035313..161036651, Cluster 14
tcgctttagcaggaacaggacgcggccgctatcgggcttcaccggatgctacagtggtagggaacgtgggcaagctcagacgcaagaagagaccctgaattctttctcggaaaagttctcttttttctctcggaaagcaagaggccccgaattcttgacttgatgggcacagcaccatcgatttttccacgcggaggtctcgtcacatgaatctcgatccagcaaagatccggcagctttccgcggccggtttcgctgcgtctgcaatggccggcaagcagagggctcgaatcaatcagctacgccgcgcgcaaggagtactggacgaacacagcagcaatcggatggatcagaccgccgccacttgggctgcaccagctagctagccgggcggcagagtggagcggtagggcggcactgcgtttgacttgcggccgggttggcgccacagcccacaggcatcggcatgggcatggtgctggtgcatatgcaaagccttgctcgtaaagttgcaacctttacttgtgctatagtgcagctgtagggcgctgcatgctttggtcagagctgatattccatttccattccattcccatggcggcgtgtcggtctggctctggtcgtgcatggcgagaacagaaagaaattacctgggggcagctgtggacacatacagctgacagtgagtgagctgtgtgtgtgagcagcagagtggcctttctgaccgaccgaggtcactcacaaacatcaaagtggcccggtccggagggacagttggtcggagatctgatgatcggtccaaagacgcacgcacgcacgcactctcggctgtaaagcgccattacaggactgggatgcaatgcaatgcaggcaaagcgacgcagctagctaggcggggtttaaagatgcagcggaatctcatcgtgcatgcggtgcctgccttttttttcccatggcggctttactgcatgcaagtctgtcgtcggcggtttagctagcgagaggagagagctagcgcgcggccgggttggtcgcggtcggtgcagtggtgaatggaaatggaaatggaggcagggccactctcgctactccgtaagcacgcacgcaccactggcagcagtgggaaggcgaaggacccagcggagaagagcttctccggcaactggacagcactaccaccgtcgtcgagcagctagctagcttctagcgatgacagcttccgcgtacgctgtctgggaattggatcccgtttcagtccatatctgtctgtccagtgttcgttcagacgagcgttttttttttcctgttcgcggcagcacacactgcactgcgggcgtgg

SEQ ID NO: 2442 - DNA, 1152 bp, Zea mays
  misc_feature (1)..(100): optimal_loci_264994_G1, chr7:167142005..167143156, Cluster 14
cgatcaaggtctaacgcagccgccacacatactaataattagtctctagaaatcaaacaccacataaatcaaccaataaatactaaaaaggtagtcaacgcaaactggatcctccgctttaatttggcatttcctaaaagcgtgttttttttctagggggtgtatttaaggcaaggacgatcgatgagcggaagaaatagcgagatcaggcgatgaaccatgaccgcgtgtccccgtatccatcgacgcccggggggagctgtcgtgacaaggacacgagtgagcgggtgccgagcggtgcgcaggcagcagcactgcgaacggggacggcgagaaagaaatcattagcagggagggacgacgcggaaaaggaacatggagcctaatcagcaggacgatcggttggaggtcaaacactcctcctaattttcctcccttgattccgcggttgtagaatagtagtaagtactaggattgagaagaacgagagataagagagacctgagctggacgaccgacgcagggcagggcagggcagggcctgccgccctggtttaattctagtagtagtagtggtggtgctttgtttagcagttagcacagagagcccactcaaaccaatccccacgtcacgcgcacgaactgccgaggaagtttctggaacgcttgattggcgttcagccgatttggccgggaacgggggagtcggcaatcgcgtgacgttttcacgcggtgccgaaatccagtgtgcgatgtagtacgtagcccccaaccaaactcaaaacgaccggcaaataaatatcctgggcaaggtggtcggtgagttagggttagggaattggattgaattaaagcccagagaatggtgatcattgtgtctagtactactccaccagacccagagggcgcggattaagcggcggggcaatcagcaaaagctgctgccgccacaccgaggggcggtccggtcggagtgagctttgcttcggtccgaatcatctgataaaaaggtaattcgtcgtacgtgtcgcagctaaacttaaacctgtgatgaaccaggcaaagcgtgcgcatcatattcatacctgcaggtttgtttgatcttctctttactcgatcggcaggaacaccgatgaccaggcaacgcttccc

SEQ ID NO: 2443 - DNA, 1322 bp, Zea mays
  misc_feature (1)..(100): optimal_loci_269389_G1, chr8:13293775..13295096, Cluster 14
tcctcttgggaaatgaggatttttttttcgacagagaagagtacatgcatatgcatgatagtggcttttgtagttagcaaaaatcatcggcgtatctccgcgtgtatcatgcacaaaaggtgaggtagatgagcgccagatctttgcggtacctcttggaatctccaaggaccgtttgagaaatctctttctttaatgaatatgtatgccccagctcatctctcttcttttttatcatatatgtgtccgaaaagaagccatggatgagtgcaagggttggaaggaagaatgggggtggagtatgagtatgatccgcatccgaagtgcggccataggactaggaggggacctcccctagatggcaacgggccaacgcgcagcggggaagcagcaggccagataccacctcctccacgccgacaaacagggctagctactacgtgcaggcagcgagtccccatgtccaccgctttcttggaggtaatggagggacccctatgcttgacggcacgcggcaggctgcctcagtgcctcagtatggcctgggaaccctgtcggaaacggagccaatggacgatgcctctcagctcactcgtcgatcgcgcggccgcggccgacaggtcgacagccgaaggtgcgggtgcggcccacggacatgccgtgcgtccgccatgcacgcgcagatgtgcgcacagctggccgtgtggtgtggaggctcccagagctctcgaccggcatgggaaacatgcagcgtcaagcccccaaactgtcgtcgagctcaaggaagatgctgcaggcaggtcgtgtcgacttcagttacgcatgcactagctagtgctacacatgaatcatctctggaagctgtgtgtagggtcatgtaattggatggagatcgtgtcgtccatccataattattgcatggcgacattagttagctggacggtctcgttctaaatcacatgcattggtctgtcgcgtgttacatgctttcatatatataagtatatacatatgcatatgcgcgtgaaagtacttttggcaaacaataaactaaccttaactcatgctcagcagagcgtgcacatagactaccaaaatattattttgtacggtagactgtattgtttatatggtgtagtttgagataagacatgatatagtgatagggacggacccaggataaaatgagagtgagcgcacatttgtaaggacgaacaccgaaataccagagcagtgacatttaataagatgggctgagcagaaaactttaaaatgaaaatctggattctactacttacaacagagaaatgaacgggagccta

SEQ ID NO: 2444 - DNA, 1109 bp, Zea mays
  misc_feature (1)..(100): optimal_loci_2697_G1, chr1:14036589..14037697, Cluster 14
aattaagtaaattttatctaggtaattatgtaatcatttatatttatatttcattaaaacgacaaaagaatacgtaagaaaaataatgtggcggtcaaggatagatccacattctaggccacccggtgagtagaaagtgtggttcatataagttgctccattgtaaaataatcaagacgagaggagaaaagaaataaaaattcagcagacttagcccagggcgtacaacagaacgatagactcctccctttgggggcacgggactcgtcaggcaggtaggggatcctgctcgtgcccaatagctgcgggtggttggcccgtgccacgcgcgcgtactgccgccggcgcgagagtacgtcctggcactccagacaacacgccaggtctggtagcatcaggaaacagagaaggagaaacagcgatacgagctcgagtgtcccaggtccaaacacagctccagaaaccacgagtgcgctagctagctaggcgatctggtgtgtgtggctgcctgccttttcaccacccacaagcaacaaccgtgccggctgctgtcgctttcgagcaacaatctactcgatctatgcatgcatgctgcattggccattgtggggactggggagccaggggcactgccggcccgggcctcgcgctggttcctcccccgcggtcggtgttgggggcaagtaggctgggctatcagaaaagcgccggcctgaatacgcgatcgcctcatggacctaaacacagagcacgtctgcagggatggaccagctggatatatagggtgtgttcattgcaggaggttgcgcgtccctctcgtagatatgatccttccttaagcttaagcctatttgtccgtctctgctagctatagcacttcattccgcgagtattgcatggaccaccacgccacgtcgccacacacgccatgcccgcttgggcgccagcagcagccgtggacgaggagcggtcgccggtgcccggttggtcgaggtcggctgtctcatttattagtggcagggcaggagtgatcggcacagcgaggacccctacgaggtcacgacagctccaatgggtaggctgggaaaggctaccaagcacattggact

SEQ ID NO: 2445 - DNA, 1338 bp, Zea mays
  misc_feature (1)..(100): optimal_loci_271142_G1, chr8:23992850..23994187, Cluster 14
agccggcccagctgcagatcgaggaggaaaaggaaggcggccatgcatggtctccccgccggtggatccaaatccaaacggacggccacatgcatcatcaggtgtctgtgtctctgggtagagctgcggggtgcgcacaggggctagagatagtcagcacgtacagacacctcacctgcagctgcatgcccgaccgaatccagcagtgtctgagtgtgcatgatagagacgaggtcgtcgtgtagccagccccctcccggcccggccctctgcaaggctggctgtgtgacatgcacctgaaatgatgaatgcgtgagttgttcatgcgtgttcatccaacagggccgccacactatttcacccctcgtgcttaaaaaccacaccaattttccccctcttgtattccttattatatatagacggtttgactcatcagaatgtatactgaggtggaaaggacagatcgaggagtaaagcatgcatgcagtagccagggcactagggcagcggtgcgtacgatacgagtcgttgacgctcggtgactcaaaacagccgcttgtactttagcctgcgtggccatgggccgcttggtccaggtccaggtgcacatgcatacacagcagcaacttgcatggcgctggatcggaggacgacgacgcacgtgtctgcatgcagccggaggatatggacggatcgcgcacttgtagtaatcctcatcagcacgatagctaactacccctcgcatccaccagacagcatgcaagaggctcgcgggtccttcgctaattacctgctggcgggttcccggcgagtttatttagaccttcccttcccggtgatggggacatgtgccatatatagtactgtactccgtccgtacggccaggtcaatccacagtgttagggtagcccatccatcgacgacgacgtacgcctgctagctgtcgccgtccgtccgtctgtccatcatttcatcagacccggtacgcccagtccagtcagccttttctgctgccccaaaccagcggatccccgtcgtgcggacaccacacctgtaaacctatgatacgtgccgtacctgccagtgccagtgccgttggattatattgatctcgaccctagactctatctagatcagaagacagcctgatttcatacgccatggaagaaggcgtaagctagacaattttgttgctcattttccacgtatatatgcgaccccgcatccgcgacctactactatactagaagcagccttactagtaaggggaaggtcgtcgtcgtcgcctctactgcacccttatcgtcgccaccgctgatctcgcttcggcatattgt

SEQ ID NO: 2446 - DNA, 1337 bp, Zea mays
  misc_feature (1)..(100): optimal_loci_271427_G1, chr8:26100850..26102186, Cluster 14
cacgattaatggtggctggttgaatgcctccgttctcgaatatttgtcgccccccgccccgttaggaaaagaaaatgtttatgccattgttgaagggaccgtacgtggttggtagccctgttgcagtgccagctttgctgagagttagaaacatatgaattgtccgaggaggagaaggggagatgtgagtagtagctagcatgggatcctgctgcttgcccttttaataattgatgattgatctggtggtcatggcatggcaactttgccgtcggtcgacgtaaagctaccaacaacgtagagcaagcaagcaagcagcgccaaagagattcagacatttggcaacaccaccagtcatcgtatagaaacagtcagtcagtcccctgacgagtgatgagcttgcattgcattgcaggtggtcacagccgggttcagaaaaccaaccataggaattaatcagatcgtctccatctggcaccaggcagtgcaagaacactgctcctccacagcacggacgctgacacagccgccgggctcctcctcctctggctctggctctgtgtctgtgaccaccgtccctgcctcgccgtttgggacactgttccacttccacgacggatgctgacacagcccaacaaacaaaccgcacagtaccagtgcatctcgttctcggggcgcccactggactgaagaggagatctcatcgccaataaagaaaaaacgccaccgagtggctgcagcgagggccacgacagccagcctgtttctgacaatgaacctaaggcttgctaaagcaaaggattcagccagatcgagcaatagtgtcacgtcttcttaataacgactactcctctctgttctaaattagaaaaaaatttaaaactttttatatacattagtttcgctatatatctataatgagtagtaagtgataacaaacctaggatattttacgtatgattttaaaatagatggagcagcaaataattcggcaacgaaacctagtaccgacagggaaattaaatgtactacagcaacagcacgcctggcctggcactggcagcaccgtctggtccggtgtccggtgagcatgatcgagctcagcagagttgatgagctagtagtggtcctgctacacaatcacatgaccttcccctctccgactccaattattggacaagtacgagccactccactgcacaggttgtgaaccgagacagttttattttgtaccatttcctccttcaggaaaataatgcatttctagcatgatactctgcgtctctgtcaaatcattttgtgcttgatcaaagttattgaaaaagatcaagagacat

SEQ ID NO: 2447 - DNA, 1068 bp, Zea mays
  misc_feature (1)..(100): optimal_loci_277850_G1, chr8:72421446..72422513, Cluster 14
tatatatatacacacaacgtgatgaatctattttttcctaaaaaagaactatagtcaaaggtattaatgaatatttgatttagggccaaactaataggacacgtattttttgggcaaaatcgggtccgacgcgttcatttgatccaaggtggaaaatggttagctcgtctggtagtactaggagattcccagcgcgatctggctcgattataaacatggcagacactaatcgtcgtcaggcttcccgcggcactggcacgagatggaccgggccgaggaggcgggggagcacgataagccggcggcgcaaccgccgccgtcgccgtgggactgcgggagcccgctgtaggctgtacgacgcgctttgaggtcgtgtcggtgcaccgcgtcctggacaccctcctgatggcgctgccgttcgcgcggccgcggcgcccgggcgagtgcgacgcctccgcggcggccgcgcggaaccgccggcacaggagggccgcggcgcggacgggctaggcggtgctgcgctccatcgtctgcggccggaggctgtgagcgactccgcgcgcagcccgcaggtagagcgtcgcacgtagtacgtgtcacggctgcgccatccgtgtcgcgctcctgtgagccaaaaatgttactgtccatcgatcggccagcgagttggatttccgtcgccatcggttccttttccttccggactcgtttcgttttcggctcgtcgtcatgtggacagcgtccgcgattgttatttgcacgtagttgtcagcgagcagtgctgctagatccgtaggtccgtccgtctgtccccgcatgtttgcctgctggggcttgatcgcgaaggaatggcaacctagacgagacgctaattaaaaaaaagtagaggaaaagcaagaaatagtcgttgagatgggctcgtgatgtgcgaacagtgtccagtccaggttctttgttcattctattccatcgttcgttcgttcagtagcgtttcaggcattatgtgtgtgagagagatagagagacacagagagagagagagggagggagggaggagtcgcatcgcaa

SEQ ID NO: 2448 - DNA, 1006 bp, Zea mays
  misc_feature (1)..(100): optimal_loci_286381_G1, chr8:122908634..122909639, Cluster 14
taatttagtggagtgagtgtgccgacacccctttgacccgtaaaaagtactccgtataataatgcattgtggggctagcttaaaggtaagttagcatctccggctgcgctgcatgcatataggctactactgttagctagctagctagggtttgcatgcagtatggcagtacgctgacgctgctgagcagtgctgtgtcgctgtgccgtcgtcgactttggccagtgcactgcacgcacagcaacatgattattatgcacacgctgctggtccccgccgccgtcgtcctatctacgtaccctacccattggcgacgctgcaatgccaacgcttcctccctgcatcctgctagctgcaatagcataataaccatgtgaaattcatgctgcttcagctagataggtacatatatagaatgacgcccaaattagcctacctgaaattccatatggttccgcacgcgcgctcgccatccgaagcggcgcctgtgatttgctttgcgccgcaacggcgtggccggccggggcgcacatctctaatggattatctctgattcactccagagactccagcagcagtagaagccaaattaaattttctgctggtcaaaattgaaaatttaaacccctcctctctcaatcgctacgcaaccaaccgaacaaggccagcccgcatactactcctccctagcaatgcaaggccaccgtctgtacaatgacattcaccgccgctaatgcatgtgataacttcattcagcttggaatgcgctgagcagagaaaacccactccacctagctcgccgccaattagaatctctgattaattagttttgtaattaaactgcatatttcaaacaaccgatcgattatgtcacacggacaaaactctagtcggagaaaccaaacatcccctagctaggtaataactccttccaaaaaaataagaaagacatgttaaaatgcccatagtatatttaaaagacgaccgacgacgttacgttgtagct

SEQ ID NO: 2449 - DNA, 1136 bp, Zea mays
  misc_feature (1)..(100): optimal_loci_286631_G1, chr8:123913676..123914811, Cluster 14
gatttggtttttatgccggtcaaaagttaaagcgagcattagtgggcgatacgaggctggttgaagagaccctctcccggtcccggacggatcggacaccgaccacgccatcgtgaccacgagcggcagaccggcgcgagtggttggttccagcggcccgcactgtcggtcggctccaagtctccacagcaccgggcggaaggaaggacaaggacaaggacgagacgcacggcacggcttggttcggctgccggccgcggattccgtcccccttcccgtgccaggccggttggagcgtgcaagacccggccggtggcgaccgagagcgccacgacacgctgccatgtgcccagccgcgtgcgcgactcggcacggcaggggcaaccaagcattgaccaaaccgaaccaaaggacggggagtcgacacgaccacaaccacagccacacacgccgctcgtgcctctcaaccagacacacacgcgccacgggtggccagcgcagcagcgtcgttttccttctctcccccccgctttctctcctccctttggggccgcacgcaaccggcccgtgccgtggcctgtggaccggagatggtcactgtccagagtgagcacgggcagtttgggcgccggtccggccaactttgttgcaatttcatagaagaagagtgtctcacttgtcctacagttacagtctcacacagatccatgggaccccgtgccgttgccacagcacgaaacgttgctattacagctacgtacgtaggagtagtactactacttgcatactaattgcatttgcgctgcggatacggagcagtaatactagtatgtcctcactagcgcactactaatactggaatttaagacgcgcataagaagggggatgtcctaggcaggccatgaataggaccgttgccaggatcgccttctcccgtgacgagacgagagtgtccgtgaactggcgttactgctccgcacgccacagtcctcgatctaccaaaccaaagctcgctacggcggcgcagaaaaaattctccgacagtaaaaataatagatcatgcatgcaaaagaatttgactccacgcggtcacttttgctttggtcaactacggtctctatataaatagattatta

SEQ ID NO: 2450 - DNA, 1366 bp, Zea mays
  misc_feature (1)..(100): optimal_loci_286886_G1, chr8:125194159..125195524, Cluster 14
  modified_base (1039)..(1039): a, c, g, or t
  misc_feature (1039)..(1138): n is a, c, g, or t
  modified_base (1040)..(1040): a, c, g, or t
  modified_base (1041)..(1041): a, c, g, or t
  modified_base (1042)..(1042): a, c, g, or t
  modified_base (1043)..(1043): a, c, g, or t
  modified_base (1044)..(1044): a, c, g, or t
  modified_base (1045)..(1045): a, c, g, or t
  modified_base (1046)..(1046): a, c, g, or t
  modified_base (1047)..(1047): a, c, g, or t
  modified_base (1048)..(1048): a, c, g, or t
  modified_base (1049)..(1049): a, c, g, or t
  modified_base (1050)..(1050): a, c, g, or t
  modified_base (1051)..(1051): a, c, g, or t
  modified_base (1052)..(1052): a, c, g, or t
  modified_base (1053)..(1053): a, c, g, or t
  modified_base (1054)..(1054): a, c, g, or t
  modified_base (1055)..(1055): a, c, g, or t
  modified_base (1056)..(1056): a, c, g, or t
  modified_base (1057)..(1057): a, c, g, or t
  modified_base (1058)..(1058): a, c, g, or t
  modified_base (1059)..(1059): a, c, g, or t
  modified_base (1060)..(1060): a, c, g, or t
  modified_base (1061)..(1061): a, c, g, or t
  modified_base (1062)..(1062): a, c, g, or t
  modified_base (1063)..(1063): a, c, g, or t
  modified_base (1064)..(1064): a, c, g, or t
  modified_base (1065)..(1065): a, c, g, or t
  modified_base (1066)..(1066): a, c, g, or t
  modified_base (1067)..(1067): a, c, g, or t
  modified_base (1068)..(1068): a, c, g, or t
  modified_base (1069)..(1069): a, c, g, or t
  modified_base (1070)..(1070): a, c, g, or t
  modified_base (1071)..(1071): a, c, g, or t
  modified_base (1072)..(1072): a, c, g, or t
  modified_base (1073)..(1073): a, c, g, or t
  modified_base (1074)..(1074): a, c, g, or t
  modified_base (1075)..(1075): a, c, g, or t
  modified_base (1076)..(1076): a, c, g, or t
  modified_base (1077)..(1077): a, c, g, or t
  modified_base (1078)..(1078): a, c, g, or t
  modified_base (1079)..(1079): a, c, g, or t
  modified_base (1080)..(1080): a, c, g, or t
  modified_base (1081)..(1081): a, c, g, or t
  modified_base (1082)..(1082): a, c, g, or t
  modified_base (1083)..(1083): a, c, g, or t
  modified_base (1084)..(1084): a, c, g, or t
  modified_base (1085)..(1085): a, c, g, or t
  modified_base (1086)..(1086): a, c, g, or t
  modified_base (1087)..(1087): a, c, g, or t
  modified_base (1088)..(1088): a, c, g, or t
  modified_base (1089)..(1089): a, c, g, or t
  modified_base (1090)..(1090): a, c, g, or t
  modified_base (1091)..(1091): a, c, g, or t
  modified_base (1092)..(1092): a, c, g, or t
  modified_base (1093)..(1093): a, c, g, or t
  modified_base (1094)..(1094): a, c, g, or t
  modified_base (1095)..(1095): a, c, g, or t
  modified_base (1096)..(1096): a, c, g, or t
  modified_base (1097)..(1097): a, c, g, or t
  modified_base (1098)..(1098): a, c, g, or t
  modified_base (1099)..(1099): a, c, g, or t
  modified_base (1100)..(1100): a, c, g, or t
  modified_base (1101)..(1101): a, c, g, or t
  modified_base (1102)..(1102): a, c, g, or t
  modified_base (1103)..(1103): a, c, g, or t
  modified_base (1104)..(1104): a, c, g, or t
  modified_base (1105)..(1105): a, c, g, or t
  modified_base (1106)..(1106): a, c, g, or t
  modified_base (1107)..(1107): a, c, g, or t
  modified_base (1108)..(1108): a, c, g, or t
  modified_base (1109)..(1109): a, c, g, or t
  modified_base (1110)..(1110): a, c, g, or t
  modified_base (1111)..(1111): a, c, g, or t
  modified_base (1112)..(1112): a, c, g, or t
  modified_base (1113)..(1113): a, c, g, or t
  modified_base (1114)..(1114): a, c, g, or t
  modified_base (1115)..(1115): a, c, g, or t
  modified_base (1116)..(1116): a, c, g, or t
  modified_base (1117)..(1117): a, c, g, or t
  modified_base (1118)..(1118): a, c, g, or t
  modified_base (1119)..(1119): a, c, g, or t
  modified_base (1120)..(1120): a, c, g, or t
  modified_base (1121)..(1121): a, c, g, or t
  modified_base (1122)..(1122): a, c, g, or t
  modified_base (1123)..(1123): a, c, g, or t
  modified_base (1124)..(1124): a, c, g, or t
  modified_base (1125)..(1125): a, c, g, or t
  modified_base (1126)..(1126): a, c, g, or t
  modified_base (1127)..(1127): a, c, g, or t
  modified_base (1128)..(1128): a, c, g, or t
  modified_base (1129)..(1129): a, c, g, or t
  modified_base (1130)..(1130): a, c, g, or t
  modified_base (1131)..(1131): a, c, g, or t
  modified_base (1132)..(1132): a, c, g, or t
  modified_base (1133)..(1133): a, c, g, or t
  modified_base (1134)..(1134): a, c, g, or t
  modified_base (1135)..(1135): a, c, g, or t
  modified_base (1136)..(1136): a, c, g, or t
  modified_base (1137)..(1137): a, c, g, or t
  modified_base (1138)..(1138): a, c, g, or t
gggagttgcgaaccagaatgccgttaccaaaatcctcaagctatctttcagaatctatccgcacccggttggccttgggctgtagaaaacgaagctgaagctgaagctgaagcgccccgaccccaaatccccaacccctgcacagccgaaccgctaagcgcgctatcccacgacgcgaggcctcggatctggcggagctagccggagccacgaaatccctctccgctagcaacgggacacgagccacagaccgcagcttcttcacagcgcaaagacccagacatgcgcgcatcccaattggtacgctgggaggacaaagagacaggcagagacgcagaggcaggcgcggagggatgaggcgatggggggggggggggggggggggggcgtccccccccccagcgaaaatccggggaggggggggcggcccgcccaaccggggggagccggagggacttttccgggaagactagcccaaccaggggtagtttgtcgccccggatccggaaaaaatcccatttgccaacaaagaaatggagaaagcgaatggccctaaaatttgaacactgaatgaccccagaaaaaaaaaaatggggggggaaaaaaaagggcacccccccgtggggccccccccccgcgaggggtaccggggccccctgtttaaaaaacccccaaaaaaaaaccttaaaggggtctcggacccctaaatataagaaataaaagggccttttccccccctcaaaaggctcctcaaagggtccttaatttaaggggaccctcctggattctccttataaggttccccaaaaaaaactttctcccttttaaaatttaaaaaaaccggttaacaaaattaaatattggccataccttttgggatatgacacatactctttgcccaaatatataaaaatgtgtcctaatataaatttttgggattaaggaggctgttttttataacacttgttgtttgggggggaggggggatttggaggggggggaactctttttaaagaagaaatggcaaagacgggcggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgcactccaatgtttttagaaatgaagagatggaaataataagtgtttcaaacgggcataagccttattttttctcctgtcccggagaaggccaaccaatctatttcacgatgtccgatcgcatcttattggtgtgtgtttttttcatccatcaaaaaaaagcaaggaaaaactagcttgcctgttgtgtttcgctgagtggtcagtggtactgttctctgacaaga

SEQ ID NO: 2451 - DNA, 1328 bp, Zea mays
  misc_feature (1)..(100): optimal_loci_290841_G1, chr8:147090179..147091506, Cluster 14
atggctgagaggagagagttaaaaataaataatagaatatgggataataattggtataggatagagatttaaagtaaagattactgtataagatcgtgggatagagtagggaatctaaatattctttttagggtaaaaatttagagttctatgagtgtagccttacaatagtacacattagaatccgaacgtactacgacgtgcattttgaacataaaaaaatgagtagacaagagcggcaagcgagacaatcctatgtgtgacagcccctcctagatccgcccctgcgcctacgcacagtcgccttgcgcacccggctatgcgctcggtgtgatcgcctctcggctggaagggcgcagagattcctgtgtgtccgtccccgtccgtgcccggccccagtgcttatatatacatctggtctcgcctgcggccggaggagagaggacacgccgaacgtgcgcgagagatcgtgcggcggagtagacggatcgaccataaatgcaatgggggaagaatggaagtgtcgtcctggcatccggcagacgagacgacgacgacgacgcaggacgctggagaaacgtgggccgatggagccgatttattggatgccgactcgattggatgtcggaggacgctgtgtgtggtgtggagtatatatgtatgggcgggcgagcgacggtcgatcgatcgatcgatagaaccaccaccaaccaacccatctcgatctgtctgtcgatccgcatctcctcgtggaaaaaccaggcttgccgaccggaaacctcggaacgtgctgcgtagtggcctgcgcggctgcgccatcgcagcgtgatggcgatatatacaaccagggatgcatggctgtggcaggctagccgggacccaccagcttcttctgaacgtagagcaaagcactaccggccggcggcctaccagatgtccagtccagatgagcgagcgagccgcatgttctgttgttggtggtgccgtactattacactgcgacttgccgacttggctcagagacttcttcgtaggcctctcctagctagtctattcgagtcgacgggtagcctagcctagcctatgttcattagctagctgtttgggattccggtcccgttgcacgtcacgcatcacgtgggacaaattcgggcgaaggccatcgtcagctcactgttccggaggctccgatcgaatagcagcatcgtcagctcgctgtatatatatatatatataggcgagtagctaggcggggcctgagctccactgtacgtcaggcgtacgtgctcgaccgtccatgcatgatgcatggtcgttgacatccatcc

SEQ ID NO: 2452 - DNA, 1027 bp, Zea mays
  misc_feature (1)..(100): optimal_loci_291738_G1, chr8:151265151..151266177, Cluster 14
tccagaggtgctggacatggactgctggctggcatgcatatagacataggcaagaaggtggcctgcttcggaaaggcgcaaccaccacgcatttaaagtcgttgggctgtacaagtcaacgtcgcaaatatatatttggatgatgcatgatcagcgtagtgccgctgccgctgggcaggtggcagtcgtgcttgcgtgcccagccgggaaaccagaacatgcacgactcagttttcctttgacagaacgcgcctgaactcagggatatctcacgaaacctgaacacgattcagcgtttcttcagccagtccaccggcggcatctcgcaagcaagcctctctttttttcttctcaagccagaacatgtatatatacgtccaagtaataaccccccaacaacgcagacctcgaaccgtcgtcggacagtatgtctatagctgccttttttttttgcatctcatcttcagaaggtgtggatcaagtaattaacttggcgatcgagcgtggcatccgacaccgacagtacgtctatagctgccttttgcatcttgtgcacagtggacgcaaagccttccaccagcttcctgcttgtagtagtgcaggtctgctactatcaactctggtgtacagaagagggttcctgcaggcgtatatatgtgcctgagatggtcgacgactgctgaagctaaggtgatcttgacgctcggtttgcatcgatcctttttctgcatcgtcgaggttagagatgattcccatcggggttgtattaggctcgtccgtatgaacgactgcgacagggtctatatcaccgagaagacaatcctaagaatcttaggacgacaagttaaggataagtgtaaaattaaattaaattaaattataccaccaagatcactctagtacgaagctagtacgtactagtggttttggcggaggagattggcgctacgtcagggatcacagctgagaaggcgacgtgtggtccaagtggcagctgaccaaattttctgaaagtaattgcggttat

SEQ ID NO: 2453 - DNA, 1033 bp, Zea mays
  misc_feature (1)..(100): optimal_loci_291758_G1, chr8:151341862..151342894, Cluster 14
ctatacaccggctagcaggaaacgagcgcctttctgcatctcttctcttctctgctgtcatggatcggtcgcaatgcaagaaacaagcagacacatgcacctttcacgcgaacgacgctgacggcacgcgtatgctgctaattaatatgctggcaatagaaaaatagacgctatcgtcggatggagcaggaggaacatactcatacttgtatgtatatgacatccttcgtgacacacgccacaccaatcatcgtcccattatacccatgcataccttttactgctgcatcggaactcggaaggccagaaacgagacggatgttttcttttccttctcctggacagattctgcatgcagcgaggtccgagtcaaagtgcgccggtcagcggcggagactgagaggtctgatcgcggacgacgctgcaccgagctggctgaacgagcatgctgaaaggctgaagggaaggttgttcgaactgatggcctgccttgcccggtctccgccctgacgcacgcagcagcgccatgctggttacaaccatctcatcgattagtctttcatatgggtgtgggatgcattggagcccctcgcaacgtcacgggcaacggagattggatctacaagcacgtagctaggacgacggctgttatggataaaggagtgtactatttattatttagtacgatatctaccctgtgtctcgataggaaatcgtccgtgatccttatctgccggccgcatcgtcatgcatgatcatcttgccctttttgcgtgttggaaacgccgaaacgtacgtacgctatatggctgtgtacactgtctgtgtgtaagcgccttttctgccgtacgtacttgtagaaacaaacttggccgggctttgcttgctttttacttattagtgtctagcttcagtcaaagcagtgtctgtacgtgtcgccgttgggtcgtcgaggcacaggcatgggaaacttgtgccggttgtgctcttaattctaataactatctatgtgctatacctactcattcatgtc

SEQ ID NO: 2454 - DNA, 1209 bp, Zea mays
  misc_feature (1)..(100): optimal_loci_294122_G1, chr8:163523205..163524413, Cluster 14
tgtactaattaacccttgccccagaaatgttcgtaggaacattggtctgtcgatatgatgcttggccccatacagcaacaatctgatgcatgggcaatggaccagaccaaagaaggaatataaaagcaccagtgctgcaccgcaggccagggcctcacactctaacccaaattagtatccgtctggaaaccttaagcgccaagtatattattctcacgggcgtgtttggtatcttagggtgtgtttgctctgggtggtccatcttcttctcacttctaacttatgatgcatcagctcatgagatgactctacaaaccaaacacactggttaggtcttagagctcaccctcgcctcgcctagcctagctcagcatgagattgaaacgctagatgacgatggtatttggttctctcaagtctcaacagagtcggctgcctctcgtcgtcgtctgcgaaagcaagcaaggattttcgtcgttaatttgctgcaggcacgaggccgattcggctagccttgcccagggatgctagcagggtgagcggttaggcttttagtgcgaaatttgggtgagtgtcttgtcgtgtggtcgtcgagaagagaagagagcgggcatccccacgtacagccggagcagcagtgcttatctattaatgcatgcatgcatgcctcggtgaccagctgctagctagcttagctgcctgcctctgcctgcctgccctactactgatggatggcgatccatggatgatgctcgtggcgaccacatggtacggtggtgagctgacgagtccatcgcccgcgcgcgcgcaactgtgctgtcccctcccctcccctacgccaccttttgctgtggccacggcgtgatgatggccgctgttaggtacgtaccacgaaaacaaccttcttcaaacagcaaggcctacagacccctgcattttcaatagcttttgctgcccggcctgctgtcgtggagatcgcgtcgtagaacaaggcatgcatggcatggcggcattgtccatatcaaggacaaggagaaggctatttagcaaggggaggtaataaaggcacgccactcgctgtcactgtgccctttgcctgcttttcttcgagcattatcaggcgcgctttgatccatgccacgacgcgcgcccgggtcttttccacgtagagtctcgcacgacgacctgtcggacgacgagaccttctcg

SEQ ID NO: 2455 - DNA, 1161 bp, Zea mays
  misc_feature (1)..(100): optimal_loci_29415_G1, chr1:179925221..179926381, Cluster 14
caaaacgtactacgatcgatcgagggctagactggagagctcacagcacctcatgtcctcacacgtagagccgactgtccatcctcgtgcataaaggatgcatgcagcaaccggccggttgggctacaggctactactgatcgactgctgctgctactactgtaggagtactagggaattgcacctccatgcaaacattggccattgcagtactagctgcacggctgcaggctgcagcatacccgcactgctcatgcatgcatggtgcggcaccaggagagagacgagcctgcaccaaaaaaaaaacgcagcacgtacaacacgcaaaaaaaggctgctggaaagctgcggacggccggaccgaaccacatgtagaatggggtgtagcactggatcgatcgaatgcagctggccgatgcctctaaacggggacgacgacgacgacgaacaacaacaaacaacagtgcaccagtcaagcaactgcacgctgtgctgactgctgaccgttgagcgcgagcctgctactgatcgagcacagagaagagggcggggggcggcgacattgtatcaatgcactatgcatgtatatgtatgcgccagttgcccagttccacgggtgtaccgtgtacgtgcatactgctgtgctggacgtgtggcagtcgttccgtcgtgttgttgcatgcatgcatgcgtgagctcaaaagcaagtgcactgcccagccagcagggagctagagctagcagtgactgagtgactgtcctcagctagccacgccacctgaacagaactgaaccgaggtagtgattcaaagaatcgagatggaaaaaaaaactgacgtgtttcattatattctgtgtatgttttttgtggtaaagtttactaaagaatctatagagagagagagaccgtttggaaagggaatactatatatccctgcgtatggattacaggagtcgtcatgcagacatgcagttcatccctgctacactcaacttctgaactcacctgttgaatgaaaaacttgaaatgtgctcgatcgtgtctgcctgcctggcgtgtgcagtgtcttaggattggcgagcaatgcaaacaggaaacggacgaccatggccaggcggcccaggccagccatggcggctcggcttccggtccggccggac

SEQ ID NO: 2456 - DNA, 1235 bp, Zea mays
  misc_feature (1)..(100): optimal_loci_294620_G1, chr8:166187994..166189228, Cluster 14
atcgattgatttccgattcatattcgccacccatcatccatggaccaatcataagctgcacatgaaggtccaagagcctagatatgatcttatattgctcgctctctgttctttttatttaacatagttttgtctcctaaattattgaacaaccatttattccatatcatttttttatatttataaatctataataatggatagtatgtttgattacaaatctaactataccaattttatattgtattaactataaatactagtcaaattattgataacaaattcaaaaactaattttcggtagtcgtgtgcgctttataaaagaggaatagtacgctgagaaaaaggggcatcgattgctgctgctgctgccaccacctacagcctctctctttcccgtctgttcccttccctggaaaacacggcggggcgccgccaaatcatggagccggcgctatcgttcgacgccatgccgccaccatgtgagagcgtgtacgtccgcggcggcggaccaccgttattaaccggacactcaaggtataattggtagtaattgctacactgtatcgcaatcaaaaaaatcggtacactgtattagggcggcgacacgcaggttctgtgcatatcttgctcacagataacgggcataacttagtccttagccgtttgcgtgtcgcgcggcgcgtagtagcccgtgtgtgggtgtggccgtgccaaatggtggcatgggctggtacgtacgccgcgcaactgcacgtctccttcgatcggccagtcaattcaggcggggtggggagggacggccggaccatgacgtgcgcgcgcgcggcaagtccaggtgacctgccgagtgccgactccttccggggaggttgatgtgcgcataaagcctgcgcttgacggtggcaggcgtgaccgtccggtccagaatccagtctccttccctgcttgccgagccctcgagatcggctgactgagttgtacctgtacgtgcgtgcgtgtggccaattgaccttcagcggggtgcgtcagggggcagtgatgtggacttcgcagtcttcgcttgtgtagtatagtcgtagttttattcctgtatatttgcttgcatgcagggggtggggtgggtggtggctggcggtgagccggtgagaggcgtggccgcgtgtggcgtgtgccagcgaatgaagatcttttgcaaccgtgaattagaccgatgctaactaacgccgtaacaa

SEQ ID NO: 2457 - DNA, 1017 bp, Zea mays
  misc_feature (1)..(100): optimal_loci_294750_G1, chr8:166897032..166898048, Cluster 14
gctagcgaagggcgaaggccatcatcatgcttgcgttactctgctccattccgcttacgctgatgctgacagaggatcaacaaggattggaaaagaaacctaaccagatacgtgagatctaggcaactgtggagcgccagttgaaggcaagagagaaaaggataaaaacgagaggtagtaatcatgaggcgaactgatcatcatctgggactgggacggccgctgcggtagtaagagcggttgttgggtcagtagtaatgccgtagtagtagtaggcggcgggcctcaccactgaatcattgggcgcgagagaaaacgcgcgcacaggctggaggacaaggacgttgttcatttccgccgctgtccggctgtccctccgagtccgagtcctccagcggcgctactagtatagtagtatatagtagccggccgggccgtggagacgacaacagaaagcaacgtcgcgggcgacaggagatgtgtagtagtacgtagtagtccactccatgttctggacgggccgtgtgggcgtatgtgctgtagtagtagtcctgtagtgtactagtgtgcgttggttcctacaagtgggttggcgacgacgtgtactgtttggcccaccgcgctgactgatgtacagtagtacttgtcccgcgtgctgctgctgctgctgctgcctgctgggtgggcctgggagggatgcctggaccctggatgcagtggtggtggtggtggaccattcagactttggacctaccgcgtagcctggcctctgtctgcttcgtcgtcgtcccctttcgtcacgtgctgatttatttatatatatatagtccgggcggcgcggcgcggcgtgagcccttcacacacgtgtactgtccacaacaactctaccacgccgggggtatcaattctcagcagcgtgccttgccttggtccctcgttttcctaccacgtgccgccgcttttctccgcccgcgccgaggccaagagcggcgcccgggaggttttggccgacgtgcc

SEQ ID NO: 2458 - DNA, 1284 bp, Zea mays
  misc_feature (1)..(100): optimal_loci_295307_G1, chr8:168929590..168930873, Cluster 14
atttgaaaggtaccaaatatgatgttttataatatactaaaatatatttacgacaaggcttacatctattataaagcattgctctccatacctcatagagacgattggctcgaggagcactcgcatagtagagaaacacaaacacgtcacttgatccacagtctagtatccattcggtgttttttttattgaacgtaaagtaagggctagcgttctgatacttaataaggactcctttgaaaaacaggaatttcacaagaatagtataaaatttcacatgaaattgattcgaaaatacaaaaaaaagaacgtaggattcatgaagttataatcgtaccaaatattttctcgatataattttagatatacgtgtagagctgaacctttaaaaaaaagctatattaataaagcaaaaatgtactggactgcatctaagatttaaaaaatgtccattctgatattaggcaaagcagagagcgagctcggtagtagagtagagtagttgcttggtgcgatggtacccaacaccgtccatgggcctcgcaccgccgacgccgagcatcgccagtgctcatgagtcatgcccgtgccggcaactgacacgaatcagcaaccgtaacgaactgaactaaacgctccgaaatgataatgccgaaccgaacggacttgttggtaagctgacgatctacgagccgtcacgagacacaagtgattcggtggagataggcgcatcagcagcagttcagcacttctgctaactacacaacctggttgtgtaacaaggtgcaggtaaaggtaaaggtgcaggtgcaacactagatcagctcgatctctcctgcttgcacagctggctgtcactctcgcgactcgcgaggccatggaccatgtccatgggtgatcggtagggatagctgccgcgcatgctgcacggtgcggggggagatcatgcgggccagaagttttcgatcatgcggttgcgcgtagctgtcgagtgtcgacgcaggatcagaagcagcagcggctgctaccgggaccgggcgctcgcggctgcctgcgtgcacgagcgcaacaggtcgcctctgtactgtaccgcactgcacgctgcacggggcttaatttggtgccagctgagggacatttcgccgtcatgatgacggtgcgacgtggccggaacggcagcgatcatggtggtttcgagagagaagcgcaaggaatatgggccgggtttttttcaccacaagcacagacggccacgatcatggtggtttcgagagagaagcccaa

SEQ ID NO: 2459 - DNA, 1219 bp, Zea mays
  misc_feature (1)..(100): optimal_loci_295994_G1, chr8:172353721..172354939, Cluster 14
ctggatggatcagacacgagtagtggggcggacgaccgaccgactgactgacgtgccgcgcccccgccccaactgtgtgtgtgtgtgtgtgtgcatgtgctgtgctcccgtgtctctcattctgtcgcaggccaggccacattgactggggactgaggtacatttgacaggcaaactgcagcagccctattactattctgtatcctgtactatccaccgccaacttgcacagaaccacggcggcgccgatgatctgtttgtaggctggggccatctcagcgacagcgagtgatagtagtacgtactacttactactcacatgcgcgcatgcagagtgacgcagcagctgaccagctgggtatggctttgcaacaccggcccgggtagcaataccaagcacagcacatgcatgtgtggagagatccctgccgcccagatctttggtccgaaagctcttttcggggatttggttcgtttcgatcgacgacgtgcagaggtaatggacatgacggcctgtagcggcgggtgatcggaaaccgcgctcgcggacggcgacggcgggtggggtcagatgcatgcagaccaggccgtggactctttgaccgcaggcgtggaccctttgaatttgatgaccgcgtgtggactcggtcgtgatcgtgacagcgacctactactaattaaggcagcagtaactaaggtagccaaagcacattctttgcgtgggtgatgacgactttttagctacttactttgtccattgcccgtagcaaaatcccggtgcgcgcgcgcgctagcagctagctttccaccaccttcccgtgtggagccggccgggcagtttggccgtgtcaaactgagcctttttgaccgtgtttttgtccggctcgggctgctgtatgttatgtactgctccacaagctggtactagcaaagtttgtttaggcttggcggtttgtttgcttctagcggtccagaacacacacagtatagctcatgtgaaagctaactactacctactagtatagctcatgtgaaagctgagttaataaataacgacgacctactagtactgcctatgcaagtggagcgttagaaaacacaagtcttcttctggaacgatttgttttttgcacgtgctgttgcggcgggcattaatagtgggcggcccgacccacacgtacgcacatccggtggttgggttgctctgctgctactggaa

SEQ ID NO: 2460 - DNA, 1135 bp, Zea mays
  misc_feature (1)..(100): optimal_loci_297010_G1, chr9:1449376..1450510, Cluster 14
ctcaaaagtaaactgctatggtaattataattgagattgactcgtattgcgattctctattataaatacttaataacatacttaatttatatgcagtatactgcggcggggcatcgaccgaattgttatgatgatttgatctggttgtcgacatggtatcaaaacattatataggtagaaaatttgacagaaactattggcctgtgataaaactccgactaggatgcctgtcaggccatagcccagttgtggtgcatgcgcaccgggccgtgacatgttctgggctgggttcggtcgcttctaaaatgcagggccgggccgggcagtcgatcactcgatcttgtttgtactttgtagtattaaaataacggggttgaaaagacaggaaatcgagatcggagcaacgtgcggtcccgcaccgcagtctctgcaatttaattccgtggcgaccaccacctgacctgacctgacctgcccacattgggacacgcagggaagtagccgttggcgggcagcatccgccccccgccgcccagatcggcctccgtccgtcctgctgatcgatcgtccacggcggcggcggcggcggcggccgtgcagtcagtccagttcaaactctactctactctactctagggcctagtggcttccagtttcagccgtgacgaaacgacaaaggagttaaccaacagcggcagcggtccagcacgaacatgcccgtgtcgctgtcaggacagctcacaggacacggccagacagacagtacaggacgccgtggcgcgccgcccaggcgtaattgaccgtgcggctgctcaattgtgcgtagtcgccgcgtctccgcctcggtcggttttctccaagctgctgcgaccgagggtccgagctggaaataccatgccgcgaccgcgaccgcgaccgcgaccgcgagcatctagtccgaacttccggtgccgagcgagcgagaccgccaagaacacggtccgtccacggccggcctgcctctgttcctgattcttcgtggaccacagatcgaaattagacacggtccggtccctgccgccggccaagacccggtgcacgactggatagactccaccggacgacagcctgggtacactaccagaacagaacaagg

SEQ ID NO: 2461 - DNA, 1347 bp, Zea mays
  misc_feature (1)..(100): optimal_loci_29871_G1, chr1:182868143..182869489, Cluster 14
  modified_base (1061)..(1061): a, c, g, or t
  misc_feature (1061)..(1160): n is a, c, g, or t
  modified_base (1062)..(1062): a, c, g, or t
  modified_base (1063)..(1063): a, c, g, or t
  modified_base (1064)..(1064): a, c, g, or t
  modified_base (1065)..(1065): a, c, g, or t
  modified_base (1066)..(1066): a, c, g, or t
  modified_base (1067)..(1067): a, c, g, or t
  modified_base (1068)..(1068): a, c, g, or t
  modified_base (1069)..(1069): a, c, g, or t
  modified_base (1070)..(1070): a, c, g, or t
  modified_base (1071)..(1071): a, c, g, or t
  modified_base (1072)..(1072): a, c, g, or t
  modified_base (1073)..(1073): a, c, g, or t
  modified_base (1074)..(1074): a, c, g, or t
  modified_base (1075)..(1075): a, c, g, or t
  modified_base (1076)..(1076): a, c, g, or t
  modified_base (1077)..(1077): a, c, g, or t
  modified_base (1078)..(1078): a, c, g, or t
  modified_base (1079)..(1079): a, c, g, or t
  modified_base (1080)..(1080): a, c, g, or t
  modified_base (1081)..(1081): a, c, g, or t
  modified_base (1082)..(1082): a, c, g, or t
  modified_base (1083)..(1083): a, c, g, or t
  modified_base (1084)..(1084): a, c, g, or t
  modified_base (1085)..(1085): a, c, g, or t
  modified_base (1086)..(1086): a, c, g, or t
  modified_base (1087)..(1087): a, c, g, or t
  modified_base (1088)..(1088): a, c, g, or t
  modified_base (1089)..(1089): a, c, g, or t
  modified_base (1090)..(1090): a, c, g, or t
  modified_base (1091)..(1091): a, c, g, or t
  modified_base (1092)..(1092): a, c, g, or t
  modified_base (1093)..(1093): a, c, g, or t
  modified_base (1094)..(1094): a, c, g, or t
  modified_base (1095)..(1095): a, c, g, or t
  modified_base (1096)..(1096): a, c, g, or t
  modified_base (1097)..(1097): a, c, g, or t
  modified_base (1098)..(1098): a, c, g, or t
  modified_base (1099)..(1099): a, c, g, or t
  modified_base (1100)..(1100): a, c, g, or t
  modified_base (1101)..(1101): a, c, g, or t
  modified_base (1102)..(1102): a, c, g, or t
  modified_base (1103)..(1103): a, c, g, or t
  modified_base (1104)..(1104): a, c, g, or t
  modified_base (1105)..(1105): a, c, g, or t
  modified_base (1106)..(1106): a, c, g, or t
  modified_base (1107)..(1107): a, c, g, or t
  modified_base (1108)..(1108): a, c, g, or t
  modified_base (1109)..(1109): a, c, g, or t
  modified_base (1110)..(1110): a, c, g, or t
  modified_base (1111)..(1111): a, c, g, or t
  modified_base (1112)..(1112): a, c, g, or t
  modified_base (1113)..(1113): a, c, g, or t
  modified_base (1114)..(1114): a, c, g, or t
  modified_base (1115)..(1115): a, c, g, or t
  modified_base (1116)..(1116): a, c, g, or t
  modified_base (1117)..(1117): a, c, g, or t
  modified_base (1118)..(1118): a, c, g, or t
  modified_base (1119)..(1119): a, c, g, or t
  modified_base (1120)..(1120): a, c, g, or t
  modified_base (1121)..(1121): a, c, g, or t
  modified_base (1122)..(1122): a, c, g, or t
  modified_base (1123)..(1123): a, c, g, or t
  modified_base (1124)..(1124): a, c, g, or t
  modified_base (1125)..(1125): a, c, g, or t
  modified_base (1126)..(1126): a, c, g, or t
  modified_base (1127)..(1127): a, c, g, or t
  modified_base (1128)..(1128): a, c, g, or t
  modified_base (1129)..(1129): a, c, g, or t
  modified_base (1130)..(1130): a, c, g, or t
  modified_base (1131)..(1131): a, c, g, or t
  modified_base (1132)..(1132): a, c, g, or t
  modified_base (1133)..(1133): a, c, g, or t
  modified_base (1134)..(1134): a, c, g, or t
  modified_base (1135)..(1135): a, c, g, or t
  modified_base (1136)..(1136): a, c, g, or t
  modified_base (1137)..(1137): a, c, g, or t
  modified_base (1138)..(1138): a, c, g, or t
  modified_base (1139)..(1139): a, c, g, or t
  modified_base (1140)..(1140): a, c, g, or t
  modified_base (1141)..(1141): a, c, g, or t
  modified_base (1142)..(1142): a, c, g, or t
  modified_base (1143)..(1143): a, c, g, or t
  modified_base (1144)..(1144): a, c, g, or t
  modified_base (1145)..(1145): a, c, g, or t
  modified_base (1146)..(1146): a, c, g, or t
  modified_base (1147)..(1147): a, c, g, or t
  modified_base (1148)..(1148): a, c, g, or t
  modified_base (1149)..(1149): a, c, g, or t
  modified_base (1150)..(1150): a, c, g, or t
  modified_base (1151)..(1151): a, c, g, or t
  modified_base (1152)..(1152): a, c, g, or t
  modified_base (1153)..(1153): a, c, g, or t
  modified_base (1154)..(1154): a, c, g, or t
  modified_base (1155)..(1155): a, c, g, or t
  modified_base (1156)..(1156): a, c, g, or t
  modified_base (1157)..(1157): a, c, g, or t
  modified_base (1158)..(1158): a, c, g, or t
  modified_base (1159)..(1159): a, c, g, or t
  modified_base (1160)..(1160): a, c, g, or t
tacgtccccgttcgccgaaccactgccgcccctccgccggcatgcagacggccagacgcacggagcgactggcagcagccgctgatgctgctggcgccgacagctcgcgagcgggacgtcgtacacccgccacgacccgtgccgacgcctcgggctcaccgacgatccaccatagatgtggatggcggacgtcgacgtgcaaccggaacaccaggccgcgcggccactgggcgtgtgggcgtaggtgtacttgttcccggcccgtcgaagatcatcgaagattcgcagtggttgagccgcctagcaatgggttcctttctgggaccgcagtcgcactcggcgccggcgggcgggcgggcaggcttcggcgggcgaaaatgatggcgtcgggaaccggatgcccccccgccgcgtggcgttgcccgctggcctggacgccggacggtctacactgctcggctcgtaatcatgacaaacccacctgcactggattggttggatgcgaatccgaatgcgatgcgagcgtcacgacgacaggcaggaccgcaggagtggagcacgaccaccgccgccgggcatcgacggacgctgacaatgttcttccgacgcctggaactggaacggaaccgagcgccccgcccggcgaatcgtcttgccgcgacaaagtcgcagcagacgtgcctgccatgccatgccatgccaaccgatcagcaccacgatcgccgtcgccggccggcggatcgattatggcggcgagtgctaactacagctttcagcatccatgctcccctgcgactctggctctgggacacacagcacgcgcgcgcgcgcgcgcaccatgagattgagagccgaggaagacgaatttagaatgttttttccccatgatcttttcttcacagaaaagaagaaaacaagcatgacagcacaacagaactttatcataagaacaaggaagaatcccagaccaacaagagctcagtctaatttataggcagccggtagaaacacttgaggtagtgccgccagccacagccatagccagcaaatgggatgagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtttgttgggataaagagtgagataagaagtatgttgtagatagtcttattgtatgccttggtgcctactgcgcagtggggcccaacgaccagcttgtatgaccaagtacgctgtgctaaaatatgctggtagacactattcgtaatgcttagtattcatacggacatgatgggtttagtgttgt

SEQ ID NO: 2462 - DNA, 1030 bp, Zea mays
  misc_feature (1)..(100): optimal_loci_30074_G1, chr1:184626558..184627587, Cluster 14
gtcgaggtgttggagcatggagtacgacagtacgtacaccagccaacctgcagccgtgcagcgagccgtggcaggcctacagcggggcaacgacccagcaatccaaggtgtccaaggcccaagtcactgtggccagcagcagcagcatggcatggccgcaatggcccagcaggccagcagcattgctgaggcagggtagctatctcctactcctacgtgccgttgttactgtcgtagaaatagatagatttatttatttattacgtggagccttgtttgaacaatgaagaacaaacgagtggtcctctgtggagcttgtgcactctacatgctctcgagagcggtttagaaatcgtggcacgccaacaaaattcttctctctcccataatttcgtcaggatgtgtttctccggtttgtttgaacggtgaccactaacccagccgacacgctggctgcacgcactgccggagcatatttcctgcgccgagagctcggcaatcaatcaatcaaccgaatggtcctctctctctctctctctctctctttcctgcaagaccaagaccagtcaggccaccagggtgccgggcccaggagcagagcaggcaggtcctggactcctggtcgccactgatcgccagcggccaggagcccagccgcatgctgccggtggcctgtggcggtgcggccccaagcgcacggcgggcggacggcgccacgccctcggcggcctcgccgcgcgcgccgggacaaaactcaaggcactacgtgtgtaatcatgccatcgatgggtcacatcgactgccactgccactactaccatcgccattgctgatgccagcagcccccctggctcgtgaggccagccgcaggccgctgctcctccgagggacaccgcgccttttactgcagacgctggcgggcaggacaggacaggacatccggaccgcatctcgtcgtccatccgtccatggttggttggttctagccggctgatccaattccaaacaaggttaggctaattcattcatc

SEQ ID NO: 2463 - DNA, 1033 bp, Zea mays
  misc_feature (1)..(100): optimal_loci_30076_G1, chr1:184628609..184629641, Cluster 14
gacggacgacaagcgtgagcagcccggagtcggagtgcgtagggatctctctccggtatccggtcgatctccagcctccactccagttcagtcccagcaggcttctcgatcccaggccgatcgcgcgagatcgatcgggtgtagtagccacagtactttctgttcctagctttccaaggcatattgcattgcggttgcatgattcgagagtcaaatgtttggcaggaccagtggaccacgtaccggcgtacccatcaatcatatcgagtctcgactggagattctgtgctgtgccacttaggtacagtatccgtgtgattaattgttctaacttttagatactatatatgcacctaaaaacccttgagacaactcctcctttacaaatgaaaagcgtagaatctacttgtttaatctttctgaaagctctacagcttaggttcgtcgtattttactttgctgctaattaatgcatgtagacgtcttatatatgcatgtgtgggtttgcactgtcggctgctcttatctttcattcattcgttcagtcagtcaaatgactgttacctggccgcttgcgaaagcagcagctctctgtaaaagacgaccttttcccgcgcttgccttgcctgctctcaaggcttttttcagcagcatcgatctgcactggcgcgaaagcgaggtcgcttgtcacgctcactcacggccagcgacagcatgcatgacgcggatgatgaatgaatcaatgaacggaaaaagaacaagtgctactacctaccaccacgcaccaaagccggatgcatgttggtgtggtcggcaggaagtcaatgtgcgtgctctctgctcaaacccatcgatcatcaacttttgatcagctacagtgttgacatgcagatctctcttccaaccaaattaagtttcttcacagaaaaggaatagtctagttcggtctaatccttgcaattaaggttaaccaccaaaaaggatggacatatataaattgggtagtacctcgtacggtagaagacattatttt

SEQ ID NO: 2464 - DNA, 1025 bp, Zea mays
  misc_feature (1)..(100): optimal_loci_309257_G1, chr9:73014026..73015050, Cluster 14
ggaaatgacaggtgtggctacgcttttcgctcgaggaaattagtcacctggcagtgacaatggagctctctagatgtcttggcgtggcggcctttgaacggcatgaccttagattgcaccaggtggacctagtggccgctgccctactcggacgctaccgcattgtatacactcagcatcccagtcccagctgcaaggaacgaaacaaaagcggcaggaagctaaggtcaagtagctagtagagcccctgatgcatgggcaatgattctccgttctcccgtcttttcttcatcgggaaacccacggaaagctgttcgtatacgtacaaacaagcggcaagtgaagcagtaggtggagctacgctaacagcaagcctttatgccaaactgtgaatcaaatacatatatagagtacgtactcctatgactgaacaagcgaggaggaggaggagaatgcgcgtcacatctttgtctcggaaaacctcacgacgttagcttagccggccacctcgctcagagtcagagggccttccctagtgagctgctgttagtaggatggacacctcagctgagacagcatcgtcgtacgcttccagggtcttgcagcacccaatgcgctagctaaatgccgccgcatgcagcttaaggtcccctgttttcagagcttctactctagacctaaaaaaaaaaattctaaaagctgttccaaacacccaatgcaccgcatgcagttttcacttacagcttgttagtttggttagaagggaattggagaaaattagcgtgagaacatagaaaagttaccttggttcactttcttattaccaaagaaacccttaaactgaccttggtttactttccggttcaatttttatgcgcacgagacgggtacaaactaattgatggctagatcgaatgtactccaaaagttaagagaacatagaaaaaaactataattgataaggacaagaaccaaagaacaactcataaaacacgagtaaaatggatctctaccgggtataatac

SEQ ID NO: 2465 - DNA, 1328 bp, Zea mays
  misc_feature (1)..(100): optimal_loci_313141_G1, chr9:96707675..96709002, Cluster 14
ccattcgttacaatgggttcattctgcttctttaggtttatgactcctaatcctctaaactttgtaggaaccattaccaattatcatgttgctttatgcatattcctctagcattattttcagatcctttataggaagttaggcactccattcgttacaaaagggaatgctttatgtacttatcaatttgctggatcactgaagcgggcaacgcagaagtacccatgtataagttaggcattgaggagagcacagtgtatgtaggttctagtcctccagcttgtgggacagcaaaatatgaagctctatgacagtgagtagaactggccaagaaactctggtttggtaatctgggcaccaaaacagctcctgaagcatgcagttcaaaaatctatatcaaatagactcttaccaaactgtatctatgattttgagcagctagatttcttcttcatgccctatggctctctgttgaaaacaggggcagatgatcagagtctggacattcaatcctactcgacgctatttattaggtcttctcttgtattgcttctaggctctagctagatccggcacagctggtcgaggaagaagatcgccagctagctagctttctccagtcatgaaattttgcaccaaagacgaaacgaaactaccgactaccaaatgtttggatggatgaacagacagctgccatgcggcaggcatgggcactgactatgcgtgaagtacatgcccagcacggttgcccgtccgatcgtgcatccggccaggcgctttgactccatgaaaaaggaatttacacgagcacgtacgatctctctgcctgccttttggcggtccaccatgcaacgcacacgcattctacagcttgatttgcacgtacgtacgcggcaccgtcgtatcgacacgacatccaggccaggccaggccattgacgacgccggccgtgtgcagcggtcgatcagtggacacacaaatcctgcttggttgcttctgtcgtttgggtcctggctatagctagtaactgctagctgcacacagcacaatcaaagccgtggcggccggggctgacggcgatgcggaacggacaccacccaccgccgtgtctcctgctcacgcagttggtggcacgcacacgcacacgctgcatgcatcatcgatgtcgttgttgttcggttccgtgttcctggaggctttgttgctcaatgctcatgctctccttactagagcttggagtggactagttggtgggggctctggccggctctcatagtctcattcagtcccatgctggatggtgtggttgccgcgcgccttgccggttt

SEQ ID NO: 2466 - DNA, 1399 bp, Zea mays
  misc_feature (1)..(100): optimal_loci_31474_G1, chr1:193451842..193453240, Cluster 14
cacgtaatcaatcagtgcgcatacatgatgcatgtccgctggcatatggcagcagaccttcctgcagctttgataagtgatcccaacgagatctcatcgatcggtcttcgacggctgtggcatggaagtagaaagcaagcaatttgcgtgtactactacgtcgtaggcggtaggccagtgcacggagaggcctgaggtcgccggctgcgtggtcagcacgtgcaggctgcggcgccgccgcgcctgccgctctcatcgtgcgcaaccttatcgctacttcgccagtagctctcgagtctggacgcacgacgacgcgctggaaagccagatgagcactagctaccctctctctactagacccggtccactagctgcgcagcatctgcagatcgacgacccgatcgacgactgccggaccggcgaggctgctgcaggtggccagcaacaccggtctgctagacggctactcgtctagcgatcgagaactagtgcgtctcgatgatttctccgcggaatcctttggaacggcttgtggtgttcggctgcgaagccgtaaaggacgacggcggcggcgaccgtacgaatatttttttctttgttgtcccgtacgaaaatcatgaaaacgtagctttgatgtaggaagataaaaaaagcaaatataaaacacttctctaatcttttttagtgcttgtttggaagccttcagtttttaagagaacttatttacagaaactaggatgcttctcaacatgctatagtttatgctccggtatctaaaaactagattctcagtttctaaaaaaccaaagaagatgccttttttccagctaaaaccagttttgcacgataaactaggcactaggcactgcattcccttggtgattgtcaccgctctctggcctatacacacgactcccttggtgcacgctctgcattcatgatttgaatgtttagttcttatttgaaaatatttaaatttatgagttcaagctatatttaaaattggcagcaacgaaaaatgagtagtaaggatatatttgtcttgtgtatcgaaaatgctagaagctggtttacaagaaaccgagtttcaaacacgcacattattttttctccataaactagtttttagaaacagaaagttccttagaaaatgtggtgctcctaaatagtccattaggtttgagagcaaggggtaataaaggtgattaaggggccgagctagaacccccactattcaattttaaatactaaaagattctagcctactcaatcctctccattccacttgcttgtgtatggttgcatttggacaaatattcccctatatataaacattatcaatcaatcaatcaactcatgaaagactcactattacaaagaagctctataatgggagcaa

SEQ ID NO: 2467 - DNA, 1335 bp, Zea mays
  misc_feature (1)..(100): optimal_loci_314815_G1, chr9:105080183..105081517, Cluster 14
catccggggatgcaagcaaataatgtgctgcatgggaaggcgcccccgggagctcgtgcctcgtgcgacctactcgtcagtttttactctcagttttggcatgcatgcacgtcccctcctgaacgtgatggcgcattgatggatacgttgaccccagagccattagagacttgggttgggtgggtgggggcggtgttgggatgggcggagaggtggcggctctatgactacgactatgactatgactgaggagtccatggcacgcccagccggtttcccgtgtgcagcggcgcggccgacgtcgcgtcaccccggccccgatcgccggccggccgatggcagcgggacacggcggcagcatggtcacttgtactcggcacggagacattgaccgagacgcgattgctcccgtagtcccgtgtccagcgtgcaatgtaatagcgtcgtctgccaagctcgatccgtcgtgtttgtactctctcggtctctctctctattattgcaacgtactgttctagctaggggtcttctaatatagcgcgttcgagaattttattttttttacgacagattgatagaaaaaccacaaagatacatttgtgccttctctatgtttcttaattagtccaacgctactaccaacacatgcaatcaatagtacgtgtttcgttaataaaataaaatactacaccgccgtgtacgaaatcatgcaactatccaacgcgcgcccatattactctacggttttggcatatcgatcgatcttttggccttgtcgaaaggtactgcacttgcggattggcggctcgcaagcatgattattgctaggaataataggaatgccaaacttgcaggcaccatcgatcaatctgaatcgttgacgactttgcccacgcggccgggagacctgtgtgaccggccggcggcattattcgggcagacccaattaccagcgtcaagggggggaggtgcggtgcggcgatcagttattattagttggggagtggcagttcaggtgcggccgtcgctgatcgggctagccgcccacactccagctccagctccagcgcagcgaattcaagtttcaggcggcgtttgtgccgcctccgatcgagctcatcatcagctgtgaccaggtctcccgaccacccgcgcagaccccatgcatcccggccggcccaacgctgcttcctgcttcgttcgcgcataacctcctgccaacggttccggtcgacccagtccactgcctcaagtgatttctacatgtttttagtaaacgtcttcaaatcccttgctgttgttgtctgaacacatgtgacatactcgatctctgta

SEQ ID NO: 2468 - DNA, 1406 bp, Zea mays
  misc_feature (1)..(100): optimal_loci_315952_G1, chr9:111464240..111465645, Cluster 14
atgctaatagtaccgaattccactagattcacatttgtgcttaattggagtctcgaactaatgtgttgataattgacaaactttttgtcagacatgcaccacaccaataccgggcaacaagccatgtaatgaccgccaaccggccggccacgctgctcggagcacgctgccggatcggaggttgccgcgtgaaagaaggcaggtcgagctcacgtaggtcagtagaatgacaaatttctgtcttccttcccgcgtggaaactggttggatctctcacttactcccgtgcgtaatccacgagctgtttgcagcatctactagcggagatgctctagttgcgtgccggactgccagttcaaacgtcaaacaaacaaaaaaaaaacttgaagataaaacaggttgccagtaaaaaaaaactagaaagggtagagaaaattttgcatgttgcatggccgtctattcttatgcacggagcgaaaaaggatgaaggaaaacggatcgaacccagctctacggcctgcggtgcacccaaagaagaggagaacgaagggggctagagcagtagagctcgaccttgaatcagcggatgtgcggcttcgcgtgtcgtcgtcgatccacatccacagcgcgaaggcgaccaggaaccacgcgggcgagacgggcggcgcggcgagaatctcggcgaagaggaggtagacggcggccgagatcatcacggcgacagctacgacacgcgacggagacgggaggacggcgacccggtcgcggtccggcaccgttcctgccttccatcgcagatgagatcgctatcttctcttctttccttgtctcgaaggggactggtgtgtgcgtgctgcaagcctcaggctctaaactgcagtcaccggctcacggcagcgacgagcccttacataaaatgtcctaatatactttttatggagggttagggcaaccgtacagtactttatacagtacagtactttatataaaatgttctaatattttgggctataccttaaaaaaacgtactttgggcctttttttttgtcacttagatatagttttttttatccttgtatggtagcatgggagtgcaaaaggttacattagaaattattacagggatatatagaaagttttctctatagataagtaggtcacatcacagatggcgggaacgaaggttcctggaaagcacagggaagctctctacacttgatccacaatttaatttctcacagatgaacgaaataaagagtttcgatctcccagattcgtaattttgcatcaagcatcatgatttcactgcaaattacgtgatgggccgtttggaactcggaacgtaggcagctgacttggtcaatgacgcaagcatcatatcaccgagaccggccggtagtatatgg

SEQ ID NO: 2469 - DNA, 1054 bp, Zea mays
  misc_feature (1)..(100): optimal_loci_316080_G1, chr9:112256801..112257854, Cluster 14
ggcgacacgaaactcttccaatttcaaaaactaaccaggttcgtctccttgccagtgatgaaccccagagagaaaggttgcggggcagttaagagaaccgaacccgcaacggtgaagctaggcgctcgcaaaacacacatcgaaagagcccaaaaccccagcgatcgcacaagagaaatttgaacataagcatttgatcggagggctcctcacggattcagaggagaaaggttgaggaatcgccaccatttgctccggcggtggaggaagcagaacgaccaacatagccgcgacggcggcctccgtgtcgtcatcggaaacgggcggcagagtggcgacggtctctgccgccaccggcggaggcactgcggcgtccggcataaccagcggcggcgggaccgtcatgtacgcggcgccgacggtctcggcggcatcctcgtctgccatcgaccgactaatgaggggttttgaggacagggcggggcgcgagggtttagacgaggggaagaagattgctgtggtggatcatgcaatccagctacaagtgcagcgcgacgcgacgcgacgcgacgcgcactggagtctggagcggcggcggaggaggagagcgagaagtcgaggcggcggcggagggcgtcctcgcttatacacgctggacgcgatgtggcatggcgcatgacttatgaacctcaggcctcagcccggacgcggcagccgggatgctggatgggttgggtcggttctccttccttcgcaaatcggtcaggggcgcgtctcggcggcccgcctcgccgtaccgctggtgcatgcaaagggttcacgttcacatgccgtcagaacagcacgatccacacgcagtgacgcagcctacatcgccggcctgtctgtccctgtccagcagatcgtagatcgtctatacgagtgtctaaaacaatattttttaagacatcactatttacgagagggctactagagataaactcatactcaaatacagcgataagaagcgtccgaacggctgagttcgtcatgtcacaccaatgctctatggtca

SEQ ID NO: 2470 - DNA, 1204 bp, Zea mays
  misc_feature (1)..(100): optimal_loci_320035_G1, chr9:133700371..133701574, Cluster 14
agtaagtagtagctagagacaagctagctagtggctgatgagcgtgtcagtcccgtgacacttgaagccgcaagcgccagtgtttgtggaacccagccgaactgagacacctcagctcttcgtggccctcgccctcgatcggaagctgcctggaagcagcgtgtgctgccctagctctacctagcttatttggtacaagtggcacccatgacatacatggctagctggatatggataactcgataataatcccaaaaaggcaattttaagataagagaccccgcgagtataacgtgcgggattgacctcagcgcagccactcgcgatcgatctctgcggagccgcaagggaaaagttcgagatccgcgcgcaacctgcaacttgctccgatcccatgaatgaatgaattgtcggtttcacaacctcgcagcgacttgtcgccgacgagcggtggactttcctcctcgccccggcccgcgcccttttttttttctctctctctctctcctgcgcttttcttgactctttctgtttgaaggggagaggagggcagaccgcagacctcgatctgtccgttgacgaagccggcggcggcgcatgcgcgcttttaatttctctgctctctgctggtggggaggcaccgatggatgcccgatggccaagggccacagctagccgcgcgcgctatgaaactggccagaaagaaacgaacctgaatgggagatctggtctagctagatgactgcgaaatgtatggcgcacagacactactggctagccctgctgacgcggagcgaggttgttcacacactcgttcgtatacatgacggccggccgtctggtctcagtttaatgaaccagcggatttcgcgcccatcgccaagcggccggtagcgattacagtactagacagatataaagatcatgcgcgcgttcgcccccttcgtaatctatccgcggcgctttctgccttctgatgtcaccgccattcacaattcattaccaccagtatgctgtctatactactgactaataattaaagcgcgattaccactggatgccacccaatcaaatttctcttgtgtgctttggaagaggggactttcacttacctgctcggctagctctttcggtcaccctaagattcgatacatatgtaatagtgattatgttttagatagaaacttagaggatgaatatccct

SEQ ID NO: 2471 - DNA, 1249 bp, Zea mays
  misc_feature (1)..(100): optimal_loci_320090_G1, chr9:133902957..133904205, Cluster 14
aagtccatagaacctcattagagttcatcctaaattttgaaatgtatattgtggataacttagtaagattatacaattgctttaatttagtcctttctaaattatttttgtctccgtccagtcctaatccactaggtggccccagagagcttgagtagccaaaacagtctcagcttaaaaagcctttgccagcttgatccagtaaacatccaagaatatttttctccaataaatgacgctacagcacgtgcagttaactaactgtaagaaatccagctatgtatggacctaaaccacctgaactgctaacttgggagaagaaattttggacttgtatatacatgttcatttactttagaatggcaacaaaaataattctgatgcgacattaagattcagtcagcttctattttgatcgttatctttgtagtcatctcaattgtaccagtctgtagtggctgcaatcgacgtcactggagatcaaataagcacatcgcacgtgtatatccacactccggccggttccctggcaacttggtaaaccgatccctcggtcaaacgtcacttaattcaaatcgagtgtctataatgcaccaccggccggtgtacgtgcagtgtaccagtgtcgtggcgctcgtgctgtcaggtcgtcgtttgtctccttcccctgtgctgccgcgtacgcgtccggcaggcaaagacaagccccgtatattcaaaatcgagcagccagtgcagcacacaacccccgtcgccatacagaaacaaggacagtgactttttctggtgccttggtggaacgggaagatcgattcatcaatagcacaggcacgtacgtaagcaaacgcaaagcagaagatgacaagagtagtagtagcagtaggcagcagaggcgctagctgcccgctcggagtgggggagcaactgagtcactgtgaccgtccatgtatgtcaggccgtgtctaagatttcagggactaaagcttatctagagacccgtttaacccatctatataataactatatatgcattgtataattatacatacacatttcgagggctcaaatgacaattacaattggctagctatagtatgcgcgtacatgcgaagatcgatcatccacgacgtgtttcgttgtttgtagtcttgtccggtcctttaacgacgtaggttgtagaggccgaactgctcacttagtatgggacagctgggcaaccaaacgaacactgattggctaaattaaataa

SEQ ID NO: 2472 - DNA, 1347 bp, Zea mays
  misc_feature (1)..(100): optimal_loci_321348_G1, chr9:139924897..139926243, Cluster 14
aaatgaagactagatttatttcgctcctactatgaacccgtgtaattttttctatttggctgtgcagaactgattctcgctagaagcgcaactgtgagagctctaccaaacactcctataaagatgtgagacaactgtaaaaccgatatttatccacgtaaccttttgttaaggttttgaaggtactggccggcaagcggcgaatggtacctgctccagctcatcaacgccctccaccctcgccgtcgacgctgcctatttgaagccgttccagacggacatcgtcctcatcacgccgggccaaaccaccaacgtactcctgcacgccgagacccaagtcgaactatggtctatgctgatggtttaggattgtttgtttcctacatcttgggtggttttaactgccccatcagctaagacagggtaaatcggattatcggactatgccgatagtttaggggttaaatcatactatgatttttttcaaaaaaatgtctaaatgttttttttgaagaaatatgcaattaaaaaaaggctaaaaaggtccccacccactgctagtttttggagtttcaaacctcaacatgacaccgtcggaagccgcattccatgttactgaatgctgtacagttcagcatactgctgaagaaccgccacgaaacgcatttcacaagcagacctctgaagaatattgtgctaggtgtctgaaaatattatctttcaagaacaggtgccgatggtttctgtgggtgacgtcaagaactgcttttactttccaaagcgaacagtgaatagatattgcattatgccgatatatcacgtggcacttgtacttgagagcggtaacataggctcggtctaatcaactgctgaggggagagcggtaacataggctcggtctaatcaactactgagggaatctctccatgtagacgaagcagacgctacccaatttagggcctcttttggtttgccccttgtagcccccgtctattctgtttcagcataacagttctcgagttctggttaaaaaaagaaagggttatgatagatttaacaagacaacgttaaatccagatgtttttaataagagttaagtggctaaactagtcgagagatactttagattcacgaactttaaaaaaacaatttgtaggtcctcgttggactcgttgactaaatctcaggcactgttcgtgtgctagtgtacctcgcgacctgcaatttaatcccaacccgtgcaagcacacgcgcgcacgcactcatttgcggattaacacttgcttaaaccagttgcctgcgctggccaccgaaacccattgcctgccctgaacagtgaccaactac

SEQ ID NO: 2473 - DNA, 1173 bp, Zea mays
  misc_feature (1)..(100): optimal_loci_321607_G1, chr9:141315106..141316278, Cluster 14
ggattgtcttgaaactctgaaaatactacgttgccaaatggcaacaggcccggctgctagtagcctgctacacagctctccaaggcaagttcggcggctaaccacagcacagcccattagtggtccaaggaccaagcccatcttttacccgacgattatgcaggggcccatagctaatctgatccgcagagaccattaaccaaagaatcccttcgtcccggagacccggacctccctggttgcgggttgcggcgcctgcctcctccgcccatgcgacgcgcgcccgcgcaaactacccgccttcgcagtcgtccgcgcgggaaacgtgaagctaatccaactccaacatttcctcccgatgcgctgtgctgtgctgtactccttcgcagggagctctcgaaacccaaaccctagctctgacccaccgcgattccccatttgatttctcgtacccatgggtggatccgctgatcccgaggcgccgtcgccgtctccgacgaagccatcgccctcgtcggctgacgggaagccgccgaggcggtgcgtgcagtcgaaactctcgtgggggcttgtcaaaccagccggcggcggccgcgaaggtggaggaaaaggaggcggcggtgaagcaggaagaggagatgccgaggctgttcctcctgtgcctgcggccggggaggcggcggcgacggaagttagagaggggctggagaaggggaagaagaagagaaagccgcggaaatcagaggatggcaagaaggtacattgcccattttagccgctgttttgtgtcttctcgttgaattgcgcaggtggaggattcaattcctttttggtagaatgtcgatagataggcatcttgcctttttcctgctgttccatttacttagagcaactccaaccgaactcttaactgaagccctatcctattttgagaggccaaaacacgaaagtttgtctggggggataccatgccatgccatggttttcgtgttatgtacattatttttctgtttattgctgatgcccgataactgtgcacttcaacctggataaggagtcaaatctgcaaccaagtgaaccaacaactacgtagctgaaatcctacctggatagcagtccacacgccaaactcagtctttcctgacttaaattgaactacatctgtttcttttc

SEQ ID NO: 2474 - DNA, 1088 bp, Zea mays
  misc_feature (1)..(100): optimal_loci_321638_G1, chr9:141454078..141455165, Cluster 14
aattgaaatcacactgtcactaattaactcgctatatatcctctcggcagtacatgacgtatagtatagccatcccggccggtgcgcacgtggacgttcgtcgcgtcatgttttactcaagatgactcgtatactcgcaggtatacctgtagtacataccatgtcggtgccgtatactgtggttagttagattgatgactaagtatactagtgtcaataacagtatttttgtacactaacggtggaagtttcatcgcacggttacggtttctaaaactgacacatagtctataaaatcatgtatcctaagttttatccatcatctttccttccattaaactctctctatatcttttattataaataccgtgtcatgtcatcaaatatgttgacgtgtgatcccatttaataaatatgtaccgtactaacttatgataaaacttttactaggaatggcatgataataggtgagccgtgagacctgagaaataaataaatagcatcgaagtgcggccctccggtccatggaaaggttgcggccacgcagcccaagagattccagcttgtccacggcggcgagcgggcgccgggccgaccgctgcctgggtcgccacggtttccgggcgttgtttatcgcttcgaaggcgttgaatgtctgccgctccccattaatgatcacgtgagctggaagccaactcgccgcgggctcccgcactagtcgttatcgtttctccctgctcctgtcctgcccgatccatccatgggtcagggtcagctgcgaccgcggcatgtcagtcacgccacgtcgccaccggtcggagcgttgacgttaaagctacccaaatgtggccctgcccgatgtactgcaagcccagcacgagacaaatttggcccaactacagcccaagggtggcccggacactcttcttgctgagaaaagtagtggagtaccaccggcaattacatccctcccacatgattcctcccccccccccccccccatctcatttcgtcgaacactttcgatgcggcagccacaacaagcaacctataataaaaggaggagagcgtagaagagagacatattc

SEQ ID NO: 2475 - DNA, 1194 bp, Zea mays
  misc_feature (1)..(100): optimal_loci_322081_G1, chr9:143964880..143966073, Cluster 14
acagactggtggtgccggggtgagacaggtctgctgcacataagtcgaggcaaaaattctacatctgaacaaatctgcaccttagcaaagactctgaataggtgaatgacctgctggaaggctagcggtgaactggcgatgaaggtaaaagcctggtttgcaactcatattgcgtgcggattggctcatgcatgagctgtttttttcttcttttccctactgaaacaagcagatgaaatcagtatttgtagttacattagagccgacggaaaccagctgagccgtgctaaacgaggttgaattccgaggtcaaggattagacactagagggccacggccacctgaattttgccatcctctagcagaaaatagacgacgtacggtgttcggctgcgtttgagtagtatttaccagcatcacgatcgttcaacatacatgacgaccatacacaaatgccaattaattccacgcacatgcatggtgtgtgcctgcatagtattcgcacatgaagggtttgcaaattgcaagcggcccggccgggggtgttctattctattattcctctgttgagctccagggcggctcaatgatttgggttacccatgcccggggattggaaggcaaggataaggcgatggcacctggcacaggtacgtacggctccccgaaggcgctctgagactgagtttgtttgtccctatcacgccatgcatgtggctactagctagctatagctgacaagccccagcatccaaaatcttctctgcaggttgggtgtgactagtgtgctgttggcctccgtcgatcgacgctttttgtttgcacacctttggtctgtctctcgtgcgcaataatgatgcgtcgtcccggccccctgtgtgccgtcgtgagcccgtacgtgtggcaacacgatccgtccccatcgttccttctgcagggtatacggtacgtgttttgtagctagggcaagtgtgcaacttgctgatcgatcgacgatcgattgagcgaggccgagactgttaacggcattgattatataccacatggccatatgctggtctccatcgctcgctcgtacgacgccgatcgatcgatcgaggtgggaatgggatgcggcaatgccatggtggtcgaactgcactgtgtgcatgcatgcatgcgaggctgacacttgcatgcgttgctatcgcgccc

SEQ ID NO: 2476 - DNA, 1321 bp, Zea mays
  misc_feature (1)..(100): optimal_loci_322861_G1, chr9:147796726..147798046, Cluster 14
agtgggagctgcccagtctctgcaaatagattggcagggtttaggggcccggctaataaggctgcaatataatgatacagtacactcgaacttcgattggttccgggctgtccgcgggtgggcatggccaacacttacagatggagtcctcaacgccaggcccagcccaaccgaagcaagggacaaacatgggccgcgggaggaagactacgatcttagcccgcatgtcccgatccgtgaaccgaacattaagcctggtagtatagtactactacctcgcacgtacacacaagtcaatgacagataaaatgacagataagctgtgtgtggtgtggtagaccgtagacgacggtcggcactgccttcctgcatgtgcttcgacttcgatcgactgcgtactcctcctgcactgcactgcacatgcaaggtagacaagccgccagatctgacggcgcgtacgggacgctacgtatccttccttgccaactcatacacgcgcgactgcataccgtcgtctacattgactgacttgcgagacctcccgcgcggctggggctgtacctgattcggcttttttttgtttgttgagggccactcacagtcacagtacacggtcccttcatgcacaccgcattggattcgcgtggtcaaagctcaggacgacgttctcgttttcaattttcatcaaacacagtggttcgtcctttgggactgctggctgctgcaactagcactagtacactactgaagcactgagctacactgctcatacaacaacacggtttctttttattattatcagcgaagaatagtacactgccatcgacgatccattcttgcccagacagcccgctcgaattctcacccgcaagaccccaaaccacgccactgctgacacgtctggtcggttgtgttcgttcgcacgcgtgcatgcacgggatcggcggaagacgccgcatcgggatcgagcgaggctgcggccgccccgcgctccaagccacgcgcgcgcgtcgatcccaccccacaggccgaacgtgaagcccttcttcggcgtcgtcgcagctcacagccggcccgcgacaaggagaccgggtccagggcgcgtcgcgtcgcgtcaagtccgccgcccgatcggacgaccgcttgtgagtctgggatccgcccccaaacccaaagccgtacgtattacgtcgcgcggcttgcgcatgcggccagcggacccccgccagctccgccagcccgccgccgcgcgtccagtgatctcgtgatggagagcccgcccggccctctggacgcgctcgctcggcccccagccccaact

SEQ ID NO: 2477 - DNA, 1059 bp, Zea mays
  misc_feature (1)..(100): optimal_loci_32346_G1, chr1:198478690..198479748, Cluster 14
atatatatatatatatttatacatttaaacattaaatctatatgtcacttccacacacacccctcccctcccctcccctacacttctctctccctccggtacggttgtctgtgtgtgtctggcgccgtaccgtctaatagcactgaaagataggcagaaagtattactgcccttgtctgtgcccgcagcgtgtgtgggggcggcggtactgggtggcactgcagcgccactactctccaacggaccggccggccgcggcaggcattgacggcgacggacggcggccctcagctcctgaaatttcgtcagcggcgatctgaaatgaatcaatcgcccatgatttgtgatgcatgcatgccaaaatgttctgcagaaagatcaaagctagctgtggctggctgctgcgctaggtagtagcagcatgcagcgggctagctagcgagctctgaaccggttgatgaacgaggatgcaaaataaattaaagctctgtatattcatttcgcggacggatcgatggatcattgctagcttcgttgcacgtgatgggcactgaagaatatatgcgtcgtgcaggtgacgacgtccggcgcctatgcgttactatattgctgctacgatgtaaagggagatcgtcgtccatctcttgctgtcgatcatgagatgctcgccacttaggtttgcgtttatataataatgatgataaggatctgccaatgcaaactaatttctggtgtttggcgcttctcttcgtcagccttgccgcttccgcttgaagcttgctgctgcctatggcagtggagaagccagaagaaaactatagcttactgcgctgcatgccatttaatttgtactaggctgttacgatgcttaaaactcggtaaaacgtatattttgtttgtcatttcaaggtgtcagcagatttcgccagatatatatgtaaggcagatcagatacagtaccatcagtgcttcctttcatcctttgtaagttccggtggtcctagtttaaggtcatatgattttggtgatgtactgcacccgttataacttataagatag

SEQ ID NO: 2478 - DNA, 1322 bp, Zea mays
  misc_feature (1)..(100): optimal_loci_323651_G1, chr9:151568146..151569467, Cluster 14
gtaggtgaccaccgccaatcattaggccggccgcgacatggccttccgtgctggtcatgaactggccctaccgcgctggtcccgatcgagttccggtgcagccatggcagaagaggtagaaggaggcggactattgcgtcggcgacttttcatggagcagcagatcgacactgcgctacacttcctctgacctccccctccatcatgcccccccaccccttcacgcttcacctcgcctgcctgccaggattcggcggaggcgatgctgggcatttgatgaggattaggatgacctcgctctcactgcagccaaatgatgcatccacgttgcagccatcacttaatgcagtgcagtggtgtggtgtcgactgtccactccaccttctcgtttttactcactcattctcactctcgtcatcgtctcgccttcacgcagagcagaagagcaggacatgcatgcatggtgtacgtacagtacaggtgtcactcttgacctgtccatcagctctacatggtccagattaaaggccaaagggggctataggcctctcgcaaccggcgatttgaagcggccgttcttctcttcgttaggttattaagggtggtgttgatgggcaacaaaattaagaagctagcacgtgtgaacatgttaggggtgaatatattgctgttgctggtgatggcacatgagtacaaacgactacttctattacacacgtaaagcatttcctgctaatcaaccggatatattattagccttgctctaatcagatctgaatatctgatcactgaccagcacacggttttttctgtagagtacgtacgtacctatgatgccatgtgatgtcagaggctaataacagctgacggctgctgactccatgaccatgcaggcatgcatgatcatgcatgatgcgtgtagcggctgtagtggtcagcagcttgtagacccgagctacattatgtgattattattattatcatttttgttttgttccatcaatggaaaacagcgagggatgcatgcatgcatttccagggagcacttttcgcgacgagggccagcaccagctactagctagagagtggagaccacacctcacacacacacacacttgattgcctgagcacaggccacaggcacagccaaaagctgccctgtactggaggaaaaaaaaaggattagagtgggcactgggattggatggcaccgacactttctctttcccctaccactccatgcacgctgccactgttaaccacgcatgtcgtttcttgttttgcttcagcaggaagcatccagctccaggaacatgcaatat

SEQ ID NO: 2479 - DNA, 1069 bp, Zea mays
  misc_feature (1)..(100): optimal_loci_323732_G1, chr9:151978950..151980018, Cluster 14
gttttggcgggagggcttgggatttggcggggtctttttttgttgttgtttttgagttgagacttgagtggggccaaatctgcggcggaaaaggttcctcctctttccatttctctggttttcttttcaccatggctgctgcctttttctttttctttttctttttcttttgcaccggcaacaaacgtgcgcaccggtagattcgtagcgtagcgagtatgcttgctgtctgtgacaccaactggtgtaccgtccatctcattttttcacacctcgaaacaacaatgtaacaagagggtatgtatgtagctaggtacactttgcgtgtacacacgcgcaacgtaccatgcgcttgtccatgaatgtcatgtaccgctgctagtacgtagtacttgagatcgagcgggggtttggaggtaggcaggcaggcatcggatgccatgccatacacaaaagcttgctgctgctgctacaccacctggcacatttaccatcacaggcaggcatccatcctgactcgctgccaaggctcaaactcaagcccaaagtcgcatggatgccaagccaagccatgcggaaaggcggcttttttttttttttgtgcacgggctggactagtctgctcctaaaacgtggaaagaccgcagcttttgaaacacggcaacggacaaaacccagcaaaggctcgtcagagagtcctcagatagggccccggctggcccgctgcccagcatgggcagcgaaaaaaagagagagtgagagagaaaaattccccgtcaggtcaacagcaccatcgatcagatcagccatcggcagcaatccatcagtccagcagatttgcatgcggctatgcaccacccgatcctcgggcttttcgttttgagtggattgtgtgagatttgagggattaaatcgtcccctaggatttgtttgagtactctaacattgatcttaatctacgtgggttgagttgaatttagatgcaaattaaactaaacttaacatatgtgtattgagatcaatattagagtaatacccaaactagtcgttaatgaacaagcttggggct

SEQ ID NO: 2480 - DNA, 1181 bp, Zea mays
  misc_feature (1)..(100): optimal_loci_324094_G1, chr9:153522219..153523399, Cluster 14
aaaatggccagatttgctgttaataagttagatttgcattcatttttagaccgagcgagggaaatacactggatgggagtagcgatccacttgtcagccaataggcccaaacatgcagcagctatagctgcaggccgcgggacgaagaacaactcaactcccggcccactcgacgatgagcagccatgtccatgccagtcgtcgtgtactttttctgcgccgtacctatcatttcgtctctctttagctagtgatctgttcgtcgtcacgggcgacggcgcgtggtgtggatggaggaccgatcattccgccggtcattagtccacgagatacatcgatggcacacgaacgcgcatcgacaccgacgacgacagaggagaagaaacaagctaggtgttgttcagggtcatcaagaagctgctgatcgacgacgaataatgatgatatcacgctccaccttctgttttctatctgtttgttcttttacagtatacatattatgtcgttcgtccaatagtttttcgatgtggctagctatacacacacgcatgcatgtctgccatggcaatggtcgtccggcaactgattgccatgctcgagcgagctttgggttcgaggcgaggcatgcacgcgcagccacgaagtgatgcgctccatgccctgcaacgacggaatggagtgcgtgcgtacgtggaggcgatcgagcaatgatgccctggaagcatcgatcgatcgaggccatacgcacgtcgcagggacacacagcatgtatgtacagctccaaggagcagaaacgcatgagagggaggaggaaaggaagcgacgacggtggaatggaacgcgcgcgcggggagaagaagcttgatgctcacattatcacatgtatggcttttgctatcaaaagcgcggtaagagtgtgccacaagggtctctctgtccatccatccatccatccatccctgcgtgttgtgcggtccccttcgcttcaccaaacgccatcgccgccgccggccttattccggccactgcacgtaggaccaaaacaatagtagcaacccctatatatgtgtggtcgctgggatcccggcctgacggcttgtttgtgaccagctaggcacgcattcttctggcccttctattatgtgcacacgaaggatgcacatcacaatcacactagtaca

SEQ ID NO: 2481 - DNA, 1122 bp, Zea mays
  misc_feature (1)..(100): optimal_loci_324096_G1, chr9:153524089..153525210, Cluster 14
tatcactgaagtgcagtagtataacaatgacggctgcagcaagagcttttcatccatccaatccgtggatgggtactgatggatccatcttccatgcacgcacacatctccctgcaggcccgacctcaacgacgacacactgaataagaagaagaagaagaagcgactatagctgtgtgtctgcatgcagtctgcaccatccaccaccaccacccacacatgtccatggcagtccccggccgtcgcttaactctctagagacgaccgaataaacccctcaattaatagggatatccatgccctaaacctatcctgttattgttaataatataagtgccctttttttaagggggagatgctgctacatgcttgctgcttggtggacgtacgggaggacggcaagagtcatcagctgccgcggcggcctcggcacacaaaggatgagcatggcgtgccgttgcagctttccgaccgatcgggccggcgatctgcgcgcgctgttcctgttattccgccacaggctggcccgccgatgatggggcggaagctaacagctagtagagagaagaagggagggagaggatgaagaactactgacgccggccggccaccatgcatgtgtgcagctagcagcgacagatggaaaagcgcagcgctttaggaaatgtgtggcgatcggctgctgcatgcgttcggtgactggcactactctcctcacatgcatcgaccgtggcccaaacaaattaaagcagagacgatgtgggtcggtggtggtctaccacagacaccggtttaattagcgagccagccgcgcgcgccgctgctgaatgaaggctccatctctctgaaaacgtgtcgcccagggagctagcaaaaccgcatgatcattctccatcctcatcagggaagaatgtcgccgcgcgcgcagccgagccgacagtggcgagctctcgcatgcggcagtttcttccccctcgggatcagcgcgcgtgatgagagagatcgctcttcagcctgcatgatcattagcagctccctctccctgccccgcgggccggcttcttgcattgtggctaccctagctagcttatatataggcggtcatatatagctcatctctcg

SEQ ID NO: 2482 - DNA, 1002 bp, Zea mays
  misc_feature (1)..(100): optimal_loci_325392_G1, chr10:4773500..4774501, Cluster 14
gttgctacgtactcgctcggcagcagtcatcagctgctgaagaatccgttgagctgacatccggagagatggctggctgtaaagataagatgtgaaaaaaagaacttgattgaatcaagctgtgtctttgacatcgcgattgacgacgcaccttttttttaaaggtcccgagatctaccagtgtagtgtagtgtagcgtaggcatcttttcagcttgcctttcgacaaaaggaagccggaggggggctaaagggaggtcagatcaggtccctgatgactgacatggctcctttgacaaaattcacacaaaaaattattattattattaataatagaggtcgccgtcctatgaacatgcggcacttcagagttctcccaagaaaagggaatcgagggacgcattcacgtttttttctttcccacaatgtacttatatgagatagagctccagagttcttctcacggtgttctattaaactgacaggctcgttccagttcgcgtgcagagactggaaactggaaggtttcgctaatagatcggctgcaggttctgttcagtctgcatgcagagatcgactgggaattgtagaagaaagaaagaaagaaagaaaaaactgcaatgctgttaccaaaaccgtttcccttttgatccctctacaagttttatgtctgggaaatttcaagtttctgcagaaatactggagatagagggtgtcaaaactgggtggttttggagggctactaaactctgaaccctaacacagattagactgcgggggaaactgcggcatggctcctctgtccatcgacgacgagctcgcacttgcacgccggcgccggcgctccaccacgtgtcgcgctcctctgtgctgcactgccacacgtcctttgcgcgtgtcctggtggccatttggcgtgcaagttaactgtcgtgtccgccctcaacgccacgacggcctcacgttctccgctcccctcgccgccgagactcgcctctgtccg

SEQ ID NO: 2483 - DNA, 1189 bp, Zea mays
  misc_feature (1)..(100): optimal_loci_327214_G1, chr10:14495819..14497007, Cluster 14
agatgtgatcattcccatcaagtcatggacccacctggcgctgcccgcggccagccgtcagcgtaacagtagtgaagcaggaggaggtggggcaaggcatgcatcgacgtgtacgtcatgcaaaggcctcatgcggaaaaaaagaaaactagcggctggcggggatttgtcaaagcgcccgcccccccgcggcacacgcaacgttcgatgatggccaggccaggccactcttgactcgctcgccgccttgccttgccacacacacagcgttgaccgcgagcccgggggaggggggtgagtggaaaaggacagcgattaattaactacgctacacaacaaacagaggtccggtcggagacggaaccaaactgtttttgttcatgagaatcatcaggacggcatgagcttcagcgacccttgccgtacgtcgcccgtcatcgatgttgcagacccggcctcgactcctcaccacgaatggtcttgcacgtggcaaagccctcgtggatcacacttgtccaattaggtgtgtttggttataggacagtcaaacaaaacaaccttatttaaatgatcgtcttatcccgtatcattgcaaccaaacgctcctgtggcccagctaaagagcaccgtacgtgcatcggggaccgggagggccagcaggggcaagcaaaacatgagtaggtcaggccaggccagcctgcgagcgactgcgtacggttgcttgcagttgcagcgcagggcaacaagcggccgctgcaacgtacgtcctcgcgccgcgcttgcatgcgcacggccggccgggcggttgcgtgcggccatgggccaagacgtcgccgtccgcatcgtgcgtcgccgtcgccgtcgccgaccggccggccgggaccagcaactgtgtgtcaattgatgaatgcaccacgaatagaaaacctgcctgctgccggccagcggcggggccccttggagatgcaggcagcagcgcacggcacggcacggcaccgcagtccgcaggcgccgcacgcaacgtctctgctctgctatgctggatgggatcggacgtcgattgttcaaatgtttcaacgaaagccaacttgtctccggtctcgcctccccgctttgcccgccagcccgacacagaaacaggatggatgtccgtttccgtttcggcataaacgttactccctccatccca

SEQ ID NO: 2484 - DNA, 1394 bp, Zea mays
  misc_feature (1)..(100): optimal_loci_32753_G1, chr1:200859213..200860606, Cluster 14
atctatacataagccagttcttctggtattacccccagggcacttctatgcatctatagaagccagttcttctagtgtatacccccggaggggcggctctagtcaaatgataatctatcttaacctgtattattaatttgcgcaagagaataatagatatcctacacacacacaccatgcatatatacataaaaaatgtggataactaggagtaaccataagcttttggattcgtaagaaaatcggcatccgaattcaagctgagacaaaaaaaaaaataaacccgggcacatcgtccaactaataagctaagctcgctaggttcacctccctgcctacaccatgcacacgtccaataaaatttcgaactgagcatgcggtcgggcaaatttccaagttggtgggagcaaataggcgagcacaacaaactcccgccattccccaggcgtccagaggtccggcattcagcacggcggcatggaccacggacgtaggcacgcgtcggaaccggccagtacgtactactccaccgcgcaacgggagctcagctcagctcagcgaatccctccggctcccgtgccggccccccacggccacggcaggcgtacgccccctcgaccatcctgtggcggccaggccatcgccggccgctcggcctagccagtacccagtaggcggacagccagccggcccaggccccgtctgtctccgtgacggagtgccgcgccgcgccgagggacccccggccccgtgcgcgcacggcacggatcggtgccgtggtccacgccggtctacagagcccactagcccgccgccagctcaggctcaggctcagcggtgcccggtcgaccactcctgccaccttcactcctctcttctcccaagctagtccccagccgcgcagtagtagagaacaaaagcttgcactatccatcagaattcagatcctgcatgcgcgcccaccggccaaccgcccacagcacagcatgcacggcacggcgcacttgccccgctccgcgctgacgcgggccgtgcgcgcgcgtgcgtgcttccccggattggccattaaggaagggggcgggcggggggattcagtaatggcgggacgcgccaaagtacagcacggtcgaggaggcgacgggagaggaaaccatatgcacctccgtccgcattgcgttgcgttgcgttgcgactgccgcatgcgcgcgcttttcactccacaccgtccgtccccagcctagcgtgcgtgagcgtgcagacgatcgaatgccgaggaagaaggccgcgacggcgggtaccggaccgggtacgttcgtgtggaaagcctgcgtgcgcagcgcagggccgggggagggagcgtccgccgcatgcgacgcccggagcaacaaaggcag

SEQ ID NO: 2485 - DNA, 1290 bp, Zea mays
  misc_feature (1)..(100): optimal_loci_348058_G1, chr10:138029858..138031147, Cluster 14
tggcatcatcgtgtgtggctacatagtcgatgcacatacataatagtggtctcgagtaccctacagcctaagtcgtggcaacaacacgtctctcaagcttaacatcacacatttcacatttaatatgttgtacccaaaatttatctgataaactatagacttgttaataggcctttagatatgggccccggcccctaccctaaggacgtaactccctcagtgggcctagacacatattcatgtcttattgataggattacatttagtcacaacaagcctcatcttttctataggaggctttgggtcttaaagggttcaagacctaggtatcggaccaatagagggccccaaatgactaagcattgttgattgtcctagggcccctgaccacctaaatcctttattagtgtcccaggtcacgagtggccctagagacttagattcttcacgagtgccctagggcacaacatgtcctagaggcctagattgtgtgcgcctcggggaacaaggggccttatggacttagattgttttagctagggcatcctagggccccaggggcgagcccggcatcataagtgcgaaaattccttgttccttagagcaccctaggtgcaaagaggccttggatcccatattggcccttagcaagatggtggtgtatatattattttggagtgcctcgatttcaagttgtctggagggccaggcccttgcactagtaagggttaggggaggtcctagggctctataagcagtggtcctagtaactaggccacgtaatagcttcatgtatcacggtccttaaatgtgtcttggcaacaactaggggtgtggcctttctctgactctatcaaaggccaataagtccattgccaaaccagtccattaattggacccatctttcttgctatgtgcctaatgaaatagattccacgtatgcatgactgaaaaattacacatctcatcaggcatcatgacaactaggtccctaaggtgaccaagcacaattgaaggattcataccatgatttagttgttcttgggatctgtctctagacctctgtcggggttagttgtcggtcatttttgtttttagctcgaagcactgttatcagtggcgttttatgtctacaccattcctgttatgatatgacatatattggacctagagcccaataattatgcaaaaggaagtgaattgccagtaatatttagtggggagtctcatatggtaatcacacatggttttcgagcgagggctcaggtccggagtgtgcatgatggatat

SEQ ID NO: 2486 - DNA, 1334 bp, Zea mays
  misc_feature (1)..(100): optimal_loci_348059_G1, chr10:138040770..138042103, Cluster 14
taatgagggaggcgtggacaatgttcgagatctccttggatagatctcgtcactagctttcaatcatattcgtatgaggatctttccaacatgaaacccttagaaggaatcgagcgagtacctcattttttctatatattctctcgtcatagtggtgggcataaactcctcccttctttcttgttttttttcccatcacatccttgactacttttagcctcaaggatgggcacctcacgcgctcaccctgttgaccttcgcgtatctacgtggagtgttcgtcgaggtgagaggtctatgcgtagaccatttccgtcatttctagttcttcgggtctaaatattattctcaccaaaaacactgagcacctagatgttttcagaattctctaccctcggtgccctgatcttttcttctttctccggacgaggggtgcgtttttttcccctcagccacgaaacaaccgcctcatttcaccttggctggaacttggaagacggtgaccggccatgcataggcctgcagctgatgatgctgtgtctacttcctctatagaagaacagtgattgcagcgtactatatatgctgcaagctcttccgagcagagcaggccgaatgtcagaaccatgcatggccaaatatacagagagagggttggttagggtttagcagtccccctagcttggtcccgatgtcgtattgtctgtatcattcatgcgagttgacgcggcgtggtgaggcgacagaggatttggtacagtatccacgtccacggaccacggtgcatggtggtacacaaacacaatgcagaacggtgccatgcccatgcatgattgttgttggcgagggaggcatatataattaatcacgttcccgaccccggccctaactggccggtgctcaattgccaatacacgcttcaagatgtggcaacgtcgtctttgaaccttgtttatggacagctagcggagtgagagcgccattgctttctgcttgacagtgccttccacacgtacgccttgatgatgctcatctgaccgttcttaatcactacgtaattaataacgacctaaacggtaacacacaaaatcctatatatccatgggtgaaggagaagcccatcgatcgacacacgtgattatattactctatgcaagcagggtgagttttgtatcatgtggcctaagaccctagtaccagttttatatatggaggttttttttttgttttttgttttgttttgtatcatctactattcgagaacacatgggggccgaatggccaatgcgagctgtcagtccgtattgcccttggcaccaacatcaggagaatga

SEQ ID NO: 2487 - DNA, 1144 bp, Zea mays
  misc_feature (1)..(100): optimal_loci_348161_G1, chr10:138732239..138733382, Cluster 14
ttatgagatttgcgaggacgagactactagtaccactctatcatctgcgtttccggcggtctcaggagctagggggacgcttcaggccggtaccaggacttggacgtgttggggagaaaatacctgtgtttggtttaaggccgaaattggtcatcccaaattttggccacggtttgaccacacttgacttcatattcaaatcgcattgtacaacaaaattttcatctatatggtttatttgactacacttaagctatatagatgagtaatttattgtttacctaaattttaatttaaagtaaaaatattcaaatattgaccgaattttggcttggccacctaaggccttaaaccaaacagaaaatgcaagcgcacgctgtcttggacatccatcgtcagatgtgatatatagcgcgcgcaggacttagccagatgaccttgattagtaggcgcgacactgggcaatgtccctctgacctcgatgcccggtgacattcagaaaggctaggctagtgatagtgacacgcgtcacacgcccgttgcaacggtgttcagtctgctcaggcttcacgttaaaatcaagcacggcgacgctttgccagcgtgtagaaatcatctgacgatagccaccgtagccggttatgccccgggccacatgcgacatatatgaaacctcgaaacagggatgccctagctccaaaaaaatgtgaatccgtgtgatctcgattacttctgagaatgtttgcatgtgcttgtatacatatacacatcattcgaaactagcgaaggtccactgatgcagtcacacgcgtcgagaggaggcactgaggcaggcagtcaggccggcacggctcgaggtcgaggaggtctacgtactagtatgtatgacttgacgcgacacgactcgttgtcctgcttttagagacaggatgtacattaccgtaattagttgggtgcacatctgtcatctgcacggacccaagtattttgaataaaaattctaggaactgaagtttatagttcctaaaatttagaagtataccctagtgtattcagattaaagtctatatttaggtgttgtttggttcacatatcagtaacgtaatggataaccaataacgctgaatcatgtttgtttaagtct

SEQ ID NO: 2488 - DNA, 1231 bp, Zea mays
  misc_feature (1)..(100): optimal_loci_348273_G1, chr10:139321284..139322514, Cluster 14
ggatttgtccgtgggggctccgccgggggcatgagcatgtttgttgtcagtcatatcatatggcaactgtcttgtgctgtagcagcagtgggagacatgcgggtacagccgcatccaccgccgctgcggggctcagattcagagcggcggtggtgggacgagagcgagcgaggcaccacagtcgcatcgcccgcccccgccttgcctgctgcctgctgccggcctccgatcgccgctcgcctcgctcatgcgcgatgcgatctcggagggaaggtggtggtggtgccgtggtggcgtgggggagaaacgggaattatcaggcgacctacagggacagcgcacgacgcggaatcattcgttgggtttgtcatgggcccccaacatctcgtctttgtacccgccaaaggcagttaggcaggccaaggttattaaaaaataaaaataaaataaaagacagcatctgtgcttggacatccaagaccaagaagtggaaatattcgttcaaaaatcaaataacaaaattaacgtctaaaattgaaccccatattgtttatgcaacacaagcttcgattccccgagtaccggaattacaggccgagcgggatgcaaccggaaacgatcgagcatttgctccaggaacgtcatgtcagagcgggacgccgacggcgaactttgtcctgaagccacgaaactgccgacaggcttcagagaacgccaggcgagtataaaaaagtactagtagcagcgcagaggagaaacactgtgcatgagatgagtgtgccgcactgccgcctgctctgccggtgcctcttgtccaacccctgtcctttttttttctgacgacgcacgggcggcaggatgggaaggcagcccaacgggaaaccggtctcccttcctctctctctacgcggtcacggccatcacacgccatccagagggatacttactgcattgacacacatcgatcggatgtaggcatggatggtgctgtagcggcgtggggagaccggggacaacggcgggcatgatccttggatctgccggtccctccctgctcgtctcggcctctcgtcccgggacgggaccagacagctaattcgatcgggatcgagtcgcgctgcgcgtgggtcgtggcccgtgtacgtacgtacgatggagcgcccatgggcaaaggggagcctgccctcgcgcttgctgctccagttggtggattgccaggctctgaaacaaa

SEQ ID NO: 2489 - DNA, 1152 bp, Zea mays
  misc_feature (1)..(100): optimal_loci_348638_G1, chr10:141230387..141231538, Cluster 14
gttgacagaatgtcaggctgccgagctggctgagagtacggaaaccttgtttgtgcagtggatccatctcatcgagagcctacaagctagcacacttgaactgagctcgtctccgatactgtacaagcataacggctcccggtcgtcacatcgtgcacatgcatgcatgaggcggggcaagtacttcgttcggtgcagcctagataacggtgagatgcctcaaataaaccgtgtagatttttgctccatgtcaaagcaagaaaatcgaccaagccttagtctgggctgtctagatctcgttaaaccagtatcttggggactatacgtattttcgaccgtaggtgccgccacgcccacgagggcctatcgtggccgtgaaaaggttccagacgtacgtcaagattcgtgtgaactaattgagagagagagtttattcaccatcatgtcagtcaccactcgaagtctcgaacctgcagaagtggtcagatcgactcaaggaagaagggacagcactgctggagatccagggcgcggcgcggggccgcaccaaccacaccagtgccgcttcttctccgggaagtgtctgcgcctgcgggcgggatgactggagaggagcatatcacctccgccgctgcaggctgcagcgacagaaatcgaggccgccctagcttctccgtcagagcagaggacacaaggtcagatgtcccgagggccgagaatcgacaggtatagccgtatagtgaagagtttgaggatccagtaagtatccatgtaaatttcgtttttttttctttctttttggtttggagcttctgtcccaacacccgtgactgggtttctgaagatcgcaaactaaacacaagttcagttcactcgtcgtacgtcctgaggacgactatgctgaccctgcaagcgtgtacgcacctcaactcgatcagatctgtttcccgccaatgaaatttattagtgaagccaaatggatttattcgaactctgcttgggtgcccgctggctccatgctcagctgtcagctgtctctcattgtggctgtttagttggtagtgatagtgagagagtcagcggtttgactttggtgacggatctcatcgaacggtgactaagcagatctgattaacttgagaacggtggctg

SEQ ID NO: 2490 - DNA, 1119 bp, Zea mays
  misc_feature (1)..(100): optimal_loci_348650_G1, chr10:141273274..141274392, Cluster 14
ctggactcttcctatcttacggtaactaaatcaaccgggtgagttaattacagttctgcaaaaaaaaaaaaaaaaaattccctcccgcgtagttgtcacggtcggtcctagtgctccgccagcatctaccaataagttcgcaggtcgttttgggcagccttctggtagtagcaactacgtatatatctaatccactcacatgcccgattggtatacgtctccttccccccgccattttctactacttttttctctctctctctctctctcttcacggtgggcactgggcagtagtcaatagacctgcatatataatatatatatatatatcatcaaatgatgaccacccactccccaacgcacaggtcaatggagccaccgagccagagttaaagtactctatcgagatagagagagagtgtgtgtgtgtgccaactttgcctgcctggctacaagctagctagtagatagctaggctgtgaaagtaaaaaaaataaagcgccgttacttttgtttgatgtagcggtcgtgggcggtgcacgcagcaggggagagggagactttgggttcagagtccgccgaagcgactagcgagagctggacacctccctccaactccaacattctttgcatcttcctgctcccatatgctttccgcctaacccaccgctgatccgctgaagctgaagctgaagcctccccccacgatttgtttattccctgcaaatctcacggtgggacacaacaaccccgcccccgccttgatcggatcaaccgatgcgaggtttcctccgggcgagctgagctgagctgtccaactggacttccactgcgttccgttccatcatggggcgactgacactgacctaaagctactcacgagactgcgagtgcctgtctttaaacaattctgtccgtttgcttgcttgcttgcttcccgattgctgcctgtgtctcgctctggcactgtgtggcagtaccagtacgtgcagagagcgaccgtcactgtgtggtggagcagagctgcagagccagagagctgacatgtgacagtggcgccgctggcccatcttgtggtccggcccttggtcgcatcagcagggagtagcagtgtcttgc

SEQ ID NO: 2491 - DNA, 1164 bp, Zea mays
  misc_feature (1)..(100): optimal_loci_348745_G1, chr10:141819586..141820749, Cluster 14
ccgagagccccatcttggccgtcgcatgtttgtactatattttgctgcttatgaaatctgcaaattatgagtgtcttactaggatactgcagaaagggtacaacgcaagtggtcgcctggccatgaagagatcgaagtgtcaacagatatttgactgaaaagcagttagacagccaataaatctcttctgctacgagaagcaaagggttagacacaggtcctagcagcaaagaaagtctccatcggtgaacagcaaggagatgcgtcagcgatggtacttgagcatgaagatccgctgaaatggaagccatttcccccctgtatggatgaagccaaaatggcggggaaatcctctttgttttttgagaaataatggcgggaaatgttgtgtgatcaaatcaaactgggccaaagacgagaacatcaacatgtcttaccaacaaaaggaagaacaggtgttcaggaaaacgacgtcccctgtaactgtaatgcttgcatggcaatgggcaggttgtggaacgagcgcagaattcagatcctgctttctgaaatttatttcgtcaggatttggtgattctgttgtgactagataggacttgggacaatggtggaaacctggggtttggcgttgattcacccactaaatatatttagggagtctggtgtggtttaatgtactgtctgaattaacgattctgaagactaaagctattaagtgatgttgtcttgatatgccaaccaggcaaccagatgaattgttttggcatgccttttttattatttttgagggtaccgtacgagggatcgagctaatcgggaggcaggcaggcaggcacagagcattcagctaggttcccattccgtgcagagacaggcagggagtggggagcaaggggaggcgcactgtgatgccataagtgtcagcaagaaggcccaaatgcgacgcgagccattgtctaaaccctccccagttcgtgtgagcaaacgaggacagcagctaatgttcacagaaacaacaggtgcaaccgtgcaagagatcaaacgattactcgggccctgcaagctattgtgagacaaggacgaggggggggagcattcgagctggagccagacgtgagcttgctgtgggctgtgtggctcagcagatctcatgtctttctggcg

SEQ ID NO: 2492 - DNA, 1121 bp, Zea mays
  misc_feature (1)..(100): optimal_loci_34971_G1, chr1:212535842..212536962, Cluster 14
acaagtgacagattacaaccctgctctcccaggtgcagtgacatggcgctttcaccgatcagcatgcacgctgatcgacaggttctccctacatatctttcttcctattctgaggcattacgggttaggttaagtttccaaaaggcattatcaggtaatcgttggatctgtttgatgttgtcatacttggaaatggttttattcatgcactcactccgatactaaagttataagaaaagatattaatttttaccacagttataaaatagttattctataatgtctctaatggagcatacaccatgtttattttaataaatttagttaagtttaaaatagattaccatacaacaaatataaaagacactatattttaggacgtgagtattggctctaggtggatttaacaagtatatatgtaatcattgtcccaaattgtcttaacatggtgacaacaaaaaaacaggtgtgttttattgtaattatagaaaaaaaacagttgtcttaacacgcaaaggattacttacccggaccatgcagagtagctccggtaaggaattcctttcccgtagtccatcaatcgtgaccgccggggacacccttttctccagcgtgctccgaagaagatatccgaccaccacacgtgacctgaacgaccatgcagccgagcttcccatggcgaattggcgacggcctgttttcgatctccctccgccttctcttctctcagcttggtggtgaacgatggtgctctcggtggattttgcgaacgcgcgtgctggtcataggatctcgggagccgagattttatactccccagggaagagtccggccgggccacaatcggtggagagctcacccggacggccggaattgcgctaactgtcttccgtccgtaccgactcgaggtggatgaccatccgacgcactggtcccacgtggaagcgaatgcgggcgcacggtgtggctgtcctgtgggaccccgtcggtgtaagggcgaggcgcgggcacgcggtgcacgcagtcaggcgggccgcgggcgtgaaaagactggatgggctggctagggaaatgtagttgggctgtgggtggactggccatgggccgatttgctaggccga

SEQ ID NO: 2493 - DNA, 1095 bp, Zea mays
  misc_feature (1)..(100): optimal_loci_35503_G1, chr1:214990459..214991553, Cluster 14
agcttcttctcatgttccccggccggcctgacgcttaatttactcacacccatctggccatctcttttgcgcgcacgcacgcatcatgctgcagctagcatatatatcggccggcgaaccggattcagaagccgatgatctcgtccggcaccgtcacgaacctcgcccgtttctgtgaaaaggagccaagagggaaacggaaaacgcaggttgttagttgcttacattgtcaacaaataatagccgcgacggtttcatatcacctttagatccgtaagcttttggaaaatagaaggccagaggaaaaaggtatatatatatatatatatatatatcagcagttcagcacacaccaatggccctgacaaaaaggttgcggcgctgtcgttgcaaacttgcaccgtactatgtgcgtgcggtgtttccacactactgtgtgcgtgcggctgctgcagcagcaggtcttgccgcgcgagtcgcttcaagtggaaagccgctagactagggtagtagctagcagttctcggtgctgtttcccacttccgcaccgaaagaggaatgctttcttgcttgcttgcatgcatgattgtccgtcctgccgctaccgggctggctggctcactgagcattaggctgactccagcagtaatcctatctcatcctctatcttaaacttaccataatttacaggatatctactatgctaccagcattattttcatcgaccgatcaacgcacggcctaaccgacaccggcagccggcagacggctgttgaatttgctacaagcaccgttcactcacatgttacaaggtgccttgcctttagtaagctacgtggattattccatcatgtcatgtgtagtgggcggcttttgaggtgtcgtgtcagatctcgacagggcacatgaccagtcgctgccaaggtctctagaaatatcattaggatacttgccaagttttagacttctgaattttagcttcattttacactataattatatatatatatatatataattacaattacggtttatgtgttatagtttatgtaactataatatgtgattctgagttctcaaagcaaaaaatatata

SEQ ID NO: 2494 - DNA, 1042 bp, Zea mays
  misc_feature (1)..(100): optimal_loci_38439_G1, chr1:230223563..230224604, Cluster 14
cacaatgaaaattatttttctgaataaactattttcaggtgtatgagttgtctatttaagggcatttgcatgcataaaaacataaataaataattaatataaaagttacatcacatgctggagttctatatgtgcatttagtttgaaccaaattgaattagttgaatctaaaaaaactgaaaataggaaaaaaggaaaatggaattgataaaagaaaagtaaaagaaaacaaacccatgggtcatctttccttgtccctctcagccttgttgggctctacccctccgcgccggtccacttacccacagccgcgctggagcgcatggttccactgatgcgtggcccctcgagtcagccagccctcctccaaaccacgtgtgcttgccgtcacggccgcgggcgcatggtccccactgttagagcctcccacactcgcgcgcgcaccagagtccttcgacaccgtggctctgtttcgctgcaatgcgggacccacccatcagctaaggtatcttccccgtgacaaacaccaccaccgagggaagagagaaggggtagctgccctccgccagcaccaacgctctagtccggtgtagtggtcggggaggtttgttggtgggtgctgatggttcctgcgacacgttcacacgagataaccagttggagtatgcgcgatttctcaccatacttccaggagatcgccgtgctgcccatccacgtcgccaggtctcattgctgctagattcgaggtgagagtttccccatgctgttagccgtcgtcccttcttcgtgtattgtccttcgaactgaagtattgcacactgaaacgctagggcgttgtgcgctggcagggcctccgtcgggggggggggggggggggtcgccaccatggttggcagcgggtgaggatagtggagctgtgtaccgttcgatcgatcgtcgatggctgagattagatctcttaataccacttcacacgtatcatccgaagcgttggatcatgtccggatgctccagattagaagttggagtggagccccctagc

SEQ ID NO: 2495 - DNA, 1165 bp, Zea mays
  misc_feature (1)..(100): optimal_loci_38698_G1, chr1:231384987..231386151, Cluster 14
aggtttatttttatacctaatattcaattttcggattaacttatgattaaaccaggaggctgggctgtagtcactatttccatgaattccagagcctaaaatgcgaatttcgggggcttaaattagatgtcctattacggctctaggactgcgggttgattagtgaaggtcacatgggctatttcaaaaagttgctcggctgacttaacggggtgagtttgagccattgaattaccgaaccttggccatgatcgaattccccaagcggtaccccacgatctaagcaccgccacccgatctagatccttcgatctggggtcatcctgttgctcctgaccagaacagggccctgacgcctgcccacccgacggtgagctagctgggccgagggtcaatcccctccctggctccctagagcaccatctcacggaccgagaggtgctacccaaccagaaggatacagtgattcgagttacgaagttgttaccaacgatggcgtagccttgcatccgatccacagtgaagatcgccactgcgacagaagaacaaccccggtgtatcctgtcgtttgcgaagacctcgaggaccctcctaaagactcggggagactcggcgaagcgcccaaaccgatctccatggattcagctatgccgatggcccaatcaccacgacggtcggttccctccacttctctctgctcacgacgacgctcagttcctccctgcgctcaccccagctctcccttggcgacgtcgaggctcgtatattcgatgacaaaagaacaaaggtgtgggggtgggcaagtcagcttttacgccccaggatcccatggcgcccatggaaatccgccctggtagaacagcaagcaacaatctgaatccgcgatttcagtggggtttgttacaggtatgaagccagcttgtggggcccaacggctgacgtcagcgcgcaaggtggagaggctacagccggggcccacctgttggcaagtgcgaccaattaggcaatgggtggggcggtgtgcgaggaagtggagttgggtgggcgaggtaagttggaccgagcgtgggaaattcttgaaccgggccgagagggtgaggtgaggagctgggctggctgaggggaaaacaggaccagatcaggtttgtgttttctttgtgttttc

SEQ ID NO: 2496 - DNA, 1078 bp, Zea mays
  misc_feature (1)..(100): optimal_loci_40348_G1, chr1:240465078..240466155, Cluster 14
gtcaagggacagcgcgagccttgttgtacagacaaccgaacatccgctgtgtgcagtccacgggatagcgcgagcctgggcgcagctgttcaatgaaccaatcatgtagactgagtgcggcgcagataatcccatttctcggatcaaatatggccacaacccctttcttctaccttgaaactgcacatgcatgcaaggagctaggaactgtcatgggtttcggccagggaggttagcgtggggggagggtgctcggctgcgccaggcgtgcgtgtaggggggcggctaggctgggcacacgggagggctgggcggctgtcagccacgccgcgccatagggcgagcgcacactcctgtacaggggctgtgcagtgtgcacaggggcaaggggcgcagggggctaggggctacgcatagggttggggcgagggagcgtgcaccatggctggggagtggggagggggcttggccaagtgacggccatggttgcgccatgcagtgaaggggaataaagaaaagggaaggggaagaaagggagtggcaaatccagggcacgacgagatctgaccatgacgaagttgattagagtgtcggtcttatgatccgacaaggggggacagaaattggtcccatggctacgctactgaacagagggcatcacagagaaactctcgacgccagggacgaccaaacgtagagaatacaaaggagcgggtggggatttctcaccgaggaaggaaggggcggtccaagaagcgctcataggcggcgaggtcactgcagcgatggcgctctggacagggacgatggtgctcctctttggttgttgcataggcgaaggagcatcatttggggaaagcgtcgtacgaacgaagggtgtgaaggggaggagggttttgtggagcgatcgagaaactatagtggacgtgcgtgtggagagagcgagggtggggtttattcttccccaacatgcacacgtacaggtgaggatttgagggggttagtctgacaggtggattccgtattttaaagattgatttttaatgcataaaaatgttttaaagagcccaaacttttt

SEQ ID NO: 2497 - DNA, 1151 bp, Zea mays
  misc_feature (1)..(100): optimal_loci_43048_G1, chr1:253607122..253608272, Cluster 14
acaaccaccaacgaggcaacgagtgctgggaacacagcagaatcagaactgttaattattaagtgcacgcaacaacggtcagaaccagcgcacacagtactgaccagcagagtgggggctaataacaccagcaacaacaagtgaccaacaactccaatgcggcggccaacactcctatcctatcaatacagatcgaccggagggaatgcttgcttcaagtgcgtggatatgtgcatgcaacaatgctcacgtgcgcgttgactcctagcttagcagcctacgtactacgcgaattgcggctgtatagtataattcactaaggcacgacgatgcaagaacacacgagcgaccacacataacaataacataatgggccgggagcattatattgcctaagtattctccagcaacaccaaaaaaaaaagcatacgtccacgcgcgcacgattgatcgaccgccggcgccatgcccgtgggccgtcggcctgatcagttagtcgtctgattgctcgggttggtgctggatatcgtctggcggtgagggcaccgggcgccaccgttgctggggctgttgctgcaccccgacggcccggccgatgattcggtcgccgtctgatcaggtttcatggcggcagcggcagcagcagccgtcgtcatcgtcggcggcggcgccgcgcgcatacgacgaccgggcctcccggcgccgacggctggcacggccgaagaaataaccacggcgatgagcatgaggacggccacagcaatcgtcgccgccgtgccagcagaacgccgcctcagcactttggccatatatatatgatactgtctgcttccaggtagcgatcgagattattactgtggaataaacaatccctaccaatcgatgaagctagctagggcagagaggggtagcgagagggtccggtgcacaggaaatgtgatgctggtggtgttgcggtttagggagctatgctatgcatgtgtctccccttctctctccctctctatatatacacatggatggccgtacgtaaaggggatctgcacatataattatgtatactgatcacaaggattagtaatgcatgcatcagatgcgtgcctaatttggtggccagcagtcagcacagctagcagaggtagaaacggccg

SEQ ID NO: 2498 - DNA, 1210 bp, Zea mays
  misc_feature (1)..(100): optimal_loci_43694_G1, chr1:257191093..257192302, Cluster 14
aacttgctcttcctgtgttcccatcttaatgactctggtttttttggaggttttctgttgatgcgtaggtgcattattgcacgttgggaaagaaccacacttgaagacaaaatccattggttcaaatcaagcggccagagccagcatttcctcctcacgccggtactgcgtagcagggggtggctggaggcccatgtgcgcggcgcggacggatggcggtgctgcgactgcgaagtcacgcgcgcgcgacgcggaccacgcctgtgccccgccggggagcaggacgcaaaggtgcccgagaccgagacgacgtcacgccacgcgtcgtatccccgttggacaggacagcagcgaagaatccgggcaccgtagtgcacatggtagggtagtgtcacggccggccgcatgcacggcgtactgacctgccggcgccagggacacaccgagcggcgagcgcggccgcgtttttctttgcaggtgtgggtgtcgctgcgtgctcaggcccccgccacccgcccgtccaccctgcgtcacgcgcgcggcgaggctctgcttcctgcctgctggcgccgcttgcactgcccagctcgcggcgcaggcagcccacagtcccacactcccagatgatgagatcatgaggttcgtaaaattaatcgtaggtatacaaccatttgttgactcgtagaagcattatttagttggatagaaattaaaggtgccgaggcccatatacgacttgctaaacagagaacgctaatcaagggccgctaaacaaggcaacagtgccatgcagccctagctagatggctagcaacggacagcgacgcgactcgcgaggctgtgtgcaagtgtacagcagtggctggcggctagcactgttcggatgatcggatcatcgtcacggatcccttcagatactctgcggccgaagtgcggactgccgtgccgcggtgggctatttttctcatgaaacaggagtcgtagataagtactgtacgcacgtggtagtacgagttcctctgccccgtagaatttttacgtcgatgcatgtaccaatcaaagtatcaaagaagctgatatcgatgattaaaggcgagacaaccagcattcatctgctctaaattcatattgctgtcagtacatcttcactctcagacaccgatcgaatatgagagctgggttgggtcgaaaagtataggaccgacttgga

SEQ ID NO: 2499 - DNA, 1251 bp, Zea mays
  misc_feature (1)..(100): optimal_loci_44065_G1, chr1:258651321..258652571, Cluster 14
cccacccagcagtgatctgacctcagcagcagcgcgtctagatagccgcgccgcgcatgattgctttgaggagacgcaagtgcctccggccggcgtcccggaggccggacccagcccaattgatggcgagcctggcccgctcggtcgggcccccccatggccgcattaacgccgctgttggctttggctgcgccggcttcaattcccgtttggccgcgcttccgttccgtggcatgcccaccccacctgctgcactgcatgagcccccgtgtctccgtcaccatccggtctcgtccacgccatcgctgccggcggccacgtacaccggccggccggcactcgctcaccttttatgagttgccgctgcgcccagtgcgtgcgtgcgtgtgcgaccgccgatacgatccgttgatggcaacagcaacacgcccggcccgccgcacccgcgcgcgctcgactcgtcgccagcagcaggggcggcgccgactgtttaaaaattccagaactaattaagacatagcctttagtttgcgtccaattactgtgaggagcagggtactagttcaaagctatgcagtggtatgtacgttggaacgtggttcacatcaacttgcttcgtcttcgtagatccgtgtcaatcatttctgttagttggaacgtggtttcaagtatacgttgagtctgaggttctagattctttatgttgtactatttcgttgctttcttggggctgcactgtataacctgtgtgagtgtgtgtaagaactaaaaatatatataaggacgaaaccagcacctcgaatatagttacggttgtattgtttatgcgtcatttaaaacccgcaactattcaattgttggtttcatatttgtatcttttttgcgcaggttttttttgttgcacctcagattttacatgaacacagaagtttgcatcatccattgatttttgtttttgttggaatttttttgacacgtttgggcgtgctttttatataaaaaaatgggagcagagaagcatgtgagggagcagtgtagtggtatgtaatatagatatacgtgatttgtgttgaatatatgagattttgtaatatagaactgtgaaacaaacttctttatttagtgagtgtgacggaaacttccgcatgcattcgatattatgacgataacgtcatgtgacacaagtttgattttctaaaggcgtctccaatgattagctattcctacatggatagaaaatatggggaaaac

SEQ ID NO: 2500 - DNA, 1106 bp, Zea mays
  misc_feature (1)..(100): optimal_loci_45176_G1, chr1:265318544..265319649, Cluster 14
cagtactctctcccgtccgcgcaacaaactttttggttgtgatccccctttatatagagaacatgttggcatgagaatcaacgtccgctgtatctccttgcccgtacagaaattaacgagatccgatctatctcctctaccagagaccaccgtaccctcgtagatattgaagcccagacttgaacctgcaactccctaattccaaaagtacactgatgggttcttagtcttctagtagatagggtaacacctaacacaaaagttggattcatcgaccccgtcgaccactcctcatccaatccagtgcaagttgtagaacacgaggcaattagcccgtggcgttcgacgcagtggcagccagccaatcatcttgtcccggcaaaagtaaccttaacacacttctcctcctcacccttcttgatggagagcgccctgccgcgagttgctttcagtacaagcatcgtagctccaatcaggcaggcctgctgtctgctgctgctacgccgtcatcttggaaggtgcctcgccgagagcacattgtggacgaattgaagatattttgtctcgacctgaaaagtgacggactccgcagagtcttcttgctaaccaaatcgacatccagccagcgtcacgtgaagctggtccatccaaattttaatctctgccctagctaccctactacacaatagaagtgtgctacctccaatagaagtgcgctacctccaactcccaggtaaaccctaaaccctactacacaacagaagtgcgctaccaccaactccatcaagtcagctgttacaaattgaatatttcattcaaaagttgaatactagtatacgtgtgactagttcgcatcgcacgttttagagaagggtatatacgtatatctcttgatcagaaccttgagccatgcgattaggcggtccaaaacacatcggatctcggtgcgggatgctgaatggtgtgaatatttatatttatagcattcgtcgtctcgatcaaactgtgctgcctgcctcgcgatcgcgatctcctagtagccctcgtcgcctctgtttttccgattgcgtctagtgggccgcctttgcttaacagcgcgaagttcc

SEQ ID NO: 2501 - DNA, 1378 bp, Zea mays
  misc_feature (1)..(100): optimal_loci_45895_G1, chr1:268943994..268945371, Cluster 14
acccaccgcggtcgtgcgagagcggcggactcgatggatagacgtggtccacatggacctcgcgatttgttgttgcgctgcttcccggtcatacacacagactggtcgtgcgtgagaacggatcggatcggaggcgatggccgggggtgcctctgtcgtctgtcccacggctgccagccatctctccagcactccaagttgtctccaactgcgtgaacgcccatgcgcctccgagcgcccgtgctagctatccgcgacaacggtccgttctgcctggcccgtcctagcggcacacgttcggtccctatagtcgcggaccggattggtcgctgtggatttccacagagataaattgcgagttaggcgttcctgtcttgtatcatgtgtgtcacagtgtgtggccaggagattgcacgggccatttccgcttatgttttttttttttgacaattcttgggtacaagtcgccgcagtcctcgtgtacatgtatgtatgcgcaaaaaacccaagattttacagcttcaatctacctgtcgctactgctacaccttctgcctatttgcacacgtcgcgctccgtgaagatttgcccccctcgccgaagaagtctcacagttaccgctatccattcgggtggccatggaacaaagtcgctccggatactaggtgcggaaacgttactgcgatcgacttgccgatcgagtccaattgcgaccacgtctaaccaagccgttgcttatgagggcgcagctgcaacaactggagatgacacagcatttgttgtcgttttttttgggtggtggtcgcataggcttgtggcctaagacaaagtagacaagcacgtcgggtcggatcaaaacaaacattactctacactattggagatgctccgttctttaaaaatatgaagccacacacaagggtggttcgcataaacaataggcactgcgctagcgcttggtctcccgaaccctgccgtgccttttggactccttgccactgcagctgatggcgttccaacttctaaccaacgggcatcatgtttgcagttggggtttgcatgtaaatttggaacttactaaatagtaggagcatataatgtatttctaacacagtgtcacggtttttgttatatagagtatacatatgtggttcggtcccttctcttatgcctctgccgatgccgttggggcactgcaacagcctacgggtactaggtgcacctgttctgcgttagcttcagaaaatattgggcgttttctatgtcgttgggcatcaaacacacctgatcattgatcgtaagctgtgtcgctcgccaatgatttttagggattcagtggagtgagaagcatatcctaacggccgatcgcttttagtat

SEQ ID NO: 2502 - DNA, 1109 bp, Zea mays
  misc_feature (1)..(100): optimal_loci_46021_G1, chr1:269638798..269639906, Cluster 14
cgttgcggtacacgtcgccttttttaattacatgcaccgttacttcttccgtccgtgcctccgtgacaaccgatgagtcggggtgggaaaaaaatagcactgcacggcacgtccagaagatttccacacgcgagaaagaagagggcctggatgatgtgcgcatatgcaagcatacatgcccgttgtctttgtctccatcggtcaaggctgcacagcactgcacacgtgagaagcaagaatgtgtgccaggtatgtcaaaaataaccctggcgtctgatcggtccgaagtttatgcgtacggcgagagaaaaatatatatatatcctgcgacacacacaaagactcccctgaaagtgttcctgcaaaaggtgtacggccttgaagattcaaatgcagtctagaaacacaatttttttcgggtataaaaaagagactaatgtacgtgtatctcattattaggtaaaacatgattctgagctagaccactggtcgtagtttatgttgctagttccctaaggtttaagcttaattaggtgcttattgcttcatgtccaagaacttttatctgccatcatgtatacggaacagagagttaggccagcggtcgaggcaggcattcagctcagctgcactgcacccccgaaacgatcttgtggcgcatgtaacctgcaacggaagcaggcaacaggcagaagctcccgggaaggaaacgagagcaatattgaaataaattaacttctgacggtatgcgctcgccggtcaccagaatgtctcctctatatatagttggcatggccccatcagatgatttttttttaaaaaaaaagtgatgtatggttaggttctctaccgtatctatggagaagcggacaggaaccaaatcgtcaccacactactacaatttggccatctcaaagtgcagagagatgcagctagccatcaacaagctagctagcactagatcttgtttcattctctaacgatttttttcagggaaaaaatatatatgaaaaggttctctatatggtttggttagttagtacttcctagggtcttaattacaagtttacaaggacacacgcacggatatcaaaatttaaactttgtat

SEQ ID NO: 2503 - DNA, 1355 bp, Zea mays
  misc_feature (1)..(100): optimal_loci_46721_G1, chr1:273369406..273370760, Cluster 14
cttccacattatcaggtgtgatgacgaagcatcagtttcgctgattattatacttgctttaaggatgtggccaatagattgtgaatatatgttatgcaaatattgttttgcaccgtattttttataaagtggagttttaaacggaagacgtgaataagtaagggcacctacaacgagagtttattacggccgggcgtctcttagctgccacgttagcaagaaacaaatgaagaaaacttacgtggaagtggaaggtaattactgaggagtgagcagattcgtcgtctcgtcagtcgccggcttcagctcgtgctctcgtacaacaccacggggcacagtcagcagccgtctgctggagatagacaagggtgttcaagcaggcaagcacgctgttcgtgcgtgcgtgtgctcgcacacaagtcccgagaaattcttctcgaagttgtgcaacatgcatgcatgcatgacacgagatactagctgatagcgtcaccaccgatccatcacatctcgaggttgcaggcaaagagccaagcaagttataaaaaaagatggaaatttccatctgcaaatcagcagaacccctcagtattatacagatacagcaagagacaaaccggtttaaggacgtgatgacatcgagaaaggatcttcacgtcacaggccgctactaccgttggacaggccatcttgctgatccctgaagcaaaaaaaatcaccaggggccccacatattctgcgtgaagtgaactccagctccgagtatcatcaggacgcggatcagtcacgttgccctaccatacatgccgatatgcgcgcatttatactcgtcctcgtagtgaaagatctctctaaaaatgcagtgcagtgctcccacggcgccatcttttggcgtggggtggcataaaaaaacaagtggttttattaagcgtttcctctggcacacatgagctagccgtcgccttccattccatggcttgtcaatgtcacgagcccaaccaaagcttgctgctggtgcctggtgctggcccagtgagtagtccgtcagagcatcaccgcccatgatcatccatcctgagctggggtccaagggatctagcgtattttaaccacttcaggggcacagctccatgcgtgccaggtccgtgagcggcggtcggtgggcacagcacagcacagcacacacacacgcacagtacagctcagcgtcagctgctgtttaggtatggcgcccgtcgtccctgtgttctcgttttgggagcattctgggaccgaacccgtgacagttttgagcgccgagacgtctctgttccttctgaccaggaacttgatagagaccatggtgcattttatta

SEQ ID NO: 2504 - DNA, 1241 bp, Zea mays
  misc_feature (1)..(100): optimal_loci_4745_G1, chr1:24305149..24306389, Cluster 14
gcattcataattgcccacgccacggaggtgacgcggtgccattccctgctctctggctctctgctcggccgggagcgctagctagctcatcggcgtcactttttttttctctctctatcggttgtgagacagtgttttggatgaaatttgaggctggccgggccactctctgcatgcgtcgacgagctagagtcgtctgtgagtgactgacaaaggaacgaagcgaatgggggacgacacaaggcactgttacgcatcagcgatcatcatctcatgccgtatgcatgggcatcaacgatcatgtccctcttatcgttagcaattagcaacgcacatatggtatcctaagagagcacgtaacatcaaaggagtacgcaaatgggatcctaattcatttgcaacattatcaatcgtacgatggcatcagaatccatgcattatttcctgcacaacttcacgatcccaacagacacacagacagaggtagtcttgtttttcaggtattttcgtttcaatcaatcagccaggtagggtggtatgatcaatgataatgtcgacgaaaccaaacgacctgaccatctcttactgtcaggatttattaaacccgatcgctcgacacatacatgctacgcacgcaacaaccaaacaagcagtgaccatgcacgcacgcaaggatcctttgcgctagctagcttgcattgatctgactatggatcaaacgcgatatcaaatctgatttatttacccctacctagctaagcttaattaagatagttaggtactagcaaaagctagctagctaggtagtaggtaggtacacaagctagtgactgaagcgcgactgaactgatacaccagccacatgtatattttaaaattatatgattgaatttgccccccccccccccccccccccacccccgggctacgtgggattcggtcagtcaatgtacatagtcagctgagccatccattacgaccttgacacagcaattgtattttgtgtggttatatgcaaacaaagggaataccgattgaacggtggtgcatggagccaccacactagcagccatgcatgacaggatatatatacacatacataattgagaattgagatgcatggatcagcaagttatgacttgacacgtcgctttctgacgagcagtgtgtgacgcaaacattcatttgacgacggaaaggagcgagccagcgtgcagtgcataaacatccacacatgcgca

SEQ ID NO: 2505 - DNA, 1177 bp, Zea mays
  misc_feature (1)..(100): optimal_loci_47941_G1, chr1:280210359..280211535, Cluster 14
gtggagacttggtggcgttctccccagtcctctatcttgcttggatggcaaaagtcaaacactttttattctgggaaagtaataataagaaatgagttcaatggctgggaattggcaactggcccaagcaacactttttatcgccacctctatcggtcctcgtcccactcccaagtgcagtacagatgtacaggacctgtacttgcttccttcctcttcctctgttctgttctccatgtgaagaagtatcgaggtcagccttttcttttatgctcagtgactgggagggagatgccggaatggtgtgatattcagaagctagtcactgtagaactaggtcgggtgaaaagggtaatgtaaaactatttgtattgtttgtagagtagagtttaaaatatggagtctagattggtgttgttgtaacgacaccatctacgctacctacgccttttaatagccgtgagatatgatttcaactgctttgctcctattccatttccctgtgttgtatagtatagttagacatcaacaaagaccaggaaagaaaaaaaagtatgcgtacacaccgctcctactgcgtcaaaggaccaggctttctatacgttatcaggcatgctatcctccattgttattagctggcgaatcttgcggatatgttcacaagattctgagtgcctgttgataatataaaagttataataaacgctagttgctgtcacaaagaacggcacgttggaaactaagctgctcccccgcgtccgccgagccaatcacgcaggcccgaccgaacgcagcgactagtagagtagtagtggtggcagtggcactaaaaaatggtttgagaagtgcgtccgtgtgcatctctctctcggacacctggatgcgtgcgtggagagagagggagagagaggatggattgggatcgaaggggacatgttggcatgttgttctagtagattcctttggtggcctctcgacgcagccatgggccgttttaggttcgccccccgttttaggtacggcagaggttagaatgcgacttgtcctttgcaacctccgtctcatctgctcttgacttctggaagctggaccctatctgaatcggggtgacaaatttccacacggcgtatggatccatgttactccagccttggggacagggcatggtgtcattttt

SEQ ID NO: 2506 - DNA, 1146 bp, Zea mays
  misc_feature (1)..(100): optimal_loci_47945_G1, chr1:280221787..280222932, Cluster 14
tacacgccatgggtttctttgttgaggcggaaccgcttgtcctagcctggtctgttgcatgtttgctcggtctttcacgtcgagacggatacgcgtagatctccgataagttgcaagtcgttgtctcgtgcatgccaatgccctcttgcagcatttggagtcaacaatggttaacaaccctatctctgtccgaccatgcttatccggcgcgtttaataatagtaaatataaatataatctggcgcggtcaggaatcagaagcacgcacgttgacggggggacggctggctttgcacaattttctggcgttcgaccgcatcaacggggcacatgagcgaacggacgagagagagaaaaaaatagaaaggaaaaggggggcaagagccgagagggactattccgattcggatcgccgaatcagggtcgcttggttcgcaaggcgctttcagagtgcgaatattcttgcggttgcttgcagcatgccagcatctgcatctgctgcccgcgcgcgtccatccttttatttccgtggcaagacgggtgtgttctgtgctgtgcctgtaagtagttaattcagcgcgtgggttagctgccattggtcagtcagctgttttctgacagcaaaacgcatggccggcggcggcggaacgggtgtgttctagtcttttgttgttgctggctgcagagagagaaagagacagctaacgatcgaccaatcttggcgtcaagcagtcgcgagctggcgaattcgaattggctgacatttttctgctggtgctgactcgatacagataacaggccacaacaaaatctctaaaaaaaaacggccaagaacacagggaactgggtctttcataaaggaggtttctctctctctcacacactctgttcctgggtgtataggccagatcgcgagaatccgaaggatcatctctgagcggtaatcaatcatcgatgaaaacagtcgtttcggcaagtgtgacgtgcgtacggtttctcctgttccgttttcaccgccattggaagttgatttgcaagttaaaaagggagtaagagcaactccaacaaatagtgttaaacaatcccaataacgtttacgggcaaaaaaaaaactcgttttgccccctccaacggaccccttcttct

SEQ ID NO: 2507 - DNA, 1338 bp, Zea mays
  misc_feature (1)..(100): optimal_loci_50479_G1, chr1:293325337..293326674, Cluster 14
atcgagtaatacatacacgatcgaaagacccacggccacagccatgaagaaatgtcagtattgtttgcacatgcgatgttgcgcccgcgcgactgcagcagaggaaagaaggaagaaagctaggtcattccatgtattcattccgatttcctactacgaatctacgggaaagcgatcgatgtactaacaagcatgcaatcaatccaatgagatctgactgggcactactgacgtgcatgtaataacttgctgaaaaggtaaaaaaaacagaagaagttgatcttgttttacttaaaaactgtcgccagcttaaacatgagttattagtttattacttgggttgtgatttgaatcaaatccatacaaataattaagtcaaaaagatggggtcagagatcagatttaggcctttattccctctccgccgagagggacgagcgagactgcatcggactgcgcgaaagcagacgaaaacttgattccctgtcccatgcgccgacttagcttgtgggccatctccaccccgcactcgttcacgtacgccggcgccggcgccgccgttcctcgcggcggactcgaatcggggcgtcacgacgggtgcttgcggctcctatctcggcgccgaacgtctctcgcttcgccccatgcatgtccccacaggtgcgagagcgaggagttcttttttttccggcggcgccaagtgaataccgagctcgccggtgccggccaataatgctaggtttctgtggaccgcgggcgcgggctcggatagcctagccggcggcggtggcggcacacgggaactgaatgctatgctgctgccttcgggtcactctctccctccctcctgtgtaagcctccctcgatttcttctgtcatgtcgttcacgcgcgcgaggtcagttgatcgctgggctctccggtgttgtatgttgaccatggtttggttttgagtaaaatatatttcatgtccttaaatttgtcatgtggtgccatttggacccataaactgtcatatgaactcccatcgttagatgagagagaatagagaaaagagataaacgagatatatagactagctagcatgtggagttcatatgccatgttatagaacgcattttgaaaccacaatacgtttggacctaataaagactcgaacaatgaataaggatctaagggccatactttaaaagattatgggccgagatgaccctgcacgacaagtttaagaaccgaaaaagtattttgtgttagctgcatcaacaagattggatctgtattgtatcccgtgatgtacatgtaggcttcggatgtccagtttgtttgttccagtttatgc

SEQ ID NO: 2508 - DNA, 1298 bp, Zea mays
  misc_feature (1)..(100): optimal_loci_5179_G1, chr1:26572680..26573977, Cluster 14
atgcgtttgtgcgtcaaacacatgggcccatagcagcaggatgcgcgcagggcttgtactgactgactgagtgactgctactgatgagcggggagcagccgcgcggtggccgtcgtcgcgcactgggtgtcgccacccggccggctcaagctttcgcggcataaatggcagctatggcacccagcgatcacagagcagattctttcgctaataacgccgggcgcccaggcccttgcttgcgttgcgcatcagatcacgcgcggatgcgcgcgcagaccctctccccccgctagctagctctgcccatcagtcaagctgcatatgctgtgtgctgaccgcgcctgcctgcgcatgcatgcattaccgtatggcccggccctccgtggctggctccctccctctatgatgtgctagtagcgagcgagtcctgtcctgtacactcaattaatcaacctgccgggcctggttcagttcaaagtagcgatcgatctgggcgggcgagcgagagagctcgacgacgacggactgctgggcacctcgctgcgccgcgggccggccggccagaccctgccggccgcatgcatgtgagagccccgcccgcatccccgagtgatcatcagtccacccatccatccatccatccatccatcggctatgatatgattgacgggacgaggagagcgcgcgcgcggcggcccccattttgtgctggcatgatacgagatttatagctgcgagcagcatggttaagttcatgcaacacgatccgcgcccatgcatgcgcgccccggcttccatatcaaatcgatcgatccgtccgtcgtcgtccatcatgcatcctatgcatggcaacagaaaaaaaaacgctgcaaggatgcatggatatatgcctaccggccggccgccgccggcgaacgacgacagcctactttccttatcatatgtcacatataggttcaaggaatgaaccccgcttccgccgtatcaaatagatatgcatgctgcatgtcggcagaaataagttggtgatatatacccttgtgttatatgcagtcactgtcttggaacaataacggctgacggcctcacagccgctgctagctgcctggaatcatggaaacagtacaaggtttgtcccgtgactgtatatatatatataaacaatgcatccgtgcattaattaatggtaatgaccatgaatgtctgtgaagatctggcattaatttaattaattagggaaaacttcagaaaattgcaaccctgcatttttatttttactaatttatttgtttgtgttc

SEQ ID NO: 2509 - DNA, 1217 bp, Zea mays
  misc_feature (1)..(100): optimal_loci_52798_G1, chr2:5510093..5511309, Cluster 14
catttcacttgcatccgtaagacgtgacctatatgaacagatgtaatataagtcatttcacttgcatctgcagaaacgtctaaaactggcgtatccacacagccaggctcgcgagagcctacgcgcttgtgtgcaggtatccaatcagattgtatatgtgtaaaacttgatcattgtatacatgtgagatgcatcttaatttgttcttaaatctgtgtgacaatcgtggtgttggctcacaggtttccgaagattttgtggcattcgagaacacgctacaagcctgtcccgtccgtcaccccagcgccgtgattttgccggccgcgatcgcgggctagcggcacggtgggctggccctgaatcgcaaatgaccctatccgaaatggccggcgggcagatcaacggcccacgcgcgaggctggacatatccgccgcgccgccatcactacgtctcaccggcccacctgatgcgtcattgtttacgtcgcggccggccagctggccagcggtgctatgcacaagtgggtcaaaccacgtggacgcatcacatacatcatactaaactggcgtcgaccggcgagccaaatttcctgatctttgcatcagcacccaagacgtacagctcgcttgatggcctcggtcgtacctcgtacgtacagcggatcacatgcagattcacagtagatatccctttggcatcgatcgccgtcgccaaaagcgcatgcttgcacggccggcaattcctcctgctgatccaagtccaggaaatggggatgctagcttacacagatcgatcccaccagcaggccggccaagtcgaaacgtgcaggagtcctcagtgatgtgtgcatggtagatgcccgcgctgaatgcattcatatgcatggaactgtcgcaacacaggcaaatacaaaacttggaagagcagacaggtactactgggcagtggactggaatactggatcgatcggttgccgcaggcgaaaagccccggccgcgcaccggcctgtggcactgcgctcctgccatgctgtggcacgcatgattcagaccgggccggaaactcctactgtactcgtagatccaccacgtacggtcgctagcttgcccaaactactagcatctcggaactctggatccaacactcggggacaccaacttaacctgtcgatcgatctgttggggagctgtcgaccgatcaatttagttcttcgata

SEQ ID NO: 2510 - DNA, 1302 bp, Zea mays
  misc_feature (1)..(100): optimal_loci_53026_G1, chr2:6566356..6567657, Cluster 14
gatcgatagtggatgggtagcaatagcatacatagcaagggagtgagggacgggccagcgcggccacaggactagctacatagcttggggcatgggcatggggcgctgccatgcccctgagctctgggtcgactgactctttgggatcatgctgcgccttgctcctgctgcgcatagggagtggcagggctggcagtggagtgactgagcgttgtgttgcatgcaaagggcttgtccttggacgcctgtcgactggcgcgaaaagactggagaatctccctgcacgcgccatgtcgtagtagctagagcatgtagtagttccgtgcaagcctcaatttcagtgctaggtgcgtaacatgcatagagctggagctgctggctagtgtggctacaatcatgcatcgatcgaggcgagctggatcatcgcttgccattttacagaactactagctactttacccaagttattaagcgctgcgactgcgattatatatatgggcggccatctgaactttgaaggtgacaggagcaggagtaggagcagtgctgatgtgcctaggcggacggacccaacactgcagagcagcggcagtcacaattcacgaaccaaacacacggtgtcagcctgacgagcctcatcatcagttcatcacaggacgcacgtgaaaacgttcgacgacaagagcccctgctgcctgcgactgcgagagcacccatgtgctcgtaaatggacgtgtgcagtgcatgtccagtagtgcggcgagcgatgccgacgtccatccgtgtggcgccctgtgtgctgcattgcatgccatgccacgcggcacgggcaacgggcagcattaccatcgtttcatatctggagaatctctgcacctggctgctgataacgccccatgcatgcaccatggcggaaaacgtacgtgagcgtcgcggccggcggcgacggtagatttgagagatctcgctagctttaccgtgcagcgtgtcccccaccccaccccgccatgcatgcatgcacttgcacgcacgcgctgacgacgtcctcgcagtcgcagtcgcaagcagggcacacgggcgggcgcaccgcgtacggcgacaaccgtaccgagcaggagcagccggggcacgggcagcggcagcggcagcggcggcgtctgagccgagcgcctctgcaatctggacagcgcgccgcacgtgtcgatgtcgtcgtcccggccggccccaggcccctcaagcccagcatggctccatccacgagacgagacgaacagggctaaactgcctgtccatcaatgccct

SEQ ID NO: 2511 - DNA, 1284 bp, Zea mays
  misc_feature (1)..(100): optimal_loci_53955_G1, chr2:11563576..11564859, Cluster 14
tacgagaaagagagaaagcaaccaagagattatcactaccacgcacgcaagtacgcaacgcaaagcatggtgcagtcacgcgcgaggacgagcccacagaatttctcccaccgcaccaggccaccaacggcattggcccgtgtcccgtataacccacggcgccgccgaatactttctgccaccggccaccgccgccagcccgccatgcacacgcgaagccaagaaacgacaggatccatccttgcgcgtgttttttttttctccaaaatgccatcagttatccgttcctcacacagccacacgtacgtacaggaggagatggtcaacaagaccacgtagtatttttagtgtcatcacggtgggtgaatctaccgtgctggagtctgttacatttggttgcttgcttgacgtttggcacgtgccgccacagccacgtacgctacgcacatcaacagcggaaaagttcactggcgtctctctccgtcagtacacgtcggtatcatcagtaggcaaatacagtcatacaggcaacggaaaaataagaccggcgaaaacggcgtgtgccgcagccatagggataagtataaaaagtatatattttttttccctcgcgagcagtcgttaccgagtcaccgtcaccactccaaactctccaagcgcgcggtgcacttttttttacatggcctggctggcgctggtgtcgccggtcggtcagaggcgtagcagggcagcccgagacgccatgcctgaccgccggcggtacatgtacgattcgccgtgtcagtgtcacgtacgtacgtacgtgctgcttcatttgtaccgtgccacatggaacaggaaccacacatacacacacccacgctaaccgtctggcgtagtattggtacagccttgaacgtacgatcggccgacggtccccgggtacggtcgccgttattactcgcacaaggacatcacagctgtggaggacgtcgtcactgcattggttcgttcgttcgttcggagaagatagtcaccataggcatgcacgtgcccatactttactcgtcacatctgataaagtccaaaaaacgctcgcaaaaaaaatgttttttttattagaaagtctctccacggcaagagtgagcacgctgctgattgttcaaggattttggttgctggagcgccaatataaaaatggcggctgcttccactcgcgcgcttgatttgcacatagaattattaggttcgaaacatagaatagtaaggcagttgaatataaataaaatatggtcatatatatgg

SEQ ID NO: 2512 - DNA, 1310 bp, Zea mays
  misc_feature (1)..(100): optimal_loci_53964_G1, chr2:11592414..11593723, Cluster 14
accactggggaaaaaatgtcgatatctcaaggcaggtttggagatttgtgtattagcctctgaaaggtttgtttttttagttaggatggtgtttctttactgttctctcagacagtcagacataggagctgtgattgttgttcggtacttcggcttcggcttgtcgtcgaaatgcaggtgtgtgtgtgcgcgcttgttttaaaacggactgttagaagctcaacagtcagactcaggaccatgaaccagcagctttttacccacagtccctgaagaaaagacgtttcagcggggagtggaaagagaagccactagacactagtactactttgagatcagagtggataagaccagacgtttgactgcacaacacaattgacgaaagctcacttgtctaatattgtgctaattgcatagctatagtatagccaacatagtattttgtatttaggctatttaatccaaaatacggtagttgccctagctagtactacttgcgagttgcgactgcgaatttgatgcgcaaaagtcaaagagatggcagagaagcagcgtcaggtatcttgaccgtggtcaagacgtcggcaacgcggcgagcacggagcacctagtgaaccttttggaccggcgtgcagggcacggtgccagaggcggtgcgccccgcccccaagttcgtcgtccgtctccgttcgcgccagtcgccactcggcagagcagcggacaatacagcgagaaccgcgccggtcttccgcaccgcagtcggcagctccgtgttcccacgccgagaccacgtgcctccgcgcttccttccagcaagcggcagggcggtccgtgcgtcgacacgcggcgcctgcgccggcaagccaaaagaaaaaataaagctgggcggtgtgcacccatctgcacgccacgtgatctctcgctctctcggtctcgtgccagacttccatctccatcttgacgcgacaagcctcccgcggtcctcctcccgccccgctcgccgttccgccgctcccaacaccggactcctgtcctgccgatcttttttcgctggttccgagtggaccagggtccagggccatggccgtgcaggtgctcagtacggccgtcagactgacgcgttcactcgtttattcaaccagcgccacttcaaattcagagcatcgcaatatcggagtttttcttcggattcacgccaccacgtatgatcgaaccttttttttaaggaaactggtctaggcttttagctcagggtaagaaacatttgtttctcttttttgagaaacatttattagattcggccagtgacc

SEQ ID NO: 2513 - DNA, 1387 bp, Zea mays
  misc_feature (1)..(100): optimal_loci_53972_G1, chr2:11624799..11626185, Cluster 14
tacttggacgcttttttctgtatgttatacaccgtaacaacaatgctcttgaatgcgcgctttggtgttatctgtaagttttggctatgcttttctcacctctccgcttttgcactcaaaagctctcctgttgcggctttccagactagttttaacctttggcccaggctccgattctttcacccgctgggcacggtagaagcgagaaattaacgacggaacggccgccgaaagggaagggaacatgacttcgttcgatgccaaagcatggacggatcaaatcagaacaaaagcgatcgagcatggcatcgggcaaacgaaggatcaaaatcggaagggaggcatcgctagattactctacttcattcgttttttttggtgagaggacattgcgtgcttctacgagtcggacgatcgatctatctactccctgaaagttcatctactgccgtcggctctaaaatatatagctgtacacttacctctcgatcgcgactcgtttttttattaataaaaaaagacaatcaaatttacgcaaaactggtaaaattgctgcacacttaactctcgatcgttgagttgttaatcactaaccgtggtcgatgatttttttttaaaaaaactctatcagctttgatctggtagacaaccccaaattaatgaatatagctagagacggattcatgaagttggtggagcagatcgtattgaagctaaaaatatttgagtaaaaaagttagatctaaatctaatattaataaacatatagctagggaaaactgccataaatagacgtttgagtgaccactgtaccaaaacagctaccattgttgttctttcacttatggctgtggattccgcgtgaggacttaagaacccatccaccctcgcaaaaaagaaagtcaagcggttccggaagaagaagaagaaaaaaaaaaggcaagacagcgaacaggtcgccaccccgtagcttcagtttcaagctattagcgagttcaatcgaaggagctagctgcacgctttcgagcgtgtaaaaagttgaaagacttgcgtaattccgatctgcaggacgtgcctggtgagacccacatcatccccagcgccagctccgatttgccgagctggaaaagaccccgtcgtcgtccgagtacggaccaccgaccacccatcgaatcctcgctggatccaacgatcatctggatgcaaaggcatatatggccatctttctttcgaatcgaaattcgaaactgtacctaatatgctgcgtatgctgatatgcatgtgttgagagacttgggaggtcaagccatgcatgtagagagtagagacaaggtatatgttcttgcatgtgtcgccttgctttccatgcgatgcgagcaggcgaagg

SEQ ID NO: 2514 - DNA, 1214 bp, Zea mays
  misc_feature (1)..(100): optimal_loci_54002_G1, chr2:11758209..11759422, Cluster 14
ctactcaagaaagggtggagtagtaacccctccgtggtgggccacgaagtcaccatatatgagtcgggatccttgaacatgtttttgcagcagagcggaaggcatgagtatgaccttcctcagacgcaggcatcggtgttttagagttgatgaacaactattttcctctttacccactacatgtttttaggagcatattcgttagaattgaaacaaaaagatatgtcaaagataaacaatggttcctttcgagacgatggaacgaagccaccagacagcacgagtgcgagggctcggtttaggcatcgggttcccgttgactttgtgacgcggcctccacttgttcctgccactctgccagcgcccagcggcatccgtgttcctgtcgtcttcggtcccctgtacgtgtgctgcggactgcggtgttgcacgtacatgttcgcgctgggcgcgcaccgcgtgtgcattctcccagtttactcgcgtacgacgagtcgacgacagacagggacgggtcgttcgtcgcgcgctcctacttttctgcgtggttgacacacacgcgcgcgcacacggcacacccgtgaatgaccagccccgtatggccgtatcaatgcgttctgtctaggaagaagatttgttggactgtatgcagttgatatcggccacaaaagaaaagcatggtactacgtgttcccttaccttttcgtaagaagacattttatgtgtaccacaaatttactacaatttaatttacttattttataccatatatattagtttttaaaatgcatcagaatttaatgtgtttgaccttttcaaccgtgcgtatttaaatacggaatgtttttttagacgggaggctggagtatgccatgtaaaccatacgaccccaatgttcggttgacctgctatcggggggcggtggactttggcggtttttttagagaccacagattaatcactctattttagtattatttagtttttaaattaccaaaaattggaattaaaatagtcactaaactgttttagtctctagtcctatttagtttttaaaatttatcaaaatttaatatgattgaccttttcaagcgtgcgtatttaaatacggaatatttttttagacgggaggctggagtatgccatgtaaacagtaaaccatacgacccaaatgttcggctgacctgctattatgggcggtggactttggttcc

SEQ ID NO: 2515 - DNA, 1082 bp, Zea mays
  misc_feature (1)..(100): optimal_loci_54326_G1, chr2:13619162..13620243, Cluster 14
ggttgctgcggcagagttagcacagcggaccacaggcctctgttttacgttacattatatgcaagaacgccgttggtggaggaaacaggaaagcgcgccgcaggagcaggggtgagggcggccatggcccatggctggccgtcgtcccctcctttttctcctccgctttccgcctttgtttccaaggactagctagggagcgtgaagcatactgcatactagcaaagcaagtcaaaacaaaaggccgtgggctcgctctcgccgacagctgactctctctctctctctcttggtgtccactacaccaaacaagagccagccccgcattattttttcccctgtttttgtgtgcgcattccgaggctatataatgtatcagacttggatacttgctcggagttgttatgctcttcggccaagaccagcgaggagcaggagcgtggtgatctagcagggtacggtggaccagtttaaaatctaagtgggagcctaacaattgagtggaggtctaaatagagacatattaaccaataaccttttataactacattaaataagataggaggtccactaaaactaaaaaaaatgagtgggagcctaaaaatagagacatatatatactcctactgactagtgtcattttatatctacattacataagatagtcgatccactaaaactataaaaaatgagtggaggactaaatagagacatactcactgtagttcgatcggaccgtggtgcataagataataagatctaatgcagactaatgtaagctactaaatcaccaccgtcggcatgcaatgccatgcacgaaacgtgaccacgagtccagaaaggaacctgcgcgttaacgccactgggctctccctctcctgctggccaggtccagccacgcacgacactgcacttttcaagaagccaaagcagacaccccagctccccggccggccggttcgcctgcattgcgttgcgccggcagacctcgtcggcggtggctctgtgggggtatttttcctgaccacctagatgaggcccggctgcctctgcgccgccgcctcagcgtcgatgatgcagag

SEQ ID NO: 2516 - DNA, 1098 bp, Zea mays
  misc_feature (1)..(100): optimal_loci_54664_G1, chr2:15474658..15475755, Cluster 14
gaactcgccctgggttgcgggggcatctcctcgcgcatctcgatccgtgtcaggccgccgtttcggctataaataggacgcacagttccgaatacatgcttaggaattaattaatcatgatctgatgagcgtacacgctcggatcaaagttgtcgcggtcccgtggccaagctttgcaatgcatcggccacgcacttggcaaaaggcacaccaaccaacaaacttggtccctttctcgcggtgcatgaacttggcagcgtcgtcggtccggtgctgtgacgcaccggggcgggggcgggcgcgcgggagcgggaggagcaagccgcgggcgaggcgatggcgaccgcggagcgaatggagggcgagggcacacgtgacgtgagtcggtgagtggggcaaggcggggcgcgcgccgggccacacccgccacgcccggccggccggccgctgctgctgtcctgtcctgtggctgggccggccccggcgttggtgataactggatgcgagcgcgttgcgttgttggtgcgctgcacgaatcggaggggcacaccctctgatttgtttgtttggatgcctggctgccacatgcatgcgcacatagtggcgagttgcgcggccgtctgacggggggttgtggcgtcatggcgctgcactagtggtgtggtgccctgcgacactgtccatgtgagcgtatctcgatacacgatctgtcggtgtcctttgcacgaagggtgtgacgactagcctgttatagttcatggttttctagtatttacgaaggtacggacagccgcgctgtgctgtaaaaatgcccccatatagtataatgtacaaacagtaatgcccccataaagtttgagccaattgtttttatttataataatgtacaaacagtaatgcccccatatagtatataataagtaatatatagatagattttcgaatctgtttttataattcatttatttaacaatatgaagattactaatatttgtccggtacgtacgattactatatccttagctattttgaataattcagaacgctcacgtgtttttcacctcttttatttggacgccgatcgagcccgttgtttta

SEQ ID NO: 2517 - DNA, 1024 bp, Zea mays
  misc_feature (1)..(100): optimal_loci_55495_G1, chr2:20006456..20007479, Cluster 14
cgtggtcttgctccgctcctggccgcccttttgggttttggcgacggcatgtgaccgacgcctcatctcatctcatcgccttggtggcaacaggtgattccagagttgcgactatttcttttacaaaaaggaaaaaaaaaaggattagcttgtacagtagagcaacatggaggaggcagtgagcccatgttgcgggctgtccgccgttaccgtactttttacgttgcaagtgcaaatgatacttggttcagcacgcaattaatttgtgcaggcaagccaggcaacttgcgactccgacagctgcctgaacgccgatttttttttcttttttaaaaagcacgtcctcggaaaccaccgaccttttaagtgcacacgtactcccaccgattcgtgtgggcaatcccaatcccaatcccatggggatcctggatccatgaagcaaagcagcaatcacgcggtcgcccgccggttaaacacagctcttaattcccccacgctgtcctcgcctcgggcagcgacggctccctctgctcggacggcccgaaaccaaaagggtcacgcaatgaacaaagaaacccgctttctctttactatgtgatgaagtaaaccctggaccaagtatagcaattccttgctaggctactggtaacagctgtttaggctcactgttgtactgctactaccagcagttaagcagagaccaaaacccgcggtctaatcctaatccagaccaggctctgtcaggtcgcttgcacgagagacgacaacccggcagcgcccactgctcacgcaccgccgcggcggcaactgctgccagcccccatggagctagctaccgcccacgttggcgtttgcacagctgatcacatgtagtagtgccacgatcgagtacgagcagcctcgcccaagctcactcacatttctgtgcgcatgcgaacgtgccgccatggagcgcgtcgtcttgcgccggggcccgggtggggtggtgggtggtggcagcagcaggggagggggcgcgtgcggc

SEQ ID NO: 2518 - DNA, 1029 bp, Zea mays
  misc_feature (1)..(100): optimal_loci_55574_G1, chr2:20413695..20414723, Cluster 14
ttaagcttcactactggctattgttcactctacctataagtttgtctcgaacatttgacttgaccatgcatgtcactaaaatctaaacagcatatcgtaccgtatcttgtcgactacgtggtgaaacatatttttgaatgaatatgcgcacttgttgtccacggaacgaggaaactttagtgcgtagtactgctgacttgttgactaagaagtgtttggttttaacatgccgtaagtgtactgtctcacgtgttttaagtcacgctgcagaggtgattactgaggcaaggatgctagactaacgagcatgacgcttgaacacggtcaaggctcaagggtctgcaacagtgtgtgattacattacctaccagctgacgacacccaacgcccacgcacgcaccaaagatggagatgcccagaaaacgggtgcggttcgtttcttcgtcagcggccggcagaaaaaacggcgcaccgggtgccctctcggataatcgtccgccggcgctgccccggcgacgagtacgtgaggactgaggaccttctcgcgtgctgggacaagcagctttgaggtctccccgacattgaggttactgcaatcgttagcaaattaagcacgtataccaatggacacagtaccagcgaagagaaggcatacagctagatccgtagccatgagctaaatcttaaatccatacctgtgtattcataaccttctacataacaaatgatatccacaacgctcgtcacccgtgaaattacccacaaaccttatatgaatttaaacatgcatataatatgtttttttcaaaaaaaaactttctcccgtgtaagtataaatcactagaactcaacatcacgcatggcattattcacatcataaaataacaaatgtgatgcgatagaggataaatgagagcataaaaccttatgattcatagggctgtttttttcttatacatagcggaataatggtactatttggtaaagcagccatgagtatggttttttatacccgtgaatttttattta

SEQ ID NO: 2519 - DNA, 1117 bp, Zea mays
  misc_feature (1)..(100): optimal_loci_55788_G1, chr2:21511940..21513056, Cluster 14
ctgcaaacagggagccaccgttagttcacatgctcctgtcctttcacggactaggatgcaccaagtaattcatgaagagaacgttgaagcgccaggaacacaagctgctagtgctatgtattgtatcatgagccattcgaatgcctccaaatcgcctttccaggttcctccaccgctcgtttattcaccgctcgacctgctgcctagctaaggtcagactatgatgacgcgccccatctctctctcctatgatggtgatttggccctgcccttttctcccgaagggagctctgatgagcgaagagaccgatcgagcacgagcatgcatgctcaggaggcatcgcgcgccgttggcaagagagtaagagaccaaggttaaatccaaacaatctatatagctaaccgcacagcctcgatctccttgtccttggaacgggaacgcgaccaccgtaccagcccgttgtgccgccgtgcgtgcgtgcgtgcaggcggtggcctttcgtgctactgctatactataccgttggtagatgtgggcgccgcgcgcgcgcggtcgtcgcaggctttcggcgccgccgccaccggtcgctgccgcggcaggaaccgcatcattcggccgggggacacaagtagacgcaattaaagcgggcaaccaaccaaccccgccgcatcggcaccgcacgcacggcacggcgtttgccgcctcccccacggccacgggccacggcacgcgcggccctcacgctcgcgccctctcttccggccggccggcccccatcggcaccgcgcgcagctcttttattcgtggccgcgcgccggggacgtcgagtccaatccagtcctctgctcctccagtccaacccgaatcgtttggcgttttgtcggctgtctctgtccatccatcggtgctagctgtagcctgtagctagtcgggtaggcctacgtttattccatttgtgacacgatcgcaggaaggtctcgccgtagcctcgtagctaggtgacagatccccttcgcctcactgctgccggcgtcgtgtatatccgccccgccccggacaagttgcccgagcccctacctgcggcactttgcgaaagagagaaaggagggtacctac

SEQ ID NO: 2520 - DNA, 1104 bp, Zea mays
  misc_feature (1)..(100): optimal_loci_56043_G1, chr2:22891258..22892361, Cluster 14
gtccaaatacttgaacccacttgataatctcgcctgtagttattaacatttgacaattttgcctatgctgtttttaatttcttggtcctacactagtactacgttttatatattttcttatagaaatgtctgggtccgatatatatttttaaaagtagttcagtattatcagtggtgtccttcagttggcaagcttgcatacaacgtgcttcctactaccatcgtcgagtttgagagatagagatgtagtttatatgtggcctgtttggctaatgggtgcagatcatccgtttacgatttgttagggctatacgtacgtgtattgtgcttaattggcaaatggctgctacgtacaatttgctgacaatttgaacgtacgaaacacttgcttggcgtagaagcttgcagccattcaattgatttgagccatatgcggtcgtcgtgtcgtgggatggagctacaattctgcgagtgttcattgtttatcggaagttttgtgagctatagctagagagttcttcgtcgtcatcagcttacgtgatcgatcgatcaagccgcgagtggatcagtctagctggagagccaaataccaagtgtatttcttgctacgtggagagcttcccggctgcaagctcaacgaaccgtacgtggccgtctctgcgaatactatccccagccaaccgcgccgcccatggcgacgcgtggacgtctgcaaccttggtcaagtctctgcaggttatgagttgcacgatgaggcagaaaggcaacaaggtcgtggacatgtcataaagttcacggataggcactggacaatagaaaattcagataaattaaaccttgatccagcgtgggcaaccgtaaaacgaaaagttgcgaagccaagcaaacgagggtaatccgtttctggcgtgccgtcatttcctccatgcatgtgtggttgagctgccgtatggactatcaagtatggaccggcaaaggagccgtgtagactgtagtgtatagacagtatagtacagacctcctcacgttcaaacctgccggtcttgtcaagttcttgataactcccgcgccatggaatggaaccgtaccttggtacggctaagt

SEQ ID NO: 2521 - DNA, 1299 bp, Zea mays
  misc_feature (1)..(100): optimal_loci_56745_G1, chr2:26981857..26983155, Cluster 14
atatcatatttggcgcagcaaataaaatttaaatttagtttaatacataaaaaataatattatttgtaatatcaaatatacaccattaattaaatcatatcatgtaattttataataaaactatttaaatatgtacatgttgatatttaaaaaaagaaacgctagacatattttaagatggagagtaacactttgttacagctgaggaaggaagcgccgtcaagtacatgcatgcatgtaacaatgatgtaaacataggaggcacgggcgataagtacatgaagagaaaaacaaaagcaagtgtcggcagcagccaccacgcaagtgacggcactgtccgtctccgtcgtcgctgaacacgagccaagccaaggcaaactctccgttcgcttcccccaacgccgcacgggattcccgcaacgtgcgcgtcgccgtcgtcgcgccgtcgccgcaacagggtttacatgcgtgcatgcacccaacccaacccaagcacatctccccgacgggcgacagcaacttggtccgccatggtcggaagaaggtgcatctccactctcccgcgcaccgcaccaacaaggctggcagaaccggccgcggaaagcacagtgcgcgcaggataggaccgcagcagcagccagcaggcgtcccaattccaacgtgggtggattattggaagggaaccgggcgtggcgtcgcagcgtgtctccgtctctccgcacgcgcgttttcgttcctgcacggttggcagacgatggcctgagcggctggctcaccaaggccggaaagtgaaagggaaggcacttgcacttctccagtcctgagaatttctgtcgacgagcacccgcccgggcgccgaaacagcgacggctgctggtggtactagtgcaggccgcaggctagctaggacggcgatgcgaccggcggcgctgacacagtgacgcgacgcgctgccgggtgccgtgcggccgagctgctacccggccggccgggcgttttccatgtgctcgcactcgcatcgaagctcgcccgctgccagagacagccacaggccaaatctgcccagcaggtcgtcaggatcggggccgtatattttttctgccgacgaacacggggggcggtcaggaatccgaatctagacggatcatgccccgggccgtgcgatctggcttcgaccgtttgagtgacgcgacttggctgccgtgattgctgctccacattagacaagtggagatgaaggcgccggcgccccgcatgctctgttcctgttgggatgttaggctgggccatccggtaccg

SEQ ID NO: 2522 - DNA, 1372 bp, Zea mays
  misc_feature (1)..(100): optimal_loci_56841_G1, chr2:27560156..27561527, Cluster 14
aaaattagctttgcgtggccaaatactcttggcctgttagagctagcttcggacacacttaagtaggatattaaatgaggttgtataccccggtctttgaacggacaagaagcgatcaacttcgatgtgtacagtgtgcctgctgccatacgcctcatgtccccatcgtattgttctcttctgtagttttccaggatgtgtgcagtgcagacgaaaacaaaatgctggatgcgctgccgctggaaatcagtggcagtggtatatatggtggtgcttgcatggaattggaacctgtgtgaggcagtcagtcgtgtccgtgtccgatccgcagctgggcatcagcgcatcacaactcgaaggctgagatcgcagtgtttactgacgcactgtgtggctggctctgctattattgtctgcagcgtctcgggaactcttttttttttttggctgacactgttctcacgagcaaacagcagcaaaatcttgtcgcctatcctgtgtacaagcccgaggtagctagatcagcaatgcacggatcaatagtcagcaacatcccggcacagtgagacttgagagtgccgcccggccaccgtccgtccgtgcccgtgcccctgcttcgtccgtgcaagcactggcatggcacgcgcggcgagccggcgaagcgacggcagagagagagaaagcgtctacagctatggtgactcctctggcgtcgaatcaggcgcccagtttaggcagacacatctgcccctgcggctgcggtgtagatccgccatgatcagagcaaatctacccgtaaggcgcaggatcctcgcggctggacgtgccgtgcacgcatgccggggatctccacgaacgagtcgcgcgcgtagtcagtcacatgcaaatgcaaggaccaaaccaaggaggatacgcgggcagttgcatgcacagtagatgtggacatcacacatgcccaacggagcgtccagaaacacaactgttctagccgctcacatgaccacagccgcatgcccgcataaacactactaccacacgggccggccggtcgtccactccagcaacagcagttcatctactacctggtgtcccggtcaacagagcacccagcacggccacagcccacagcatatatacagctagcctagtatcgatccaccacactcgtgtcagtacttgcgtcgtctggttttcactactactactactacgcgacaggcactacgaaagcaggaagacaaaggagtatggctggtagctagatttgaggccggccggaccagacgacggccgcgtccgatccgcttgcgatttcagtcgtcgtcgtcgcaggctgtcatctcgcttgctcgatcgcccgctggacaagcgc

SEQ ID NO: 2523 - DNA, 1081 bp, Zea mays
  misc_feature (1)..(100): optimal_loci_5828_G1, chr1:29678894..29679974, Cluster 14
agctaaggctaagctttcagttcatcttcttgcaacacctgtgtgagtcctccctttttctgaatttctttacggtgtaaaacacacgccgccggggtgcgaacaaacctacctagcagactagctagcagattgttttattgtccacaggttcttggtgtctcgcgggaggtaagcacgcaaatgattgataatagcaacctgggatcacgtcgagatcttttgtttgctttctgtcccgttgaattggcctcttacgttcgtggggctgggataaattaaaccacacggaggaagttccatgggcgcaacaactcaatgataagaaaataaaccggccaatcatttggtcatgcatgcaatgcaaagcgccggtaactaacatacacatataattgtgccgcccatatggcccccctctcgagagggacttagggatatgtatacccggccctcttgtgtttgtttgggctggatttgttaggccagaaccaataatatagccagtaaaagaattcgtctcgcaaattaaagcagcgaccgacgacgcatgcatgagccgggaacaagatctcgcaatatattattggggcattatccggtgaaccgatccataagtcaaatggggccggggtgttcatcgcaatgagcagggctctctctagctgctagtcgcccttttaattagaaaggctatgcgtttgactcgagctagcctagcttagctatgacgaggtggatggacatcattaggcgtagctaagctagagggacaggacaggcttctcgttcgtccagtggttaattggcatcagcctgctgggtttattgtatagaaaatcagaagggcgtgagatatatatataggataagtaatctggatatgcgtttagtgtcgcgtggctaagtggctagctacttgggagggtttcgcgttcctgacgtgcaatagcaatccgaaaccaaggacgacaaagacatggcggccaacaacaatacaactggaatagcatacgcttccacatcgcagtgtgttgggttgcctgatcttatgaaagttagtttcaaagaacactcgacg

SEQ ID NO: 2524 - DNA, 1324 bp, Zea mays
  misc_feature (1)..(100): optimal_loci_58630_G1, chr2:38105872..38107195, Cluster 14
tataataaacgtagcagagagaaattgaatctctctatatagaagatataagagtatcctctatatacgctttaccggatatcgtgggacggtagaaaagagaatcttctacaaattctttagacggtgcggtcgagtcagccttaggtgataaaaaatgacgccatgctagcttcaggccggccaaagcataaacgctgatgggaggagagtgatatatacattgacttttatgatctgggatatagagtgagttgacgcatccccgctgtacatcacgagcgcagtgctggcgctacttatgagcatcaggattggcgcacgccgtgaccacgacttggcaaatgacagccctaaccttaatggtcggtttaattagccgcagctacgtactagcgcaccaggcaccagcagcgctttttctgctgatcagtgcttgccccggccgatgggcgacgggacaacactcactagtcactacactagtagaaattgtggatggacggacgacggagcgcaggcgcaggcgcaggcgcagcgcatagaaatgcatgcatggccctgatgacagacgacgacgaagcgcactagcagctgagcttttagattggaaaaagggactcaacgcctctgctaccttggtccttggctccttgccattgttggtgacggcggcgggggggcattggattccgacgtgacatgcgttgcgtgcgtgcgtgcgtgcgtgggatcaatcatgcggtcaagtggaccgtgcgtgtcgtcctcatccagagcatgagcattgagctagtaggactccattctgaacataatattaatactattagttagcctctcaaaaggttataagccagctgcaatgcaaacatgattgaactcttttttatttttggaggacgtcgctttggtctttccaggaatggaatgcgatttgacgtcggtcgcatcagcttgcacgaccatccactaggagatccagcacgttcctcgctcgccatgcttcttttttctcttctctacccacatttaaagcactaggtcgtgcgtcattcaagaagctcataggtcatccccgctcatcattgctattaatagaccgttacgtcctatataaaccgtaataaatcacctaaatccaacatggcaccaagccccactcactcaggtatcgcttccaaatattaccaccgttgggtctagacttatgggcccaagcattcaggaataggtaagtgagagaaagggtgtatgacaaaataagaagttgagttgctagatattttgtcaagcatgtctcgtctaggattcagacgggtca

SEQ ID NO: 2525 - DNA, 1348 bp, Zea mays
  misc_feature (1)..(100): optimal_loci_59255_G1, chr2:41775445..41776792, Cluster 14
gacttgattgcgatcccggccgcggcgtgtttagggaaacccttttgttttactcattgatttcggtgccgagagaacgctccgaggtgccgccgtcggttttcgagctcttcccatgatcttctcgcggtgtcggctcctggtttgcattgcatgccgatcggtgcagtgctgcagcacctgccgtttcccagagagcgagcgagcgtcttggctgtgtcctgcctgcgtggcggattttatcgcattcgcttgcgttgcgtgccctggtcaaaacgacactgcttcaaattgaatttgctccgtcgagcccatgctagtacgtactggcgtgtcccgagtaaatgctctgtgccagtctgttgctctctctctctctctctctctctctctctctgcttgcaggtttactctttccagtaaactgtgtccacgaggaaatttgtcggtgctaacctcgtcccctgtcctttttgccatccatccatccatgattaattacgcggttactacggtgtacgtcgccatcaagctggcgagacgaattatcgtaagcctgattcattcaccacaggcctggtggtgagacgaattaggacgctgtgacgaagggagagagagagagagagagggccgactgatgctgtctgtaccggcactgaactgaacaccctgtaaaattccgccaacctgcaatcgcgaggccgggcgcgcccggtctggtctggactggacctggaccctggtgtggcggtacgccgggtggcttttgccatttactccgctgtttcccatggccacggcgaggaccaccgcttgcagcgggggacggaatcattcaccggggcatgtgcgccttctccaggaatttacgacgaccgcctcgcctcgcctcaatctcactctcaccctctgtaagcaaacctgtaatttccgtacggagccgccagctctctgcgcgtgaccagtgcaactggcgtatcggagccagcaagcagctcggcacctctctgcctgccggcatagcgcccccacgccagccacgtacgttatcctcgatggcctgcacgcaagacggcaggggagtcacatcacggcgtaggctcgtgttgcgacgcttcaggagtcaacatcctggcgatcgcgcgccgcgccactccggagtccggactccggacacgcaagaaggcaacacatgtgcatgttgctagagatagagctagacggccgtcctgggcggccgtcgtagatgtcctattttgacggccgacgtgtgtacgtatgacgtgcatccggccgcggcagcggatcatccaccggcgcggcgatttggctggcgagtagcgcc

SEQ ID NO: 2526 - DNA, 1075 bp, Zea mays
  misc_feature (1)..(100): optimal_loci_59835_G1, chr2:45217630..45218704, Cluster 14
tttaatttattgatgccgttaaacacggtaaaaataatgtttgctcatgattacagtttatatatcgtacacgtagatggaggagcactgatggagtaatcgcgggtcaaattcttgtcccactgtggttttataaaaaaaaaattcggtttctgacctggtcggtcggttttagtttcgtgcggcactgcaccgcaggagcatgtgcctgtcagcctgtggtggtagtggcacatcgcggtccatggtcagcagccggccagaagcccgagtctgaacagccgggttaagaatcaacgagcaaaccatgtatgtcgatccctagaccagcaaagccacgaattagaccaaaaggaccggaaggtggtgtacagtgtactgttatgatacgctggcccaaacctttcaggctttcacaatcatgtcggcggtggtggttagccagcttttaccgacaaccggaagcaccgacgggaaaagggaaatctccccaattatcttgtcctgggggcatggactgtaagtacaatcgactttacatgatgctggtggctagctaaacatgagtttacttacttacctcacgaacagaagctcatagggtcttcaggcccagggacagggactcgctatgaactggtactggtagcacacaggacaggagctccgtagaggtaaactgcaaaggcaacataagctcagggaaaaaaaatatttggtgttcttcagcctacctttgttttttgaacttagacaaccgctgcacacggaagatgatctaaccagcgttgtcgaaaggaacttcagcggagtagcttacaaggactatccccccctcaatcaactaaaaggtgtggactatacacacacacacacacacacacaaatggtcaaaggaagataatcatccagacaatgaacaacatgtcgataagtaaaaggcgaccatgaagaccaggatttcagtcttccaagatatccaggctggagagctttctgtaggctgtagctgtccaagactgcactgcacagttcaggaaattacaccacagcgaaacaatattcaaatgagacg

SEQ ID NO: 2527 - DNA, 1222 bp, Zea mays
  misc_feature (1)..(100): optimal_loci_628_G1, chr1:3372357..3373578, Cluster 14
ccctagagtatagctatagctcgtatttttgaacctaaactctttaacataaaataagctaaagtctagaactgactttatatactgtatgtcacatatttaaagctttagctgtaaagagtatggggggggggggtctaactaattagactttaatttgtagagcttatatacatggtagtatgtagctaatggaagatattctgggcaaataattttttacgcatgcacgcatgacaacaacatgcatgagagttgatcacatggagtcaaagtatacaaatttgtctcttcccgctggacgtctgagagtgagagagataataattgatcaaacaagctactagaggaaattaaagctgatagaaattggggttagtttggttggatatgcatggcacacgcgtggaagctaggacctcggcgcgcgcgaccatgtggtggcacgcaaggagctagcagcgacgtcttgtacccgccgactcgcgtgcgttgccgaagaccatcgtagcgctgacgggtagggtgatatggtgtggtgggtgcgcgcgccacgccctcgtccgcgtggtggtcgtggtcatcgctctcgccgcagagtcgttctgccggtcgccggtcagccgaacgcgcgcgccctagtagctagctcgtcgtgcctaggagggttaggttacggtagcccaccaatcatcgtctaggactccgtacgtacgagacacgagcgagttcgtccgggcgcgcgaggctacagacagacgtcgtcgccggcatcacgttaaggtgctagctggagattcttctttctcgagatcactcggcggcctttctatggcgatccaccgcgaccgtaccatgcgtgctgctggtcgagcgaaagtagctagctggagcaggacgagctagctagctagtgccggccgggtcaaatgcgcggagacatggcactgatcttctttgtttggaagcagtgcactcagggccggcagaggtggtggttagctacctgttcgctagcttcctgtttgctcgtcagactttgaatgtcgatcgtaggagtatcatgtatgagcgcaagacgacaaggacagcacccaggattagagggatctcgatccaatggatcagggatgatgtgatttgacctcccaatatgaccagattgttttattgattcattcataaatgaataatgatagtagcacgcaggaagctatataca

SEQ ID NO: 2528 - DNA, 1056 bp, Zea mays
  misc_feature (1)..(100): optimal_loci_6804_G1, chr1:34948017..34949072, Cluster 14
gttttttttttctgcttgatgaaataaagccacattgaagccatgatgggaaacctgctgggatctgcgagtgtgagtgtgcctgggcatgatggtgtgggcaatgatggtttgatctttgatttatcactgcgctaggttactagcgaatcctagacaccgttgatcgatcgatcgatcgatcggtgacggtcggtcggcaacagctgcttgtgttgaggccgtggatgccggctttgttaataaccaaatccactgaattgcgtggagcatcagcttgtactacgccttcccatcgagctcaggcggccggccggcctgccgatcccatgctcttcatgctatagcgcggccgcgtacgtacaggccggccggggcgcgggggagtggaggcaggcacacgcctgcacagacgtacgcgccgcggtcgccggccggccgatcgatcacatgttcatgctcatgctgtagcgtggccgcgtatgtacatgccggggcgcgagggagtgtggaggcaggcacacgcctgcacagacgcgccgcggtcgccggacggccggcgcgcgcggcgccgcgcggaggacaggcgtgcgtggccgcgcgcgcttcggtgtcgacgcgcgcggctggccggccggccaacgtgctcgtacgatacatcccggatgaccagctagtcagctaccacaacatgcatgcaccgatgcacacgagcgcgccgagtggctagctggactactggacgaggtcgaatacgtgcgctacacgacgtcgtcgtagtcggcccgcggcttgccggagacgcacgcatacgcgttcgtcgcgtcgcattcatagaaagcgccacgtacgcagcaacgcatgtggtgtgcacgcggcagagtctggcagacgcgaggaaggcaggcagcgtccgatgatcgagctgggtgcactggtgcaggtcgtcgcctggtgtatgaatgagtgatctatcgtctcgagctgatcctgagagaagttcttactagtaaaactccaagcggtctagagagagagagtggctcaagtgttcag

SEQ ID NO: 2529 - DNA, 1003 bp, Zea mays
  misc_feature (1)..(100): optimal_loci_74607_G1, chr2:139640239..139641241, Cluster 14
actatggtcatctatttgtatattatctaggttaatcgtaatagatagtcgtgcctagcggctacgttttctggagagcacagaggagcacgaagaagagcatcaggccaacacagtgcgttccatggagaagcttccaaaggaccaaacgctacaggtcgcggtagccgcgtgccgccacggcatcaactttcctcgtagcgtggttgcgtacagacaccgatgaaaagtcgtgttgatgacgatgaaaatggcgagttgactacggagatgtccatgcatcatgcccaggcaaaaaaaaaaacgaaagtcagaaaccggccctgcctcttgtgaacaagctcatgtgtggcaggtgaacctctcagctgagcagcagggcggaccttcgttatacggccccactcaatttttaagtttcagtagatcttttatcttatttactagcagaaaaaaaacaagaggacaggttagtgaggttacagggggcacatgacagagctgatgatgcatcacgcgtataatgacgatggaacctcaccgtgctgcatttttccagatgtggtcatgagtaaaacattttcctcgactattatttcatctgttttgcgaaaaggcttctaccataatgattaatacttccgagtaacatattcaagtcttgaatccgatctctctggaaacgaatttcttgtttagttaaaaaaaatctcctcgagtagaacggttacagagaagacggtagcacaaaaggcggtaacagcccgttcgtaacaggggccagcagtggcagagacagggaggggccaggggccgtggccctgccaacgaaaattaaaaaaaacatatatggattaatgagcctaattaaacttaacccgccaaagcataaacaaagccacgtacaaacgaaaaccaacgagtagattgcgacctgccgttgtcgactttgctagtgccggacgcccgcatcgcgcctcgtcctcgatcgtcactctacgct

SEQ ID NO: 2530 - DNA, 1220 bp, Zea mays
  misc_feature (1)..(100): optimal_loci_8131_G1, chr1:42478962..42480181, Cluster 14
atccacaaccccccccccccccccctccctctcgcatgattcaatacagttgaacctcccatctggtaatatctggaaagcgatttcagattcaacagtaaaaaaatggcccatccacaccccccccccccctccctctcgcatgattcaatacagttgaacctcccatctggtaatatctggaaaaactaaatcaaacatgagtttagcaactaaccctcctcaaaccagcaaaagggacagtagagcatccacaagaacagcatgcctgtgagtcttcctcctcaacccaggaaactctgaatctaaataacaggaatccaccaatctgtgcttatggcgccctttgcctagcaggtagagtggcattcctgttattggcgaactatctcactggtaatctgtcattggcgaacttctgtaactcaagataatgtctccaattcctcacattggaatatcttaagacttccacttcaggatttctggaggcattaaaacaaaaaaagaccgccacagttaaccattatacctcgccatctgaatatcacagcccgtgccttggctgcaaacgtctacctttcctttgctcttgtaccgatcatagtagtagcctctcctgctcaggcttttcagaacgcatttcgatttcgggagccttttccagctcctgttgtttgtacgtcgcactcgactttctttaatgaagtttgtttcttctatttaaacaaagaaagatacaaacttgattaaagtgatccaccaaaaagcgtgcgttcttgattgaagtgatccacgtaaaatccggcggagagggaaaacggaagaagcagcgaagaagatttcgtctcgtgccaggtgactcgcggtcgcgggagatgagggcagatggtcagtgatccaccgaaatcttgacacgacacacgacaaccggcacccatgtgcgggacgtcacgatcccgcgaccttccggacagcgacgcaggacctgcacaaaatcatgagccgtgttaacacgccacgcaagcaaatcctcaactacggcgaactatgtatgagcgtgcttcttgttaggtagagacgaaaaagatggtgagaactgagaaagactacaatgcaatcagaccctgcttgtaatcgtgtcccttcgatgccttccttgccgtgtccagaagaggacacctcacacctgagtccccgcctgaactggtcgtcttctt

SEQ ID NO: 2531 - DNA, 1276 bp, Zea mays
  misc_feature (1)..(100): optimal_loci_82576_G1, chr2:184963042..184964317, Cluster 14
gcataccactgaagtgatcgatttttcgctatggtctctaatatagtaaacgtaaaaacgtgtcgccataatgcaattttaaagttccgaactctttcttatgtacgggtttctatggtttatttttttgaaaatatcctatagatcattttgctaaatacaaagtgttgagctctgttccaccaaacaaacaaatcgaaggccagagcaacgttaggatgagcttgagctagctagcgctggctaaacacgattttcaatcgacacgtggtgatgatcgaccgaacttggggaaattaaggcatggatatattagagatctgtagcatcattaattgagatgacgatcgaagagtattcagcgagccactgttcattgtatgtggaatatccacaccccggggggggggggggggggggggggggaggatctgccctccgttacaatgacaagggctgtgtgtaataatgtatcatctgaactggtcctagtagtgtacagtactagtgtactaacctcccctgattcaccgtcacctcttaactgggcatttaataaacacagtgcatttctcggattagctttcgtgtcacatatataaagaagcaatgcaaaatttcagcatcgatcgatcagtcggttgtctccagtcttggctccgttttgcatgcccatacgtcgtcataactcgtaactggatcgatgcgcgtggacgtggtccacagtgccatgccgctgccaaccgtccttaatctcaagcggatgaaagacgaaactacagcatgtgtcgtgaaaaagatagatatagatggatacacataacgggctaattggatagctggacgtgccaaaccaggctcgcgcgagcatgggcgctcatgtacgcgcgttttggccgtatggccgggtgcagtcaaatgtccttaaaaatggttggttttgcatcgttacatggagtatgtagtccatattttctgtgtgcatacaaccaaacaaatactcatatatagtcaacgcatatggtgacttaggataatcactgacataccatccaacggcgaccggtcagggaaatctccggcggagatcgggacgtatcgtggtcctggtccaggagcaggatggtccagcatgccttgctgtttactcaatgtgttggaccggtgaggaacctacacggtcacggaggctgagttaatttctgtgtgtccttgcttctgatccatgcattcgtgcgatcatccaacgacacgtggctatctgacggcgaattaa

SEQ ID NO: 2532 - DNA, 1007 bp, Zea mays
  misc_feature (1)..(100): optimal_loci_82596_G1, chr2:185020721..185021727, Cluster 14
agtatactaataaaatttatttggctaacattttttgtttgtttataaaactatttaaaacagcgctaacgacaaaactttagaaagaaaagccgccatccgttcggttttatcttgatactttagaaagaaagccatctctgttcactgttcggcgtagccgggttgcttgctggtgtgacttgttgtgagtaggaggaggagcacgatagcagggtcagcgatctttgaccggccagccagggtgtaaccggaggctggagactggagcggggctacagtgcctgacagccgctgagtgcatagtagcagcaggcgtagccgttcccgcgcggggccaaaaagatggatggatccgatcaggatttctgaacaggtggccataccgtaggcaatgctgtggcctgtgggtagctcgtggtagacgtttgatctacccatctaggggcctggcgcaggctcgcagacctgcatcacctgtgcgtctcccaatcgatgatacaggtagagaaggaggcctatccgagaccgcgacgctgccggccgtcccgtgcagccgtgcagggagcatcgttacggcttttgctgttgttagtacgagtgaagtacactggttctggtctcgatctaccgctcgatcttcaggtggtgcgcccagatgccgatttgatcgctgctactaccccggccgatggccacgatccattgccccgtctctctcatgcacaatgttctcgtggtgagcgggtccgggtctgtgcgctagtctagtcgcctgcaccaggttgatgagagaacatgcatgctcgacgagaccgccaatagcaccgtctaccaggggcggcccctcatgtcagggtctgtccgagggactgctattagcagcgagcaaaagaatctttttctttcggccaatcccaatcccatccgcagaaccgttctgcctgaccgcgcacacggtgtcactcaaaagcgcggtccgggttcatttacgcttatctgaccgc

SEQ ID NO: 2533 - DNA, 1303 bp, Zea mays
  misc_feature (1)..(100): optimal_loci_83082_G1, chr2:187789134..187790436, Cluster 14
atgtcgctttacagcaaagtaggaagtagctggcgaatgttcggagatcccgcttgcctatagcagagacaattctgtgcagggtaggcggcggagaatctgatgggcgtcccgtccccttgctcagcggaatgcgatcagcgaaggatcgccggagatgcgtggcggcacgtgagttttttttaatcattattattattagcttgtgcgtttggcctcttcaggccgggcctgtcttcgcgttccatttcctggagctacccacccgctcagcaaaattgactagagcgggtgctcattgcggaccactgaccggctgcatgatctgtttcatttatttatcctaatcctctggtagtcaaatggctagaagcagaagaaggttctttgagtgtttgacaaggaaatctgtgcaagacttgagacatcatgcatgaccagaccagggagcagtgttgattgggataaaggaagtttcttcgttgctttcttgttttctggggggggaaataattaaaaaaaaaacggagcacgcagcagtttctgatgtggatcatgtgctatatatatatactcgttttgcttaatggagtacgtgcgcgcgcgctcactcggcccgaattaaaccgcgtgtattgtattcagagtaactgatagtatcactatgtgatttcttcctttctttacaaaaccactgtccgctgctagatacatttgaacttgtcaagctcgcctcacgccctcactggaccggacatctcgaggcgataatgcttggacattggaggcagctgacgacggggcatgctatggaaggagctggtccgttctggaagactggagcggttgccggcggttgtggcgaaaacaacgccagaatcttccgccgtcctcggtcctacgctccaggctccagccgccatacgggtacggggtgatgcgtgcagatatgtgcaaatgcgcttcgtcacgctacgcagtacgcacgcacacgggtatgtatcggtatctctttgttagtatgttcgttaatatacccaattaccttagaccctgtctggtttcagcagagtacgagaatctccatcacacacttaattcgagaaaattcagccgaaacttgataaccgtggatagtctcctgtagcgtattatccaagaccggaaatcagcgatgtttggttcagtgtgaattctgtaaacaggatttctaagtaaccttggaatcaaacatcctcttaggactagttgggggagccacataaacgaaggagattggaggggctaaaaaaaatatatcaga

SEQ ID NO: 2534 - DNA, 1037 bp, Zea mays
  misc_feature (1)..(100): optimal_loci_8324_G1, chr1:43769545..43770581, Cluster 14
gtactacacatgcatgtggatgtgaatctctctctctctctctctctggcctgctagtgctagactctcgtctagtctagctcatcagcgcgtgccgtctgtttaattacgtcttccaatgcatcggtcagtgccattattttgaccgagtagtatagtagcgtagacatgcaatatatatatcctatcagcaatccaaagcgatggatgcaaatcggcggcaagcaagagcccagacagacagcctcctaaaaatagcaagcgcctgccccgcagaccgcagcactataccctgggttctggttcgttagccatgtgtctcatgcctacgacgtaccttggtcacgtccgtccgatgcatgtggtgctggcgcccgaccgacagcagcgcagcatcgatcgcattcatgaacagagctgcagatccacgagcgtactgcgtacgtacgtggcactcgatatcgtcttccaacggtgcaatacaacggcccctctccgccgcggtggaacggtgcctggcgcacgcagcaagtggggcgccggggcacatgcatgctttcccttccctagcttggttcgcgagaataatctcctccctaccacgccaccggccaccggcgccatctccctgtcgtcctcgatcggctctctcttgcctccgccgcgcgccagcccggccatgcatgcagcagcgcccacccgcactgcatgctgtgccctctccgcctcgcgtggccgcaacgtgggacaactgtaactcctgtctacatgcctgcctgcctgcctagaccggatcatcatcagctagctgcctggcagggcattaccgctggactagtggactgcactgcacacacactggatgagagacggaccgaccgatcgaccgatcacggtggtaggtttgactggaccggccggccagccgggatcgatcacggtgtggtagggacaagggcgggctgggagctagctgtaagacgagagccgtgagctggcggcgaaagaagggcaaaggggaagaaagagaacattag

SEQ ID NO: 2535 - DNA, 1378 bp, Zea mays
  misc_feature (1)..(100): optimal_loci_8326_G1, chr1:43770853..43772230, Cluster 14
cccatgcatgtatgttggcacatttggatctcatgtgctaaactttagtatggtgctaataaagtttagcacactttgaggagctaaattaattactgttaggtgctaagcatcatcgatccaaacaagccgtgcaccgtgatgtaacttttgtgcatggtctctctcgctgatagactggtgcggtgcagcggtggtgccagtgtgtgccacccttccccccccccccccatatcagcatagttcgttgccctcggctagttgcgctgctgaaagttttctgaccggtgtctgaaacttctcagctgctttaacgtgcatgtaatcatgtaggtaactacgtgcgtaactgttctgccagtctgtcgcgaatagattatagcgaaataaaaagggtcaacttgcatgtagtatgtatatgttgtaataataagatcgaacacacagaagcttgacgaggaagagagggggtatcatggatgatgcaattaaattaatccatatggtgatgatcccatggccatggccacacgtcgtcgtcgtcgtcgaggcgggcgctctcggcgtgcgtgccgtacgtacgtctggacttttagctccatcgatcaggtaccagatggtgctgcgcatgtgtgagcaagctggccggcaggcatagtggacgtgggaaggcatcatcaatctgatgtacgcaatcgcatgtctgcgccggccggccggttctggccaccacgttggaatgcacatgcatgtatatgcgatgcaaatatgggtgccgctttgaggcctgctgccacgttcggtcatcggtccaccagtacgcatacgcattggtatagtgcatgtacgtggtgtgggtgcacgactgcacgcttctgcttcacggccggccggtacgagaaaaagaagaagaataaacaagtggagagagagctcagtgcatcgcgtgtggagggagcctgcatgcatgctgctgcaagcatcggccggtttatgtggtagacaaacaagtgccagttaagccaatggttggtgtcgatcagttcgctcatcgcggtcacttgcagttgtttgcccgccggctcctgtgtggcctgtgggctacatgatgaactggtggatcagcgtgagttttattcatttttcaattatgtttataacaattatttaagaatatatcatttaatttgtttaaaagaattatcagcgtcaggaatgccgatagagtaggcttacaacaaaactaatgatatagaataggatttatgacgttgtcatttcacgtatagccaattaataatagatcaccacttttttctcataaactattttgaagtctgtgagcatcccgttttgcctcctttcgctctcttcatat

SEQ ID NO: 2536 - DNA, 1343 bp, Zea mays
  misc_feature (1)..(100): optimal_loci_84227_G1, chr2:194618871..194620213, Cluster 14
tccagcctatcaaaaaaaaattattccagtcgaaccaaatccagaagaaccaaaaaaggggtctaattaaggaatcgtccatcgagcggcgcacaaaaactcattctatttccgtgggataaaatatttcttcagtgcctcctccacacacacacagcggcacgttagctgctgctgggatcggaggcgccgcaaccgcaagcactggaacaaaataggatagactcgtgcgttatccaaacctgagaaaagatcatttggaatttaattaagattcgggcggcggatagcatgatccacgtatctttcgttcgttcactcattcctggatcgatctgctgcatggtacgttgccagaaggacgtcctgttcgcgcctccggttgtgttgctgcggctaccagagagacttggcggccgctgcgccacgacacaaaaagatctttggcggccgctacgccgccgcatgtggcgtggtctcgctctcgccgccgcccaagctagccgcaatatactccagcatgcacatctatccggatggatcagcgaattcggcgcctgcccatactactagctactgctgttccgaggcctgtctgtctgtcgtgcacgcttgtatacattcatcgtaccatacagatacactaagctaggccgtattaggttgcatccatataatcattatcatcgtcggttttaatacaaccgggcgccgatcgaagaaaataatataatgtacgcaggaggaaactatttacgtactagtagcaggattatcaactgacctttgaacatggcttgcttaattttgtgcaactagtacaaattaatggtcgcgcgcggacgtaaaattcatgcatgcatttgcgcgtcctgctgtccgcgggtacaggtaagcatcgttctacagttggtcgtcagtgaagtcttctggcatgcatgcatcttgaactctagcgagttgtgtacgtggacttatatacacccacttttcatgtatatgaaatgcaaagctaattccctttttaatcactcatcatcgatctgtctctgtactgcagtaccagctagtagcagcgctcgtgcatggacgcgcattcagatgacgtgtctaggcgcagcaatatggagagtatctctgagaaataaagtcaacgtttaccacattattggcagcccaaaccgatcgagctgacgcaatgcaagctagaacacatataaccggtccgtcaattttactgtgtccaagttccatatcaattaattatagcctatctatcgatctcttgacaatctgctgtatgcatcatgttcatgtttgcgcgcgcctaaccacattaggtc

SEQ ID NO: 2537 - DNA, 1407 bp, Zea mays
  misc_feature (1)..(100): optimal_loci_84708_G1, chr2:197141867..197143273, Cluster 14
gatatgttcactttaatccgttcgaggcagcaaagacagcgcaacgtttggcgcgagacatcgtcgataggagggcggtcgttggatagcggcaggccattctgctctatgacggctaatggcgttggcgattggctattggcgtagaggttcaatttaccctattttttttacctcttgatccattattgtggacgccggtcatcagtgggctctcagttcactaacgaagcacatgcatgctaagcacacgttctgaataaagttcactttagttcatttatatccatcaactaattaatggactaattggccaaggaaccgtagccgcgcgccgtacgtagttcggcatgccatatgattccacgcatccggtctctgccaaaagcggcagagggcgagcacagatgcacgtgacatgattggaacatcaccatggattcctgcaagcaaagcaagcagcagctagctacggtcgtactagtagtagtaatcggggcgaaaagaggacatcctgcgtggcatcgcatgccccgccccccacgcatgcatgaatgatacattgccgcagcgcagacccgttaaaacgagatctggtggtcacgcacgccgaggaagcagattgccgcgcgcggcccggacacgacagacgacacacaccgggtccggcctgcatgcggaagagacggcgacgtgagttttccatgtcacctcacccagactagcccattaatctctcgagcagcgccaaggaccgatccaggccagtccagggcacgcgcgcgcaaagtctcatgcatgcatgctgctcgcctgtaggacgtacagtactgtacgtgctgctgcgtgatcgactgatcgtacccaaacccatgccatgttggatgttcaccgagatccagaactgcgaggatatgagagagatccctagccagataccaagagctgctgcggcgatcggtcgagatattgtcttgtaaaatgtgggagtgggacgtgtgcttacaagaatcgaagctgtacgcgcttctctcgagtatgcagaatggactgggctgggctggggcgctgggcaggccaggccaggccatttcgcgctttacgctcctattctaggccgtcgtacgtcgacccacagaaaacatgctacaatgaacttgtcgaaactttggagaacgacgccgcgtgttttcttcccctcgcagtcgcagcctttcccgcctttaatttccacgccggcgaaaagcctcgttggccgaccgacccaaaaccaaaagccagtcaaggccagctgctacaagtctagaactcggcaaggaaaggacgtggagctgctggccgatcgaccggcctcctgctgatgctgaaacgagaacacaaggctggggaagcccaaaccaaccgtgt

SEQ ID NO: 2538 - DNA, 1067 bp, Zea mays
  misc_feature (1)..(100): optimal_loci_856_G1, chr1:4544544..4545610, Cluster 14
aagaaaagttgatcttctccaaaccacgctagctgcaaacattgaccacagaaaggagctttcttgaccctaactaacaggccagccaactaacccccggtataggctgcttgcctccccgttctccctcagaatcaaagaaaacacaaaaatatatatagccactggccaaatgggcaaatggccatatacattactccccagctgcctcctttgcccagtttacacccaacaacgtgtgtgcgtgctccatacacacatataccatatacaatttttttttataaaaaaaaaatcaacatgtggcgcctaccggtaagtagccgcatcgcatcctattgtatgtgtcagcgtgcgcacataaaataggcgccatccgctcctggggccggccgaatcagagaccggcagccatgtcgacgacgctgacctgagctgctgccctcctgttaggcttgtcctggcccagtgacaacaccagctggccttgcagttgcaagctcagctactgccaatggccgagattttctagccatataatgcccagcagataaccctgaaacctgctcaggggccagtcgatccatgccgattaaaaaactgtcacttcagattcacatcgcaatagcacgcattattattctttcagctgcgttgtagacacactagctacgtggatcagttttcattcgctgaactgggttttttttatatatttaggagaacagcaagaacacacagagtacgttcatctgattcgcatccaattaatctatggggggaaggaaatgaacggaacggacggacgatgcgtggttttcagaggcaggcggaactgtgcagggatgcttcgagagctgttcttgccgagcaggccggagcaggaacaggcggtgtgataagagcggcctgcagcaggcatgcatgcatatgcagcaaattaaaatcgagttaagcatgcgccatcctccgcctcctcctgaaatgggcctgcacgatttattaaatatggcgacgctgcctgcctataattaaagcaacaatatatgcgtgcgccattgctttcc

SEQ ID NO: 2539 - DNA, 1227 bp, Zea mays
  misc_feature (1)..(100): optimal_loci_85833_G1, chr2:204774091..204775317, Cluster 14
gtactaatatttagctgaattttgcactgactaggagagtgggcgactgggcgtgacttcctctctcgatggtcaccgtcggccagccttcccaagacaacaaacttaatgtagtagttgtcggtgtaggtcgctgcctcactatcactgatggcggcttttaaccatggtcgattgttctctgtgtggatgagcttcaactagttttgtttcagagttttttgtttgtttgttttagagttatgattgtactacgtaggtacctcggaacataggaaagtttgctgacacccccatgaccgaggaggagcgagggtagtgagcgacgaaaagaaaggaagcagactccggttgcacttccttttgttgtgacttgtgacggtgaaaagggaggcggaatcgagtttacacgcgttcctttcgctctctcctccggtcctccctacgtttttgtttcttctctctttcttcctctctctcccgtacggtttcgtttcccgatcgagtcctgctcatactgtcacgcatcactgcgctccggcctccggccacgtagtcctatcccggatcgggcccgacacaacggatctactaccaggagtgtgtacaccgtctgtgtacgatagcaggcggcgccaagtttcgttggattgcatcagccatcattgtcagcagcaggcggtgttgccggccgactcgtgagggcaaggccctccagattacctcctcgctctttccaaccagtcctgaaggctacgactttttgtgagaggtcgtacccccaattgaaagggtttcatcgttacaaaagaaatatccaagtcaaccgatgcgatttgtcaacccgttaaaaaataccggtaccagtaccacagctcagctcagccggccaagtcaacgccgtcggcaagggcgcaccacgcacgacgcaaaaaccagcgatggtggacgtctctgcctcagtcggcacgcgtcccccttgtttccctgcgtctccggtttactgtccgagagagatgagccaaaatgcttcaaaagagagagagagagatgagccgaatgggcgctggcggctgtcagcagcctctgggctgattcgccgtgcaggtcccgtcgtcgcggcgagcacaccgagaggaatatatgatccgtttcgacacgaggaccagaccacacgtcggttccgattagggatgatgcaaacgttggataggaaaaaaaaaagta

SEQ ID NO: 2540 - DNA, 1112 bp, Zea mays
  misc_feature (1)..(100): optimal_loci_86203_G1, chr2:207229723..207230834, Cluster 14
gtggaccgtgtgccgcgcgggatccggcatgccgttccagtttgaccgccagattacacggggccgtggaaggcagactgcccagtgcatgtggttcccgggcagcttaagctacgcatattttatcccgggccacgggtaggtgttgttggtgtccaagagccaaggcccatctttgtgtgacctacgggttgctactgcacacgatgcttctcggcccatgtttatttcctggcccgtctttagcttgggcagtttcgtagtcggcatcaggaattcaggaatgccagcgttcacagaaatttagccctttgctgcgtctgcagggtgggcctttgtgggctgccactactgcctcgcccgttgccctgtcgaaccgaaaacgattttcgacatactattctctcgctgacaattcatcatttgacatttcgcttcacctttgtctccagcgtcttgttgacttgttgtcacgtcttccgaagtcgaagctgttgctccaattctcaggttcacacacaggcacaggtgactcgttggagtcttggagggagagtgttggagtcttggagggacaggtcagggacagattagtagccaaactcacacaaatacccgggcaaattcatctgatttttttggattgatacaccgcacgcacgcattttggatgctaatgacgctcggcttgcatgcccacgcccagttcgtttttttgcggaggcgacgaccaaaacaaaatcgagcgtcaaacgttggccagccgtcacgtctggcggcatccaaacgcaccatttgaattggaactcactaacatcttctcatcgctgaggaccacccacacacacaaaacttaggctgctaccacgtgcttggtttaaacaaatattcgtacggtcttcgcatgagtttccatgaatattcatacaagtcgccgtgttatcccttatcaccacacacacacactaaaaaaaaaaacacaaattgaacaagtgttcgctacagttctttctaactgatagagttcatgttcgcacaatttgaccatatatatactagctatttcctagatgcttctaacgacgccagtggcagatatggatagagatgtt

SEQ ID NO: 2541 - DNA, 1204 bp, Zea mays
  misc_feature (1)..(100): optimal_loci_86389_G1, chr2:207970682..207971885, Cluster 14
gtctgtttggtaggaatgcttttaacactgtagtttttagaatactatggcttataactgcacatgaaataaatactatggtttcacaattttttcagttaaaccatagtattttctaatactgcaagccgtttgcttgcactccacaaaaaaaaaaaactgcagctttgaggctatagtattgaaaattttagtttgcaaaaatcaaaccaaacacctcgtggtttacatacctcagttttcttagataccacattattttattaaaactgcaaaattactttggtgccaaacaggcccaagtggcaggtggattaatgtcaatcatcgaatcacatggcttgaaatcccgcattccgcagtttcactgccacatcctcttcgaactccttcgcgatgtaaaaccatcattcgtgcgtgtgatcagcgcgttacctgacgcactcatggtaggcatggcatcgctgcacaccccctcttttactgttgagagcacgagacaggccgcccgccgccgcacctcatcttttgctgttcccggctccattcttcagtcccaggatttcatcattacccccacgtgcacacgcctacggcgcacctgattgccctgatcgccttttgttgccgccccgtcccatcccatcctttcgcttggatggacgcgcgaccgacgccgacgccgacgccgacgccgcgtgagtaatccccttccgcccttcgattcggagagcacgcgcggacacgagtcgcgcaaagcgtccagcgctctaccccacggcccatgccgtgcctgctaaaatctgccaagtgccgctctccgtttcccgttggaaggaaaagggggagcgcagatctccactacgtaccgagcgcacggccatcccaatcagccgtcggattcgtctcctttccccaccaaactcccggctccggagcccgagccacgaaagacgacgaacgctaccgccggagccgcgcgcggtggcagcctggcaggatcgtcgctcgtcggattgttgttggcccggcgcgcgacggaacgggacaaggaacaaaacggaaagcgttattccttgcttgctccgttgctcgcttcacggaaagtgttttactgtcctcgctcctagcccgcagtcccgcacacaaagccagccaaaagcatagcaaagccacgcctggtggtggcgctctctcaggctga

SEQ ID NO: 2542 - DNA, 1094 bp, Zea mays
  misc_feature (1)..(100): optimal_loci_87230_G1, chr2:211741190..211742283, Cluster 14
tatggattactcggactcaagatacggatgctctcttgcacagatcgaattcgtaatatccatatcatttacaacaacctagtaaccagcatctcgtaaaaggaagctacgggtgcagcaattgtgagcatcagacagtattcaaaacagcacgaacgggaaggaacgtgagcaagcacaaaccaagggccagcaggacgtcaaccacgtcgaacccaagattagaagcaagaacgaccgtgggtagaaaagataaaaaggcgtctgcagcagggccggcaaaggatctagcgctggcatgcagtctggatgaggagtgaagacaaagcaagctagcaggcatgggctctgctcatcacgtccgtgctgtgcggcgcaggcagccaggcagggcagcgcagttcgctcgttccgtgcttcagcgtccgtcaacggaagtgtcagattcttgaagcacttgtgcctccaaagacgcggacccgcagagctgggcgcgggctcggcgaaggcacggcagcgccatctgcgcggggcccaggcgcccccggaccgatgcgtcggtgaaggacagccgacagcgtgcggtccggtcaaacggcagcgcccgcggaggaatgtttactcgcaagcttcctgtttcaactagaggacgactgtgaaacaggtcgtttttcgatggatggatttttgtttatgagatgggactctggttcgggaggaccggaggagaagatagaacacgtactgtgctctgtactacctacgtagtagcagcatacagtgaagcagagagaggccagaggaggaggagtactggtggcggaccacgatctacagaagctgctagtagaagctagcagtgcattgcagctctcacaggatggggtcatggcggcggaagcaagacagcagccagcagctgtcactttatggtggctttcattgcagctgcatcggttgcctcccgaggccatgcaggccccagcggcattaacgcgagccgctggatcgtcgctgccgcggcagttcatcagagctgccccggctccaactgctcgtgcgtccagagtccagactgaagaaagctgcaggca

SEQ ID NO: 2543 - DNA, 1203 bp, Zea mays
  misc_feature (1)..(100): optimal_loci_87433_G1, chr2:213171525..213172727, Cluster 14
ccgtcgacggcctctcgctgctgctgctgctcgccgtcgaggtcgccttgtcaaattgctctgtagaatatttttgcgtatctacgtagatggggtgacctcttttgggcttattcagttgctacgtgatgtgagatcgagctcatttaagttaatatcgtgtctgccatcaagaggttttcgacttactaaattatcgcgaaagatcatttgtgttatgttcttgaccaaaaggggtgttttagtgtcaacttataatgtgtgtttatgaattattaagtcattagtgattttttttttttgaagtcattccacgaacttgagtcggagagagtggtactagttgattcctccaacttaaattgtagcaaactatgacctttaatagatgtaaaaaaatatagttagtaaggttaattaacattttgtgatggtaaccactagtctctgttatgcgaggaaacctaccactcaatgcatgagcagcagccagatccattttattttattaaagtagcgtttggttcccgagcctacggctttttaggttccgtccgaaagattttagtaaatcaaataatgattcagcagttaagtataactttttttttaatttttagaatcactgtgttctatatggaatcaatctaccgcctacctacaggtcgtgagttgtgacgatcgaccgcacgcacgcgcggcgcgacacagcccgtgctcttcgtgcctcgctcatcatgcacgtgcgggtagcgcgcgtcccggcccaacgtttaaaagacggggcggccgatgtagatggctaaacggcacgcggggttcattcattcatatgcatggtggcatggcacgcatcaagcatacgacacgccactgaccgaccaaacgagtcaggccggaggagacagggaccaggcagccgcagccgccccggcacatggtcacgtacatggcctggacactggaggggatgggatgggtccgttgctgcaattcaattatgcgataacatcatcatcgcattaccattgtctaaaaaagccggcgctcgtcagaaaggaaatggcgtgacagcagcgggtgacagggtagatctggcagcgcagcgagcgacctcgatccgcccgtgcttcccatctacgacaactgcttcatcgaccgcgggctagcttcgatccaagcctgttgttgcttcaccttcac

SEQ ID NO: 2544 - DNA, 1007 bp, Zea mays
  misc_feature (1)..(100): optimal_loci_89114_G1, chr2:222643904..222644910, Cluster 14
tagtaatgtattggcattggcatggagctctgctttgttatacttttgttcaggtactttcttcttgctgagtagtacaaacatttaaaagtgaaggcaggtaaaaaaagggaaaattgaatctagaaactgaaaaggtaattgctccaaatttcttctgttacgagacgcgacgagaagacgagacgccgcagtcactcacatgcagtggacggcaatgtgaccgcgccgaggtaaccctgtccctgccaccagtccaccacccattgcaacaacgctgagacctatagagagagagatcgcgtggacctgaacctagcaggctagcacgagacatgcacgtggctccgaagggcggcagtcgacgacgacccgtcgctctgcttgggttctaaatatatacttccactacttaattagattaagaagagaaaaatatccctactttagaaacttaaattgtattggagattggaataattgaaagagaaatgaactaattaaaggatttgagtttccaagctaaactaaacggcgccacgtatagtttgtatatgaaagcactttccggatcttaattatgattctttgatatttggttcagaaaaaaaaacatcttagaagaaacttcctgtcagaagagcagctttttttaaccatccaactgttactgtaaagaaatgagcgagcaaagacccaataatatcaataatatatagccgataggcaagctagtcggagtcagatctcgtgaagtcaacaatgaactaccttacctgtacgttaccttggagtatagaattgtggacgcacactacttgattggcgtgcaccatacacgacgaacattccataagggagctgagctgagactgagactgacaggcatttaagactcactgtccctcgacgagctgcaccgtggaccgatatgatgatggcgggtgaaggagaccccgatcggcacgtgacaccagtgtagtttcgcggcgtcatttccaagatgg

SEQ ID NO: 2545 - DNA, 1244 bp, Zea mays
  misc_feature (1)..(100): optimal_loci_90575_G1, chr2:229011473..229012716, Cluster 14
agtagcgtcctcggccttcttgcgcctgtggacttccatggcaagagtcgtcttgcccatgcccggaggtccgacaatggacatgactctcaggctcttgtccgtctcctcccggggtgtgagccacctgaggagctttttcgccgggcggtcgatgccaacaagagggagggcggcactcgccgttaagttggtgccagtgccactgccaccaccaagttggggtggtgcaagcccgatgtcggcctcaggacgactattagcttgaagaagatgcttaaacctgcagggatgttcgctgcgatagtaaagctgttttatgttaggagagaacggatacgatctattgttgcggcttaggatgcactgcgtggcacttctcaatcgcgttcgtagcagcgtgcggcgtgagggatcaacttcttggatgacgctgtcgagtttactgaagacaagctcatagtgctccatccatctcctcgtgtcggcatccagatgttgctggctaagtgtcttgagaaactccgcaatgatgctcagctccgtctccatgaaggccaagcagcgccgtctagtgtaacctgcagcgacgacgcagcgacggccggcagcaccagcacccagctgttgagagatactcgcccgaacgggctccaacacgcttagtacctccgcgatctttgccaccctcgtgtcctcctgatcctgcttgttggaaggagaaggctgctgcttccgggaaccatgtggatgtgggtgcgccgccatgacaccagtagctgcagaataagagagggagaatatatatatatatatataatgtcgatcggcatttatttagtttattttcccaagcaaaaggagagagggacacacgtacacacacttacttgatccagctgcaggataattaatgtccgagctctcgatcaaatctcagcctctagcttgcattggatgcatgcatgcaagagatcgagcaatgcaagccactcagccatgcagcctcgccatcatatagagctagcaagcaaagggccatgggggacgtgtgtcggtgcaggtttgattcggttccaaacccccgaacgcacggcggcacatcgatatcattcatggacgccacccagtccaaccaattcctttcttcttacatgcacaagcttttgtgtcagtatgggcttcctttattctcatgcggtcatgacatgcacccccattcacgccatcctcccccagatcgg

SEQ ID NO: 2546 - DNA, 1176 bp, Zea mays
  misc_feature (1)..(100): optimal_loci_9082_G1, chr1:48110273..48111448, Cluster 14
ctgacgaaaaagcgatggtggaagactccacgctggtcgtggtgcaggttaacggtaaagtccgtgccaaaatcaccgttccggtggacgcaacggaagaacaggttcgcgaacgtgctggccaggaacatctggtagcaaaatatcttgatggcgttactgtacgtaaagtgatttacgtaccaggtaaactcctcaatctggtcgttggctaagcgcgggaggaagcgtgcgatatctggcaacattgttgttatctctggcggtgttaatcaccgccgggtgtggctggcatctgcgtgataccacgcaggttccttccactatgaaggtcatgatcctggactcaggcgatccgaacgggccattaagccgtgcggtgcgtaaccagttacgtctgaatggtgtcgagttgcttgataaagaaaccacgcgtaaggacgttccatccttgcgtttgggtaaagtgagcatcgcgaaagataccgcatcggtattccgtaacggtcaaacagcagagtatcagatgatcatgacggttaatgcgaccgtgttgatccccggccgtgatatctacccgattagcgccaaagtcttccgttcgttcttcgataacccgcaaatggcgttagcgaaagataacgaacaagacatgatcgtaaaagagatgtacgaccgtgctgccgaacagctgattcgtaagctgccaagcatccgtgctgcggatattcgttccgacgaagaacagacgtcgaccacaacggatactccggcaacgcctgcacgcgtctccaccacgctgggtaactgatgattcggttgtacccggaacaactccgcgcgcagctcaatgaagggctgcgcgcggcgtatcttttacttggtaacgatcctctgttattgcaggaaagccaggacgctgttcgtcaggtagctgcggcacaaggattcgaagaacaccacactttttccattgatcccaacactgactggaatgcgatcttttcgttatgccaggctatgagtctgtttgccagtcgacaaacgctattgctgttgttaccagaaaacggaccgaatgcggcgatcaatgagcaacttctcacactcaccgggacttctgcatgacgacctgctgttgatcgtccgcggtaataaattaagcaaagccgcaag

SEQ ID NO: 2547 - DNA, 1349 bp, Zea mays
  misc_feature (1)..(100): optimal_loci_91432_G1, chr2:232995362..232996710, Cluster 14
atgcatactcatgtttcctagcaatcgaaacaaaacaaagcaaccgtttttgcagccacagtgcacgaggcaaattcggcggtgagccggtgacccgacccacgagcgcgcgcgcagtgcacgaggcaaacggggcccacttacctcagcccgcgctttgaataatcgcgacgacggggcgggagcgggagcggacggctgagatgggatgcaccggggtacctacctacctaggacgaggataaggtcggtcggtggctcggtgcccaagggtttgttggcgcgggtgcggtgggtcgcggatcctttgcggcttgccgggctggctgggcggccgtcaacgtcctggtcctggcctcctgggcgctggaaagtcaaaaagggccggacccggacacccgctagcccccgaccgatcggatcctctcagcctcaagtcaggacgtcaggtagccttttgcgtagtagtacgtagctctcgcgtatcgacgttttcgttggacagtactagttgcgtagtacgtacgtagctctcgcgtcaggtctgcttcttttaattctagaactagaatgatgtgtctaggatgatgtgtggggggcaacgatatttaatctctgaatggtaatcactcctgcttagatgatgatgatgagtagcatagacggtataaggacgtgcggtgccgaaatgaatcacgtcggtctcgtccttaaagatggcactgttgtatatatatctcacttgttgggggtcataacaagttagcgatgtgaccccatggtttagtaaaccctagctccgtgcttgcggtatccatgaccaccatgtgagtcgtcgtcggtttcagcgaggtgtacggcacggacggacagaacctcagaaacctgctgccacgcagcctcgccgtcagagcacaatcaccggagatggagacgaaggggttgccacactccagcaatgatggatgtacgggactgatcggcgtccagtcccatccgccgccggcgactaatccgcatgggccgattattagtacgcacgaccactgtcactttagccagaaatcaaaatggagtacagatgcttccatgcaaagcaaaagcatgaaagaaatcaaaatggcaattctattctctttgagagtcacgtgtataaatagatagatggtaaagttatacctcaggatgcagcttcgtcttcaagctttttagcgtttaatattatgatctagtgcaatacaaaccacatgcactattgatgaatactacaaccatttggtctgcttgccaagccccccttctttttttcgcgtaaaataggcttaggcctcttttgaaacaaacgaaaa

SEQ ID NO: 2548 - DNA, 1077 bp, Zea mays
  misc_feature (1)..(100): optimal_loci_91512_G1, chr2:233585512..233586588, Cluster 14
atcctagggtgtatgcactccctgtagagaggcacggtggtggacgccgacccaactgcgacgcctcggaagtactccgacgtgaacatgtccctgatcttgtcgtcccccttgaacccggtggcgaagatgacgacgtcgctcttcaccaccgccgccgccgccggcgccgacgccgacgacgacggctcgccctccacgaccaccacgccgtccttgcagaagctgaacgtcttggacttcttcagcactatgctcccttcgtccagccgcttgtagtggtccttgggcgtgatggcgatggtggcggcggccagcgcctggaacaggctgtggtcgggcaccatgtcgtgcttcctcatcgggatggagtagtagctctcggcgaacttggagaaagcccacctctgcacacacatgacacaacacaacaccaaggggttcttacttcttttcaaggggttcttttcaattcagatcatgcatgagatggatggatggatggatggaaattaccaagggagacagaagggtggccaaggcggacaggagaaggccttcgccaggcttgtggatgaggagttcagaaaagcggttgaggtagagccttgagatgtggaagccccaggcgaagtagtccggcaagacccagtgcttggtccggaccaccattgtgcaagggtgagcggtgccattcacttgcgcgcattcggcggcgatgtcgagcgccgacttcaggtagccaacgacggtgacacgcttgccccttatcgtctccttggccttgctcgagcccatcttggcgtagtccatggagtgcatcacctgcccgtcaaacacctctggaccttcgccctctgggaacgtcgtgggtacgttgggcacaccactgaacctccccacgcaaagaaccacaaagtctgctgcgtgtgtctgcagaaatcaagaacgtcgtgggtacgttgggcacaccactgatctcgctccatccaaatgcatgctagatatagcctaggcagctctgctcacctcaacgtggccgccgccgtcggcgtcggccacagacagaagccactc

SEQ ID NO: 2549 - DNA, 1008 bp, Zea mays
  misc_feature (1)..(100): optimal_loci_9208_G1, chr1:48536360..48537367, Cluster 14
atccctcgtgcatgtcgtgtgaagaagtgcagtactgcctgctattatggccgtttcatctactatatatatgctcggcgccacctgaaaatggatacttccacggttctgtattatcattgccgagtctcgaatatttgagcagctagctagccagcctccctgacgatacgtttgctacatggcgtgcacgcgcgcggtcaccataattaacctcatgcatatggatctcatttctgtaagttaaaagaagatgaggccggccggccgggggacaaagcgagcgttggagtcacgtatgctctcgatctgtgtgtgatgagccagccagtgcaagaatgcgtgtgcatgcgtaatgcgttgttcagatcatcagatgccaattcacatgagttccatcataccattggttgacacaacaacgctccttcacatgcatcgtctccaagacacttcacggctgtcctgcccgtccccggcccgccactctttcatgcccatgctttccatcaatgcacgcggctctgcaggactgcagattcttcttgccaaactaatactgttagtacgaactcgatctgctcacaaactgcaaaacaagagtactagatgatcgagagggagcccttttcccgtcacatgcatgctcaagatctggtgcctctcgctcgcgcgtaccgtacgtatccttttcgagcgtctgggcaacacgttacacacgtatgggtggagagaaattaacaccgctgctttacgattacgacgcctttgcctttttttttcctctgaatcaatgacacagcgtggtccttggcatgctagctagattttatgtgcgcctctgcccttccttgtgcagctacatacgaccggttactagctagctgtacgttgttggacagccttattcataaataaattcatgatgtaggggcgagggaaacaaaacccagaaatgtttatctttatgttaggatatctcgagagctataaatacttggaacaaaa

SEQ ID NO: 2550 - DNA, 1203 bp, Zea mays
  misc_feature (1)..(100): optimal_loci_92959_G1, chr3:4703633..4704835, Cluster 14
gtcaccaactctgaactgaacgatcattcacggggcagtccgaggccttacaggtcaagctgcacgcccgtcctgtgccgtcctgccgtgcacaagccggacgcgtctgtacgcactcgatctacgctatggtggaagaagcttccagctacctgagctacggcgaccgtgcacgagccggacagccggtggactcgtctcgtctgtacgcacgttacgctatggctggaggctgaagctttccggctccgacgaccacgctgcggcgcctgtccgcagcctccgcctcggcgtcgcatgagttgcgtcaaccagcgcgtcggacggcgaccaagcgacgccggccacggtaaggtacacgtacgtatcgtcacagttccaattcgtgtctggattctggacccgcccggccggtccacgaaccggcggacgccatgcagacgtccctgcttagcgcgcaagggggccggggctgcaaggcttagcgtgcaagggtcataggagacgaagacgcgcgtggaaggagccgtgtagtgcagaggtcagcatgctcgttttttcttcactccccacagtacgaggggctattcagtcacgtgctatatgccactactacaaggatctatattttagcatgtcttcagtagatcgtgcacatagtcatacaaaacattgttttatacttgcagagtacaatttaaaatatgagacgagattgttggagaccatattcttccaaaggttcttaaaacactattttaacaagttactttttagcccgtttcaagtgcaacataaaaaatgccgaagagcacattcggttggggccatcacaattgcggagacgaaggcaccgacttcggattgacggcgtgcatgtgaggaacaatgccatgtattgtttacgtttttttttggcttgaaagaatttatttactctgtctatgaagttgtatttctttctatcttcaccttgtaccttcaagaaaccgaagacattcttgtaattaagtaaaattaatgggattaaatcatatgattcatcttagtattttattgtgttcactttgtcatctgttaatctctaaacatcttcgtccttcatcttatctctctttggggataaataaagtgaagaacatatatgaagctttatataactacgttgccttgtttttggtctctcgaaggaatcgaaaacag

SEQ ID NO: 2551 - DNA, 1377 bp, Zea mays
  misc_feature (1)..(100): optimal_loci_93017_G1, chr3:4878926..4880302, Cluster 14
tgaaccaagctttattggttggaaagcgagaggggccggggtagtacatgcgatcgatcgatgcatcactcatccaaaggcgaagcaaacgaagagagataataacaaccttggccgaaatgcgcaggctatggaggagatgccatggcagccggactgattgttttccacaagcgagcatggatgctcccaccacatgacatgaaggaaaaagatctctactctacctgcatcgcggtcccatcccaattcccatcactactgaagcaacagtgatgcatgcatgcatgctgctcgatcgaaagggaccgccatcatcgatcctagtgctactgctaagtaactgacgacatgtgacacgtacgtatctgctcgtccggcctctcacatgtagaagctgtactgcagatcggctttcagggtttgggtatatatatatattgattgacctcctgcctgcatgaatgcctgaattttcacaggaatgtatatttacccaggtcccaggccaggccagttcgtgagacctgtgtgccccctgggcctggcccctgccctatactagaaaattttcaggctgttgcattgcattggattggccggagtgctcagagatgctatctgtctgtctgtctgccctgctgatatatcaaaggcaccagcgtgtacggcgcggccggcgatgcccggcgcggccggccaaaagccatgcgcgcacgtacggtgacctgacctgaccttttcaaagctcatgcagccagccaagtagtgtcgatctccctcctttgtgcttcatgactcatggcagtaaaatgcatgcatgcatgcatgaggaatcctggacgtacggcagttggatcgtccttgatctcgctcgttgcatgcgcggcggggaccggccgcgggccgcggcgccagcctttccggctccggccgggaaggaaatcttgggggatccggcgctgacatgagcgtgtaccggaagggatcgatcgagcaggcgcaaggcgtgagctagctggtggctgtggtggccgcccgttccaagggttctacacggatcgagctttaatgcatgctcttcacctgcgtacgacgatcttcggattattgtagaggctggcaccctgttccattcatttaatgaattttctctttgttctaaaatgataccaaccctgtcaatcgacgtatccggtcgcagaaatttaaagaatgatataatacaaatgtgtttggttgcctcgctagcttttacagtctagctctacaaattaatgtatagctttcctctagacttggctctcgagttagaaaatggatgtttctttagagccatgctctgctgatgtaaccattagtctttcttaatgatag

SEQ ID NO: 2552 - DNA, 1149 bp, Zea mays
  misc_feature (1)..(100): optimal_loci_93576_G1, chr3:7208572..7209720, Cluster 14
agaattgaagagagtttagggaaatgaactaattttcactaaatcggcttaaatccctaatgggaggttagcaaactagccttacctggcaatgagcagggaacagggaagcaaacgcgacagtcggcagcgtaccgtccaagcggcgggcggcggccgcatgtgcggcgtgttggtaggggtacccagggaaggcctcaactccggctcgctcaaaaccctcgcctggctgcactgcacaatccactgacatgtggggaacaccaccgcgtgcctgagggagcgtgtagcggctcggaaaaccgcgcgccgtggggcggggaggtggtgcgaggaatgggcccggcgccccgcgctcgtcgccagccgtcacgtgctgtctgttctgtgcctgcgtgcgctgtgcaggcatcacttcttccagcagtcccgtccggtccggcaaggcggcaacaggagggtgcctggttttggacacaacacagccgcgtactgtaggcagatcggcgttggcgttggcctctctctctcccgcagaccgcagtgatcggtgaggaaagaaacaggatgatcctttcaatctcctctgcgcgggagttgattattagtggcctgcaccagggccacggaatcaggcgggctgacaggtgaacgatcatccgttgatggacgccggcgtgccgcgctggtccacgaacgcaagcgaattttaatgagcaattgagcataacatggactcatcagtcatagtaaatggacttgattgagatgggaaacaacatgctagtgaccacaatcacgtcccagcacataatgtggatcacacaccagcaaggactattacgctcgaggtcacacacgacctgtgtcatacgcatcaaacaactccaggatcagtgagataggtcacaggattgattcagccgatttggtatcctactttcaccgcaaaagctcgagaacacctccttgggtgtgcagaaagttgttcagtctgtctgtctgtgcgctaacgtcggtaaggccatcataataaaaaaaatccaaatcgtacgagacacgagtagttagagaaataaaaattcacaataaaatattgtctatctatcattttctcatatttttaaacttttatagataatttagaag

SEQ ID NO: 2553 - DNA, 1247 bp, Zea mays
  misc_feature (1)..(100): optimal_loci_93741_G1, chr3:8215654..8216900, Cluster 14
atcaatctccttcaaccctcttctcccaaacaaggcctaagaagaaaacgtggtactgaattgaacaaaaacacaccaaaacggactcctagatagccaaagtaagtcggtctgctccaggttcgagggccggcctggctgggtttgggccatagccaggtttaatctggcctggccgggatcaaagtcatcctggtttagacagaaacctagtacgagtatttttcagaaactgaagaagacatgaacaaagccctgttccagaagctgaagaaatggacagcactcagcgcacgtcaagactgaagagctagcggatcgttcgtaagtctcctacgatatatatttagtcaactttgatcggttcgcctgtccacgtcttctccgacgagcagcagagcaatcgcggcccagctgcatgcgtctctggctaatctccaactattattacggtagttgtttgacttggttcagatcagcgtccaaagtcttgatccagacctcgtttctggtgaccgtgcgctgcttcgtatacgcgcctgctcggtctctagcttagagacgtacaatgtacgccgacgggcaccgtgcgcggctcgctcgccctccgcctggggacgcccggcgacgacgcgcgcgtgcgccccgccggacccgtcagctgagccgttcatggcgtctgaggtggtaatccgtcggagtagtcatggcccgccgcacgacgacgtggacgacgccagttagcatggtgcccgtgtcgatcccggcccgcggctcgccgggcacgccgacgtcgtgcaacgagaaggccaaggtccacgtcttcttgtcgccactgggggacatgcaggcggagaaaatccgatgcagaacatgcagatgatcacggggatgtgcatgaagagcatgcggcagttcaacgagtcgctggccaagatgaaaatgtacatgaggaagagcgcagcagttcagcaagtcgtcgctgggcaaatttatttattattatgatctacaagtatattcctctgtcaatattatttgctaattaagacataagttaacatgcagtttcagattttagtcacccctatagacaaccatattgcagtttggtcacaaatattagacgattaaacataatagtactattaagattcagcatcatcgtccttctctaacataattaccttaaaattatatttctcacagctacatatttatattatcatgactcttaatttattgta

SEQ ID NO: 2554 - DNA, 1342 bp, Zea mays
  misc_feature (1)..(100): optimal_loci_94313_G1, chr3:11208658..11209999, Cluster 14
gtaatgcatggacgatgcaagtcaactttggcatgggttgcactcacatccatgtctcatgacatgtggagtggtaaaaggttgcagtactaacttgtgtgcagatcaaggaagacgatgctcccggtggggtttttttttgggcgcttgacttccataaagaaatggagtatatagcgtatactctttccctagagggggtgtatatgttcggaagcacatctgttggcacgttacaacagaacacaacatgcgtcgtacactcctctgcacgcacgttacaacagaaatgtagggacgccactctaacaaaaataacaagacgacgacgacgggagaaaggcgctagcggcgcgcggtagcagataaggcagccaccccaccaattccggggtcttcataatgtgtagtactagtaacaaacaaaaacgaaccggaacagcatcgcaaaagagtcgtcatcgtccactgggcttggctacgagccaagattggctcggaaacggagctgtgttcccgggtcgcaacagtccacatgggaaaagcaaaaggaggaagtgacccatgctgcacaacaagcggagttcgttgcagcaatacggagccatacggggctcatgctcatcgctcatgaacctgaccggcaccggccccttaggtttcgtcaccaaccgacgacgtgcttatcttcttcagctagctcggccgtactatgaacctgtgtagctaagctagctacgtacagcgagaatgcgagatgcatgtctccagtcagatactgtagtacaagccaagcctgactttctttgctgaaggctgcagagcgtagggcgtagcgtagctccaattcccctgcaatcaatcacctttcctcccgcccgactctgctctgctcaaaccaaatcatcctgcaccaaaagcaaagatctagcctaggcggcgcttgtctcttctgtaagcgcgaaccaggatcggaggggagggcgggctgggccgggccccacacgccacgcagctagcaccagtggcagtgcacctgcccacctttttcttcctcctccggcccgtccccgaaaggcagacgaagagccacctaagccaaggtgaaagtgaaagcagcaatgcaagaagacgcatatacgggagagctctcatcaatcttgtcaaccagcagcaaagcaaagcacacacacccggccaggccagccgaacaaaagccgcggtaaaaaaagggagggggccactcgccgttactctacttctgtgtctactcttctgcatcggctggctgacctgactgacacacacaaagcccgtaactgtcaaagcatacaaggggata

SEQ ID NO: 2555 - DNA, 1295 bp, Zea mays
  misc_feature (1)..(100): optimal_loci_96164_G1, chr3:21556820..21558114, Cluster 14
cacaccttaagctgctccaggctccagctgagtgttttagggcttaagtgcagacatctaactgcattgagcatagttcattactttaaacagcatatgatgtcaactattcgtgtaaatagagtaccggtgccttaagtataggtctctctccaccagccggatacactctcattactgaacttataagttttagtttgattttttgttacaaccagtacggtatttatgtttatatctgaagaatagcaatattattatataatgcacacaggtttgtaccgttaaaatttagcaatgttattttgaataaaattgaacatgaaaaacaaaatccagctgcaccgtcctgcatccgccagccgcctcctgttccagcgccagatcgcccggcctctttcgcgcgcttgtgcgcccatgcgaggccagggaagtggtagccctaaaaccggccggccagccgcagccacgctgccgagagagagtacagcggagagggggaccaaacagcggggagggagggaggagggatcaggacatcaggtcgacgggatggatcgagacgagggcggaaagcgatccgagcaaaggcaagcaagaggcacacaggcactgcacgagcgatctgcccggcgctcatgtgcggcaacagggggggcgtcgtcaatcagtcagtactcgacagtgctcgccgcgtttcgcgctgtggaggagtgtggagtctggatcagtacagtttgtagccgtggagagtactcctacacatgcttttgttttggatgcaagtacgtacgtactattcgcattttggtagtgcagattttggagttcagctcttggtttagcacagttactcgcaggttgtgtagcatgtgtgacctgatgagcagagcttttgtgacgaacatgtttttagttgcgtagggcttgacagcgtgtgtgtgctagacgctttgtgctgcctgcgtgcgtgcgtgcgtgcgtatggcgtatgcaggctaggcggcgctacaaacattttagtagcgtaggtaggcagttgactgatgactactacgcaacacggggatggatgaagccggttggagtctttttctggcagaaggtgggtctcaggagtcagaggagcggatggataaaggcccaaaggctccacgccaactgcactccagctccaggactgtggactgggatcattggctgcgcttggctaaccacttcactgtgtcgatccaaggcattgttgcatagcacagcatgtgccgcatgctctcggttgcgtgtgccatagcttt

SEQ ID NO: 2556 - DNA, 1046 bp, Zea mays
  misc_feature (1)..(100): optimal_loci_9852_G1, chr1:52351562..52352607, Cluster 14
tatctcgtacctacacacggccgattcgtcgtcccatgacgaggaaattaaccaaacaaaaaaaaagaaatctcgtacacaccataccagacatatgcatgctgcatgcatatgcctaacgccgccatataaaaacagctagcgaaggatgcattgaactgaatggacattttgcttgcatcgcagcaaataaagcagtgcaaagaacgatgattattctcgcgctcgtgcagaggttcctggacacggcttgcctagctgtacccgagcggacgtgtcaagcgctgctgacgccggcgtgctccggcgccggcaggcggcacctgcccctcgatccaccgccccatgtagcctatccgcgaggaaagcacgtcgatcgatccctcgccattttgcatcgaggcttgccttggagagccttggatcctgtacaaacgtacaatctgcatgctgccggtccagcgtatgtatgtatgtacccttgttggtatttcgtttcatcagggctgcaggctcttcacgtacgctggagtattcggaagtctctcgatctgggcgcgagagagcaaggcagagggtgcgtggtggtgatccagttgtccgtgcgtgacaacgcggcgggtaaagaaacatgtcggtcgggcggtgtcctgtcccggcacgtccccctcctccggcgctccgcgcgttgattccttcgccaccgcctcgccgaaccgagtttggcgtcgctcgtcgagggcctcgaggcaaaggaatccgctagctgcacagcacaccgggtcaaattgtttaagactacatatatattcttcacccggcctgccgcgttgaactgaagaccagcagtgagagtgagtgcgttcttcttgggctcttggccgaagtgtccatgcacattgcacagcctccatcgccagctgtcgtcgcaagttcttccttcgaccctgcctaatcaacgtggagaacagctagtggccaacgcacaatttgcgcatccagcggcgatactcgcgtactcgagtaattcttcctcaactattgac

SEQ ID NO: 2557 - DNA, 2349 bp, Zea mays
  misc_feature (1)..(100): optimal_loci_162531_G1, chr4:189896984..189899332, Cluster 15
gtgtggcggcttaggcgccacaccaaacacgcccctaatccatcgtccgcgcagcttattgtatccgtagtattggcaataatagcatatttgcacattgaccaagaccgctactatacagttgaatgcaaatttaattgttaaacatgtggcaggatggatgtatactactatactagttctagatatatctataaactacacgggcggtcgttcgttggcagcacggtacatgcactcgcgcgcggccatgaattttgaccaaaataagtgcgtgatatttaaaagatgaccactaccatgcatgcatgcgagagtactagtaccagtagggaaccgatcgaaccacgcagcaggtccttttgcaagctcaatcatgcagctcacctgcattgctaatgtgggtttgggtttctctccacgcacgcacatgaatgatttggtatcttgtgggaggaattgaatacaggataactcaaagataagggggacacatgctattgctcctggttttgtttattgctgtggtctcggcttctccccttttgccgtacggccatgcctgtttggccggagctctcctcattcatgcatgcatgcatatgcgcgcgggttgggctgaaaaccaacgaacccttgagctagctaataagcgccatgcatgttactcccccctcccccccctgttccttctcccgaatgcatgcatatgctgcccctggaaatgtgcaatcaagccttgcccatttcgacctttgattattgaatcatgacattcattttattattagcgtctggacaagggacaaggctaacgcagcagtactctttctcattttaaattgcaagttgttttagtcttacatgcttgtttgatgcagcttgctacgggctttaatccagctgcggctacggctgtgacttctacaatattttgtctttatggattacagttgcaaggctttaatccagctgcgactgtggcttctagagtatttattttgtttatatgaattgcagccgtaacagcctgactagctgaatcagcatgacagccgaactgcataccaaaagctatatatctgacactcataaacttgaagtgtggagacagcataccagcagatctgccatcgaaaaatgcttactacgcagttcttgctttgaaaactctgcgcgcgtctgctagcaggatggatggatggacgatgcatgcatcagtgtcatcagctgcacgagagtgaaagcgtttatatatatacacacacatacgcgcgcgggtgccatatgtatgtggttcctgcatggctttggcaccaataatggctggcgggcggccatcacatcatgtgtctatcattcatggccaaatgctcgcgcacatcacatcacatgcccgggaaacctatgaacggcgacagtatctcgcagtcatattgggcgtgtggccgtgtggggcaggtagctaggagaagaagccaagaaggagggtagttgcctgcctatgcatgcgcatgccatccgttgctagctgcttgctgcctttcgtacgtacgtgaggaggcaacaagctatagcagcatcctggagctaatagcacatcttgcgaagatctcggtcctttgggtggcagggaccatcacttcacttgcttgccgccgctgtaggctgcgggctgcgctacacgcgaggctgctgcctgcgtccttttccggcccttttcactttgtaccacgttgatttgtgaagactgcgagagagtgcgcggctgcgcgcacagtgactttctgtcatctctctggagctacttactaggcggcggctatagctaggcgtatctcttcttcgtgcgcgatggtggtcgtggacggatgaactgtggtacgtttcgcacttggaactggcaggcgcctttttttttctcaatctcgtcttggtggtggtgtggtgccggctccgtcgtctcattcttttcgcttcgtgtgtcagagcgagcattggagaggggcgaaggcgaaggcctcggtgcccggtggtggtggtgcagcagagcggaagcaggcggttgtggcgaggcgtggacatgcacagtgctggaatctgtacgtgcgtgtttgtttgtgtgtgcatgacactgtggtggctcgtggatgcatggtgggcagccccgtggccatgtatgggctcatgcctgcctgctgagaacaaaagcggtgattgcccttgttatacacttatgcaggcttagcggatcttatttcatcctctattttaaattacactcttcaaataatgacttatatagttccacgtctcctattttatcctatctctactgtagatagcctt

SEQ ID NO: 2558 - DNA, 2962 bp, Zea mays
  misc_feature (1)..(100): optimal_loci_1122_G1, chr1:5646473..5649434, Cluster 15
ttgcttcttcatatctatcagccagatattttctgcgcttcgtcgcgtcaggcgcgcggcctctagcttcctcctccatgactgaattcatgctccatgcatgcatggaccatccatttactagctagctcgctcgccgatcaaatgaagtacacactagcaactcattcatgttcgtccaaaatgaagtacatcatgcgccgcgcttttccacctgtcatgtcacacactgcacactccgtggccggccggccggcgttgcgctgttagcttcgtccccgtcggcgtgccgcccggtggtgtgggataacaggaacagcagaccggccggccgggaaggctgtaacggcacgccatgttctttgtttttgtgtgcacaccgtccaccaagcatgcatgtaacagcatttctccccctctaaactaaaaaaaggggggcacgtaacgtaacgaataacaggataagctagcttatcaggcagctgttatacgtacgctagcttgtggccaccgattggtcctccgggtatctatatcatctgttgctaatcatgcatggccccaccacccgccggtagccagcgaggccgcctctacaaactagctaggtggctgtagagctatagctagccagctgcttctatcttactactcgtacttgtattttaagctatctctggaaatctagcgttattctatagctacaggtgtcgtagcgagtgcagtacagtagtatactgctaggcgacagcaacatatatacagcaccgtcaccgtaaagcagatcgatgcaggcgtacgtgttcgtccgagaagagaaaagggtagccaagttgcagcactgaatctggcgctgtctgatggggcgccggccggccggccgccaggaccctaccatgcagtacctctcatcctctgaaactggacacgtacgtagcggcagctgatcgtcgctgtctcggtcttcatcagggcaagtaaaaggagggccgggctttacgtacaagatacagcagctggtagctagagctagtatgcggcacgcacgcacacatcttcgcgtcgtccttgcttgtagtactcgacggcgctttattagggctacgaggatctccacttcgcaatgtgtgcgatcgcgcatgagctccttctgacagccggttggtcatgctagctgttgcttctgtacgtacgtgtggcatgcaggcatggccgcatatggctgcaagcttgcaggcacatgtacagctagcgatcgatcgcgaataatgatggggtattggggtgcacagcaggtgcactacagatcgacgtcgtacgtacagggactgccatgggcatgatatgtggtgcatggtgtattggtgtgcacaggtgcagcgcagagccacacacagctatggcttcttcttctgcgcgtcgtcgttgacgcgttctatgcatgatcacgcagggattcagaaagcaaggctgtaaatatctagctgggccatgcttttccggcgatgcgcgacgggggcaccgcaatgcatggatgctgatgctgttttctctttcctgctgcagctgcaccagcagtgactgagagctccatgcaccggtggtggtacttgatcgcagctgcagcggaagggatggaccagaggagatatgcgtgcgtgaaagatggatgcacggccgatgaaaagctcctgcctgccgccgtgacccggccgtgaaggaagaacattttcacgttatggcatgcgtttcggcaacaatactactcgagtgttgtggtgtggtgtgtgtgtgccatgcatgtattgggctatgctacgctacgctagtagtagcagctaatcgttgctttgtggttcgctttcattggtgggccggcacggcgcgcggcggcggcgccgtgcgtatctatgcacgtggttattattatggtcaccgcacactacacacaccaagatatttgtgtagtagtactatacatactccagtgtgcatgagcccagaaactttggagtcacgagtcactgatcggtcggaccattttgcgtacacgtgcatgcaagtgccatatcctgccagaaacaagaagatggcataaaaatgcaggagaacaggaaccagagatgcatggatcgagtatgtgtgtagcgtgccgccatacatacttatccggccggtgcggtgcggggcggtgcgccggtgcggatggggacgggcgcatcgatcggctggccgccgcccatgcactcctcctacctctcctcccatcccatgcgcgcacgcccggcggcccgggtcggaccgaaagaccaaccgggcggccggcccccatacgcgcccgcccaatcatacgcagcgcgctcgctcacggtcacggcatgattagccccggcccgaacggatcgatcgatcggacggagtgtgcgcaacgcgcaatgccagcgcgcaggccccgccgccgccgtgcgtgcgatgcccgcgcgcgccctacgtgttgcgccctccgcgtctcggcggcttgccgcgccgcgcgcagtccacaatccagccacctggcgggccggcccgcccgcccgcgcacaatcatgcaaaactgaatccacagcgctcgctccgccggctcggttaaactacgagcgatctgcagtagtattgatcgggcacctttagcgttggtccatcagtatcggtttctttgcatccggcagtgattaagattcttaaaaaccgacagttaatggtcacgaattcacgaaacatgaccacaaagcaactatcctccgtgacttctacgcgaatctctttggcaactcctctcccaccaattggcttttcgaccttgttgctctttatcctaaaaaggccctaattaataccgccctcgatcgcccgccttgatgcttctttcaccaacaccgaaatggacgacgctatcaagcttatgaaaaaaaatggacgacgc

SEQ ID NO: 2559 - DNA, 1902 bp, Zea mays
  misc_feature (1)..(100): optimal_loci_117865_G1, chr3:159800094..159801995, Cluster 15
gtatcgctgttctctgtcaggcaactatcgctgccatgcaacccgatatgcttatccgtttgatagcagtagtttctctactctacaccacacccatctatctatcttgaaagagttcccgtgtgttccggatcattcttctgtcgcttgcctttttttttctgctccaatgatgatttgtctccaaaccagcataacacctgcgtgcgtgcgtgcgtgcctctaacctgaaaccatgcggcagtcgggctcatctctttcttcatcatccatctccgagaggccgatgtgcatgcgactgacgacgctgttctttgtgcttttaaaagggtctggggcttccataatagcgttgacactgcccctgagtagagaagagttgcgtgcataagctaagaggagcttattgtagctagtagtgtttcttttattggggtggaccttcagctttcagattaattaaccactatattccaaacatcaaggttcagtgcagcaagctatatagatatttttctccaataatccatatgtgcctgccctctccgataattaagtcgaagaatgattggaaagcatgcctcgatgactcgtagaaataggacgctctaaatccacaagcaaggcaacatcagacgcacaactgtccccgactcacaaatagtacgtcacatgacatcctccctacctgcaactgcaaatacacgccaccggaagaagcagcgagcgagcgagcagcatgcatccatccatccatatgatcgtctatatatctacggagtataattaatacaatacacaaggacacgaagctaagagcgattaggctactagcaggtcttgctccgctaatcgccaggttataatcagcagctagctagcaggccggccatgccatcttggcttttccctctccctcacgctaacccacccgacaacagtgttgacccgagcgccctaatcatgcagccaacccacgcgcgccgccttaaaccggtcccgacaacgctgatccgcattactattatttttacgccggccgtgacaccacggcggtgcctgccgggctcgcggcagctgccggccgttgatgagttgactagcggtagactcgccgggtactcaaccggggctaaagagtaccggtaaggtcgctgtcggcgaactgcgaatcgcccgccctcatcttctctgcgcagtcagcgttgtcggaaacagcgtcttttacatcgtccggcccccttgtcttggacggatgtcgcttgttgcgttgcatatgcgacgttaacgtctgacctagagctagctgtgtgtgttttattatcgaggcagggaaagtgttcctcttttcctgccctccaatattaacacacttttaatcggtaacaatactaatgccggacccggaccgtacgtgtgcactaattgttagagataaagatggaataggatagaaaccaacctcttttctgtagaagtatttttttttgtcttgtcttttgaaacggtttctgtaaaaaagtatttgttcctatatactacttatattttacaatagatatagacatatgcatatgctagttgattactgctgccgagctggggatttgcggagacatgtgtggcgcgcgggacacatgagcgtacgtgtgcatatgttcttcagtagtagagagcatctgtggcccgatatgatgatctgcacctaataatcgatcctagctaggttgctttcagaatttatacctccgggccaccccttccacggctgcgagggagaagggatcggcacccggttccgtgctgtgacttgagaaaatggcatgttctgggcaaagatttcaacgtgtgcgatctacgattaaccctgtcgccgatttaatgattacttggaacgacaag

SEQ ID NO: 2560 - DNA, 2178 bp, Zea mays
  misc_feature (1)..(100): optimal_loci_118682_G1, chr3:165167284..165169461, Cluster 15
ttagcatagtatgtgtattcacttttgtgttcgcatagtatgtgtatacacttgctctgaaaatttacacagccatgtctccgcgggaacttttatggtataattattgtcaagaacattagtgtcaaacacagtcaggtccttgctttctttagcatagtatgtgtatacacttgctctaaaaatttataagacctgactgtgtttgacaaagtttcaataaagctaccattccagtcccccagatgctcgtcaagcaagcaggaaaagtgttgataattacttgccgtacaaccagggtgtggccgagcactagtgcttttgaggagacaaaaggtccactccatgaacgaacaaaaaaaaaaccacgagaaaggcttcttctcgttggtcgacggtactagtaccgctgctcctgctctttgttctagcagtaacctggccacaaatattgtgcacacaaacaaatacacaaagcccattgttgacgagacgaccgatcgaaagcggcgaaggagagagcctattgttttatggaaccaaggaaggaaggaaggaaagcgaggtagctagctagcaaagatgatggatggtttttgcatcgtgttgtcgtgtgctcgtgcaaggtctcctcggttgcatgcatgcgactgtctgcccccactgtttcgagtcacaacaacacaggggaggggggttgcctcggaattcgcgggagggccagaccaaacgccaccgcgcgcgcgcgcgcgcctcggtgaccccgaaagcgcccgcaaatcgcaccgcttcccccgggaactgcaccggccgtgcaataacacttgctccgatccatccggccggcgggccaccattttttctgggtggttggctttgtctcacggcgcacacagacagacagcatgcatgtccaaaaatcctactcatccggaaacgctcggcctcgacaggcgacactcaccaataaactacatactcggtcgatgggtggtcgtcgtcgtcgagagtgtcacactgcgtacgtgcaatgaacatgggtatatataatatttacttccccctcctccatagacgactactactgtgctcatgctgtgtgctgcattgatctatctgctatatgcacgcgtgtagtacgtacttacgtagtagtactacgtacgtacgcacgcatgggtagctttgcattgttgcagctgcagcatgcagtggccagtggcagtgtttcgagacgtgtctcctccactccactccacctgcctccggcggccgtggacgatctgtgtcgcatcgttcatcaaaatcattgcatgtgatcgatcgatcagctgggtaatccactggcctgacccatcaaggatgtaaaatgccgtacgacacacacacacaccgtattctatggtagctttgttgtacttgcattgcatgcatgcccagcattgctcctagctttatattgctaggactaagagtagtagtttagcctatatagtaagagtagtatagtatttcattagcacgaacgtgtactatgtgtcgcttagtctactagtctaataagcgagaggtcggtcaaacggagccctacgaccgacgcgcacccacacacagctcggtacccgtttctatcgtgctgcgaccgatatgcaatgtgcaccctcctaccagtactactacccaaagcggccaacgcatgcatgctgtcagggtctgtggcgtgggcccaccaaggccacgccagactggctcatggccccgcacacagcgcgtcctgctgcagcgggaacacatgaaatatagacaagtacatcacccgcagattgctattgatacgtgcatctaccaagcgcaaacagtagcggcggggaggcgcgaagcataattggagccgcaggtcagcacagaggtagccgcccacaaaaagtgtgtacaggctgcttcacaatactacatgcatggtttcttttgtatttaaggtagtacagtacctattattagaggtgttttcctgattgcttgttgatctcctgtttgtgtgccgagtattctttattctgtggttttttatttgaaagtgtacaagaaaaacttatactctatgcaagaaagatcatggaccgttacagctagctgtatgcaaataaaaggaccaaagtaaaataattcaataatgta

SEQ ID NO: 2561 - DNA, 1524 bp, Zea mays
  misc_feature (1)..(100): optimal_loci_118788_G1, chr3:165870097..165871620, Cluster 15
tgaagttttaggatctccagtatgtgtcgatctttttctagtgctgaacagaagcaattcgtgtcctctgtattttactgctactcactcagctgggcatgcattattttaatacttcgttgctgcgatttgggcagcgatgatatatatatatagtcactagcccacttgccgctgcaaggatttagtggaattgtacattaaaaaaaaccccggaggccaatctgctgcaaaaggcaacgagcaagctggagaaaggaattatcagaaacattatcccgagagctagccagtgcttgctgtttgcaaaggcagggttttttttttcttcttcttccaaaacaacataagtgcggcaagacaagcgccattgactgctcatttcttgggcatgcaatgcagtcgtcggcagtcctggctgcttgccccaattatacttgacctttagatcgcaggaagtaaagccctacaagcactaaaggagccagctgatggcttagaccaatctggcaagttctggagcaggatggatatatacgtatttctttacatcttcttccttgttccttcagggttacactacacacaccagactgcgactcacacagttgcctaccctaccaccagggctcaaagcgttgcataatttaaacaatcatttcagcgccacttcaaaaggcagggagtgcagcccatgtgaaagtgaaggcaccagcaagtattccctactaaaatgcagctattggctgtgggaaaatgcctttcagataagacacgcgcacacacacacacaaaatttcccccatagccctagaaatgctttacagaatgctagcaaaggcacacacacacaaaatttcccccatagccctagaaatgctttacagaatgctagcaaaggcacacacaacacaaaatttacccctagccgcccctagaatgaactgctttgcagaatgctagtgaaggctttcaagggcactgtaattggggtgtgtgttggtattctgctgccttttcctatagttccccccacacaggcatgagaactgttcccctgtcatgagaactctcgttcggcatatctgaacagaaaccttcaatgattaagctcctcattggcctcacgccttgtggcctcgctttgcgcatctactgctgacagacgacagacaattcagcgtagcatcgagtttttggagtggtagtgttccaatcaggggccttttgagtcactactctagcaaagtatagtcactaccagcacacaaaacacaccccgcgtgaaattcggtctgttgagctgctcctgaggccgaccaaacacttgctgcttctttatctgatctaagctactagtgtctttcagttacaggcacacttcactggcctgtggcagggtcaaggtcaactctgccgccggtaagctcacaaagaccggcgtcgccaaccagcagatagatctccgcttcggaaaaaaaaatagatgggtcatctacctgccgcagcaaaagcaggcatcaa

SEQ ID NO: 2562 - DNA, 1688 bp, Zea mays
  misc_feature (1)..(100): optimal_loci_119626_G1, chr3:171020826..171022513, Cluster 15
ttgaggtaacaccttggaaacgtattgccctcttagttgttttgtgcttgaaacttgtgtagcaactagctaggaccgagccggtcattcatggctgtagcgacagacgcagggaaaactccatctggcttggtgccctcgctcgctgtcaagagcatcgtctcgacatctctgctagggcgtgtacaacatggcgccttgctcccggtcccgacggttggtcgcgagcgtacccggccggtagtagggctgcaatgtgtgctgtacgttgcccgggacgcgggtcaagccaaatcagccggcgagaactttgccgaccgtgccccaccgcggcgtccatcgatcgggaagactgtgtatagtacgacaacgacgacgacgacggcattcagtggcaaaccctgcgcgcacgtcccgggaaatggccgggcgggccgacgggacgccgcgagatcgatggatggatgggaatggcgcgctctggccggcacggcacccgatcgctcggcgccgcggcacctatcgatcgagcgcgggagtggcaccgtcgccgtcgctccagactctggggtacacgagtccagcggacatgatggcgctgctgctgctgctgttgtcggactgagtgctgagtgccacccctctctggggtacgctttgttgtgacaagggaccgagagctcctcgtactggcaacaaggtaccatggcatgtgttgcttcctcataggatgcctccatgtccttaccgtcaaatggacgcagactcgacttctccaatgaaagttttagggaatatatggccttcccaagctgtcgaaaacgcagtggctagctaggctaagccatgcgcatcggataacctctatgcatgcaagacagtgaggacgaccgtcgcggcgtaatgaagagggtcacgggaacgcttcgccagggcgcgaaaatggtcgccgaagatgctgacgatgagcgcgttggacgacgacggccagtcaagcacgaactagtcgaggggattgcagtgcagccggaggtggtcacgccgtctgtgcactgtatccttgcgcacgttgaagcccacctcgtcgtcggagtacatcttggcctttgtggggcccaccgcgtcaactaatctaaatcaggtgttaatcaacattgaccatccctttccaagatcttattgctagatccaccacaaatcaattatcaattattgatataattccttatcacgtacagtatttagaaagaaatgatatataagttacaacactattactactactagtactacaataaataaattttattgacataaattaaaaattgacatataacccacattataaaacaaaatcgtcaccacttgtggcacatatataatgagattactagcacataacttttttattatataaattagtaagacaaccattatcatgtaataaaaaggtaaaccaagagaaggttctaatgtagcattagtgacaaatccaacatatcaagagagcttttaccgagactattacatgactttttttcaatcatactatcccctttattatgtacatattgtaaagtactagttccaactagagtcaaacaacattttgtcaaaatttagatttagatgaaggcattcgttggggaaatcccgataatgaatttgtacggtgtggatcgcgagat

SEQ ID NO: 2563 - DNA, 2903 bp, Zea mays
  misc_feature (1)..(100): optimal_loci_120710_G1, chr3:178039535..178042437, Cluster 15
aattatactcggctttttctctggtactactagtaggtatacaaaaggcccaccacaggttgggtagggtagggcagtaatatctgagaactagctttgccttcactagcaagtactacttagcaaccagaccaggctgctgtatccttcctaccaaccacccacgaaccagaggaggattttgttctcaagacgtggactcgcttggaaaaaaacttctcggcggtttctaccttttcgcccccgcgtagtgacggtacaccaacctctggaaaaccgattggacttgaagttgatccaacatcagaccaaaccattcgggggttcctttcaaaaccgcgacgtgcttacacgatctgtcaaggcaagcaacgacgagagggggaaaagaaaaccccatatgctaattgacaagacgagaagcatcgatggatcgcgatgaatgaattcggagcattattgccgtgtatcaacggagaggtggctaaccattttattgctcccggggtcctatctccaaactcctatggctggcactgggcactggcaccaagcaatcctgcaagagatttgctctgttttttttctctcttctttctcctttccctttccgctacgcgctccaacagacaaaagagacttgtggagaggagaggcgcccagatttgcgccacacctggggccgaatccagcgcacgcacgggacgggagaagggggcagggcgcaattcctgcgctgcacgcacggtgcaaccactgggtggcgcgcaccactgacaagacacaagcgcatttaaacaacggcgatatatggccatgcatgcctgcccgtgctcgattatgatctgcagagcacaaagcgcagcactacagcagggtgcagctagctacggctacgagtgaccgagacgccactccacttgcgagcgagctcccggcggcaatgccaatgccaatgccgacgggccggcgacgggcagcaagcaacacagcccactgcccaccacaggggggaggggggacacaatacggcacccgccgcgctccactaccgtcgcctgtccccctcttgtctgcccctggggcgtcccaatgcttccacggtttagaccacggatcattgcctgcactagcctcaccggacaggaacatgtcacctccactgcgcctgccctggccggccgccacccaccatctacgctgcactatccgtccatccatccatccggttccctgttccgtagtgcgcgcgcggcctggacctgggtagggttcacggtgccgctagtgtaaataaagcgacgcgggccaaaggaaaggatcggtacgtgcgcggttgtggtgtcatagcactacacgaagaacaccggtcaccggaggcttcctcctttccttgtcgcggctccacagggctgggggttgggggtgtcgacggggccagccaggttgcatcggtttccggtggctgtacgggcaccagggcgcagcgaaacggggcaggcaaaggctggccagtagtaataagtgcgcgattcgatcggtgtgtgtttttgctcgttgcgccggcgagttatccggcggccatcatcaacgcctgggtctgggggcacgcatgcatgcagccaccaccagcgccaagtggtgcatcggaaagccttaatatttttattataagaagaaaaatgcatctctggcataatatcgaggcacgagtaaatatacaaagatatcaatatttatacaccaaaagaatatcgtaagtattggcatcattttctaaaatgtttgactagctagcaataatagagctgtagttgcattttctttttctgcacggcagtaaggaatttgagttggactaacgatgtgccgaatgtttgtatgtcatcatcttgaaaaaaaaaacacccttccatatattcggaaaagggaatttctccgatcacggtgactcgctcgctcgatgtggaagaacatggctgttagccttgagccacgccgcgctacactacacaatagtagtgcttatcatataccgccgtcccgaatcctccaaggtagcggatgcaggatcgcataatagctgctgacggcgaccaaaaattatgcccaccactcacaaataaaacaaattaaactgatgaaacgaccgcgcgcggtcgcatcgcatcgcatgtgatctgcgcggatgtcaaaaggggctgagcgcacgccatcgccgtgcgcgcgtctgcacggtaacaggatttgactgaggcgaggcgatgcgatgcgagaatcctgccatggaaaccatcccccgggaagcaagcgctagggggtgaagtgacagtgactgggtggcgtgtttctttagaggctgcttggctttgggatttggatttggttgtcacaacaaccaaacgtgggatgcgtatgctcccgccatcccacggagaaaagtgttactacgtgcataagatttgtagcccacattaaatttcagttacataactcgcatgtcccttggaaaacactagttgatcatgataaacagacagccaataattttatggtgtcttttttaaggacaaaagcaagtaagtcttcttgtctaacagcgtctccaccagattaaagaacctcctttctaaaaaaaatacaatagtatatgtgattttaaaataaaagtggagaggataggggagatgctgccctttccatcgacgttgtgcgtgcgcatgtcaatagctcccctctttctgtgtcgcggacgagcggccatcccatgcggctggcacggtggcgactggcgtggtggactggtggtgcggccagcccgcgcgcctaccatatgatcagacaccatgtcagacttacaaactcgaggacagtgtgcgagagaggtggatcgattattaaat

SEQ ID NO: 2564 - DNA, 2469 bp, Zea mays
  misc_feature (1)..(100): optimal_loci_120777_G1, chr3:178292366..178294834, Cluster 15
  modified_base (36)..(36): a, c, g, or t
  modified_base (37)..(37): a, c, g, or t
  modified_base (38)..(38): a, c, g, or t
  modified_base (39)..(39): a, c, g, or t
  modified_base (40)..(40): a, c, g, or t
  modified_base (41)..(41): a, c, g, or t
  modified_base (42)..(42): a, c, g, or t
  modified_base (43)..(43): a, c, g, or t
  modified_base (44)..(44): a, c, g, or t
  modified_base (45)..(45): a, c, g, or t
  modified_base (46)..(46): a, c, g, or t
  modified_base (47)..(47): a, c, g, or t
  modified_base (48)..(48): a, c, g, or t
  modified_base (49)..(49): a, c, g, or t
  modified_base (50)..(50): a, c, g, or t
  modified_base (51)..(51): a, c, g, or t
  modified_base (52)..(52): a, c, g, or t
  modified_base (53)..(53): a, c, g, or t
  modified_base (54)..(54): a, c, g, or t
  modified_base (55)..(55): a, c, g, or t
  modified_base (56)..(56): a, c, g, or t
  modified_base (57)..(57): a, c, g, or t
  modified_base (58)..(58): a, c, g, or t
  modified_base (59)..(59): a, c, g, or t
  modified_base (60)..(60): a, c, g, or t
  modified_base (61)..(61): a, c, g, or t
  modified_base (62)..(62): a, c, g, or t
  modified_base (63)..(63): a, c, g, or t
  modified_base (64)..(64): a, c, g, or t
  modified_base (65)..(65): a, c, g, or t
  modified_base (66)..(66): a, c, g, or t
  modified_base (67)..(67): a, c, g, or t
  modified_base (68)..(68): a, c, g, or t
  modified_base (69)..(69): a, c, g, or t
  modified_base (70)..(70): a, c, g, or t
  modified_base (71)..(71): a, c, g, or t
  modified_base (72)..(72): a, c, g, or t
  modified_base (73)..(73): a, c, g, or t
  modified_base (74)..(74): a, c, g, or t
  modified_base (75)..(75): a, c, g, or t
  modified_base (76)..(76): a, c, g, or t
  modified_base (77)..(77): a, c, g, or t
  modified_base (78)..(78): a, c, g, or t
  modified_base (79)..(79): a, c, g, or t
  modified_base (80)..(80): a, c, g, or t
  modified_base (81)..(81): a, c, g, or t
  modified_base (82)..(82): a, c, g, or t
  modified_base (83)..(83): a, c, g, or t
  modified_base (84)..(84): a, c, g, or t
  modified_base (85)..(85): a, c, g, or t
  modified_base (86)..(86): a, c, g, or t
  modified_base (87)..(87): a, c, g, or t
  modified_base (88)..(88): a, c, g, or t
  modified_base (89)..(89): a, c, g, or t
  modified_base (90)..(90): a, c, g, or t
  modified_base (91)..(91): a, c, g, or t
  modified_base (92)..(92): a, c, g, or t
  modified_base (93)..(93): a, c, g, or t
  modified_base (94)..(94): a, c, g, or t
  modified_base (95)..(95): a, c, g, or t
  modified_base (96)..(96): a, c, g, or t
  modified_base (97)..(97): a, c, g, or t
  modified_base (98)..(98): a, c, g, or t
  modified_base (99)..(99): a, c, g, or t
  modified_base (100)..(100): a, c, g, or t
  modified_base (101)..(101): a, c, g, or t
  misc_feature (101)..(135): n is a, c, g, or t
  modified_base (102)..(102): a, c, g, or t
  modified_base (103)..(103): a, c, g, or t
  modified_base (104)..(104): a, c, g, or t
  modified_base (105)..(105): a, c, g, or t
  modified_base (106)..(106): a, c, g, or t
  modified_base (107)..(107): a, c, g, or t
  modified_base (108)..(108): a, c, g, or t
  modified_base (109)..(109): a, c, g, or t
  modified_base (110)..(110): a, c, g, or t
  modified_base (111)..(111): a, c, g, or t
  modified_base (112)..(112): a, c, g, or t
  modified_base (113)..(113): a, c, g, or t
  modified_base (114)..(114): a, c, g, or t
  modified_base (115)..(115): a, c, g, or t
  modified_base (116)..(116): a, c, g, or t
  modified_base (117)..(117): a, c, g, or t
  modified_base (118)..(118): a, c, g, or t
  modified_base (119)..(119): a, c, g, or t
  modified_base (120)..(120): a, c, g, or t
  modified_base (121)..(121): a, c, g, or t
  modified_base (122)..(122): a, c, g, or t
  modified_base (123)..(123): a, c, g, or t
  modified_base (124)..(124): a, c, g, or t
  modified_base (125)..(125): a, c, g, or t
  modified_base (126)..(126): a, c, g, or t
  modified_base (127)..(127): a, c, g, or t
  modified_base (128)..(128): a, c, g, or t
  modified_base (129)..(129): a, c, g, or t
  modified_base (130)..(130): a, c, g, or t
  modified_base (131)..(131): a, c, g, or t
  modified_base (132)..(132): a, c, g, or t
  modified_base (133)..(133): a, c, g, or t
  modified_base (134)..(134): a, c, g, or t
  modified_base (135)..(135): a, c, g, or t
aacgagaaaacgaatcaagctggttcttcagaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgggatgattcagcttgattcgtatgtgcctggaacatggcgggccgggtcggacgccgtgcgtcagatcctgcgccagcaagccggtgtcgatattggaaacaccattattgccgatggttcagggctttcgcggcataacctgattgcccccgccaccatgatgcaggtgctgcaatacattgcccaacacgacaatgaacttaactttatctccatgctgccgctggcgggctatgacggctctttgcagtaccgtgcaggtctgcatcaggcgggcgtggatggaaaagtctcagcgaaaaccggttcgttgcagggggtatataacctggcgggattcattaccacagcgagcgggcaacgaatggcgtttgtgcaatatctttctggctatgcagtagaacctgcggatcagcgtaatcgccgtattccgttagtgcgttttgaaagccgtttgtataaagatatttatcagaacaattagtcaaaaagaaaccccggcacatggccggggcttcagattattgacaaagtgcgctttgtttatgccggatgcggcgtaaacgccttatccggcctacaaaatcgtgcaaattcaacatattgcaattctcttgtaggcctgataagcgtagcgcatcaggctgatttggcgtttatcatcagtgattaacgcttgtaaatgaactcaacgccttcttcgtcgtcttcgtcccagtcgtcatcccagtcttcatcatcctcttcagcaatctcttcaagctgctggcgatgataatcatcccacatgaattcgactttctctggctgtttcgcttcttcagcctgcacgaccgggttttcaatgataaaggtcatcacatcccagcagagatctttcacgcccagtccactcgccgcagagatcagataatatttatcttcccagcccagcgcctcagcgatcgctttcgctttctcttcggcttctaccttatccagcagatcgatcttgttgaacactaaccaacgcggtttcgtcgccagatcctggctgtatttttccagctcgctgataataatacgcgcgttttcaaccggatcggtgccgtcaatcggatcgatatcgatgaggtgcaacaggacgcggcaacgttccaggtgcttcaggaagcgaatgcccagacctgcgccttccgcagcgccttcaatcagtcctggaatatcggcaacaacgaagctcttttcgttgtccattcgtaccacacccagacttggcaccagagtggtaaacggataatccgccactttcggtttagccgccgataccgcacgaataaaggtcgatttacccgcgtttggcatccccaacataccgacgtcagccagcagcatcagctccagcagcagctcgcgcttatcgcccggcgtgccgttggttttctgccgcggtgtacggttaacggacgatttgaaacgggtattgcccagaccgtgccagccgcccttagcaaccagcagacgctgaccgtgtttggtcatatcgcccatggtttcaccagtaccctggtcgattacacgcgtacctaccggcactttaatcgtcacgtctttaccgcgcttaccggtacagtcgcggcttgcgccattctgaccgcgctctgcacggaaagatttttcaaaacgataatcgataagcgtgttcaggttctcgtcggcttccatccatacgtcaccaccatcaccgccgtcgccgccatccgggccgccttgcggaatatacttttcgcggcggaagctcacgcaaccattaccgccatcacctgcaacgaccagaatcgatgcttcatcaacaaacttcattttatgctccgtaaatcattcgcctgcgcggggttgcgataccaccgttgtatgcttacgtaatccgccccaaatacgatgaccaatggcggaatacatcgcgcccgcaaccacgacaaacgcaccgagataacctaaaaggtttaacatcggtctggcgaagaaatcgggccaggccagtgataaaagatctgaaaaaaacagcgtaaacagtggggtgagcgtgatgatcgcgctcacctgcgctgcctgccagcgagccatcgcttccgccagggcgccatatcctaccaaggtattcagtccgcaaaaaattaaacatgcgagctgccagtggctaagctgcgctatcactccaggctttgccagagggaagagcgcaattgtacataaagtgtacagtaaaaacaggatctccgttggggccagccgacgcaataaaacctttgcgccacgccataactcaccgacgaatctctagatcggtcc

SEQ ID NO: 2565 - DNA, 1639 bp, Zea mays
  misc_feature (1)..(100): optimal_loci_121239_G1, chr3:180583581..180585219, Cluster 15
aaagtatgcgtcggactgtcccccattccccaaagaaacgtgaatgaaggaaacatcttccttccctctctataaaaaaagacatactgtgcatggttttggtttcaggaatgacacgcaaagttcgaacctattattgttaatcctttcggtctaaccaaacgatcatgttcatgtatgctcgaccatggtaattcatcttatatatcgtctggtaatgtcatgccgtggtccttcaactgcgaaaacgatgtaacatgtgctactcagtttcagtacaaggtgagatcttgctagtagacaaggatacgaggtgggagatcctccatatcctgaaagaattgaaagtatgcggactctgcgtggacacgagcccggacaaaactcaaaagggaaaaggaacgtcaatctcaggtcctgccggcctccgtcgatccgtccaatgccttgaatgttctttaatttgtgaaccaaaccttagtaaaacgagaaggcgacaagacatatttatcctgtattctatggatcgtggaagggccaacacaacacaagcagttcaagttggaaacatattacatggacgcgcctgtcaacggcgtaatgtcgccgacgggacggaccggaagcagccgctctgcctgtccatgtcgcggctcggcggttgacccgttcgcgcgctcgcgcctgatctcgacccggtggagagtgtggatcaggcatccgccggtgtcaactccagagaggcctgaacccctgaacggcgggcggcgacttccggccacacgtgagaacaccgtgacgaaaacaaggagctggcagctaatgaacgtccgagactgtgcgctgcgtgctgccctgaccgtggcattagctcaagatgaaatgcacggcggctctgtcaaatcggtatgggcatcggccggagatgcaggtcgcgatgcgcacccgtgcagcacggtcaacaactagtggcgacgaaaaatcggcccctgggaggacgacccgtcggccggctgaggaatccacactgttgccggacaaggttaaatgcccaaaattcgaaagtgaaatgggggtgtcctgtctctccccgatccgtcggtgtccgtaccggttcctggtacgtactgagtgctccagcggtccagggttagccgtgcaaatccggagcaaagtacatttatgcagagctttttgtttagggccagtggtccagaagactgtattcgcagttcctgctggctgtttcgaacacgtttgtttgtttgatcagcaaaatcgtcgctgttcactgatacagggtttccatgatactgtatcatatgttcgggccttctcttagcactgtacaacaacgacagggactaattgcgcgcactcctcagccaaattgttcatatgatgatgtgcacttatcacttgtgtatcgatcctttcggcggttgggccgatgggtagagttattagggcacaaagacctcacgatcgtccttgctcacgttccactgctatagaatgggtcttgctgtcgtattttaatctgggactttttagtcctgatgattgcatgttttgatattggttgttgtctctaatatcggtttatagttcgaaacagatactacaagagttagatagt

SEQ ID NO: 2566 - DNA, 2043 bp, Zea mays
  misc_feature (1)..(100): optimal_loci_122515_G1, chr3:187010746..187012788, Cluster 15
ggagagaggacggtaggacgcgaaagtagaaactaggaacgtatgctagttcagtaatttattagtttattacacgcaatgcatggggaacctgcgtgcatatgctgtaaaagaaactgagttccggttccggtcaaaagaattgagttcaacagaaatgccaaaggtacgtaggcggtagaattgtgtgtgtgtgtgtgtgttttatacaagcggcaaaatattgcttgatttaaacactttgaggcaccgtcgtgtggctttgcttgcgtcgtgtattgtttattatgtgcgctataatgataaaaaaatagtaatgactcagggtcactaatttacctttttttccacagggagtgaggaatttatcccccgtcgaacgctctcttgctcaacaaagtgggggaagaaaataaagggatttcgcgtacgtgcgatgcgatcgtggtcgtaaaagctgcagcattagatccctgactgactgacaaagaaagttaccggcgcagcaggtacaattgcaaagcagtacagtataccagagcggcagcacaacaggcacgtactgactagacagcgttgtgtcgggcgggtagtttagtttgtttctgctttgcacagcaccagcacagcaatgaagggtaaaaactcgaaaagggactaggcaagacagtgtaacgatacgctacgtacgtacgtagagagagtgagtgactgctgatgcgtagcttgtgctcacttggagagtacacttgtactgcctacagtacaatggttggtcagtggtgtgagtgtgactcgggagtaatttatagtacgaccggcctagtaggttgattaggtagctagtagtacacgcgagagccacttttgcggccaggaccaggaggacgtgagcgattcagagccgtaggccccagatcttcgcgctaatctacaagtacactagtgcaccgcctgccgtcaaatacatgcattcgcctgctcgatcatcagtcactaccgtatgaggtccatcaagcatgaaacatcgggttaggttaggtcccgtccatgcggccgaccatcatcatcatgcaatgcacggggggcaccgtaggcaacagacagagccatgcatgcagaacggattatcgctgctgagctagctccctgcctgccttcccgagccagacgcgcacgcaacaggcacgggagggaaaatggtccggccgtgcaggattgaccctcaggtccccgactccggaccaagctggcaagctttagcttacggtgcacccccaacgcggcacggcgaggagtctggatggatggtgtctgccatcgtctgctcattcatttctgcctcgccgccactcgccagtgcgtcagggtgaaccgctcagcccgatccgatctgatcttcggcgggcgggcgggcggcaaccagagcccctggtatgctcaccttctgcttggcttgcgcgcgcttgggccgtcgcacgcacacgacgcggcgacggcgaggaaagaaagcgcgcggcgcggatgccggatggacaaggctaggggctagggcctagggccccacgagcgtgtcgcccgcccccttcctttttcccggcagcccagcgtggcgcctaccacaaaccgagggtccgcccccggatggcgtggggccccgtgccgttccgaaaaccagtcactggttcgctccctccgtcaggtaggcagaggcagaggcagaggcagaggcgggacagggaaggcgaggcgggcaagcaagcaaccggggcgaacatgcaggcctcgtgggaggcgcgcgcggggcccatatgcccctgcctggagctggtggtcccaccgcgcccatgttgcgctgggcaacggtggccctcagctagtactgtactgtactactgtacaccgcccacgccctggcggcccggaaccggaagcctctctctgcctctgcgggtcatggagacagaggcatcttcacagcagtcgcccccccggccggccgtcgaccgacgcgtgcctccccgcttgcttgcttgcttgggg

SEQ ID NO: 2567 - DNA, 1544 bp, Zea mays
  misc_feature (1)..(100): optimal_loci_123080_G1, chr3:190091558..190093101, Cluster 15
tccgacttccatcttacatgcactcgaaagtagttacttgagaaactagcgtagaatcgagatacagtctcggttttccagcctcaatcttatattcaggattacaatgttccaccctttgatcttggattagttaacttctaaccggggcttaggtgatctccaacggagaccctaataaatggatgtggatgtgcaaaatacgcgctcacaagcaacacggatgaagacgagaaaaaaaatgcgatgatcttcctcctacactaaattcatggattctctcttctaacagtatctatttgtgggtttgtatatgtgcgctcggctgcagaaaggctaagactatctccagcagatcttatatcttatccctattttaaatttatctctataaacagtgtcatgtacaattatgcgtcatctattttacacaatctaagggaagtatgttttaggagcaacagtgtaatctgttggtattatgcatggttgtgaaccagcacgtcgatcaaacacgtccggacgccgaatgtatatcggtatagggacgggcactgtgccttatttgcgccggttgttgctgtgttagcatgtcaagactcaagaccgggggccgcctccgcctatgttaacggcccgatcatgatcgatactgtgacaagcttaaaacgtctattttcagtggatggcagtatggcacttgctttttatctcatagaatcttgcgagatcttatgctctcttgtcgtgactcgcgaggcgacagtacggacctacactgatatgggcggataaaaatggcctgttcggatcataagattaattgatgaactaataagcgcgaccgggtgatcacgccaacacaatccatcaagcgtgcgtcacgatcgagcgagcgcgcatatatataccacccatacgtatcagtacgtcgcggtacgcgccacgcaccccccgcagcgataataataatccgggccggctggccggacaaaccccgcgaaggacgcgcgcacggctggccgtcggcggggcgggcgctgtcgtcgcacgcgacgtgccgggcgccgatcgaccgggcccccgtcgcgcgcgcgccaagctccccgcggccgcggctgagaaccccgagcgcggccgccgccgtccccgctccccgtcacgggctccacacggctccccgaggccccgtcacgggaataactccgcgacccgcccagtcccatcccgtgccggcctatgccgcccgccccgcggtccacggcctacagagggctacaagaagaatgtcggggcgtgtggtacgggcgtgcggtccctttcgcggccgcgcgctgcgacttctggcctccggccggcgacacgacacgtccagcgcagggaagtacgtgcgcgcacggcgcggaggttttttttttttttttggcttggttcgctctctcacaccgtcgcgcgtttcgtcgacagacactgccgcccgcgaccgctggcgctgggccggctctccgtgtcgtgtcccgtcgctgccgcggtcccgtcagtca

SEQ ID NO: 2568 - DNA, 1426 bp, Zea mays
  misc_feature (1)..(100): optimal_loci_124182_G1, chr3:195918694..195920119, Cluster 15
ccggccgcgcagcctacccgacgaggacgaggcagaccggccggcgagcggaacggaatggaccgtagcgcgtgtcatcgtgattcgtgtagcgacgacgggccgcgatcgcgaccggattccggagcagcgcactgtatcgtatccgcggcagcctgagatcagatgttgactaggtgtcccccttccgggccggccttccctcctgtcctgcctgcggttcattgattcactacatcccgtcgccaccccccctgcggcgagcctggcgggcggctgccctgccactggcgcgcacggcaaaaagaggcagccggacgggccagagcgtggtggcaggggggaccggctgctctccgccccgacgccgtacccgcggcggagatctccatttattggccggtgacgcgcccacgttctcttgcccgcaccgcgtcattggatccgatccgaaaaccacccgcacccgaggcgacgcgccccggccgccacgccccgccgcccccagttggttttttgtttggagccacccacagaaaacaccgcgggagatggagattggagcatgaaatgcccaccgcgcacggacttcactaccctgtctctactctctcaagtctaatcaatgtcactgcctatgcggtagtacaaaggagtagtacaggcgtccaaagctaaaccttttatgttatgtctattctcatggaccgtaagcgttatgtgtggtgtgggtttgatccatcaaccggtggagggttgaaagaaggggacaaaaaaaggatggaaaggtttaagcgttggggacggcccgccggacgggttgttccggcatagtagtagtcgctgttttaattattctactcgatccataaacaaagtccaaagtgcaaaatcctaaagcgtcgctttttgccttttggacttgctagcaagaaaaagggcatcatgggtcttttctggctttaattttccaaccagcaacaccttcttttgtcctcgccagaaactacactgccattttttttataggtccaaaggtgcaaaaaaaaatgcacggcaaaagcttctctttccactttaaagcaaagggtatatatatatacatatagatagatagatatattcttgttttggatcatttcatgccgcaaaagcagccatccaattggatagcgtggaaggtgcctttgcgtttccttagcaggttggtttcttagtaaacaagtcacgttagttcgtgtagaattttgaagccaacgttctggccaaaacggaatatataggctttacattttagttagaagaaagcatatatctaaaccagacaaagtagtattctttttttgctggactttatggaaatggaactgattatgtttggatacttgcaaaagcaacctcgtgagcccatgtattagggtgtgta

SEQ ID NO: 2569 - DNA, 1699 bp, Zea mays
  misc_feature (1)..(100): optimal_loci_126203_G1, chr3:206557537..206559235, Cluster 15
taataaaaattttcctacctacctaccatcagcctacggctcgctatggcatcttcttcgactgggtagctctaaaatttaaaagggccacgccaatttaacccgttaccattagcgtcaactgggccaccaaatgcatgtatcgccgcaacttcgcttgtcttgtcatgttcgtgggccgtggctgatgcctccgccatacatgcaatgcaatctttcgcacgggtgcctgtttggatccgcttttcagtgggtaaataaatttgcctttggacacttaaatttaccccaagtcaatacgtgtgcataagtttgaatgtcgcacgggcacctgaagcagctgctgtgctggcatcttcctttgtttccacttgctgcctttaagtgccttcgctggcgtcccaccctctccccctcggtagggactgccgggactgtggacgtgcgagcgtgagctctgtttccactcgcactactgttcatgtaggggtaccgggtccccgcacaggcacacgcatgcacagtgcaacgacgactgaccttgtcaaaggtgcgtttcgggtctcgctccttcgatcacgtactgactgctccgatccttcgagcggtagtagcagtatacctgtatagctagcagcaggtcgacgcgcttttgctgctgctgcgtcgtcgtcgtcttctcactattaccgcccccctctccaactccaagtacccgcgcgtctactagatattgaaccgctagctgagcccaactgaacgtgcctcgtatcaatttggttgcttacgatcgatgacattatggtgtatccaaactgttctggaaatggaacgtctgctacggtacccagcagccgtctatttctacagctataaacagaagccttcatacggactacggactatttggtaattaaataggagtccagtgatatatataaatactccaaggacgaggggcgctgtttcctcgtcgtcgtcaattctgagcagtgccaactagctagtaccaattaattgtaataattcgctggtcaatgaatgccgcggaaattgcatgcaggcggacagatctgcatgcatgatgccgccatcacgtacaggtacagcatatgcagccacccagtcggcagtcgcgccggacgctgtacatgcgcatattcctggaaggtgtaaaacaggagtagcgagacgattggggagtacaagagtggcatgtcccaactcccattccaggaatgctacgctacatcctagctacatgcatgtaccgtcgtgcagtctctattgctacatgcatctgtatagatttcgcagcttcagctctaacacatggcgcgctacagataccgcctgtttggttgtctgcacgcagagtgtacagccttgccgaactggccctgtaggtggagaaatccaacttccaatcgtcaaattaaaggaacacatctacttctcttttgccctatctatctttctatgtaccttgtcgtccatcccgtcttcaagcgttattgttcgtcacatctgcgagcgagatttgtcaacgcttaagatggcgatcatacgataacctctacatgctcctcctctaacgtgtactatcaagaggcattcagaagcctaggtatcaaacgaatcacgagcttcaattcattttagattcacaggcgatttcgttgattcaataattgcattt

SEQ ID NO: 2570 - DNA, 2489 bp, Zea mays
  misc_feature (1)..(100): optimal_loci_126239_G1, chr3:206682648..206685136, Cluster 15
acagctagtcaaaatcgtcgttatgcgggaattagtctggcaatataaaggcttgtttgacaagaaggataatgaagagaattaaatgctcttactatttaattttaaatatcaagaaattttagttccatcaatctcctatgttactctcattcccaaacaaaccctaaaattgaacttacctctggacttggcagcctgccggctaggggctggaggcgtgcatccgaaaatttctccgtgcgggggggctctctaggccttccattccaagccgaccgaacacaccgatcgaaacgggctgaatagtgaatgccttgatccatcagcatctcctcggcatcgcgggccgccctacacgacgagcactcgaaagaaaaaatcgaaaaaggctgcggcgtgaaccagaacggcgggggtaaggtgatatgctacttgccagcctgcaacggcccaacacgccgggcgcacacaccggcacaacaactcaatcggtgctcaagcaatgtggcctgtcacctgtggccggcttggccgccgcgcgctgccgcggctcaggcggcagcatgggttttcgagccgtgcgccagtcgcggctgcctcccacggctggcatgcaccgtttttttttcttggcaggaagtgaacaagtagatgcggacacggacagagcggccgttcctgctttctccagtcacagagcgcaaacagtggcaagtttctcccctttttttgattgaaagtacacatggggtgctttcgtgctgctcgagctcgactcgaccataggctgcctgcaacatgcatgcgcatgaatgcatggatgtttggtcgctacctctgtaaaaggacatgctaggagtagcaaggcagatgggtttatatacatagagacagagaaaataaacaattttccatttgaacccgaaacctagtgccgatgccaccagcactgtactgtgcctacacttcacacggaataatacatgttttcttttgggcatggcatatcacaattgctgaaaaaagcagacagtatgcgcgaaaagggtttcggaggctctcaaagatgtcttgcaagcagaggaggcatgtaaacgcataattacgaacccccatcattttgtcaaggagcacggcgcatgatgaacgatagcgaagctagatcaaacttaagtattggtgtggatatatctgcactatctaagggcttgttcggttaagttaatctggaatagcgtaaccgaacaagatctaagggtacttttatattaaagtggtttagagggattgtaacttatacaactcaaaccggagttttggacttgcaggttgaaaaaataatggactttctatttaatataggttgacaacttccgtcggatgtcagatatctcgtcgcagcgtcgcgggttggcgccacagcggacacgccagtatacctgccacgtcactagatcagcgtgcagctgaccagccatggtggcacggttgttctgtcaggcaggatgacatgtcgtcgcagttttgccgtgccagagaaattagtgcggcggacgaagtagtcgagaaaattcatattatttttagaaatattattaaaaaataaaattaagaaaaaaaaatgtgtggagcacctcgaccgtctttaatcattccgtgtgttatgcctcatctttggaagtcatgactaggcccatgcagtaaaagtttggcaagcactgtccaccttttgtccagtagtaagtaaagatatcaataagctcatcacatgggaaaaaaaagaggaacgaagcaacgccgtggcctgacggagctttatttggtgtacacctacacacgtcttcagtcactgttctaatgcaaatttgtacgacaaaaacatctgtggatcggagagagcaaagcggcattcgtcgctgtcgacctctcttgtcgtgacccaataatatacgcgtattattatatatgtaaacatgcgtgatcgcaacgggtttgagatagatagagtttttttccctctccttcagtcgcatgctcttcctaatatttatgttcctttctttccctccctgcgtgcagtgcctgctgtacgtttgatgataatccgatatggatgttgcaggcaaggtatcatgttgcgctggactggcttgtatttttatgactattttttttgggagatgatttatttcgctgtcgccaatcgatcggcctctctgatctgatcatttaaacgtgcccgatcacagccttttttttgtcgtttacttaagtaaaacgaaatatctccggctccgtactctcgtccaccagcatcatcatcatcacgattgtttcaatccggtgcggatgtgatgatacgctagctaggtcgctagcaaattatttttagcagatccgccgatgctacaaaccaacgacaaatgcttccaaataatatgtcgctgcgaattcgaaatttcgaagcgcacataattaagcagcta

SEQ ID NO: 2571 - DNA, 3024 bp, Zea mays
  misc_feature (1)..(100): optimal_loci_126484_G1, chr3:207763285..207766308, Cluster 15
agcgtgttgtgcctggattatatatattttttcgaagcatgcatgtcatacacaaacaaaataaaataaaaatcggcgctagtagtcctagctactagcttgctcgcatcagcatccatgtgatatttttatactattacatgtggtgtatatgtcatgataaaagtcccatactcttttttttttcgaatccaagcaaggtgacaagtcggtcataccctttttgaaggaatcgacctgtgacgacgcgcgaatgatgccacgatgcgacacggtacatacacaagagttccaagctagctagggctagctaggtactagcgtactctaggcgaagaacaggtctagtacgttaacgttacctacctggctacctagctatacagagtctaacacaaggctctacaccgctaatctagccgctgacctggtctacaacctcagtttggcgatgaacgtacagagaagctggcgcactccccccggccccttccggtcgctaggaaagaagaagaagaagaaaagttgatacgataggcagcagcagcaggtcgtcgtccggcctggatggtgtggctggcgttccttgaaacggctcttccatctccagtctccatccgccatcatcttccaggcagcacacacagcaaataaaagcaaagcaaagcaaatgcttggatagatcggccaagccagccagccagccaggcaggcaggggatttgtcaacccgttccttttaatcaagcaagcctgcagatataaagggccgggcaaataaagctggctgacagccccagatcggccgggtctctcttatctcagtcagcagctgcccgcaggcaggcactagctgcatgcctttccgcaatacgtcctgtggccttttggtgataaagcaaggccaaggcccaggccggccacctttcttccttcctttaatctctcgcgcgtcgggcgagcgtgagcatgcagtgatgaacgatgagtggtcgtattggatcggagtagccaatagccatcatagcccagggtagctgttgttcatggttcccgatgaaagaaaacctttgggaagcatcgatcagttgcctgctcgatcttgcccggaactctgaccgcacgcacgcacttcagaatctgcacacgttcgcgagatcagcggccacgacgagttgcttcagccacaagatcgatcggtcgatcgatctttcctatccgtcctctcattgggggtatggaagatctgtccctcccgatcgactgggcttttgcagcatccgtgtggaaagcttgcagctccttgcccgttgccgtcttgtaaaaccgtcctcgcggtagccactgcagggtttacttggaaggaatatatgctccctaccctctggagtctggacagtggacaccagacgagagagagagatggaccggaccagaccagaccagatcatcagacgcacgcgcgaatagcaaagtacgacgtgcgtgattgtacagcagaggtcaccggggagggggaaggaaggaagaaagaatcgctgcctggaccagggggcagggccatgccgcttgccgtcccaggcaggcagaggcaggcagggctgaaagctgaataccagtcgattgatgtgcgggcagagcagaagcgttgaccttgcccctttggaggggcctaccgcctacgtcgttaggtgaggccgacggttagcagtggcacatcaacacacaccacaccacaaacgctactactgtacatggcatgcattgcagccgcacacaagctgacaaacgctaggggctggccgggagatgtactctcgtctattctatacctcatcaggaagagatgtcactgcatgcatgcctgttgacactaactaacgcaggtggatcgttaattacctagctatagtacagcagctagcagatgagttgagtagttccattccaaagtgcttgagaactgagacgcagtagctagcaggcctgacgctgacgctgacgctgtcctggccgctagttctctctccttcaggataagaggagggggctggcctgggccctggggcctcctccctccttccctccatcctctttctttctcgtcggagccagccagccagatgccccaaagcggcgcgggaatattcacggccggctagaagacaagcgcaagcggcgcgacgagggattattgttttcggtgctcggcggggggcacctggttgacgccgcgagagcgacgccgcagcggacaggggatgatcgtcgccactaccgcccgctagctttctcatatcgatctccgctgtttacacacgtacgttcctgtgctgccatgcctgccaacgggtttggctcgtttctggcctaataagtcagattccaagagtgttagaagagtatatcgccgagataacctaataaaaatcatgacgatttcacagcctcagtggtttctcgctatagctaggcacacctgagccctgcctgtgtgaggttggtttgcacaggaggaggccgggcggtgttggctgcccatgcgtcgtcctcctcttgcgagaaagcgcaggtccttttcatacagcttcgtaacacttgggggtgcagctaagttgttagccttttgttccctttttatcctctttttttttgttaggttggtagggaaagcgcgcgtatagtctgctgcacggatgattttatttgcactttcgtcagtgagcctgcctagtagtagctagcagcacttcgccgtggagaggcaccccaccaccaccaggccaccacgaaccggtgtgctgctcgtgttctcgcatgcacattgcttggaaccgccgccatgcagcaaagtaaccagtcagtggacactggatgggggcaggcacacacgtgtcgtgagtcgtgactcgtttgcccggttttctagggatcaactgtggaggcagagccctgaatgaaagctatagcgcaccgttacaacggtgatctgatctcagctaacagggtgtgcacacggctttag

SEQ ID NO: 2572 - DNA, 1492 bp, Zea mays
  misc_feature (1)..(100): optimal_loci_127990_G1, chr3:215046235..215047726, Cluster 15
tgaacatggtatacagatgagctaaccatctaatttcaaaaaaacagagtggtatgtatataattaatcctaatattaaacgtgatctaagccttctggtccgttggctatgcaagacaaggcaagacattccacgctgaccaggttatctccaagttaactaaacacgccagcgatgattgatgatgacctgagccgtgagaagctcgtgctatgtatcattggacgtggccatgcaggacagcatgcggcgtttttgcccataacgcgatgccccgcccggctcgacagcatctcaccccactgggaaagaacgcagatagcacgcgggtgaacgggcgatcaccgttctcctatggaataaagcatggggccggccgtaaaacggcggccgtaatcatgccgagagcggcacgccgctggtactcagtgctcctgcctgccaaccatgtgccttactagagctaaattgccggcacctggttcagaacgagaactaggcgtggtgctgtcgcttcgcttttaccactcatcctacttgctgtcatgctgtgcgcctgtgctggtgccttgtgcagccaacctcctccaaaagtcaaccgatagactgctcgcccgagcaagctgggctgtggagcgccagagacctgcaccaagcggcagctggcagtcgactgaatcgccacagcgcttgggaagccacaactggaggcagggctaggcaactgcagtacgtgacgattgatggcttggcgtgtggagatgcacaatggagtagagatatcccaaactttagtgccatctaaacatataaactaaaactttactaaattttgatttacacattaactaaaatttagtagcaggtgatacagataggattttctcttctactactgctcctggccctgcacttactctactcctcctcctgactgacggacccgtcatgattatagtattattgtcgctgccactttgtcgtgtgagcgacacgattggtggtgcctgatgtgtgatgtggtgtggtacagcactactactgcggctgcttctttttctttcgtctctttcggccatgttctcgagcacggtcatcgataaagggagcaactgtaacatcgctcattgtccgatactctgatcggccacgagtttccaattgtaagggtcgatttggtgataaaaaaaatggaaagaatttatgagaagaaatttcttgttattcttgctattttgaatatcaaataatttcttctcgtatagattacttctaatttacttgtcatcaaatcagtccttaacggatccggctagcacgacgcaactgctaagagcctaaccagtgacatctgacaaatgcacacggtctgttgtatggagccacgagagcgatgacaggagttcactgtgtgtttttcacctgcggacaagaactgatgtgcaacaaaaattctagtacaatcaaactactactcgtctgtcccacaaa

SEQ ID NO: 2573 - DNA, 3429 bp, Zea mays
  misc_feature (1)..(100): optimal_loci_128404_G1, chr3:217223790..217227218, Cluster 15
acaaatgttaccttcgccgaaggtcctcgagatattgtgctaacaattaaagattttccaagtattggtaacacgtagcgaaggttacctgcgtcagcacccgcgtataggcaagtgacaaagccagggaacttcagcctcgtcgagttgatcggtggacatgaacgaaggggaggacgtacgaagcatgagaggaacccggcgagcacgacggataatagaaaagacatccttaccctcacaaatgttatagatcatgtaaataagacttgtgggtatgtttgcgatttcatacgaagttgtacgtcaccattataaatagaggaacaataccatacattactacggacatgttgtggaacagagtatagagaaattgctctgccttcgaatgtgtttctcgctaccttcgagctctcgtttgtaaagtcgaaggtatctttgtaatcacttatatatgagctggatagattcccttaaatattttgttatgtggagttattcttttgtcatgattcgttattcgttgtgtcattcacatatatttatttcacttaaatacttcaatcccaccttgccttctccttttagtcaaccccttcgaacaagggtacttactataaaaagagaaatgagagtttttttatttgtgttgccttattcttgatttgtctcaagagccaaaaggaagtgagcaacagatgttgattcatgatacctacgatggcgtgacaccaagaccgtaagagtctttttctttactaatctaaagtatatacagagctattgtagttgaaatgaccaaatatttttcatagaaatacacatgtataaaacacaaagcactgtgccctggttcaactgaaaatagattgtgcaagtaagtactacttgctaaaactcacatccgcgagttttctggtgatgtagaacgcaccaaagctgtgtgtaaaaagtgcaaaccccccttttcgttcaaaatccagaaaaaaaaaaggatacggaaagatctcggcgaaggcaaccataagaagcaacccgcttggacggacggcgggcgggcgcggcgcgggccaggacgccacgccgggtacgaagctggaggagcggccacggctcctcacaggtcacgatgcccggccggccggtcggtcggtcctaggccctgcgcacgaaaggtgaatggtcgaatggaaccggagaacgggagaaggcaacggcgtaggctggcgtcgcgtcacgcgcgccacgtccgtccacgagcgagcgagcgagaagtataggacggtggtccccgccatgtacgcacggcgcacggtacagtggtagtagaatactcggtacaggagcaggtacgctggcctggcctggcctggccgcacgggccgtcccgtcacgtacgtgccctgcagtggtcaggacggcacgggcccgggcagtcagcctcagagggccctcgcgcggtcaagctttacggcgcggccgtggggcccacccgccctcacgtgtgcgattgtgtatcggccgttcgcccacgcaaggtcgcaacgccgcgccccgacgtgccgcccactcgaaagtcgaaacccggctcgcgcgttcgcgcccgacggagggaaatcgctgtccgcaggcgtcgccgacgcgcgggccagcctgggatcgggtaccgtgcgtgcgtgtgaatgggcggccgccgcgatagcaggatgcgcggcgtggacggatcagcggcgggcgtacggggcggatgcgtgcgcgccaggggattttgggtttggcgatgcgggactgcggatgcggacggctcgcgtcgcgtcgcgtcgcgtgctgcggctatttgcgcatgcggggcggtgggggtgcgcggcaccggggcggcgcggcgtcggcaggcggatatcgacgccgatgtgcgcgcgaggaccttgtgcgtgcaactgcggcgtggcgtcctgcgcgccaggtgcaaaccgcgcgcgcgcagtggtgcggagctgcccttcggcggcggcggcggtctggtgcgcgttcccgacgtgtcgacgccttgtcggttccgccgtagacagcggggctggcctgtgacacggacggtttacaaacctgcgatcgaaatcgctcacgattcgatcgctccgttccgaaagggaggcacgatccactgtcgacgagtgaatatatgcgtgttcgtgcgcgccccactcatgaggaggaagcttgctgcacgtggttcaatgccttctctgtactagtacacaggcacagctccggtgcatgcatgtggtcagccccccgtcccgtcggttgcacgcacgagtgctgtatattggattcttctttttttatagtagcttttccttttcgcttcagcctgaatatcatcgacaccatccatattacgtgcatgacgcctgtggtcagctagcttgctatactgagcactaactgacaagtccttttaccgtgtgtcgttataaaagtttgtataattattggtaaggcattaagaaatttgaattgtcagtttaagctctctgttttgccttcatgtgactcacgtcaccttgcgtcggagaaattgaaaatactctattggctaattcagaaactcaaatcctctttgcatcgtgttatttttatagggtgccatttaagtaagacatttagttcttcgtgagagattttttctccatatgtttggcctccattgcctccaaattagttataaacatgttaatttttagcttttaatggtcttaactgaaaaaactttttaatgaagttaaataaatatatatttttaataaagagatcaataagtttctattattgagtttttttttatttaagatcatttagacctgaggctattttaaatatttatcaccgtaatttaacactgttagagccaaatctgatgaaaagtggcattgatagaaacaaaaaatttggactactcaacaccgatggtgaccactcaactttttttagtaataacttgtgagcaattataaacttccataagggcatgtataaccgtgctcattatatatggggtcctacggggtttctagagggtcgtctttctctatacatattgtcttttactatatttatgatctaaggatcagaatagtataatgttgtatttagctattacttgtacgtggaaaaccatcgaggggctcatcagggctgtacatgtcataaggttatttttcattgcactgttttcgagaatgacacatcatcatttatctacgaaatcatgtatgctaagtttcatctagatgaaactctctcacctctcgttaaactctcactatttctcttattaaattcttgtcatgtcaccatccttgcttatatggcgatatatttaatgaaaatgaaactaaaataaaatttccactaaaaatagtctaa

SEQ ID NO: 2574 - DNA, 1791 bp, Zea mays
  misc_feature (1)..(100): optimal_loci_132647_G1, chr4:5841928..5843718, Cluster 15
cgccgaccggttcaccagcggccagcgccaacacggccgcgatgacgtacgatcctaccaacatggcgctgtcgccctacggcgagcgctggcgacagctgcgcaagatctgcgtgctggagctgctgagcgccgcccgagtgcagtcgttccggcgcatacggcaggaggaggtggcgcggctcgtggcgacggtggcggcggcagccgccgtgcgttcctccgtggacatgtccgcgcgggtcaagacgttcgtctacgacaccatcatgagggagtgcgtcggcagccggagcaggcaccaggacgggtaccttgacgccttccacatggcggtgcggcagacgtcgggcggggctatccatcgccgacctgttcccgtcgtctaggatcatgcagatgctcgccaccgggcctcgcaagggggtcgcgtgccgtgacaggatgcagcgcgtactggagcagatcctgagcgagaagaaggaatccatgggcacggagcgcggcggcggcgacgagacagcgcaggagacattcgttggtgtcctgctcaggctccagaaggaaggacgcgcacccattgaaatcaccgacggcacgatcggctcactcatgtttgtaagcatctcctagcgagctatccgacgaagacgatcaatcgatcgatcatttgccatttgtcttgtttgtacaggacatgtttagcgccggaaacgacacctcggcgagcgtactgatctggtgcatgagtgcatgaccgagctgatccggtccccgacggcgatggccagggtccaggccgaggtgcgagaagccttcaaatccaagagcacaatcaccgaggaagacatttctcgggccgacgccgacgccgacgccgatgtctacctcaagctcgtgatcaaggagaccctaaggatgcacacgcagctgccattgctgatcccgcgccgatgccgccggacatgccggatcatggggtacgacatcccggagggcacgacggtgatggtcgatgtgtgggcgatctgtagggaccctgtgcactgggacgatcctgagcagttcatgccagaacggtttgagaaccgcagcctggacctggattacaagggcacaaacaagctacgagtacctcccgttcggctccggccgtcgtatgtgccccggcgtaaaccttgggctggcaaatatcaacctcgcgctggtcagccttctgtaccacttcgactggaagctgtgcgatggagatggactggagcctgaggacgtcgacgtaagggaggatgtgggattagtcacaaacaagaaaaccagcctcattctgtgtcccgttactcgcgttgctccagctcatgcgtaaattaaattagtggaagaagtatgtgtaatgcagtaattccttgtcgagaaggaaagttattccttatccaagttatactacggccctgctttgttcccaccaccctaaactgccaaacagggtgactaaaagtgaccttctaaacttccacttttacagggtgttctacccctcctaaaacttcactagctgtattaattatatagttcgatgacctagctgctttgggtctgatgcttttgtttaccgtcgattaaggtttgcctttgacaacatgttctaatggccctcaggatggtctgatgatacattggtctaacaccttataaacattttcttgcctcttttctttgtgatctgtatgtctaatttggctccatcttgtatcttagacttttgcatgttgttatagatctttaatgagtata

SEQ ID NO: 2575 - DNA, 1484 bp, Zea mays
  misc_feature (1)..(100): optimal_loci_133490_G1, chr4:10004981..10006464, Cluster 15
tgagagaacaaccgcaagagagtggctggctccacctggaatccccctttacccaacaccctcgtcctgcctgttggccattttcccgccatgactcgtggggcctcagcctcatgcatgtcggattcttcccacataatatatactgtatataatcagcacaatcagcgttaatggcaagaataccggagtactactacgactatctgacggaataatcctagctagactgagagagtattgcgtccggaattctaaggtcgatcgatgagcgcatgtaagtttatgccagacacgattagcacgctccacagcactactactagctagcttgatgacgacacgagctatagtatctcaacaactgtttggtgtgtaagcaaagctggccgcttttattttggagttggaaaaaaatccgaaaccagcatgtgccgtccatcgtcctattctattgcacggagaaagatcattgagggaataatccgtcccctttaaaaatccctcacttgatgacgaaaaacgaatgccagcagactactctttattcttctacctatacatcatccaaagggatcgaacagtagtggatgatgatggcaaatcgatccccaaatcgcgttcagggatatatatagcaaatccatctgtcagtaatataatggccctttgggtcggaaacagtcgagcgagagggagatcgcttgaaaggatctccatcccactacgtacctgctcatcatatgcaatgcagtcgatgatctcgcgccacactaatcatatcgatcgatcgtctcctcccatagtatatattcatgtgcgatcaaatgagtccatcatatatagcgcatgcatgcaagattgtggagctcaacaactaatgcacaacggaacggagcgacgacatgtatatatatgtagttattagtgccggggtgatgaattcggaattttatacttgtgcacgagcaagcatgcatgcatagataggaataggatcgtcgtcgtacgtggctgcggcattcatcaattagttaggtgcctacctaactactttgacgacagtaccatactccatacatagggctgctttccatttcgccaagtcattctcaaaaattaggcaggaggagatagagcatataaagttttcaaaaattagcactagcgtggttgttggttagcaattcgatcggccggggtctcagatttctagcttgcatgcccaacaagccactctctctgatctatctgttggcagagttgaaagtggcctaacccaagtgctgcattttgaccacacggggtacggtgtgccacttttagttatatatttgtattagctatgcatgtgtaccttcgtgtgccttgccgaccgtgcagtgaggcgccgttgcagaccccaatgtcaacatgttcgattcaacatggatgctagatcgaccatatctaatgccactagcatagagtcatgcgcggtgaaa

SEQ ID NO: 2576 - DNA, 1433 bp, Zea mays
  misc_feature (1)..(100): optimal_loci_133662_G1, chr4:10645572..10647004, Cluster 15
agactcataaagtcataatacaccgtctcatttagaatgcccaagcaatttatttgctctggagggtagtcatttaaatctgacgatcgtagagtttgagcagctagatgtgttgagagaagctcggtgacgacaatggcaaagaaacaaaacagacaggaacgaaccatatatgattgtggccacattccctggtcatcatgcggccctcttaacattctttaacaccatcgatcacggttgcgctcacaaatgtgacgcgctgagaccgcgcagataaaataaaccggccccccgcacagctgggactgggagggacacatcgacatcggtgcgcgcactgcccttgccctgccctgcagctgcaacagttgacgcgcgtatgattggcgccccgtctcccggtgcacccgtggtggcctcccattgcaacaggcgacgcacaggctgtactggacgcacgcccctcgatgcatgccttccacatatacgtccggcggcctaccctctgtgtctcgtttcgctccaatccatgtgtgttctcgactatagggtagggctatggcgtaggagcagcagtgtagcacgaccacgatcctgatgagctcagatcccgaggtggtgcagggggtggaaaaagggtatggccacacctcattgttgtggttgtggaggcacggaaacaaacttcgtaaagtactatctagagttgagttgtccatggagtaccaacgtatgacaccgtactatagttatcctgaggtacagctttcaaatgcatcatgtgattctaataactattttacaaaccatgtaaattcttatgttggtattgctagttataccaataatagatttattgcatcggctaattattacggtgacaatggtcttcatcgtaaatgtcataatgatggatagtatgtttaagagccgttatcgactatgaggatggctttaatgctactggcaacctacaacgtgcatatctttattcatcagctataagtttacaatatgcatgtgttcccatcgtaagacacgccgatgaacgagagaactggttttttttggtaatgctagctatttagccaattactcccaatttgtcagtatcatatgcaactattcatgcccgtactttggcttattatgctacctctaatttgagccaaacccatgaaaaaagctcactagagcagggccattgggacagtagcccacgaaatcaccctctcacctatttacttgttgtgggaacaaaaccaggacacctttgtacaacaaataggacttttaaggcatatacatgttgtgatgtgtttgattctaatatgagacaatattttttgccaaaaattttcttgcaatggctagctagggagaaccttgcaaacaaagacgaggtaatgagaaaacatatatcacaacac

SEQ ID NO: 2577 - DNA, 1629 bp, Zea mays
  misc_feature (1)..(100): optimal_loci_144_G1, chr1:662339..663967, Cluster 15
tcggatctagagattcgtcgcatcatccggctggtaggattgttggcgcggctgtgaatatccggcaggcttttccagccgtgtttgccatctaactcccagacactgagcttttcaatcgtgggcgtgaccgccacggaccacaccagcacgtcttccgcgtcgcataacgcttctacatgatttacatgagcacatttcaggcgtccggcaatgggcagcagctgcagatcgcgcggatcgtcattcaaaacatcaccggttagttttagcacgcttcggcgcagcgtgatgagctgcgcccgcgcttcgttaggatcgttttgtttactgatccatagcgattcattgctggaaaaggtgtggttatcgggcgcgtgtgggctatgaaacccgcgcgtcgcacgctgtagttccatatcgaggccacattcaccttcggttgttaacgccacgccaaccatattcccggcataggaaatggaaaacgaaggcaaatttttatcactgaaaaccggtttacctttcggcagggtgacgatttccggcaattcgccaatgccatacagcatgaacatcagttctgcgagtaaacctctggacgccagaaaacggctttgacgatgagggggaatgtttcgggcttcttgatgacactgggaggggagacgaacagaaatcagatgtccttccgttaaaatccctcgggcaaagtgagtcgccatttttcgctccatgcttaatggtccattatgaatacaagagtaatcatttactggaatgatggacagactaaagcggctaaaagttcgattcagacaagcttattacaacttttttacattttattgtgaaattgggtcgcgtttcatacgattcggttatgccatcgacgcgtaaaggtttttaatggtttcccgtaaccagacgatcttcggattatggctgttccgtttatgccacagcagggtaaaaggaacttccagctttttttgctggctttcgtcaaacgggagaggaagagcaaccaacggcagttgatggagttgattgtagtactgacagtagcgcggcgcggtcgccagtagcagattgtcgggttgcgctgccataaacagtgactgctcgaattccggcaggctcatagcaatcgtgcgttcgcgtcccagctcctgtaacacattgtccagcgcccaggttatcgctctgttcccagcaaatgctgatatgcggataacgtaagaaggtgtccagattccacgtttgatgcagtgccggatgatctttgcgtaaccagacgcaggggcacatcactaaaacagcacttcattatcaaatggctaaacggtagcgagcttaacagctccccgcgagcgagggatggctttcgcgaccgggaaaaacccgatatccacttcaccacgagtaatggcatctaaaggaatcgtaatcccagttacgtaatttgatggtcgcctgcgggtaacgttggtagatctgtttccgacagcgcattaagcatgatcatcatcagcggtgattccgccgccagctcaaacttcaggccgcgcggtgtctggtggtgcggtttatccagcagcaggttgctcatttgcatccactccgcca

SEQ ID NO: 2578 - DNA, 1642 bp, Zea mays
  misc_feature (1)..(100): optimal_loci_156894_G1, chr4:156510342..156511983, Cluster 15
cagtttatgattgagttgagtcaagactttttggagtctggcgtgtttttgtcagtttagatgaactagattgtgtttaactcttttttttggcaggtgtggaagttaatgtttcgtttgaaggatagtagtctgggacctgtcctgtcagtgtggcctcgcaatcgcatcgcttattcgcttgcaagtcaatgggcagtttgccttgaaattatgctcagggggcaatcgatatgcaataaagcaagcattagttttttttttgatacttcccaaaccatcgtgaaatcatccacctttcttctttgtttttgcttttttttttctcccgaatcaatactcgtcttcgtctttcactgggggtctgattgggtagtcgcattagtataatacttgcattgcattactgtctatgcatcatacccttagcctgaacaacccgtcaatagatcgactgggcttgcttttgaggacagtcctagactgcaaatgagtctgcgcaggtaaccaatccgtgacgtacgtaactgcactgcgaaagtctgtagtatatgtcctaaatgaataacctcaatggcagcaaggaaaaaaatagtaagctaaacttgtggctggttagtgtaacgagctagctgaaccaaagccagtttttgttaacgagatactaagctgtgaggaaccgaggtggcccgatctgcagagggtcggtcgcagccaatacaaagccatgcatggcccatggacagtgacaatccagtataggcccaaggcccagccgacccacctcgacactgagcatggccgtttgttctgttctgccatgtccggcacgcgaccgccgtgccaatcatccatgtctctccctcctttagcctttaccaacctttttcaccgcatgtgtcctccccttgcgtgcgcgagacacagggagagtacgttgaaagattcggtggagtggagttcttttcacttggggggggggggggggggggggaggcggccttgcactgcagggcacacagcacgctgctcttcactgtgcgcaaagcgtggctgcctgcctacagtttctgaatcggtcgtcgtcgtagtacgtgttcttcttttggacaccgagttatcacggccgcgtgggtaaggacgacgcgtgagctggaaggggtcctacgaacaaatagctgggtaatatatatgcagtggttaaaaaaggaccaccgcggagagacggaggagtttgacggcggcctggccccaagcccccaaccaagatcagccagtgctactggggttggggctttcgtatacaacggagttcatgagactgaacgacgacggccaacgaaacgaacgaaccaacgggagacaagagcacgcatggttcagacgcctaactctttcctctttggctttcgactttggactttggtggtggagcagagcagagcaggcggcaacgagaaggggaagagctttcatgttgtcatggtgcccctaaagaggaggcagccaggcgcgaggagcagcagcaatcgatggctgccttttgacccttctgtgccaaacccaaacgcatgctcgcctcgcacgaattgctgggctgcctggagacatgctctgacgctctgtcgctgtaggactgtac

SEQ ID NO: 2579 - DNA, 1460 bp, Zea mays
  misc_feature (1)..(100): optimal_loci_159391_G1, chr4:172121863..172123322, Cluster 15
agcgagggcagcgtcgtttcagacatatttcgccacatccacacaccactgacgtacggcagtgaagcgagcaccaaaactgcatgtttccggacatgcctagcttgttcttcccccacccccatcgtttctactctctctaatctctatagctagattctagctaccattgggctggaaacacacaacgttgcatatatagttctcatgggtactccgactcgtcgtacgtgtatccggactgcaccaatcagagatcatgtcctccgtctccgtgtcagcagcagtagctagcagtgcttcggtaccttgctcccagaagcaacacaactgcaagtacaacagctagctagcatagcgttggccgctactacacgccaacagtaaccgccggcaatgcacgttgctgccgcgatccgctgctaccggccgtggaagcaacatactgcaagcaggagtcaagcgcccgtacagtacatggcgcgtcgatcggatggatggcgtacgcgcgcgatacgtatacgtatacgtactacatgcccgtacgtgtctcgccgggggtgagctgaggacgtattgcggaggaggccgcgcgtcgcgtcagtgtgcagccccgccaagccaccggagcttttacttgcaggcaaggcaaccgtttctccactcgcccaagccacctcccccgagccacgcccacgcgcacgtcgtccccccttggccacccgcagatggatgagctgcggctgcctgtagatcgcccggggcgagcgggggtcgctgtcgacgccccgccctccccgcccggggccccgtcgacgagtccatcaatgatcaatcattggcgctgcggctgcactgcatgcgtggcatgccccggccggccggagcaggtactagctagctagcctcgccggcgccacgccgcccgcgcccttccgcatgcgtgcagaccccggctaggtagctgccacgcactatgtacagcacagaacagtggacacgatcgagaaggtcgtcttctttcccacacagacacagggaagggaatgattaacaacagatcaagtatagtagccatctagttctacttctacctagggaatgctagtgtggacgggtgcttaactttagctaccttcaattcatcaccaacggtaacggatctattcacacagcagccttcctttgcaaatacaccgtctaattaagatcaaaatggaaatgttttatgtaggtaaacggtgtgagggacaaaatgcagctagtacgtagcttgctcctgcatgcgtgcatttcgctttactggcgcctggttacaacttacaaacaaacaacaacactatcctaactcatacatgctagctagctgttgtataattggagacatcgttttttagatcagtcggtactctgaccatctgattggttagtcgcaccgtctcatcctgcatcagtgcgtg

SEQ ID NO: 2580 - DNA, 1702 bp, Zea mays
  misc_feature (1)..(100): optimal_loci_160006_G1, chr4:175264651..175266352, Cluster 15
taggggagaataattatcttcagttcacccggatataaattgcagtggcatacatatcttaaaaagaattgtcatgagaaaaaaaattaaaaaacatattattgattatgagatgattgagctggcttttactgatccagtttagattttaagaccgaatcatataacccagctgagttttgcttttatatactgtatgtgagatcaacaactggacgatctcatacatatctgcggtagcacctgtgagctgtgaggtgtgtgactgtgtgagcaactgagcatgtggtcgaggccatgacgtacaaatgatgacaggacagccgccgggccttcatcaccccccgcggtccacgtcggcgcgtacgtttacttttccatgccggctggaaatcgacgttgctttcctctcgtcttctccagtgtcaaacgtgaagctgcaacttaatcgctgcgcgtgcgacgtcgcatgcatggcatggcatggcacgactgacgacacgacacgacacgaccgtcacagggctcgctcgcccggcgttgaagcgttcgccctgtcacgcccagcgagctgcgcacgtccgaccgaccgaccgaccgcgtgcccgtgccgcacccggtcgcgggcgccgtgaggcttcctgactccttccgcgtagcacgaccaaccaaaacccccgcgaagccggtacgcgcccgccggtgtggaacaggtcgtccgccacggccggaacgacgtggcggcaggtcggaatcgactcctgcgctagctgcggcgaaggctggcgtggcgggtccgggcgcgaatcgctgtccaggcggccggccggccgcgttcgtcatttccgttcctcccggttactactagttgctcagggaagcgttgacacttctggtgcgaggcgttgacatggacgacctgtcctatcctttgtgctatcgcgaggcctacgcttggggcagggtcgatccgaaaaaaagggccgggacgcgaccagatccatgggccggaaccggaaggggtcagcagtttgatctcttctctgtctctcccgtggtgctctcggtcctatctgattctgccttccggtcaccgagcaagaaacacgtctatggaaaagccaacgaacattacacggtacggcacctgtctggcgaaaagccgaaaacgctatagctccactcctagcaatagctagctagatggatgctatagtacccgaggcgatgaacaatcggcaggaacggggcgacgcatgtcagggacgggcccacaggaagaagtagaagcagggttgtagatttgtagtgtacggaataggagtagtaggtgatagtgtggtccgcatgaacaagtatatagcatttggttgtaccgtcgcctagctggctagctcgcccattcttttttttttccatggccacgtcccgtcaccggctgtctgtccagtgtcctctttccttgtccctgtccttgtcgatggggccctcgactccgagaatcccagattccaagtaggtacgtactcctgcaaaagcgcgcactttcttgctcatcgcctcgagtactgtgtactcgctccgcgccgcacacggcatcgcgctctccactgctcattcgccttaaaaaaaacttttaatctatttttgtattatttgtgaacgagtggtataaaaaaaactgaccatgtaagtggttttc

SEQ ID NO: 2581 - DNA, 1783 bp, Zea mays
  misc_feature (1)..(100): optimal_loci_160436_G1, chr4:177636753..177638535, Cluster 15
cttctttttttttacacaaagcataatcttgtcctacagtagtggtaggtttgggtttattctccatttttactacgtttattttaggtgtctgaccttttttttttactacgtttatttcaaaatcctaggggcagtagtagtagctggcgtcggcaacactgcatgatgtctgcatggtgtctcgccaagagcaagtgacgaccactgactactgactgatactgagtcagtggagctgcatctggaaccaattatacgcttcgagcattgtgttgttccaaataattgtttccatagcgcgtgcattttcatatatatgcgtaggtacccgtacacgtatagatattattactacagggcacaggcatgatacgcatatacatagtgctcacgtacgcatacgactcttgtatggtcttggtctgcaactcacagcaccggccaccggatcgatcagagaggaaaggccgaattattggtgcttgtcgcgagctagtagctagcaacctacagtacacaccgagtggactagtgccaaccaacaagctccataagccgcggggactggacgatgactggccggacagatagaccctgtcgttgttgttgggacgtgacggcgtgacgtacgtggtgcgggaccgatcgagccatccacggtggaactggaagtgagggatgagtgacgtgcgcgaccgcgaccacgagctgacgagacgcgcagcgtgaacggtgcggtgccgtcgggtcgcgtcgcgggccggaaaatgttgacgaactgggcgggcgggcggggaggctacggatagcgacagacgcaccggggattacgcgatccgcgagacgggccctgaccttgggctgcactacggcgttcgcggtggcccgcggtggagcgggccgtgtccgtggccccggatctgatttttttttccatatggccctcaccgatgaaaaaaaaaatgtcaccgtcggcctgcctgtcttcaggtcattgtactgtcatgtccacgatccgtttccgcgtctggggaaaaaaatgctagccctttgcactgtcatgtgtcgccgtcggcctgcctgtcttcaggtcattgtacgagttttccgccacgcatattccgcgcgcctttcgtcgcgttgctatgctactaccccaaaaaaaggacagaggccatataataataatagtagaaagcagccatacacctccgtttatagcagggcagggcaggccgcgtgctacttccccattggaaccaacggaagtttattgtagcggcagcgaatagaggagaagcagggaccggagaagaggttggtttcgtgcgtgcacccgtggacggataacataaagatacggtcactgtccggtggtgatgtacggatcgaggagcatacagggcgcctccttctcttctcttcttctagtttcccggcttagatcatggcgttcgcgtttgttgtggctcccgagccccgaccgagtgtctcagctctggccgacagctacttgcacgctgtatcggatcatcacgtgtgccaacaccgcagcagcaatgatcaatctcgaggtgcgacgtctccgtcccatccgcccgcattgggcacactgcctgtcttgttgccccccattcggcggcgtgctcaaacgcgactgaaatgcttcgtcaggaatcaatcaggaactggtagcaagttttactagcaactgcttttaggtaaagactgtactacgtaccaaagagcgatcgacagcgcagtacaaatgcatggatcc

SEQ ID NO: 2582 - DNA, 1437 bp, Zea mays
  misc_feature (1)..(100): optimal_loci_164350_G1, chr4:198986131..198987567, Cluster 15
acacattcaaatagtatatggacaatcgattcatctttcgtacaaaacagacaagagagatcatctagctccctgcgttttgcaagattatcccgagtaagaattttgtttcgagatactaaccaaagaaaaaactgaacacttgggggaacttttaagtcccaaaccacaggactatgaaccatagtgacccctctagaatgaatcaccctatataaatattgtgaggaataagtgccattggagctgaattgccaaatcaatgaatcctcctccaaggaaaaagtcaaatagtagaagctaactcaataattttgtcacataggttcatcagagaggaatcaaaagttcttctaaaagtgcatcttaacgacacaccatttcaaagatcagcaacgacatcattttttcattgaccaacacacaaagagcctccaatattgaatggcaagactagaagaccccaaccaattgtcttcccagaacttaacctttcgaccattagtaataatatagttataggtataatagttttgtgattactggatcatattggatgaattttgagcttaaaatccactggattgggaattgatcattgccgcctctaccactgctcctagttccaacgaatgcaagcgcacgggtggtttggagcccccgaaatcccgcttccaacgcagcagcattccaccacctcccgaacacgcacgtgcgacgggacacgcgtgcgccccgccggccggctggctcgtcactgcatctgcatgagcgtcccggcccgcgacacgatcgagcgggcctcgctgcctttaaaatttgggacggggcggagagcccggcggccggttgcggtggcgagggggagctgagcccgaccgggcgccacgcgtcccaaggctggtgccgacggaagccacggcctacgcctccctccccgagcagatcacgcgggctgccggcctggcgccgcgcgcggggcacgaagcagatcgcgcacaccatgagcaggcaggccataccaccgcgcgtcgtgccgtaggccgtaaacaaacgcccgccgtgtcgatgtaatgtaatgtaatgtctagatgggaaaggcgtggatttgtttagtgctgctgcaagcgtgcgttgttggcttggcttggctccatctatcggcagttcgtcgttcacttctgcatgcgcgccactaccgcctattgagcggagccgtttcaggcagctggtcgtagtcctggactgcctcggaaaccaagcacgtgtggacacgcatgaaggagagtgtgaaaataaacttgtaaagttgtcctaggtacattgttaccaagccgtttcagtgcgaagagacctttacacgaccaaggccaagccctgcgcagcaaagtgcgttgttatcctgatgtcatttctgaacaatgtgtgtaaaatttt

SEQ ID NO: 2583 - DNA, 1595 bp, Zea mays
  misc_feature (1)..(100): optimal_loci_173048_G1, chr5:3980959..3982553, Cluster 15
gcccatcgactggctgatcgtaacaattacggtcacccaaaaataaaatggtgccgaatcttttcgagtttgaccgggccggacgtcacgtacccaatatacacctataacgcactgcccctgttccccttcccactcaccggctccacggccacgccccaccttccacggccacggcggcgaggacgaacgggagtgcggcggcgaggctccggtttgaggtgattgctctgtcgatctttctctctctctctctctgggtgcttgcctggtagggtgctaaatcacagcggtcgtggttttgggagggttttgttgcttctgtgactgaggacgaataccggcgacacgggaggtgggggcgcgacggcggcgacttgctgccggtcgagcacggggctggcctcctgtaggcgaaccttctagtgtttccgtattctagccgttgagtgacgatgcccgaggtggtcgcccaaccggcggcatgcggccggcggcggcgtggcggtgccgtgaggtcaaggtggcggccgcggaggagacaggacggcgcgatcggcggtgctagtgcatttagcgttttcagggtcggggatatggggccgatcgacggtgagcgtggaaggggaatacagcagccagacgtagcagcagccatctgtggagggtgcgccgtggtagcaggtagtggtggcagaggccggaggccagtcatcggctgcagtgtcggagcgtgacgtgaaatcaagagggggcgacgaacgatttggcttctggatgtagaatcggagatagatcgaagcgcgtggcggcgtgtttccgtttgtgaaaatataggagtgctgtatggtcgatggcgtgcgcgacggtggagcagcacggcgtagtggcgggaggaggccgtggccgcgccaaccattcacttgggactgtcgtgcaagctgcccatccctgcgctcttgctgaagtcctgtgttgcagctgctcagctgtatgcttgtgacgagcatgtggtgctgggggccggcggggcacataatttcaagcaagcagatgaggatctacaaccaggagggtgtatccatccatgaattctagtccaacacccgagcatttaaccaaactagcacctttgatttcatcctgtgtctggcacgattcgtgctctggatcgtgttcgtcttccctaacaacagctgggtccggtgagctgaggtttgggtttgggggttttcaccagaggttgcacaggattagagtggtggtagaagacaaccaaccgataggaaaggtcggggcgcgtggaggtgttacaccaagacgagtagcatggtcaggcctgggccggcataaactgagaccctgttcaaaattctaaaatggggcctatcactataatcactcgtcaaatacataattttatatagagcaatttgtttacaattttacggacatagaaaagatgaataggaaaaatataaaattaatgaactttataaaagagcattaagattctttccgaataatagaattaaattaaaaattttatattatgttctgacaggcaacaacctattgacgttggcgactagagt

SEQ ID NO: 2584 - DNA, 1725 bp, Zea mays
  misc_feature (1)..(100): optimal_loci_174826_G1, chr5:14513326..14515050, Cluster 15
atattttatgattgatctaatgatacttatctagtgcgacaaatctaaagtattttttgtatagatttgatcaaatttaagttattttaggcggagagtatctccaagtatttttcaggctgtaaattagctctgatataagatggtgagagaccaatcagatcagatggttgggctggtgaaatgtgtcccgtggatgggtgatgatggatcgatggcccatatatggtcccaaaagggcaggtcccgctagattgtgcaggctgcagttaagggactacgtacgtacgaagactaggctgggcccaaacagtctctgaataaattgaagcccagcagaggcagcacagcgaaagcctgacatgtggcaccggcccgttacaaaagtttgaggagatagatgattgattgcctgcgactgcctcatcatcatcatggtatcgaaatgaactagagtttgcttcccataagaaagatatcataaaattcagcagaatcggtacactttcaaatccatttcctagagtttccctttccttgaagtgcaaaaacatacagagggaaataatgggcacgagctgtacgtgcaggcaagcgaggttcagaatcttcccatgagcaattccacaaaggaaagggctggcaatggcatgcccttccgttgctgctttggtccaataaaaaggtcacgagaacctttactggtgcttgctgctaatactgctagagagtccatgaccatgcatgatgagctgagagctcagtgctactgctgctgcctctatggacagtacagcagacatggtttggcacagagacgatggaggaagagacatgcatgcgagtagtgctgtggatggatcgatccacaaatcccaataaaagcgtagcagttggagtgaggtcatgtaaaagtgaccaatccttgtcctcttcgacgaaccgcacatgccagcctcatcatgccattcatctgtttgtttacagtggtttttttttacaaaaaaaaagaggaggaggaaagagataagaagctcatgacagttgtgagttggtattaaagattgtgatgaactgatgaacagtgatatatgccggcaacttgcatccataacagttccgttcgagtcctatatatcatgcatatgagaaaataaaacgcagatattattctcagacatgagttactgcagatcgtctctctcactctcacacataagagcagcaacaaggactgtgaaatttctgtgcgaaaggaccctttattcttttgggtgggagtgggactgagactgagactgagactgagactgtgcctgtgacctgtgccctgtgccctgggcgagaagggaatcttcccatgcatttctcgacgacgggcatcgtcagtgctttctgtgctgatgggtggcattctccggcccggtgatgtgatacagtgatatccaatccaaggcttgttcacatcaggcactcactttttgctcggcgtgacgacgcctgacggtgtccctgtgcggttgcccttgcccatcaggatcaggcgtgaggtatcgatgcctcggcctcggttcgatggcttcgcgcacctgcccggctgccgggtgggtgcgtcttccgtatacgagccggagctggaaccgccggaggagctccattaattattcattgtaccgggtctctcagactgcaaagccggccggcaaccattgcgatgcttgtccc

SEQ ID NO: 2585 - DNA, 1586 bp, Zea mays
  misc_feature (1)..(100): optimal_loci_175546_G1, chr5:18571315..18572900, Cluster 15
ttattagttgactaacaattagttttagaggtttggaacaggggccgaagtactatttattgggatatatagtaagttaggagtgagtgtgtaataagttaggactgcaggccaaaacaaaagttgcgtatgtttctgattggccattccgaagtaacactgcatgcatgcatgcatgcatgcatgcatatggttaatagtactagtagccatctaatcacgttgaaaatttgcccggcgcgcgtacgatgtgttgcctgccgtctccattacgaaactgaaggatcttccattatgaccgtgttgagattactggaccccccgcccacaaagctggtcaaataaacgcgacgcagctgatcagttggaccacggcggaacggattcaggggctcacgatttgacaagtatactccatacctaaataaacatgatggcagcaagcaccgaaaccgaactgcggctgtcgatggaccctgttcctgctgaagccaggcgggacgaagcggcttcctcgtcagcgattgaaagagaaacgatggaccggccggggtgggtgctttttgctggagaagacagagaaatgcattccagatcctcaaatctcgccgaaagcgacgcatgttggagctgcccccccggcccggccggccctgcgcagatacgctgaaatgcctcttcttttctatcgtctatcctcaactcaactcaagccccctgcatgcagcctctgatcaagttgactctcagaagtcaggtttcacaagaagaactggctagcgatacctgagagaagagaagagaagagaagtagaccaccccaaaagcaaagtacatgcagctggtggccgtcctcctccgttattagaccaatacctgcagtgcacttgtgacccttgtggtcctgtggacacagctagctagcagcagcagtcgtctccgtccgatcccactaggccactaccaaaaggaaatgaatggattgaaacccttgtggtgggggaagggggaggcatcattgtacaaatcccattacgactagagcttaacaagctatacaaattgcatgcacacgcatgcatggagcgccatagtgggtttagtctcaactctcaactgtttgttagtgttgttcagaattcagatcagtcagccctagtgatgctaccatcatttgtcgtgagagagaccagatttgagtgcagtacgtatacaagctcacgtgaggctgggtgcgaatctctccggacaaattaaaggtttgcccaccatcacatattaatggcgtgattgctgcgccaatctgcagggacaggattaaactttcgtgcatggcttttctgactgtgacacgaacccgcttctttaactaactggatgagcctggctgtggacaactcaattatccagaacaacttaattgttgccttgtgttcattcttgcgtgcttgtctctctctttttctttgtcaaaattagagcacagtagatcactttcaacgcaccctgcgccattgttaaaacgacgcgtgtccattgatcggtttggtggatggttaagttgtactcccctctgtcctaaaata

SEQ ID NO: 2586 - DNA, 1451 bp, Zea mays
  misc_feature (1)..(100): optimal_loci_181259_G1, chr5:49835565..49837015, Cluster 15
gacttgagctggcgacttccggtccggagcagggcgtgctcgtggtcgtggtcccaccggtcagtgagcacgcaccgtccgtcaaagcatgcgtggcttcgtcgtgggatccccgaacaggtcccctcggtgctagatcttttggtgtatagagcaagtgatggcgctggatccatggacggatggatgatggatcggtctgtccgtgtatgcgccggccagtggtggtgctcgatcgacgcatctcccactctaacccgtcgtgttgtgtttgcctcgaccaaacccatcagtccccgtcgcctaatacttggccttctcggttggttggtatctccgccgtcgttttccgatgccggaccaaggaaagccacgtccgcacccccgagacgtgccaggccgggcgtaccccgcgagtgagatgccgggcgtaccccggctcttgggactgcgatccggccgctgttgcctgcgtcggtcggcgtggggatgggagcttcgccgttgctgttgccgctggcgctgggctttccacctcacgacgacacgaaccaccaccactgtgtcctgcactgcatccgcatcgcaatggaccaacggtgatgcaacaacacatccccggacggtcttatattatacgagtagacgtgattggtgtgtttttcattctaagccgtgaaagtgttcatttcttctgtcgaccgacagaggaacgttctgcactggagttttctcgcggcgttcaagtagtacgactagcgacactagccggtaacgcctacacgttcagtcagtcagtcagttggctgggtctgcctgccgctgcgtgcgtgcgtacggagtctgggggcatggatggtctatccgtgcacgatccatccaccggaagatccgatctggggatagcatatatagcagtggatgctgcgaagctccgggctgtcgcctggaaagccgaggcgcggcaggatccatgtcccccgagtcgccgtcagcggcggcatcgcgggagtccactggcctgccactggatggtgctccacgctccagggcaagcaactagtacgcaaaggctccaaggccaagctcgtcacgacagccacccaattctgtccccctctcgctcctccggatccccacaccgctttccgtcgttgcaaggactcctccgatccgctatctgtcgaccgacgccagatctttcgcgaagactagttttggaagggatcggagttgctaaaatctaattcttatttaattttaaataaaaagtaaattttagtccattcacaatccctttcgattttctcactcttaaactagctcgaaagcaagaaattgtgcagcagaaacttcacgcgaattttcgacataagcagtggcggaaccagattcaggcaagccccgggcccaattatgactcaagtgcgcaaaaatacattattagaaag

SEQ ID NO: 2587 - DNA, 2361 bp, Zea mays
  misc_feature (1)..(100): optimal_loci_187078_G1, chr5:89708177..89710537, Cluster 15
ctgcatgcatcacagaccgccgtatctcatctcatcatacggtgatggatccgcgacttttttttctctcttcttcttcttcgcatccggcgatcgagtggcttcgcatccacggcacggcagactgcagatgcaaccccaaccccaaccccaagtcggcaacggcaagtccccaacccgacctaccgagaatctcctcgcgggcacggtcggccggcttgcttggattggacaggatgcgtgatatcacgggagcttgggcgaggtggcggctgaggtgggtccaccgccgcctacgcctagggaggcactagtaggcaggtaggattacaagttgggtggggatggcggggcggcacgggccaatcgtagcgcgcgcgtcaacctgcccgctccggccgggcccacccacgccaccagccaccacggcccatgatccaactggatcggcgttacgcgcgccggcacagacaccgccaccggcaccgccgtgcgcccctgccccttctgatcggttcacgcgcgacgcgcaggcagcctccgtggcatcctgagtgagacgaccctgtcgagcacgggcagggcagcgcccatgatgccaccacgaccagtgaccgatcataacttggaaaagatgcacagcttgggagctgaactccgtccagttgaaggggacatgcatcgtctgctactggtactctactacgcttcaattatttgggcactgcatgcaccaaggaactggcacatgctgcgcgttgcatcgcccccgtgcatgcatgcagccatgctgtgcaaaactaaaacccatgttttctttctttctttctttcttcaaagtaaaccctacaacgatccaggattacatataaaaatgcctcgctccagaagcgtcggcgaccaccgcgccagcgaattaacggcgcgcgcgcgcgcgatctccagcggggatgctggcagaagcggcgaccaaaaccagccgaagcagcagcggactgggccgggtacagagcacgctggctggattcggcgcaaagcgcgcggcacggcgcgggggcactcacatgcatgccgtgccgtgccgtgccgtgccgcaccggatcgcggccgcgctgtccctgtccgcccgcgggatatgacggcatccagttcgtcaccacccccgcgcgggaaatgacccgcctgccctccctcctgtgcacgtccccgtccgcccccgcgcgactttgccctcggcggcagggcaggtcacgcgactcgcgagcgtcgcccccaccagcagaggcccacgggggggcgccccgcgcggcgagacgcgacgggccggcgtcaaggtcgtcgtcgacttgcgtgcctgctcgcgctcggccgcgcgtcaacgtacgcgggccgcgcgaaacgccgccgccggccgccgatcgaatcgagcggtggagcacgcgcgcgggggccgatggtggagcgcggccctgtcgagcacgggcagcgtgcgcgcgccaaagttttggactgtggatttgtgcaacaccgaaacagttttagactgttctagaaatttcgcgagggtggatacttgttccattacgacatgagagcgaaacggtctgcaaaatactactagctcgagagcgaccgctatccccctccccctccccggtacgtataacgtatgtcgtcgtcggcagcagtttttatacggcgttgaaacaatctacgcgcggtagatatacgtcggggcaattaaacacgagcgatctgcgtggactcctcgagaagatgaattagcccggtgaaccagccaagtgccaaccatgggtcaatgagagttccgtgtgaggcctcctttggatcaaagaataattttactaaatcctgtgtttttaccgtgtttttgaactaatttctatatattattgctgtgaaattcctatatgttccaaaggaggcgtggtgagtttcatctctattaaataggttgttagcatatttatgatatagcagtgtattttaaaaaaaaataagataaactcttgtcttgacatgattattatattaactctctaaagttaacgccaacaaaaataatcattgaaactggccataggctaatgtcatgcaccgaggccatttgcgacatttcatacgcgcatggcacgtcgtcgcagcctcccagatcccagctagagcctagagctagtgccgatgccgactggtctccggagtgggaaggcaaagccagctaaacggacgtggacgtgcagcgatggtgtcgatcacacgttaatgatgaagataagtggtctttaattagtcacaagcacgtccattaatactactttcaaactatacttacgagtatac

SEQ ID NO: 2588 - DNA, 2054 bp, Zea mays
  misc_feature (1)..(100): optimal_loci_192637_G1, chr5:131560958..131563011, Cluster 15
cggctatatggggatgggagagaatcactggaggattaaattctattttatttaattttgactagcaagaaatttttgtaaccctcttcaatccacttctaaccaccgaacaatcccctaacgagatcattaaaatcctctcttacatgccatgcgataaggaaatcaatgtgttccttgtacgggactgcgagattaagcccccgcttttaactgaaaatgcaagcatgattctatctatcgatagagatccgaccatatcgtaccacccggcggcagatgtacgacgatggattttagctactaaggcatcgtttgccttggtcgtctaagaagcctggtcctttgtttcctactgtagctaggaggagaataacttttgtgtagactcagcaagcccggacgatgtccttgctaacccaaagggaagggaagcagacggtgaaatagcagtgacgcgagtacacgacggctggaacagcacccgctgtgctccgtccttccacctgtgactgtgagcacggacacggacggggtcccacaggcagagcacgcgcgcgggtggcggagggtccccagtgagtgaccagagcgacgttaaattggcgccatcgtgtcgcctccattcactcgttagtttcctcgccgctcccagatcggcagattttacctgctctgctcctcgccagccggccggccgggccatcgcacgtcgcccgtcgcgcgcgcgggcaggcaggcatgggaaagaagcacgcggcaggtggcggctggttcgccgccgtcaggaaggtgttccggccgtcgggctccggcggctcatccgcgaccaccaccacctcctcctcctcgtccaaggacaaggataaggacgccgtgcagcacgggaaacaggtaggcgccccggacccgccactccgatctccgttctgccgacatcgatccgcacttgtcgacgagctagctctagcatctgcatttccatcggctggcgtgcgcgtgctatgccatgccatgccatggtacggtgccgcgagcggtcgttattgtacaaattgacggcgatgatggcgagcaagtcgtcgacgccgtaccgtgtgcgtaagtgacgcattattcatcgcatggtgtgtgtgtgccaggccaccgccgccgccgccgccgaagagccagaggtgctgctgctggagcacttcccggcgtccgagacgtcggcggaggcgagcaacgagggcggcgacgcggaggcggagctggcggcggttgcggcgacgacgaagggtcgtcgtcgtcgagacgacgaggtcggcgacgaggatggggagatggaggaggagctggccgacgacatggagcgcgcgagggcgctggcggccgcggccgaggctgccgtggccgcggccgaggcggctgccagagtggtgcggcttgcggcgctccggcgcctgtcgcgcgaggagcgcgccgccgtgcgcatccaggcctactaccgcggatacctggtacgtacgcgtgctgtgccccccaagctactattgcctaaacagaacagcttgcgttacatttttactatagtacgtataatatattgttgcctaaattaaaccatgagaactactagatcgctgatggatcatagatagaatggaaaaaagcatacattcaggacgatggggagagagacattggtgagtggtgagtgagcagtagtaagtaggtggggagcccctgtttaatctttgacacaacaacagcgctaattaagatggggcgttaaaatcaggcggtgactttttaaggtggccggtccaaggaacggatggatgattcaagcagatctcttgcttacagctcaagcatggaggggagatctggcgagaggaggatgacgaggggtggatgacttggcgttgaatcatgcatcaattctccaccgcgcttaccagttgcagcagtagctagtgcctgcgtgcatgccggacctgacctgttggcgtggcaacgggcaatggcgtccacctaccggaccagccctgccgagctcagttaaagtg

SEQ ID NO: 2589 - DNA, 1950 bp, Zea mays
  misc_feature (1)..(100): optimal_loci_199111_G1, chr5:168852200..168854149, Cluster 15
acgtactacggtgctgccaatgcatatgcactgcactgcactgcattgcagccatgcagggagtgaagacgatcgatccatcgaaaaaagttttccgcgggacaaatcgatgcttcgcattgaccgcgccatcttgcattgagaaggcgcgcgggcagcagggtactacttatatatggcagcagctagcggcagcttcttcttcttctccgatccttccttttgcaggccggctggctggctggaccattagactttctgcccatgcacttcattgcaccaccccctgctgcgcgcgttccatcatgcctctcgagaaacaattgcgtttgcatgcagctcattagtgttctgttctgttctgctctgctctgcatgcgtgccctaatatttgcaggcccggccggccggcgctgccttctgaaaagggggattatatattattccttttgccggaccggagctccttacacagtaatacgtagccagccatacagttacagtgcacgaaaaatattagaccaccaagcacttgccttgtgcactgtagttagtctgttgcgtcatagccgcatcgaccatagctatacatgtatcgcttctgcttttctgccgctcgctcacccagtcaccctcaatgcaaaaaaaaaaaagccttccggtttccgctgctagctgctcgcgatcgagtgccctcccctctgccgtacgtgtgtgcacgccagctatcccagcagtatattctctcatcagcagcctcgctcgatctctctcactagccattgatgccagctagcgtcaccgtcaccgagaaagctccgctccggccggatcgacgacgactccggccggtagtacgtgatggctaccacctgctgctgcactgtcactgcagccaagcgatagatggcgcgcgcgcatcatcggccggccgaccggcgccggccggggttcggatctgcaaaaaggcagggatgggccgcgcgcgatggcgaggaagcaaagcaatcaatcactgcgcactggagcgctgctactaacagcgtacaatgatggcctagcttttgatccgtaatcatgtttgcgctcccggcctttggagacggatcgcgttcatttgcagctagctagctagtccgtctactgtagcactatgtccacggctctagtggtctatcatgctcatgctcatgcatgcagcggctagtagctcttgcctgcagacctgcagtagtaataggagcctacagaccagacgcgccatgcatgatgcacggcgtcggcggcctgtctgccggtcgtcgcagccacacgctagtgcgtttgtttggccggggggggtcaacattgcagcgcgttctgttctctgacagggccttttctagctagctaggaggatagaagaaaaaaaacaggggaagggcgactgtcaggtagtggcgaaatatggtcatggagaggctggtcaggaattcagaccaagaggccagaggtttatgcctcttcattactacgtacgtacgtacgtcgtactagtagcaactaaaacaaccatactgtcagagaaattaacacacataatggtttccagcttttcattgcctaccaaaatagtaataaatacaagtgcaaaaaaaaaagttctgagtagaagttcgctcggattttgacggcgttgttggtcatcgttcgttactgatgtagtatgaagagaggatgctaaagcagccatgactgtcagaaaaaagatgagaagagggatcatgatcatcaggattcaggggtggcatgaaagaagcaggggcacaccacaaggcagcacagggatatgcgatgacgagcgatgagccatcattacggatcttgggccggctaaggcccatatatcatcatcatcgtcatcatttggagtcctctctattccgctatacctcctcctttttcttttat

SEQ ID NO: 2590 - DNA, 2084 bp, Zea mays
  misc_feature (1)..(100): optimal_loci_203009_G1, chr5:190933033..190935116, Cluster 15
  modified_base (1641)..(1641): a, c, g, or t
  misc_feature (1641)..(1740): n is a, c, g, or t
  modified_base (1642)..(1642): a, c, g, or t
  modified_base (1643)..(1643): a, c, g, or t
  modified_base (1644)..(1644): a, c, g, or t
  modified_base (1645)..(1645): a, c, g, or t
  modified_base (1646)..(1646): a, c, g, or t
  modified_base (1647)..(1647): a, c, g, or t
  modified_base (1648)..(1648): a, c, g, or t
  modified_base (1649)..(1649): a, c, g, or t
  modified_base (1650)..(1650): a, c, g, or t
  modified_base (1651)..(1651): a, c, g, or t
  modified_base (1652)..(1652): a, c, g, or t
  modified_base (1653)..(1653): a, c, g, or t
  modified_base (1654)..(1654): a, c, g, or t
  modified_base (1655)..(1655): a, c, g, or t
  modified_base (1656)..(1656): a, c, g, or t
  modified_base (1657)..(1657): a, c, g, or t
  modified_base (1658)..(1658): a, c, g, or t
  modified_base (1659)..(1659): a, c, g, or t
  modified_base (1660)..(1660): a, c, g, or t
  modified_base (1661)..(1661): a, c, g, or t
  modified_base (1662)..(1662): a, c, g, or t
  modified_base (1663)..(1663): a, c, g, or t
  modified_base (1664)..(1664): a, c, g, or t
  modified_base (1665)..(1665): a, c, g, or t
  modified_base (1666)..(1666): a, c, g, or t
  modified_base (1667)..(1667): a, c, g, or t
  modified_base (1668)..(1668): a, c, g, or t
  modified_base (1669)..(1669): a, c, g, or t
  modified_base (1670)..(1670): a, c, g, or t
  modified_base (1671)..(1671): a, c, g, or t
  modified_base (1672)..(1672): a, c, g, or t
  modified_base (1673)..(1673): a, c, g, or t
  modified_base (1674)..(1674): a, c, g, or t
  modified_base (1675)..(1675): a, c, g, or t
  modified_base (1676)..(1676): a, c, g, or t
  modified_base (1677)..(1677): a, c, g, or t
  modified_base (1678)..(1678): a, c, g, or t
  modified_base (1679)..(1679): a, c, g, or t
  modified_base (1680)..(1680): a, c, g, or t
  modified_base (1681)..(1681): a, c, g, or t
  modified_base (1682)..(1682): a, c, g, or t
  modified_base (1683)..(1683): a, c, g, or t
  modified_base (1684)..(1684): a, c, g, or t
  modified_base (1685)..(1685): a, c, g, or t
  modified_base (1686)..(1686): a, c, g, or t
  modified_base (1687)..(1687): a, c, g, or t
  modified_base (1688)..(1688): a, c, g, or t
  modified_base (1689)..(1689): a, c, g, or t
  modified_base (1690)..(1690): a, c, g, or t
  modified_base (1691)..(1691): a, c, g, or t
  modified_base (1692)..(1692): a, c, g, or t
  modified_base (1693)..(1693): a, c, g, or t
  modified_base (1694)..(1694): a, c, g, or t
  modified_base (1695)..(1695): a, c, g, or t
  modified_base (1696)..(1696): a, c, g, or t
  modified_base (1697)..(1697): a, c, g, or t
  modified_base (1698)..(1698): a, c, g, or t
  modified_base (1699)..(1699): a, c, g, or t
  modified_base (1700)..(1700): a, c, g, or t
  modified_base (1701)..(1701): a, c, g, or t
  modified_base (1702)..(1702): a, c, g, or t
  modified_base (1703)..(1703): a, c, g, or t
  modified_base (1704)..(1704): a, c, g, or t
  modified_base (1705)..(1705): a, c, g, or t
  modified_base (1706)..(1706): a, c, g, or t
  modified_base (1707)..(1707): a, c, g, or t
  modified_base (1708)..(1708): a, c, g, or t
  modified_base (1709)..(1709): a, c, g, or t
  modified_base (1710)..(1710): a, c, g, or t
  modified_base (1711)..(1711): a, c, g, or t
  modified_base (1712)..(1712): a, c, g, or t
  modified_base (1713)..(1713): a, c, g, or t
  modified_base (1714)..(1714): a, c, g, or t
  modified_base (1715)..(1715): a, c, g, or t
  modified_base (1716)..(1716): a, c, g, or t
  modified_base (1717)..(1717): a, c, g, or t
  modified_base (1718)..(1718): a, c, g, or t
  modified_base (1719)..(1719): a, c, g, or t
  modified_base (1720)..(1720): a, c, g, or t
  modified_base (1721)..(1721): a, c, g, or t
  modified_base (1722)..(1722): a, c, g, or t
  modified_base (1723)..(1723): a, c, g, or t
  modified_base (1724)..(1724): a, c, g, or t
  modified_base (1725)..(1725): a, c, g, or t
  modified_base (1726)..(1726): a, c, g, or t
  modified_base (1727)..(1727): a, c, g, or t
  modified_base (1728)..(1728): a, c, g, or t
  modified_base (1729)..(1729): a, c, g, or t
  modified_base (1730)..(1730): a, c, g, or t
  modified_base (1731)..(1731): a, c, g, or t
  modified_base (1732)..(1732): a, c, g, or t
  modified_base (1733)..(1733): a, c, g, or t
  modified_base (1734)..(1734): a, c, g, or t
  modified_base (1735)..(1735): a, c, g, or t
  modified_base (1736)..(1736): a, c, g, or t
  modified_base (1737)..(1737): a, c, g, or t
  modified_base (1738)..(1738): a, c, g, or t
  modified_base (1739)..(1739): a, c, g, or t
  modified_base (1740)..(1740): a, c, g, or t
agcataacatcgctgtaccatctgcacaggtcgggccggccagcgacatctgttgcctcgccgtgcaagaacgtacagatcgagaggcggcttttgattcagccgttcggtcagtcagtagtaggcgagaaaagtaactattgcccggacggactccagttttccggccgccaagttccataacgctacggaaaaggagccggcggccggagaaagctttccatgcaccaccctctcctctttctcttgtgtctttgcagttgcagtacagaaacgcgtcgtcgtactcgttcgtctggtctcaccgcacctcctgcgcgcacgtacgtccgtcgtagtaaacctaacccagccagctgagctgtgctgtgctgtgcggtgaataatggccacgcacgcaacgcaacagtagcggtggttgagaggatcggaggaagacgaagactaggggggccgggaaggatcgaaaaggcggtgacggatggatggtcgctttgctttgcttcccttgcaatgcaccccacccacccaaccttgtcatcactctcgccacgctactgtctcacgtcactgggataaatcaaatgctagtagtgtttttcgaccgaccgaccgatcggccggccggctcgctcgtcgtgcctcgttttttttttcttttccttttcctttgagcatgcaatgcaatggttcgtgcctggtggaggaggtgcagtgcagctaggtagccagagccagagccaggccactaatgcgcggctcataataatcattgtactgcccggactcgagaccgtgatattgatcgagggagggaggggtcgtcgtccaggctgtggttggtgcagtaggcctcgtggtcatgggccaggatctgtatgatccagttggtttgcgagtcgctgtcagctgcatatatttatatatataatttccagtactgatcgagctgagctgcagcagcggccagcgatcgagtagtgactgaccgcccaagggagaagggacggcagctgcatgcctgcatgcgcctggttgtggttggtagggcgatcggatctctgtgaaaactatgtgcgtgtgtggcggtgtgtgggcgtaccaatagcccattatctgcggatgacacacctctgcctgcctctgcctgtatggtgttgtggagcttcagatgtgcatcagtgcatggccgggcgcctctctcatctgcagtagtacaatgctacgcgcctacaacgtttggtggacgtctggtctctgctcgatctctcaaagctacataacctctacctaccgcattgtctgtagccaattagccatacttgccttttctgcgcgaactgaacctctggtgcctacagaactggacaccttcacacctatagcttttagccaagaccacctgtttgttctgtttacgatgagctccaatgtactacaacgctagctagtactatactcaagttctgaaagggtcttatcgaacgtacgatgagatttgcacgtacagattcgagctgctggcggtggcgccaagtggctggacttgcttcagacgtgcacaagatcgctgtcatccttgaccagtacgtcggccatcagagactactgcggggggtgggggggggggggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccccccccactcacaccattaccggctcatccccctccccgaaatcgtagcgttagcacgggcatgtagacctttatggccctttgatcaagtttcatgggggaatattatcttttgtttcagttggtcgagcacatcaccggccaccgagcatcctctccgcgtggttatctagccttgtctcgccttctccatttctaaggcctcactctatttgatccatcactatctttgtttgtcatggcgaactctctgcctactatgttttcccctcaccttcttcttcatctatggtgaccccctattgtcaaatctgccaccatctcccatcatcgtctaacc

SEQ ID NO: 2591 - DNA, 2702 bp, Zea mays
  misc_feature (1)..(100): optimal_loci_203081_G1, chr5:191385052..191387753, Cluster 15
actaatattttgttgaacaatttatataccgttgcaacacacaggtattgtaatatctatgttttatactattttttactctcgtggcaacgcacgggcacagacctagtaaactaaatatgtacaatatacgctcggcgcgccacgccaaacccgcgagcgcggaccgcccaccccgacgcgacccgagcaagcggcgccgcgcccaacaccgtcactggatttgcgctttggaccccgtcctccgggcgaggtcagcccgttttcgtcgcggccgagcggctgagggcatgcaattcctctgcccacgttggacgcttgctgaatttttaggcgatccgggtgccggccggccgagcggcgtcgggacacgtacgcacgcacgcacgggacgtccaggtccgcttgatgtcaggggggatcatggatgcacgcgtgcacccacgcggttttgcgttacccactcccttatcctcttcttcttctttttttttatctctgagaatatcctcattgttgttagctaggctgtataccatggcacagcactgtgctgtcctgcattgtgcggacggattagaacagctagctaccccttttaggtctgggatacatcacggttgatcaggcctctcgacgcgtttgcttagcaaagcgctgcactagcttagtacgtgtactgttttctctcatccgtattttcaatcgtcgtactagtaagaaaccgaactgtgtcaccttgctttggtcttctagtagctggattagtttaacggggtctagtcatcactatacgagatcttgctatcacagcccggtaaaaatggttacattcactaggcagcggtatgaatggacaggcagggacagacagggatggtgaccggaatgtgcagggtaaatgaagtagaccctgcatgcgcacacactctcgccaatcaccagcgtcgtggcctgctaggagaggaaggcagcatccacatcgcccctgtcacattgcctcctgctcctgggttgtaacgagcggatcagctagaataatacccgacgatcgccccaatcactgctgctcagctaagactatactcttacccccgtgtgtttcatccggaaaacaccgtgcgtgtgcctgtcgagctagctgatcgcgattagaaaacggctgcattgctttgaacgcataataaataaatctatcgcgtatcttcggagctcaaaccgatgcaggaatctgagtccctgacgactcctccgagctctcaatacccaaggctacacctacacgtatcttctagacggaagcagcaaaaccaatgcagggtgactttgcttacccaaacacctgcacacgccgttggtaacgcaaggcaccattccggcacttcaagatcagatcagatcagatcagatcgttcaggtcttggtctgtgtcagagtgatagtggtaatacacaatgagtgatctctctgactgctagctgaccgtttcaaagggggggcggtccgagcaatcaggcctcccccaaaaaagcgtttttttggactcaaattggcatcggcctgcggttgatttgatccgttcctgcggttgatttgtcgtgcagcgcgcagggagcgcggaacgaccccgcttcgagcagcattaagcgcggctgggacggcgcgccagtccaagagcatgggcagcaaccgtctcatcgcgtgcgtccaagccccgtgatccggtcgcgaccgtcttttacacgcctgcagattgttgccgatgggacacacgcggtatataaagatctagttcctctcattttttcccacgcaacaaaaattgccttctcgtggaactgcaggttcggatctggacgttctccagcctgattcgtccacggataggattgaaaggcctcgtgctagaacaaactgtatagcaacttgtttgaaacagcaagcgcactgtcgtttgactggttcaggcgtcctctagggagcgagacgcgagaatgcagctggaatcgacatccagttttgtatcatatgtgagtgtgtgtgtgttcgtatgccactactagccactttaaattacgagcagaacccactgctggcgttacagcctcgtctttatgcgtgcgtctcgtggaccacgagatccttctgtttgacgaagaattactcaacattccttcgcatctatcgcgagttcgcaacaggccaacagtaaactgactgagaacagcaactatgcgcgtccatccaatcagagggattcagtactcgcgggaaaacgtcactgctcggaaggaaaaaggaaccgtggtcgcgctgccgctcgctatatcccatccgacaaatttttgcagccagcacagcagatgccaggagcttaccggagacctgttcacagcggatggcctgaaatgaaaatcgcaggccggcagagccatgcatcagcaaaagagacaacaggttgcactaacagcgacattacagaatttgtttagatcctgcttttgcagcttatcgaagttcgtcatattaataaacaaacacaataaattgaaactaaaatatgattaaaataagtaagtaacacacatgtgaaataagtttttaattagaaatattgattaggagatatatttaaacagagtgtatataaaacaatatacagtttatttgcagctgacaactcacaacggtttgaaccaaat

SEQ ID NO: 2592 - DNA, 1900 bp, Zea mays
  misc_feature (1)..(100): optimal_loci_203147_G1, chr5:191856892..191858791, Cluster 15
actaaatagcacgtaccaacgtatgctagagagcataaactacattacattcgagaaacgattgggacgtccctgttctctatggaaagagagagagagagagaggagctaaccaccactctacattgttttgtctgtctttagttccttccttttgtaggccaaaagctcgtggccgaatatgacgcacgcagcatcatgcatcattgtttccgcaaaaccatatcctaatggccattgccaaaagggagagattgtgtgctcgatcctaactgcccatgcaggagtcaataatgaagagatccagattagtagcaaaaacagcttccactgatttttcttttgtttatcggtgagataaggtgtggtggagttcgggcggcgagtccatgtggagtgccaactccgatccggcgaacggacggcgaccgtacgtgcatacaggccagaggtacgtgcatacggcggttgtggtctcgctcgcagctcgcggtcgacgaacgaaacaaagcactattcaggttccatagggccgggtttaccggataatggaatttcaggaatgtatagccacgctcgatttgggtgctagcatttgtctcacgagccagaatttgggtgctagcatttttttttttttttacaaaatatatagtggaatgaaagaccgatctcgaatgtcaattctagcacgatcggctaggatcgacagcgcagggaaaccgatcagatagatctaatataaggagggcagacgactgcatatagcttattatactactatattggagagacaacaatgggccggccgggactctgatcttgtgctgcattaaggtatgggttttaatttcgcagcaaaagaagaagaaaaggagaggagtgtgtatagctggcactggcaccagtggccgggggctcatgtagtcatgtcacagttacgcaatagcgcgcccaggacgatcgtgtgtgtggtggctttgctctgattaattaacaaagcttttttatatatgctatgcatgtgcagggctcgctgtggcattaactcacggtacagtttgacactgttgtttagtgatgatgatgcacatatactcatattcgtatcttccttgtctaatatatatgctgtttggagactagcatatgcatatgcttactttccgttgtcatgagactttaaatacatttatttgtttgtttggacgttgtaacaatactttagtttagttcctactcccatttgcattggctttaatcatgcgtgttcatgggaacggctgcggccggggagctagctgttttttagtgcctcatgctagcaggaatcgtcagccagcagcaagtgccgggtagctttcttttctgggggtctaattggtgctaaaagcgaataataattgatgcgaaaagcaaatcctgtctgtaaccacaggacgcaacgtggaaactaaaatagttgatcagggattcaatccgagatatcgatgatggtgcggatcgatcgtctcgatcagtagtagtctcaggtacaaaccaccagagggttggcgcactgtgcccctaaactaggcgtctccgatcttgagtcgcatgcatgcaagatattattagtgccgcatagaatactgccgagtggtctaatcatgcacagtgcatatagttggttgatattataaaaaaaataccgtacaattctctcataattaatttgcagaaaaaaaaataccgtacaattctctcaacgtggacatttgttaattcagagagtgctcgatcggcgacaaaaatccccgcgcattttgtagagaaatattggtgtagatcgcttgcgccggtgggcgggggctattcaatataatataataataatggcaaattgtccctacccgccaag

SEQ ID NO: 2593 - DNA, 2561 bp, Zea mays
  misc_feature (1)..(100): optimal_loci_203521_G1, chr5:193929542..193932102, Cluster 15
ggcggaatagttgacgcaccagcacagttgaatagttgacggcactagcatatatcatttgagctggaccaggtgtgtgtcctcctggctggcagctacatgctgctttgttttggtctgaaagaaccaaagaatccggcctgccgaaggctctggtctggtcagccgccaaccgctccaccatcatgcatggtactacgcagatgaatcaggcatggctgcgcggcggagtctcatgtgcttatccttgcttctggacatggcgcaggaccacacctagtagtgcacagtgaaatggccccggagttggccacacatgactgagcaaaaagagctactacttaattacctggatgttcagtgaacaataatgttttcacactgacgaatgcttttgttttccccccttgcagcagcaaggacacacaggcacacagcacacacatatggctccatgtctgttttgtttcagcctttgaggcactgttagtgagtggtggagtgagtgattttgcctgtgtccttgtgcattggctgccgtgcacaaatcttgaccgtaaaaagctactgcgtgatccaaccactaacccccgcgccagttagtttttaacggtttcaagcatccctaccccagtggcagagtcagtgtaccgcactcccttttttttccaagctgtttgttcagtccagtgctgcaaaaagtaaccgtgcgagtgcttgcgtcgcgcatgcgtacgtgcttccttatttaattgagggtgtttggttgaagaatcaattcattctagatgacatgagatgatgtatcatgagtctattaatgtggatattatcactaattgttaacctatgagagataaaatggtgatggataaaatcattttattcccaaaaccaaacaagacaatgaggatgaataagaaaatgatgtatgggctactttatttttcaaaccaaacctgctttaagtgtggtcattgtaaaaaaaaaacaccacatgggcagcgagtgagctcaaatgcgctttgaaatcgacggtgcagagaggagtttcctgcctgggagtgggaccgacagaccggccacccccaccccacacacacccgtatccactgctactactacgcagcaggcagcgatctttggcagacctttgcggtctgaaaagataaaaagaaaaaaaaagaaacgccaaggaaaaaggaaaagaagaggggagaagcaagaacagcagcagacgatagagaggcgaaacgaaaagcagtaaagcggggtgaaagaaagaaatccatggcgaacgaaagctgggctacaaagattcaagggggagatgcacgcaaaagcggcggggcaaagcgagcgaaagggatatgcgaatcagttcgtggcctgcacgaggcggagagccggttgttgtggttgtggctggctttcactcgaggcaggatttgaccgaccaaccgcaactgcactacttcactcatccattcactgcgatcgagcttgggggaggacgacgtgaaaaagaaaaggtgcatctttaccggtgtgtgattgtgtgaaacgcagtaaagaaatggagatggcatggccgcgtatggactcctttatatccggccgggggcggtgactgatcagtgatcaggatgtggcccgccaaatctccaatgcaagattattttaccctactgaagagcagatggatactgtactccagttcggtctaggaatatcctacgacatggtagtttactaggccacatgtccacattgagtactaagcaatggcctggggaagtgaaggcacagggtaaagaattggctagcccttgctcagagtttcgcgcctcggttagctgacgagttccaactgtacgtgtgctggatgatccgtggagtataatacgtactactcgatgctccaataaataactgttgcctcctactgagcgcagagagcgatgagcgagagtttctctagagacagtactgctcaaactggagctagattcatgcatacgtacccatataagaagggccagccgccgcggatttgggaagagctgcgtcctttctctctgacaaaaaccgattctataatatacacatactacctgccttgtagataggaatatttattaggagttgaggatgaatagaagcttcgggcactgaactgacaggtgcagaaaaattattgcattccctatatatgctcttaattggtgtcagttcagtcttcagtgtagtcgcatgccgagagcgctgggggtttcgctttcatgttcaggtcttcgttgttaagaaacagatctatctaccttagatgcttctctcattctcacaggagtagtgatgtactactgtactagtggtatggctgtgcagctgcagcgagcttttatttgggggttgcagttgctgctgctgctgctcattcgaggactagttagttattaggcactaataatagctagtagctagggttaaatcttccagctgctctgcaactaacggaaagtgaaagagctccatcagtactcgagtgatcgatctactat

SEQ ID NO: 2594 - DNA, 1935 bp, Zea mays
  misc_feature (1)..(100): optimal_loci_203550_G1, chr5:194121504..194123438, Cluster 15
cttggatattgggtccaaggcacaaggatatcttgcaagagttggcaagagctgagcaccgagcagagcagtggcgtgcatccctccctgggatgaccccacgcacggcacgagcgaccatatatatatatagaacgagtaggccggtagcccatacggtgttacgcatgcatgcatcatgcatggcttccacttgaagctccctgagaaaggggaactagtgattgttattcccttccggattcgtcgtccggtatatgaaccaagacaagaaaacgcgagagcagagcggagcagacacatgatcgcgatgccgtcatcctcgggtggtcggacacggaatgacagggcggcaggcttgtagtattgtgaggcaggtcacacacttccagaaatgcatgtatatatatgattgcttgtataccccattttctctcgccctttcactccccagatactacttgctagtttggccatgcacacacgcatcacctcgtactatgtatacaggaggtcgagtactagctcactgctgcaggcggaccggacacacacgctttgcttgacacgtggatggatcagcctaataatatacaattagccctcgctatttctagctacatacagctgtttgcaaggttaaagctgtggcctatatacaattagccactatttaccgctatatatagtgcaatataatacgctgttagcggtttgaaaagagcgatcgcgcccgctatttagaactgcggtgtaattgggtaaaccctagctagctagtgtgacatgcaagcacgcacggcacagtacttcacggagataagtctcacaattttccatcagaaggaagcgaccagagaatctcagcgtggactgggagagggaccagctagtcgcacggcagccggccccggcgagatattcccatgcgaccgctcgccgcccggtagagtccaaagccagccggcatgatgctgccatatacaacctggcgagcgaactcacacgcgcgaacacagcgcgctcgctcgcgtcgcgtcgcagtgaaactcacgcgtgcctgcttggtcgggattgctagaatgttcaggtcaggctgtgcctgtgacgccatacatatgcaagcacgcagcagagagaggctagggctgcatgcatgtcacctttgcacgctgttcgctcacctaatactaatgttttttttttcagctatatatgtattatatataggtataggttgtcgggttgcttaggctatagcggcgccaagttgtgtttgatctcatcaggagcgtttgtttatagttcggatgccgaaaggccacggcttgataaggtttccttggcgtacggcctcacttggactggccatctgactcgaaaatactcctattttccggttgatagctgggacgacgtacgtctctctcgtgcgcgctagtaacggtacgttactatgatttcatttatgcttcagtatagatatgactatgagtgtgtcgattgtgcgaccctacaggctacagggcccaagaatttctagcaatccgtatatattacagataaaaaaatattagcttggatacaatattgactaaaatgtggttcaggatcgtaagttcgatctgttctttaatttccgttgttaatcaagtaatttctccgcttataagaaaagatttaaacggtattaaggttatcaaaaaaaaatagcttaaatgcattcgttgtgatagcaattgttagtaaaatgccagagaagattattgagtatggaatatcatcgaaaaaaaatactttgaagaacactaaaataataatgcatttcaaatgaagattatataacgacacaatgtttagtcattattatattacgtgcacatttttttgctacattttgcaaaaggtcttcaaaaatgtcgataaaatcctgag

SEQ ID NO: 2595 - DNA, 1571 bp, Zea mays
  misc_feature (1)..(100): optimal_loci_205496_G1, chr5:205291262..205292832, Cluster 15
cttatgtttaagttaaaggtgtttgtttaggattataatccgtcgaaagcaaacgtccgcacgttttttgagttgcgtgtagaagtcgatccgtccctcactcagttggacagatgcgggcgtgcaccggcgcatacgccatcagcggcaaccggcaagcgagcgagcgcttgccgaggggcgccgccccgtgtagtgcacagtcacaggacagcaggcgggcacgcgggtgggcggagggattccgacgctggagtttggtggggcggcagcaagtcaagatcgcatcacggcgggggcggtctgtggatggatctcaccgaggattgctgtggtaccgcgcgcgggtcacatgcgccggatagatagaaccagccccgagtacacatacgactaagatgggccgggttcagtgggcacggcgagggccacgggctgcgtacttgaatggcccaccggtcccagatcgtccatggaagtttgaggaccctcacctactcgcacaacaaacggttcaacgtgagcagtcacggtgtgacaaagaacggtaccgataggttctctcatctctccgtttgtgcacaggaattaagaacaccaccggagcaccgcggtgtcacagttcgccacttttgaaccggccatcgcccaccggaactgagctgctactactgacggccaccagatacagagacgccacttttgctcacgtgcccgtggcctagcttttccattcttgggcagcggggatctggcaggtacggttgcctgatctgctcgatagcggggtcctggctggctctggactgaagaccgcactcgagtcatgagcgcacgccgatgcactgtgctgtgcacagcctgagcctgtgcgccgagccgatgcaggcggcacgggcccgccgagcatccaatgatcgtgggtgtcgtgtaccgccgcggctgcatcgtgcagcatcattcccgcgtcgaacgaaacgtggtaccacgcacgaatccttccatgagcaaaagcatgcagatgcagccatgcatcgttacgctacccatatactattgctagctgcatggcactcgaaatttgacctaccgtgtcccgtctcgtacgtgccgtgccgtccggagcacacaatctccatttcgtggctgaactgaacagacgacagcactagagatggaaaacgtacatatatatatatcacagactcacagcgcacaccaggacgacgatcacacgcttctgttgcacactagctatagcctctcccgttcctttcgaagtcatcgatcgacaacaacgtgtcaacgtgtgtcctttccatccgcgtcggcgaggcgagttccagtgggtgttctctcaagagtacagtctcgactctcgcgtgtgccacatcgcgctccacgtatagctgcagcgcaaaggaaggccaaaaggatgccgcgcgcggttgccaccaaaaaaacggagagcgagagctggtgcttcatttccttttcccaggagaagatgacgatccagagcacacgaggttgtggctcgacaagacgtgcgagggggaactattgtgttc

SEQ ID NO: 2596 - DNA, 1747 bp, Zea mays
  misc_feature (1)..(100): optimal_loci_206719_G1, chr5:211554690..211556436, Cluster 15
ctacaatctactacctctacactagtagctagctaggaccacctcgatcagcggctcgatcggtcctgaatcctgatcgagctcaccagcctgtgtagccggggcagggactcctgttcgacttgaagcgagtagtccatcgatctcctcaacagctcagccgctcagcttgaacgcagcaggccccgccatgtttcagagttggagatatttatgggtatgtgtggattggcccggaagagccagtttgtggggaggtacaaggttgctttcgtccagtgttatgtttgtgcctgcccatatatatgcatggatgggaatatgtataattgcgtgcccaactatttccgggggcatcagggcgtattcaggtatgatgcttgcttgcccagaattagatggaaataatggacatgtagtccagaactgacgaaacatggataccggccggcgggaactggtgtctagctggtcacgtcgtcgttgagatggacaaacggatctagctagaaacaaccctgctcatcgtgtcttcttttgcttaaattaatatccttgcatgcatattcatcatatatatgttttgcactatctaacgggcggcacgctctgccgtgcccgtggcggacgtgacatgtcggcatcatcggcgcgcgaactggcgccaccgctgcaccaaccaaccgcatccgtacgtcgtctcggcgccggcagccgcgagagtacagcgctctgccgcgccgggcgctggcgcggctccagcctgctggtggtactccggccgtacgtacgaacgcgcgccgtggtgggcgccggccggccggccggccagcgcgagctcgtagcacgtacgtacgcgtagcaggcagcggcagtccacggatcggagatgtggagctgatgggggcgggctgtaactgtaaataataatcccgtcgatctaccacgtactgcggcagatgcacatgcggaggcctcgctcggctcgtcgatcggctcagctagctagccagcgagccaagtgcccaagtcctgaccttgctagcatgcatgcatcatgcattgatggctgatcgtgacgactgacgacgagggacatgtatgttccaaggattacctactgcacggtactactggaatactacacacacagacacaatgcacatccttggcttggcttcagcgcaattctcaattcctcggccgggccggggtccactgatccacaagccgttgtgtgcggcccgtgcatgctgctgtccagtccaggcagcgccagccggtatgtactggggccatgatgagtccatgtccatgacgcgccctccccctcccgccctgcgtgtcagcatgtctgcctctcctttttaatgctgacagacgacgcacagaaagaaacgtgatggtcctcaagtacgcaaagcatagcactgcacatctgacatctgcactgcacatctgcgcgtagcatgcaatgcatgacacagcacacaaaacatggagcgaacggccaagtacatgggcccctcccggttcctggctagctggcccctttgtttctacccgtacggaatgtaggagtacattcttatgctgcagtgccgtgtattcatagtttcataccatgtactcccccgccgatttatagttccaatcttattattcgaaaaaatcgtaactattatattttttatctaatattatttaacatattgttcagcaccgtttgtgacattggacacggcaa

SEQ ID NO: 2597 - DNA, 1602 bp, Zea mays
  misc_feature (1)..(100): optimal_loci_206771_G1, chr5:211730852..211732453, Cluster 15
ggtttaaggcctaggggtcaagggtagggcgggcaggtaaaggcacgcacgcattgagacttgcagggcactctttcggaccttgcagtaataatgacaagtcctttatatatctgctgctttgaccatgtctatgccgacgaaatctacatcgaggctggctcagtactactgaactttgacccttttttgttttcaaatactagtacagctggtaaggaagaaagcaccgtgagcgtgtgtggttgccgttggccagggctcagcacagagacaggctaccttagtacctttgttcttggaagcacacgttcttttcccccagatgaaacttggaagcgcatgttctgctgccagctgccaccgtgtgatatgattcatcaggcatgcgcgagtgcatcatgcatgctgccaaaaagggccactactagtagttgcccatccgaagaaaaccatcttcctgccgtcaatgccaaaaaaaaaaaagaccagccagccggccggccggcatgaaccagatccaccatgagtacctgtcgtccgaaccctgcacttccctctcactgtgacctaggtttcccttcacccgggcgctgcttgctgcgtctgcgtctacgaaatggaaacgagcaacggaaggaagtgggaaaaaagccgcatcacaatcctaggcaggccacgcagaagcacacatcactcgctggtaactccacccactcactcacagtcacagacagagcacatgttttgtcccctcccatcacgcagcgacgcgagcagggaaggagtctctgtgcgcgtgtcaggggagagtgaaggctggctggatggaggccccctttgcctgttgcctgcttgcctgcctcactggcgggtcacggcgtttcctctggttctctcccttccatgatgatgagtcaaagaagcggccagtcagatcagatcagaaccagatggggcgacgcaggcctttccatctggttgtttcgcagaccagatgcatggcatacgttcagtgatgactgactgcacgcctgcgcctcccatgtcgccgttcgtacgtgtgctcccctctccagctctcacctccagccttcagcctcccagccggccagcagcagcagcgatcgcctcgctgacgcttgcagcaggccagcagagcagccacccctctcgcctccctgcctgcgtgtgcgacaggcacggagcagacatcaggaccggtcactagctgccgctgccgctgccgcctccgcctgagcgcgcgcgcatgcatgcatacatacgtatgcatggcatgcactggcactgcactctgcacgcttccgggctccggccggtctggtcaggtcagccgtccgccagtgggcatgccgcttgtcatgcacggatgcttggacggacgctggcatgcagcgcgtcagagacgcagacgctcccattccccgtccgcttttgctgccgcggccagtactgcggcgccagagcctgtggccagttgtaaatggagatgccacggttggtggtgcgggtctagtggggagagtttttgaacccactagagctagagcaagattttagcctatgtatataaacatgaaa

SEQ ID NO: 2598 - DNA, 1518 bp, Zea mays
  misc_feature (1)..(100): optimal_loci_225125_G1, chr6:109249122..109250639, Cluster 15
atgtataactaactagtttacttatacgttgcatggtctaggcgtcaaatcgacagtgatctgaactgactagtattaactcgaaacgttaaattctagtcaactttaacgacgtggcgtgttatgattggtccacacgagcgtcacatcagctcatgtttttatttctgactaactaaggtataagaaattcttaaaaaaaattgaaagcaattgtggaattcgacatatgaaattctttggctccaagaattatgtgaatttttttatttatactttatgacatttgtaatttttatttatgttttaaacgtttgtagtcataaatgtttggttattttttaagattaaaccaaacataaatccataacagttgagaggtggccaccaaccactaaggacagagcgtgtacaatacagtctgcagttcctagtacccctttccagtttgcacctacggcccggcgacgcggtgggcgcccatgtgcgcgcgtcgtggcctgggccagcacggcatgttattcttcttcgggcccggttccgcacggccgggcaaggcatgattcatgcggggtttttaggctgacgcctgccggtggtagagtacgtggtgccagtgggccgctcgggcacgcgcgcgtccttgcgaagcgggcccagatggacagcgacggcctttggtcgtagcctcgtactcaatgttcgtactagtagtagaattttcggtaggacacactacacaggacaaggcttccttccttcctggtcggggtctcggtctcgaccacaagtcaagggcggttctgtagcgagggccatgcaactggaccacttgagtcagagtcagcagcgcatcagcagatggaatggaacggaatccgaggtgcagtagtgcataagagagtagggtttagggcagagcatatgttgtggcgagcgaaatcgatgcaggcccggaagttgacgacggtcccattggatagcctacagaatggccagcccagcccagcagccgagggaagaaaggtgtgtgtgccagtcacgcaaaaaagcacgcgacctcagccgattgtgcagctggatgcgcaggagtactcctctccgtccgtagcgggagccgggaggagacgggagacccagtcactcaagtgctgacgaggccagccactccatgattagccgccggcatgcatgacaacccccacatggccacatgcgcatgatgccctgcagtcctgcagcacccagcaccgggggtccggcgccagcgccagcgactcgggggccgaaacgtatccagcgcgcggcgcggtgtctgctgcgtcggccccccgcgagcgagcgagcgagcggctggcgcgcgcggaccaagcgcagccgcacgctcccggcgaggacggcacgcactcgccatccctgttgcttttaacgcgacgtcgacgtcgacgtccgtggccaacactgccaaattgctgtacgcctgtacctgtacctgtactataccaccacgtatttaga

SEQ ID NO: 2599 - DNA, 1952 bp, Zea mays
  misc_feature (1)..(100): optimal_loci_228893_G1, chr6:129481578..129483529, Cluster 15
tgagcactgtaacagcggtccaccgagagaaaaaaaaactgtcggcaaaattatggagaaacgttttctacttttctcatactactgttcatattcatttcactgttcatatccatagatcgcatgttcagaattctgttacgccagaaagatggtcgggaccttttccttgaccttgatgatctcaggagaggtcgtttagccaatttaatgctttggcagaggtaatcaaatttggctgttcattaaaaaatcattaggctaacacactaggttctaaattcgctgttcattacggaaggggaatggtggtccgaaacaatttctagtaagattgattctataatttatataagtttcggtcagctgtaacgatttctagtctatttttgaacaaacgaataagtctttaacacgtgtccagtcatattcgcccggcgttgcaattccaccagcctgctactgatgttttgtttctcgcatagcccatatgtgatccctggtcggctggtcccaccatatcgtgtcgacaagcaattttctttttcttcttcttctttcgacacggttttctgaatggatgttgcgcgagacttgtggatcctgtggtacgtaccaataccatacaatagaagaaaaagaatgatggcgaatgagaacgcggcacgcatgccggttgttacctgttagccaatagccaggagactctttttttttttttttgagggctgctgctctgaaccttgggaattgcagaactttacgagcacgggcaggccgtcaaagctgcaatgtactactagtactgccactggtaccagtactgacgatctacgcagaaaagccttttcaacttttttttttgtctagtggtatttctgacatggaagtgaaagaacctgggcgtggaggatctgccccagttctttaccggcgtgattcgcaagcatcgtctcaactgacggaggaaggaaacaacgataggtaatgtagacatgtacaatgtttcatcgagagtagacagtaggtaatgtaggcatgggctagactctcacacacacatatcccacaggccacgtcgccacactggatcggagcactcggcatgggcgctaaccattgctccgacaaagacatctagaaaggtagtacgtagctcagcactgcatcatatcatatgcaatgcaatgcaatgcatgcactgccatggcagctgttccgcgggcctctctgccttcagcagcgacgcatcactgtccccgctgtcttgtggcccatcagcatctgtctgtgtaagatgagatgagagcagccaaaagagcgcgggatgcgctgcagcagtggtggcaatgggatcgtggtcaacactggacgaagactagagagcgccacgggctagccgcggctgcctgcctcatgcagtcatgctggctgcttgctttgcttgcaatggtcctagctctctctctctctctctccgtttccctttttgcagttgcagcgaagattgtcgaatcaggatttcgaggggctgtgatatacttagctcctcacaaggcgctaatgattgcggccttgaacgtttccctcaaacacaagaagagtctagctcccaagtcaataactgataggacgccctctaatatgatcagagaacataagagagccctcgagtctgacagaaaaactcaagagcacaagcaaaatcaaacttcggacaacaaaactatcgctcccatcctcaaccaaaccgaaaagcaagagcgcgcgcacacatgacacctaaaaccgatcggcggttggtggtttataaaaagttttctggataacttataaagctaccgaaataaacggatcacaaaaacagacaaaatcacctccaaaaggtgtcaagaacacgcgaaagttggtctggaccatgtcaagggtcagcctgaccgattttcaagagc

SEQ ID NO: 2600 - DNA, 2124 bp, Zea mays
  misc_feature (1)..(100): optimal_loci_232108_G1, chr6:143976151..143978274, Cluster 15
ctaatgataagctatgtgtgtcatatattcgtcaaacttcaccccaactgataagtgttgaactatcttcaaattgcccaccactaattgcgaaaacctcgttcaggaaaaaaaaagaatcttcaaaatccttcgatatataggacgatggaatttggtacccaggggcggagctaaggttggttgttagtgtcagctggcactggtaactttttttttgtaaaatcaatgaaattttctttttggtataactgttcatgtatgtatatatagctgacatcggtgtctagtgaaactgaggccggtggcttcttgatgagctggcttggacccggcctgttggtaccgaaggtgccgcgtggagggagagggacagacaaaagttggaatgggaattccaaatcagcacgcatttcttcgtcgccagttccgaaaccggcgacagtgacaggaaaacctgcagcgtggaagaagcagacatcagcggagacacggacgcccaaagaaaggaatgtggtgaggaaagcggctttgcaaccccccctaggcccaaagcgccgatgctctcgcgacgttcttgcattgctattgcttgttgggtgccgtgctaggcggcgtcgtacgtgctcgcttgctgctcgccgaacgagtgtatagctcgcatgcggttcaccgacacctccgtacgctcgctcactggcataaataagagcgggttggtggccgccgcctaccgcctacgtacgccccaaaattcaatttttcgtttcaccgtaccgcagtggagtgaagtgaactgacacgcacactaccgcttccttccagctgcgtacagtgcatgcaggcccgcccggtcattcagcaaagggtcacgcgctgcctgtgctgtgctgtgctgtgcacgctagagaggcagtactgtactctagctagctcaatcatcggggtacggcgcgcgtggttccggccgggcgagcgaacgagcgagacagcgagcgacgttgagcgtctgcgcgtgccggaatgccggtaggtatatgccaggtgctctgcttaagtacggtgtttgaggggtcgcgcggtggcagaggagctggctgtggaactgctggagcgtacgtgtgcgtctggccattgcttggcgccatgcatgcttggagtccggtggttgcgtgccgacaggacgtacggccgggtaggggtacatacatgtacatgattttcgcttcgagtgcacaccaccatctataccgacgcggcgccaggtggtgtgggttcgtgggcgccacgccacgcgcacctggtcggggtttggcgcttggctggcgcggttggcgccgcgcgcggacgggtatgtgtgagatccatcgtccagcgcttgcagcaagcagctaggccgcccacgtctctcactggagcatggttttgacaatccggaacttgttactgccatgccaattccacgtcatcttcaccactttgaagcccacacccgtctgctgatgctgctcgatccacacatgcgccgcgccttttggtgtcaggctgctgctgctgcggctgcgatctacatctactctacagtataagtgtataacggtaaaatattctgtcgcgcgcgcggcgtcccgttcccctgctactgctagctagcttgtcggctgcagctagcacccatgcacgtgccacgctggcatggccacccgtacgtcgccgtcgcatgcaggacacgatcgcacaggcacaggacatactcctatatgtactacacctaccacagtaactactacacgacaaggcaggcaggcagcagctagctagctagcacgaggccgagcagtgcgtcgctggctggctctgtggcatgcataccgggggcgcaggcaggcaggcatggggatctgcgtgcagcggcagccgtcatgcatgcacgcacggccaagtgtgagcggctagcgcgcacccaggccagctagagctagctccttgggaacaggtcgtcgtactacctcactgtcactttatgctcgcgctgttggcttaacgtgatcagttggtgattataacgatttcattacgcaacgcaacgggttgctgttgggccagccaatgcagttcactaat

SEQ ID NO: 2601 - DNA, 1955 bp, Zea mays
  misc_feature (1)..(100): optimal_loci_234070_G1, chr6:153272396..153274350, Cluster 15
tctcatctcgcgcgcgtgcgtgctttgcctttatcttcttgtacgtacgtactcttcttctctaggttgcctacatccgaagaaaccagcgagacagctgcgtgcgagtcgatcgaactgatcacgtacctagctagctatccctccgtccgccagccaccgagaaagggaagtggcgaacatgatttgaaggcacacgatcagtagtcatgaagggaagaagtagcttgtccatgcatgcatctacccctctcgctcgctcgctacgattgcgaaggggcagtgcaggcggctgcagaatcaccgcgaccgatccatagagataaccacacagaagcggagaagccttgagtggtcctgagccgcccgtcgcgtcacggtcgccataaaaatggagctccacgatggagagcaggagagggcgcgcataaactacagtagtgctatatatgctatactagcagatctgctgcgtcgccgtggttccggcggccggccgccggtgatcgatccatcagactatacaccagcagatctgagttggctccgtcctcctgtagcccaccggtcacatgcattcaactacagtacgtatacatgcttcatatatatatgtcttctgggggggccggccaattgcctactacactaccactacaccacctccgtccagcaaaccggtgcatctcctggacatcattgggcggcgtggccaccgggcatggcgtctctattctctaagagatgtgtggctctgggggtgtcgtacgtcggagatggccggccggccgggatggagtacgtagagacgacaagtcgaacaagggtattttcgtctatacagctagctagaaatagggtcggcattaggcagtgcttatatatataggtcgtccaaaggcgcgcgtgttggacgtatacaatggcaaatggactgaaggaaagcagagattattacgatgatcgatagatttattaataaataccatgagtagtaacgatatataggtcttttgttcaaagtcactggtgctattttttttttacaaataaaaaaagaaaagtcggtgttggtgttgttgttattagaggcatgacaccaatggttgagctttggatccgtgcgtcctgtggtagtgctgagtctaaccgagccgtgtagagtttaatcaagtctatatgacaactttttaaattcgaccgatcgggaaaacatgtttttttgatgtatctattcagtttgttagagattacttcttttatatactcggtcgaactttgtgtaattcggtttaatttaaaatcaaaatagggaatcgcatcctctttacaatgattggtatatatatatggttcagaattatccagacacactgctagtacttttcttctttatttcttctacgaagacctcgagaactttgaaaagtataaaccactaatatatatatgatagaaatcgttgctccatccatcttttttcatacttgccaactgtatcagtatcaccaccatatatacacacagggacagggaggcgggagcatctctgtccttgatcgactagctagccagtacccctactcctccactgggtaaaaaggtggccgtgcgtgtcggtgtcggtgtggccgtgcgtacgtgcgtctgtatggccatacaatggaggtgtggctagcgaattgaacgcgcgcgcagtaggcatggagtcgtccgaacatccggaaggttagccggcaggcacgtcccttgcggaaaagcgaacgtggacaccccatcccgtccgtcctgccagtgcctgccggtggtcgacccggacgtcatcccaccagaagattattaccgcacgtacagttggtatggtgtttgtgccgctaaactataccgtaggctacaaactcgggttgcatgcttgcggacgggtgactagataactaatctcaggtaatttagta

SEQ ID NO: 2602 - DNA, 1918 bp, Zea mays
  misc_feature (1)..(100): optimal_loci_234188_G1, chr6:153656779..153658696, Cluster 15
gctatatattaacggggaaaaggtgtgacggtgacagtgccattgagtggcatggcatgcagtggacggcgacttgcatgctcggcaagtttccccggcccgagctagcgcgtcacggtgacgcgaccgtgatgccataaaccgcggggggatccccaacgagtttttgtgcctagttcgactgttgccatgcatatttattctggctgctgctccgccgtggtccaagcatacgtgtacgtacgagtgcaaatatggcagagctggaacaaaatcgtgcatgagcatcattactcattagagcatctcatgaacggaacacgtctctggaggtatacgtaataattaatttggcatatatttggggccgacgtgctgcatgtgcacgcatcacgctgatgcaggccgtgcatctgcagagcccctgaaatgaatgatgattatattccgaacaggtaattaaagtgctgactaggctgtgcgaattgtgatggatattatgaactaatgaactatgatggtgtcacttttactggacgccagctttcttcggcaaccgggtacgtgcgtgtccaggtgagatatgctgttgttaatgttgtctgcccgctgcccaggttttaacagcatcgatctggtggctgcgctgcgctgcgcgctgcagcgcccaaggggggcaggagcaagagggcatgtctgcatgaatggatgatgtgacggcgggacacacgcaggccgaaacgtgtcggcgatcctctgctagttcagtcggatacgcctgcacaagaaggcatgcacgatggtcggtcgctatagattttttgcatcctcttcccccacaggccacaaaaggccagagcatgcattgctgttttcgcatgggacaccggagtgtgccttactcgtgctgtgtgtacgtgtgccactctgccagtgtgtgcagcaggaggcttggtggtgatgccttcccttgtgtaggcttgcaagccttcgtggggttgagatattaaggtgcgcgcgatatggatgcttgtggagccaggtttgggacttgggagtgcaacgtggagtgtaggatgcaccatgcgcatgtgcacgcccgcagggtgcctgcgggcatgcggcatgcgtcaatcgcccgtggacacgtcaagtgaagcttggcataaaacctattagacacccgaggaagatgtgacaacagtgtagtgcccaattcaggcgggcctggtgtggcttcgctatatatgagtttcatcatgactacaacctctatatatgagtcatgcaaaaaaactaggtataaaactatacaacaacacttttcattaaaagcgagggtttcatctatattttattttattctatatgatatgacagtgatataaaactctttagactttaggacatgtttgtttccctcctaggctatataagttgaattgtgatggagggttaggaggttaagtatcactctggaattacaaataagctgaaataagctatctaatgctaacttatttgtagttctaaagcgatattttattactctcctactctttcaccttagtccaacttatacaatctaggatagaaacaaataggccctaacccaatcgaaaaggagaagtgaagctaattaaggagcccgcaaaaatagtcaaatctacaaaacatatatgaaacgaagggagacttgaacagatctgaaacctgtgaaaggacagacatcaagcaatggaggaaaaaaaacagcggaagcacggaaaaaacaagagcccatgggactagcccatatggacacgggatacaagcccatatgcgtgttcctattcttccgcccaaaataattggagccgcattcatggagcggtgtcctggcaatggattccttcctcctatgggccactcattagcc

SEQ ID NO: 2603 - DNA, 1466 bp, Zea mays
  misc_feature (1)..(100): optimal_loci_235393_G1, chr6:159218904..159220369, Cluster 15
gagcgtgagcgtacagcttttgtgctagtttctgttagcccggggggcatgcatgcatagcctatttcatccgaatccgccgcacgctgcactcacactttggcgtgtcgcgcacgtacggtcccactcgcgcacgcttttgtagcgggccaaggacgacgagcggaagcgagaaaccctaggaattcccgacagaacgatcgatctaatattccgccaagatctagctacgtacgtacggagacgacccaatcgtcgatcctcggccatctccggcacgtcaatcactgtctagctatagctagcatagatcgtgcagtggacgggcacgcacgcgcgtcgtccctgcagagtgcagagggatgtgtgtcgtacgcgcggcgccgcaccattggccgcccggcccaggctccgaacaacttggccgggctgaccacaccaccaccacaacacactcgtgcagacagcacacacacgtccactgctgtatgcctgtgtgcgtacgtgcgctgtccgagatcacacgtccgatcctttacaacgaccgacgacgcgtcctccagagaacaaatctgggcaatcgatccgaaccttttcttttttggcagccgatgtgagggggcgcgggtgaaaaaaacacgaagcctcctcgcatgcacgcgcggaaaagatggctagcagaagatcacatgatctatctaaagagtcgcctagtacgtgcgcgcgaaagaagggctacgcgccacaccacaccacaccacgcggtcgatgacacacacaccctccctcgcagcacccttttgcaagttgcgccgaggcccggagaaaagggagggggcccccaatccagtcctctagattcgatcgcgatctcgccgctgtgacaaccggccgcaggctcgctcgctcgctggggcctgggggccaagggcatggcgcggcgcggcttgttgtgtgcatgctagcgtacgggcgggcgccggggcagcagcagggagaaagccgtgcggcccggcccgtcctgcccgggtaagatctcgcgcgagatcggacggagaaagcgcgcaggtgcagcgcatgccagtggtgtagggcccggcccaatagccgggtgggggccgtgcgcgattttcccgaggaagatttgttcctccgtgtccgtgtccgtgtccgtgtccgtgtccttggattgcagggcacatgcgtgcgtgctgctcaagtgcctgatgcgtcttctttttccccgtgtggcgccgcgcgtgacgtcacccacagaggagagaacggaatcggcggcatcacgcaccgtggggctcaggtcggtccacccgacgttcctaaagcatccagctcatacaataaatctaatattttcaagtataataataaaatcttgtatagtttttttgtgtgcattattttctttccacaataaaacaaataaaaaagcatctgaatccgtattc

SEQ ID NO: 2604 - DNA, 1472 bp, Zea mays
  misc_feature (1)..(100): optimal_loci_236258_G1, chr6:163926527..163927998, Cluster 15
cacacgcgaggaccatgcctagatgcatgccgtggcacagttcatgtgttcgtgtaaactctctgaagggtcgcccccacttggcgcagcagtacatgcgtgcccgagtgtccattcaatggcatggcatggcatgtacgcgcgcgtgacatccataactgcaaagcaactcatctactgatgtacgtactgcaaacgcgtgcagacgggcggatacccatgctccaacgggcaacggcatggcgaaacggggacggcgtccgtaggcgtaggcagagaggggagggggcgggcccgcggccatgtgaccagccactggggcttgtccgtccgtgcccgcgggcgctgcgccgctgcgactgcgactgcgagtcaaggcgcgcaagcaactggccgtgttccgtcgcggtcgcccgccgaacaccgatggcatatcggcatcgcgcgctgggctgactgccgaggcaatgctggttgctctggctggtcccgctcccgctctcgtgcgccgcgggacgctgggtctggtcgtcgagcccgcaaccccaagtccccaacccgagccgtgcatgtggcgtcgagatcgcagtggtcctcgtcacccactgccactggccaccgtgccgttgggtccccctcggcctgactggacgcctggtgatccggtcgccgccaccagcaccagcaccagcaccaggctgtagctgccagggtcggcccccgtccgcgctaaacgaatgaacaatcacggaggcagcgcgccaggacggggcacggcggccggagccggacgcacaggacccgtgacagacgtgcaattctgcgtgacgatgtttttaatactgcaggggcacaagagggacggggcagggtgccagttttgtgctggagacctttcactgtcccgatcgatcgctgctgctacctagtagtagtagtaaccaggcgtgttctctcgcagtcgcaggcagctaataaagcagtttcgctagcttcggatccgggtccgggtccgggtcctacagggccccacgaggtgcgcactgcgcagcgcagcgcagcggcagacgtgtcgggttgcgagaatggcagcggcagcgaactggtctggggccgcgggatctggagttgttgcgatggttggcaacgctcatccgcccgaccagatctcaccgagcgccagcccgggcacacctccttgtcgtccgatgctccagtactattactactttccttcacggtcattcagcctccctttttttcttcttctttttgctctcccaccaactacgcctaccaaaggtgtaggtggtacacttgtttggatagggtgttattgaaaaaataaaaacaatcagcctgtatgcttaacgactgtttctaaagtggttttgtctagatagatttcagctacaacggtctaaacaacggagctctataggagtatccatcatcaggtaaaacaacagagc

SEQ ID NO: 2605 - DNA, 2732 bp, Zea mays
  misc_feature (1)..(100): optimal_loci_236448_G1, chr6:164788470..164791201, Cluster 15
aacattatattattgttaccccaaattagtttaaggtgaacatgcgaatcacgagtccaaattaagcccccgacagtccagtctgcatccgaactgatctatcaggaaccagtgccaaggagttacatgtgttatagtatacaattattacagtatcagctcgtatgttaacagctctccaatcgtcatccctatctatcctatgcgtagctggcttagcctgtgagcttctcaaatgttctcgctttcctttgcaatagactatagtttcgtctttcacgatttcggtaaacagagagagagagaagtttctgcatatataaactacggaatttgaaagtggcttttcagcaacaagcggaaaagaattttcgaaagtcgttcaaaaaaaaagggagcaaaccctaaaagcggcgaagagacaagacggcacagcaggttgcggcattggggagggatcgcggcgcgcggtttgaggcgcactccctctgtctttgttaagtggaaggaatatgttctgctaatctttctcaaatcgtctgggcctgcctgggctgggcggacggaacaggggggcggcaggaataacgcgtgccagatttctgcttctgtctccatgcacggtgcacctgctttcaacagcttcacggactgaaagaaagacaggacaaaagcaaaagatcattattccttttgttcgacagaaataaagaagaaaaaaaaatggtctgagtgcgtgtggtctctcagcaaactgcgttgctgggcaagcgaagggccgggacttggagcgacaacaacccgtaccgcggactcgtcgcctccatctcctccgctgtctcatccgggtcgccatgtctctagattcctctagaaaaattgccggaccacctttgtttcccttcatccgggccggctcgcgaaattgcagcgcgccgcgcggcatgcgtaggataggatggcgcgaaaggggggagcggtggtggtggtggagcgacgcagggtgccccgtttttttttacaaaaagttttcttcgtttcttttctgcctgcgtatttggagtcagttgagagtggacaccgggagcacggagttcggagccgcctgcgcacagctgggccactcggcgcgctcgaccatggctgccctttgctgctatgcttgcacgcacgggcaacgaacacctcctccctttttgcagcgcattcagaatcccaggtggtgtgagatcagctctcgtcggagaacgatacggatggaccgggtaggtacacatgtgaaactcagctgccacagacgggcaccgcaccgaggggccaggacagagacagaacagcctgaagaaaaacgggggggggggggggggggggggggatttggcctgttagaagcaaaaccgtcggaatttattgtttcaacagaagacggggcccaattcgaagcaacaagatactgtgccgtggctcccttgtaaaagcccgctcaattccgtggacgatgggagcacctgcgggtcctcgtacttttttttaaaaaaaacagttggaacagttaaaccggcccaatacgtcggtaaacgaaggcgtctcagcccattaaggcgttcgccatacattacgcgccgccactcttgtcatttcagtcgtgggccttagccgcggactgcctgggctgctacgggacaccactcgccttctatgagagcgatctttttttttctttcgtccgaatcataacagtagcactgcagcagcacgccatggtcgagtccgcctcgacaacgtggtgggcacagcgagatggtcggtacacgcgtgccgtgacgccagccagacgatctcccccgacctctggacggacaggcagcacggctgcacggcggcagcaaggcaactcggtaggcgccctgccgacgtgccgttgccgtgcggccacggcccacgaagcgagggcaccggttttttcccccaccctacgccttcgggctccgctgcgccggggactcctcgcttgtcgcagtccagcgtcatcggtggcgctcgcgcaccgacacggcgaaaaagtctgtgcgcgagctgatctgtcaatcgctctgactccatggccttcgtccatccactgcctggtctcccagcccaacaccgtgcgcccatgcttcattcttctccacctcttcttccgccctgtcggctgtcgccaccgtggctgcacccgcgtttgacaccggcgctgcatctgtcctcccccgttcaccatattatcaatcactttatcagtgatcaatcacaattgcagaagccacctctttcaccatggatcaatgaaattgaacagttttttattctcgtcggtgtccttaagtttttaaaaatactatactatgaagtctgaacacgttaataacagtttaacacggagaattgctgtctccgtgttgtctccacagtgaagaatcggatccggattgcaacccaccgtttttttctctgacctactcgttaatgtcacagccaccaggcaccttgttcttcatgctcgttcagctgtggccgccttggcttgctgccccatgatgtcgcaatcgatctgcttcttagacacagacgcgcgtccgcctccagctctcaggtgtcagccggtgcacttgctacaaacgccagcgggaacaatcctgcacctgcatggctcccgcctgttcaaagccattagttttcctcacgtagatttctta

SEQ ID NO: 2606 - DNA, 1505 bp, Zea mays
  misc_feature (1)..(100): optimal_loci_236451_G1, chr6:164792203..164793707, Cluster 15
gtgccgctaagcaaacgtcaaggcgcacgaatcacggcgacgcatgccggtggcgcaaacacacactgtacatgtagtagtgagggagggagggacagacatctctctcgcgcggctcgtcgtgtactcgtgtgtcattattcttctcgtgtgcatgcattgtttaactgtcaccgcgctgacaggcgaacagttcgcgggcgagagttgacctcggcaatcgatccgtcagtactagcatgcgacatgggtagcctagcccgtagccgcagccgcagccgggccggacgtgagaagaatccaacgcggcggcggagcgtgcaggcagggcagggcagggcaggccgccgcctgccccgtcgtgcgcatgtgctcgtgcaccgtgccgcgcgcgcgcttgtccccccggcccatcctcgcgccgcgcgcctgagaatgaacgcgtctttgcgcgcgccatgcggatgcggccgggctgtgatctgaatcggctgacgctccgcgtgctgcccgcgtgcacaggccgcgagcacgagacctgctcgatcggcctcggcgctgttgctccgttctctggagtctggaaaccggttcgcgagtgtgaatctgaccgcctgcggtagactcggatatgtttgggggtccgttggtgcacgcgtgcacagtatgcagcagcatgcttgttcagttactcatatatcctttttttgtttttttaaaaaaactaacggtcgaatttttcccagccgtacgtttcgtccaaagctgttcttgttctcttgtttgaacagaaactttcaatgctgctctttgccaaaaaaaaacgacaagaacaaaaaaaaaactttcaacgttattctccagactccagatatgtcaaaccggagagagatgaccagccacttccttttcctgactgaatcttacagcttaatccgtttcgtttttacccacggggataagaaaaaaaaagagaggctatacagtacagttttcgtcaacattctggtgaactgaaagaaacacagccgatcgagagacaaacgcctgcatacacacgcagaaacaagccgcatcatcaaacttcaaaaagaagtgtttgcatcatacatcctacgtgtacgtagaggcaaaaaatcatttgaagccacccaggccaggccaggccaggccccagcattgcgatgtgaacctgcaaggagatggggatgggggctcctgcacaaagattccctgcaaaaggcctagctgcagccccagaaaaggagtcagacaaatgacaaaagatacataataataataataatgaacacgaacacgacatgaaccaagtcaaaagggccaagcatctgcataaaccaccacaactctattctggaataaaaagtaaaaaccactcactcatcacctgcccagccttgcctggagctggagtcagggaggttcctggtccgccctttaacaacaagaataaacacccttttccaccagtgagtggatggatc

SEQ ID NO: 2607 - DNA, 1551 bp, Zea mays
  misc_feature (1)..(100): optimal_loci_2459_G1, chr1:12874218..12875768, Cluster 15
gcttatcttgtcagaacctaacattaccagctagcagcaccagctcatcaggatcgtcgattagtctgtctgctcatcacacattcttctgaatcgacagctgcatgcatgcatcattaagacatactcctgtctctagacggaaccatctaagtttttaattgcaccacagacgagagtcgatgctaaattatcaccatgacttttgtaaaaaaataataatatcaccatggcagttgacaaagcaagttactatatatgtgaccccaagcagagtagcagatcgacgttcctgtgcagggacgacggcaggccattttctcagaaacgcgccatcgacgacaggccattttcagggcgcagggagtcggcgcgcccatgatcgcccatccggtccaggaggagcggcaaacaccgtgctgccgcgcggcgcgctacccacaccatacagccggcggcatggcaccgcgctgaccaccatgtatgtactcgagcgaactcactcgccatttgccgtgccgtgccgtgcatgcaccccggaaacggtcagcgcgcgcgcgcgcccgtgcgtccgtctcaacgcaacggctgaggcggaacactccgcgtgcggccgcctggcgcgtcgcagtctcgcagacaccgaacatgctcggcattggcatctccgtgtgggcaccgggctagcgggcgggcgggccggccggcataactccgtagggagggccggaggggggcctcgatctgcctggagactggaggctggagttcgtgcgtgcagcgtgcggtctgaccgtctgaggctgagctgggtagcgagtaacgacggccggggggcgggcgccaccgccacgcgtcgtgcggcggcgtgccctggccgcgcgcgcgttatgggcagagctcttgggaggcatggatcggatcggagctcgtggacggaggcgcgcgtctttgttcctcccatgatggccggaggacggtagctactagctgccggttgcatttatgtatgtacgtggcgaccgagatgcgtgcatgtgcatgcacctgttgccggcggcccggcgccggcgtcgtcccaagtgtaatccagagcagagccccggcatcgcggattcgctccatccgtcgctgcgggtaccggggtactacgtgctgacacaaagcgggccaaggaggagatgtgtgcattgtgcacgctagctcgctagaatcgcattcgatcgatcgagtaggcagccgagcatgggctctgaaaaggatcggacgggcgtcgtagctgatcgcacgatacaacccggctaccatacgtgtagacgttctctacatttcatctcctaatgcttagtttgggaaccaaaatcgccttgaaatctccctcttttcgcaggatgaggaatacctcccaataacatttaaataaggtatgtagttatatacgggagggttttttctgcataggtttgcctctgccctaaaatattattctccgtcctttgtatcaccctctaaaaaaaatccattatctatatccaaactctcataagtaag

SEQ ID NO: 2608 - DNA, 1656 bp, Zea mays
  misc_feature (1)..(100): optimal_loci_250167_G1, chr7:84710605..84712260, Cluster 15
aatatatggtatgcatgcgtcgaccagatggtagcgtcgtcgtcactgtacatgcatgatggatggatgcgtcgcttggcatacatgcgtgtcttattccaacgatctagaaacggatttgaagggacagacggacagacatccctctacgtgcacagtagaggctgtactacgtgcgtatgcacgagccagtgtgcatgcatacgctttccagcaagcaggtcgcacgcagtccccctagctagtgcatgcatgcagcagtggccgcgctactgttgggttcagctccatgcacccccaactgatgaaaggccacagccatcgggtcagtcagttgtcacagcacaggggcatgatgtacatgtacatacactgatgtgctggctgccacacaggcccaccgctacagtacctgttggagactagactacattgcgttgcatgcaatgcaccgcaacgtcgtcgtcatattcgatggatcacggtgcacgtacatacgtacgtacatactagctatagctagtacgacgacaatggttacttaacgtgtgcatgcgtgggtatgcccggtatggaccacactgtgctgtgcgcctcagtcgctgctgttgctgttgctctgaggaaggagagagagagagtgatgtgagctacgagtagtagtactagcttgagtgtgtggtactgtgtggtgtgggagtgagtgtgtgtgtgcgtgtgcgagcgtgagagcgagagacgcagatgcctgagcgcgctgctgctcgctgtgtgtgtggtagcgtggtcatgtcactggcagagccgcgggcccgcgaggcatgcatttggaaactgagatgtcagcgtggcacgacaaggccactgttgcccgcagccgcttcctctgttgatgtcgcgcgcacatgcattctcctatgtgcatgcaccgtgacaacgaatggatcacagtcgcaatcgctcgctcgctctctctctctctctctatgatgcagcagtagcagtactgccgacgacggtctcttctcatcgatctagtcacatcttctttcgtcagactagctcatcaggacctctcaggtacactatagcccatcacatcacatcactcgatccatcctgagacgatctttgctttctgctagctagcttccaatttgttagcagcgcaattaataaacgcgacacagcagctagcttaaatatatatagtacgtgcttagcttgtattatcatcagttgaatagattatttatgtattatcatttcttgttgttgacgtgactgaatcaacggatgacacgtactacacggcctccattattgccaagctactacttcgcggctgcatgccctcctttgtttggaccgccgggcccaccggtcactgacatgggctgcaccggtgctccatttttggtgaacaacaagcgcaagcgcggctcgctctcgctgcgtgcatggatgctagcaccaggctccatctgcatgcatgggcaccaacagtacgcctcctttaaaccctgcggtcgtccctaccagcagctagtgctattactgaacctgtcgacatatatacaaggctagtacaactatacatacatatacatgccacggatctagctagaacgtcttttatatgaggtgttttttatt

SEQ ID NO: 2609 - DNA, 1919 bp, Zea mays
  misc_feature (1)..(100): optimal_loci_257098_G1, chr7:123696583..123698501, Cluster 15
tcgtgctacgacgagtctattcattcatttccatatgcatgcatgggaatgggccatttggatcgccttgtcaggatagcctttttatttgcgtgatgagtgcagcagggaacaaaactattcaatggactcgtgatctcgcaactaagtagtcgtagtcgtagtagcatgtgaataatgcgatgccgaggaatataatgatgcggcccttcctcatcagaatcagtctggaagtagtccgatcgggtacgtaggagtagggctacgcgcgcacctgaaaattggccattttaattttgcatgagggagaaaaaaaaaaccaaaaagaggagcgagtacgtgcttcagttctttcaagcaaagctgctaacagcatagcgtactgtattactaattgatcatcgtgcgtgtggttctgtgcttacagcagctaactgttttctgactatgaaagggaaaagctgtcggtattacctataatttgttgtccgtttatttatgaaaagagttagaacactgccggtacaacgaactacacatctgaaacaacaatataacacacacagctggagcatcgccatgcataggtagctttgccttttgagaaatgtgatctactccagattttgttttccgaaaggtcctgacatgatggcatgcgcatccatgcatgcatgtcatcaagccagagggcggccagagaaagttggagctgaaaaccgctgcatccacacgcacacgtacggctggcaagcttaatgatgcgcgcaaatgaggctgccccagctagctaggatcgtcgtgtttagagatatctaagggtacagtaatagtaagagcaatgactgacgacaacctgttgacacatcagtcactgagtgagtgagtgagtggctactgctacatatctgtgtccgctcatgcatctgtccatcatcatcagtgccccggttcccctctttggcgcagaagtcaaaacacagcttttttttttcttcccctcccccggtaatccggtggccacacagctttgaaatggcccgtgtcaatcattgcctgcctgcctgcccgccgcggcgctggttattatcagtaaatttcccctcttcccataatcctactagaggggaagccgacaaggacgacaacgggcttgcaggcacagacgagcagtggtgggtggcagtgtggcacaggcatcgcaagtcaaacagttgcacgaggttgtcacagccagccagtcacgcacaagcacaattgcacaaaggaacggaacggaggacaacggtggcgccgcatgcatgggttgggtcgggccggtttcggtgggtgtggctcatgcgggtgatcaatgcggcgcgtcgtgcagatagctctagctggtaggcggatttggatggacctcttccattcaaccgtacgggccgcctgcccggctggcggctggcccagtcgatttgggtggacgccgccgccgcgtgtattcactccccctcgtgattgcatttgcggctcgttcctactcagcctggccgcggcgttaaccgtcggcaggtgggcgaggaggcaacaacccgtcttgcttacgtacgcgcgcatgcaatgtgcacgtttccccttcaaactagtttgtcgtctcggacagcagcagcagcagccgtgcagtgtccccgtgttctccccgcatgtgtccatgcatgtacaacgtcaactagtttgcatttcagcaacagtacacatcggtgtgctcggtgcaacgtggaatgtagggtgaattcgcatcagttctatatattgttctccaacctctcctaaggcccgttcgtttcggccggatcggcccattcccgaccttgtgctggtggaacaaattggtccggtttgaaattgggtgtgatttattgcaggtgttcgttttg

SEQ ID NO: 2610 - DNA, 2318 bp, Zea mays
  misc_feature (1)..(100): optimal_loci_260260_G1, chr7:141519603..141521920, Cluster 15
  modified_base (480)..(480): a, c, g, or t
  misc_feature (480)..(579): n is a, c, g, or t
  modified_base (481)..(481): a, c, g, or t
  modified_base (482)..(482): a, c, g, or t
  modified_base (483)..(483): a, c, g, or t
  modified_base (484)..(484): a, c, g, or t
  modified_base (485)..(485): a, c, g, or t
  modified_base (486)..(486): a, c, g, or t
  modified_base (487)..(487): a, c, g, or t
  modified_base (488)..(488): a, c, g, or t
  modified_base (489)..(489): a, c, g, or t
  modified_base (490)..(490): a, c, g, or t
  modified_base (491)..(491): a, c, g, or t
  modified_base (492)..(492): a, c, g, or t
  modified_base (493)..(493): a, c, g, or t
  modified_base (494)..(494): a, c, g, or t
  modified_base (495)..(495): a, c, g, or t
  modified_base (496)..(496): a, c, g, or t
  modified_base (497)..(497): a, c, g, or t
  modified_base (498)..(498): a, c, g, or t
  modified_base (499)..(499): a, c, g, or t
  modified_base (500)..(500): a, c, g, or t
  modified_base (501)..(501): a, c, g, or t
  modified_base (502)..(502): a, c, g, or t
  modified_base (503)..(503): a, c, g, or t
  modified_base (504)..(504): a, c, g, or t
  modified_base (505)..(505): a, c, g, or t
  modified_base (506)..(506): a, c, g, or t
  modified_base (507)..(507): a, c, g, or t
  modified_base (508)..(508): a, c, g, or t
  modified_base (509)..(509): a, c, g, or t
  modified_base (510)..(510): a, c, g, or t
  modified_base (511)..(511): a, c, g, or t
  modified_base (512)..(512): a, c, g, or t
  modified_base (513)..(513): a, c, g, or t
  modified_base (514)..(514): a, c, g, or t
  modified_base (515)..(515): a, c, g, or t
  modified_base (516)..(516): a, c, g, or t
  modified_base (517)..(517): a, c, g, or t
  modified_base (518)..(518): a, c, g, or t
  modified_base (519)..(519): a, c, g, or t
  modified_base (520)..(520): a, c, g, or t
  modified_base (521)..(521): a, c, g, or t
  modified_base (522)..(522): a, c, g, or t
  modified_base (523)..(523): a, c, g, or t
  modified_base (524)..(524): a, c, g, or t
  modified_base (525)..(525): a, c, g, or t
  modified_base (526)..(526): a, c, g, or t
  modified_base (527)..(527): a, c, g, or t
  modified_base (528)..(528): a, c, g, or t
  modified_base (529)..(529): a, c, g, or t
  modified_base (530)..(530): a, c, g, or t
  modified_base (531)..(531): a, c, g, or t
  modified_base (532)..(532): a, c, g, or t
  modified_base (533)..(533): a, c, g, or t
  modified_base (534)..(534): a, c, g, or t
  modified_base (535)..(535): a, c, g, or t
  modified_base (536)..(536): a, c, g, or t
  modified_base (537)..(537): a, c, g, or t
  modified_base (538)..(538): a, c, g, or t
  modified_base (539)..(539): a, c, g, or t
  modified_base (540)..(540): a, c, g, or t
  modified_base (541)..(541): a, c, g, or t
  modified_base (542)..(542): a, c, g, or t
  modified_base (543)..(543): a, c, g, or t
  modified_base (544)..(544): a, c, g, or t
  modified_base (545)..(545): a, c, g, or t
  modified_base (546)..(546): a, c, g, or t
  modified_base (547)..(547): a, c, g, or t
  modified_base (548)..(548): a, c, g, or t
  modified_base (549)..(549): a, c, g, or t
  modified_base (550)..(550): a, c, g, or t
  modified_base (551)..(551): a, c, g, or t
  modified_base (552)..(552): a, c, g, or t
  modified_base (553)..(553): a, c, g, or t
  modified_base (554)..(554): a, c, g, or t
  modified_base (555)..(555): a, c, g, or t
  modified_base (556)..(556): a, c, g, or t
  modified_base (557)..(557): a, c, g, or t
  modified_base (558)..(558): a, c, g, or t
  modified_base (559)..(559): a, c, g, or t
  modified_base (560)..(560): a, c, g, or t
  modified_base (561)..(561): a, c, g, or t
  modified_base (562)..(562): a, c, g, or t
  modified_base (563)..(563): a, c, g, or t
  modified_base (564)..(564): a, c, g, or t
  modified_base (565)..(565): a, c, g, or t
  modified_base (566)..(566): a, c, g, or t
  modified_base (567)..(567): a, c, g, or t
  modified_base (568)..(568): a, c, g, or t
  modified_base (569)..(569): a, c, g, or t
  modified_base (570)..(570): a, c, g, or t
  modified_base (571)..(571): a, c, g, or t
  modified_base (572)..(572): a, c, g, or t
  modified_base (573)..(573): a, c, g, or t
  modified_base (574)..(574): a, c, g, or t
  modified_base (575)..(575): a, c, g, or t
  modified_base (576)..(576): a, c, g, or t
  modified_base (577)..(577): a, c, g, or t
  modified_base (578)..(578): a, c, g, or t
  modified_base (579)..(579): a, c, g, or t
caagaaggtgacgctggcgatgatcaggtggccatgtggaaggccctgagctcaagattgcagacgcgatacgatcaggtggtctgattcatccaagcactcatttcacctcgtactgccgatggagatctccccccacgacgactttttttttctgcaccccttttttttcctcttcatttaaatagcaatggttcggttgacacacacatatatatttcgttcaataagaaagggttgtcagaaatttgaagatcgatgatgacgatctggccatgctctttccctgacgacgagacgtcgtaggattcaatggtgaaaccctgcgtgcctcttaaagaaagctctctgtgtctctctgtgcgtgcgtttcggccatgcttgtcttcttcccagtctagcctagcttaggcttgcttctttagtttctaccaccgtacctagaaaggatgaagtagtcagacgaatctctagaatcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccaatcctttggtatatagtattcctactgattatactatcaggtcgcagatgaatagggttttgcaggactgaatgaatgacaactacagatccagcgactaatcgtccataatacagtactaataaccggtgaagtgacagtcagattcattcacccagctgaaacaacggaggggaggggagggaaagagacgatgtgcctccaggacgggtgcaggcttaattggcaggaggtggtttcccccatgcgagcgtgcgtgcgtgtaaagaatctggctggacatggactgaggctggggaggggactgccactgcatggcccctttttaaccggacagcggcgcagcggttgttgataaggatatactgtactcgtagctagcatgacgattgacatgcaggtggagcaaaagcagcagcggctgctatgcgagcttgtcagttgtcatggtcaggtcaggaggaggaggaggcctggcgcccacagaacatgggcgcggattgaatgcccaaatgcttccaagcagagcagaggcgcaaaaatgaatgaattcctcagggctccaggaggcccggggcgagcagtgcacacatgtggatcctgcaatcatcgtcgtcggcacactgtccgtttctcctcccacccgattcgagttacaggttccaagtacatgtgtgcgccagtaacaaagcatacacggtatgcatcataagtggccagtgggtgtgcatcaagtggatggatatacatatagcagcaagggagatttattatttgtggacactatagcttcaatcgttgtgcgtgtcgaattgcatgtgtctggaatcctgaattctgtctggctaccttgtgcgagcaagaggataggatttgtgtgtgtgtgtgtgtgtgtgcaggcagcaggcttcatcacgcacgcatgtgcgcgcccaggggactggataagcaagtgtgcatgcgcgcgtgctgcgccacacaacggaacggatgaggacacagctcgcctcccgggaccttggaaggccggacgggacatgggacgttcatttcacacaccgttacctctaaaaacattgcaggacgttacagccaagaaggaactacacagcgtgaaaacaatacgctgctgctactactactactggctgatcagcagcacacgcgccaaacgccgttccactgttccagtttcgtcagcggttaaccaacttaagccccatcacttgtttgtatttgtccatcattctgatcgtcttcatttttcttcagagctccagcagcagcttgctttctcttggacgccacagtatccatgaccacatgtccgatatctaactaatgcatatatatgcatggcaaattatctccaaaagatttttgtcaaatttccttgtcaaagcatgcatgctttactctgagctttccagatatacaacaaattgcagctaccacctgcatgtgcaatccttgcgaaccaacggactctagctagagatcggctagcgatcgatctctgctgttatatgcccccaggtctgcacgaaatactggtggcagatcggcctgtgcaacgcaccgcactcttatgttcctggcaacagcaacgtttagatctactactactacccctctgatgccggtgtttatgtggcaccccgcacccacggctgccgccgctccccttatctgacgcgtgcgagagcacagcagactggtaggggagaggacagaa

SEQ ID NO: 2611 - DNA, 2705 bp, Zea mays
  misc_feature (1)..(100): optimal_loci_260484_G1, chr7:142880138..142882842, Cluster 15
cctctgattttaaactaaataactttatttaagtaatcgtcacagttcgtcattgtatccaaacatgcccttatatacgaggagaggagcttggaagaggagaacacattggtcggcaatttgtaagggtctggtggttttaaatttaaaccatatggattgcagagatttaatgatctaaattcatagcaagttaaagtcttctctaattttttctaaactcaacaaaaacaagaatgatcgaacaaggtctaactttggtatgttcgaccgtcgacaaatctgacttttttttttacaagaagtaaacaaaatctggtggacagcaggagcaacacatctggttttgcctcggacccccaaaacggaataaataaccatgttgggcccgttcacgccagactcatcttttcgcactacatggcctcgcgccatatgataggcatgggccgcaaagcccagctctgcacctagcccagtaagccagcaatgatgcagcgggaggggcaaaagctggcatcctggggccgacacaatgagtagcgtgtttccctttcctttagctccaagcttttgcactcactcgcgagaaggcatatttgccggcacccagcagcggcgcgcggcgcccatatcatgtcatgatccgtgatgtcacgagacggcatgcatgccgatcggcgagagaacgtggcgccatgattccttggagatggatggcgatgaatccttcctcgcttcggatcctctttttacagcaacaggtgcagcgccccatcagttaaaagggcgcaagtggcctgcagaaagaaagctcattggaaacgtgtgtgggccgtggggcggtatatatgtataaagatatatgatataaaagaaacgtcacccaaatttgcgtgccaataccatcgtgaaagattatctaaagtgaccacaacattaatttgcatctaatttattaatcttatttattattattacaaataactaaaagcgtcccatagaatttacttctaaattactaacataaaatgttatagtaaaaaatcaataaccataaatatgtctatatgtgtttcccttttgaatatccactcgtatcgctgttaacaaaatattaaaagcaaaggtcaaggtaaacacacttgtgtgccacgatgaaaaccaaatgtagtacctggatgcatgaatgagtggtaaaatagattttgatagagtatttctcgacatctagattgcacaaaaggagcattttaaataaaatatataataagcattatattagagtttttacttgaatatatggattaaacaaaaaattacaacaactaatgacatcaacacttgaaagctgaaatctagactgttgaactcacgacacatgtgcttgaacaattgtttatataacttaagctaagctttcacctagctaaacacatggtgaagacacacatatatatgctagaggagaaaactatgaatatgtaaaaaaaaacatatcgaataattagtaaatctacaagaggcatatattacttgcaaccattaaattcatccacaaacttctaactcatatgcttatctcatataggattgtagcgtgtgcataaacacaggttgtcaacctaattaagaaggagcgcgcgccctagggaggaatatataagtgttaagcagaagagatgtgcatgggaaaaggcgcagaaggaatcctgctacttaaatatgtgcagaacaaagggcgtttggaacaaattcttatcgtacacgatttggcacggggaaagctagggggagagatccaaagcatgccaaccagcatacatacatatataggcatagcccaatactcatctctatctatcccaaatgtgtctggtcaactccttgcctagctacgagagagatcgatggactgcatgcagattcgtgttctttcgatgtttgtatctttatttggggctcagagaggctggctgatcgctgaacacctgctgctgtctgtacagtcgacttgagagggtttcagaggaggcgcacagtagccgactgcagttgtgtggcaacggacagacacgcacctttctatcctcttctttggccatgacaactgacaaggtgaactggtctctctgcagaaaccaaagcaaaggtgacgtggacttgaaagagctgcctgtactacacgtcctctggaacgaaagcgccggctatgcatggattcccaaggagcagagcgctgcagcagccctgcaggtgcatgggcaaagccgggttcggaacgacgaagcataagagtcagacggtggtgcgtcgtctttgttcctttctgtcaaaccaaagtcaccgcgcgcggcaaagaaagcgcatgcaggagaactcggggggctggtggtgcttttctcctgaaaaatataatgaagcgatccatgagcgtgcgtgcgtgcatggagatggaggagcaatggagtggagccccacctgaggcctagagatacgggcgatcgtgccctagctagctccgggtcgcatataaatgggaagaaaagttgcacagggcgcgcgacgagggggctaaaccatggaagcaaagaacaaattaaaggcgacctaaggcccgcctaacccaggtaacttttgcttgctctcccagtcaggcagtcgcagaggaaagcgtagtcggaaagcggatgcccctagctcat

SEQ ID NO: 2612 - DNA, 1777 bp, Zea mays
  misc_feature (1)..(100): optimal_loci_262979_G1, chr7:156657611..156659387, Cluster 15
ccattacacgcgcattttgactatggaatttctgaacagaattaaatgcagaaatgactaaattcctaaccgtactctagtactctccagtagtatatactactttacgtactgccttgagttagttgaacctaaacccccgacagcacgtcggtacagtacagtacagtacagaacgacgcttcattcgatcgctacgtagtacgtacgaggtaattatggcgggcgggccggcctgggctgtcaatctatcgcctccgatggatcgatcgatcagaacggattgatggatggagacttgaatgaatggagacggagccgtggccatgcatggcccattgaggctggagctaggactagctagggcggagagagtgatgatctggagggcgtggaagttgggcgaccgaccgaccgaccgaaaagccaaaagatatacggcgcgcgcggcccgggcggggagaggaaagcctcagccgatgctggtggcccgccgggggcagagcagagaccggcgcagcgcgaaacagggcatgcaactgctgctgctgctgccgcccgcgctctggtcctgctgctgcctgaagctatgagagctatggctctcctgccattgccttcttccgcgccacactccgcctgcgcgggcggcacgcggcagcagcaggcttggccgacgacacatgcgcgagccgtttcccccgtcgtcgtcgtcgtcggccgcgtgcactgactgtagcaagctgtgaataggccaggcgctgtgcgtgcgccgggccacggtgtgtgcacatggaccgcgccaggagcgaccacgccggcgacgaaacacacaaacacagagaagccaggcaccaggactccaggagacgagacggaccaagatcaagaggcatgcatgcggctactagccagagcccagagccagacttgttggtcccttcccttacccctggttgcttacaattaatggcgacacgccacattgatgattcattgcattgataatctgtacgtgacggtggctctaaaggctccccggccgccaggacccccttttaggtaagcccaggcttttgcttttagcagacacgattcaacgacgatcggttttctttctttttttactatatcgatcaaacttgacccatctcttggttgtggttcagtactccaatccagtgcaaactgctcaccgcgcgtcaccgggccccgggaccaaaacttggacgtaaaactgaagaagggcaaaacttctcctttttgcaatccttgcacaccactatagctcgtcatacactcaaacaggcggttatgtcacagttccgaccagcggccacatacataggtcataggtgtcgagaccagcagagaggagaaggcgagcaacaagcaggcatgcctctgctacgacgtttctgccggcaggcaagctaggcaaagcgcacgcaatggattgcactcaagtgaccatgtccccgcacacgtcaacaacaacattgctacgacgtttcgggcgggaaagggggcatgctagaaagctacgtacgcagcaatgcgtgcagctagtggcacgtactcatggtgtcacgcgcacgagggtacgtacgctcagatcatcagctcaaggagccgtcagttcgtcgctcgtaaagccaagccaaggaacaaagacgcgtcgtacgctcaacgaagctttagggtctgtatactgtatactggtacattaataattcgccgcgcgctacaatctatacctccgttcacaaatatgctg

SEQ ID NO: 2613 - DNA, 1449 bp, Zea mays
  misc_feature (1)..(100): optimal_loci_264190_G1, chr7:162336834..162338282, Cluster 15
atctagcgcctccaccacacgtccacgccccgcgatgcctactggcggtataatatgttttgtgctttaaaatctagtggttagggcacactcgaattacctaaacgaacaacgatcaatcaaaatcgtggtactatagtttcttgttataatgcacgggtatttcacgattcatgaacactattctaaacgagagagagagttgggaattgggagggtaatgcttactgaattgggctgctccaaaatgcatttcaagttcagtctagttggaaacttcctccataaacaggcctaaccattcctgaccccgcggtaagcgatctgaaaacctattgggccaaagcccatgagctctacgagcttggaaaaagtgaagtgaagcactaggccacagagggcgacggatgggacaacaaacgtgacagaaaacttgagcactcgcatctcgggcggaggacagcttggcagcacccgtcaaaattttcagctccacctgactgtattcgagggcttttgcgagagcctggagaagagaacgcaaacgcatggctgcaaagctagcaagcgcctggagaagtggagactggagagcatcggaaaatgtagccgtgcttggcatcaaaagctgactgaatccaaggccgggaaatgtagcccctggaggagtagcagctagcagtagtgtagtagtactatgcagtctctgaaaaaaagtgagccagacttccgtactgtttgaacaccagcttgtgcttgtcctaggaatcgtagctttggaaaatggtcgcactgctcgtaccgtgctcgtgttgtgttgctccgcctcagctgaaaaaaagctactaggtacaaaaaaaaacttgtgtgcactgttctaaaagccgcgttggatcagccatcctgaaatccggctttgccctaatgggaatcggagctgtagcaacagagaaggtaacgaaagacgagcgagctgcagctgtctcctgatcgagtgaagcttctgctgcttttttcttctttttttttcgactcgaagatatggcatgttattgcttccaacaggacagacattgggctagtccgtgaagcaacctctctctctccggttcagatctaataaacacaagggagcctaaagatgcttgttcagcgttgcagatgccctcatgattatttttaataaagcgtctcgagatcgatcgaatttgttaaaagtgtcggtattcaccaaagattcagcgtcaagtgcttttatttaatccgagacatttttggtgcctgacatcgatacaaaagtcggctacaaacttgtctgccgcgaaaccaagcaggcgaacggcgtatgttgtcgacaaaatgtttttgtagacataagcacggaggaaatagacaaattgctatctaacgggatctctggtggcatggcatggcatggcatgaacgatg

SEQ ID NO: 2614 - DNA, 1475 bp, Zea mays
  misc_feature (1)..(100): optimal_loci_264766_G1, chr7:165798273..165799747, Cluster 15
acccgacgcggccaatggcagcttaaccctgcatgacataattgcatgctttgcttcttcgttgcagaagaaacataccgtttactaatagaatttcagcagggggccacacacttcttgttcgctcgaaaaaagagagagagagaagaagaagaagaagatagttgagttagcagcaagcatgggcgggccgggcaggtggccgaacaagcgacggcaacggcagcaccagcggactgggccaaccggggacggtgtggatgagccgatatccgcgcccaatcgccctgcattatctatcatactagacgattgttggaaaaacaaatgcgcgccgtgacgccacacgagcgacgtcgatgggtgcagcaggaagggaacttgggtttgctcaaccggaaccgcccacccccgaaaacggataggctcgcaccagcgtgtcgtcctcgcgtcgtgggccagccatgcccacaggcagccgccaccacagctcgccgtcatggcgattcctcctcttcttcatcttctccctcttttcgccgtcagggcacaggcgaggacaaatgcgcctgcatcagcaccgataccgacccaaggctccgtgtccatgtactactactactactactggagtatataaattcgcgtcatccggtgcgttttcttgcgttccggtctctttctttctgcttcgcttgttcgtctcgtgatggacgctcttgcggtcgtcgacctactactcttcctgccattctcgcaacacgtcgaatgatgtggcgttgcgttgctgcccacgattttctccttgtacgtatagtagtaatctgatgctgctgccgctgccctatcctacggaagataaaaggattctgaagatgtgacggggggcaagattagcttgagattccgggcgtgccaggcattttttttaaggatctctatccgaaaaggatttgacaattgcgatcagtacgcttaatccacggtcacgattacgatcgcgtcgctttcctaagttgggcatgcttgcacgcgggaacgctgcaaccattgtttgagcctggcaaaggggtgactcggagacactagtaccggtcaaactgctgcggcgggcggcgtctcaggttcctgtggatttcctcctcctcctgagcttccaacggtgttgtgttgaccttttcgttattgcgacgtggcaagggcggctacggcataggcatggcatgactgggcctgaatttgactcgcgaatctgtcagccatgacatgagctccgtccctgaccggtttgtttcgttcccaacaaaagggaggggggctcgcctcaagaatagaatatatggtgtgccgatactaaagattcagggttttggaagttgaagctctagcagttattcacttattcgtgcgtttgaactttgaaggaacggaggccagaccttgtttacgctttcatctttcgtcatgattcatgg

SEQ ID NO: 2615 - DNA, 1741 bp, Zea mays
  misc_feature (1)..(100): optimal_loci_264767_G1, chr7:165799781..165801521, Cluster 15
aggcccctcgaaagcaggacgcagtcgcaggcatgtgcggcagagccgggaaacaacaaacgaacgcacgggcgcagagcagcaggcaggcaggctctgaattttctgaaacgacggtcagcacgtggccgtcatcagatacctcagatgagatggcaggcacgctgattacagggatgccttcttttgcgggcgcccggcgccggcgccgcggcagccttcctttccttttttttttcttttttcttttctccaatgccgccattagaatgatggggtcaaagtcccaaagcctgctgattagggcggcttttgtatttgacaacacattagtcattagattaggttcacacactatgatggatcaaggggacacagaacgcctgcctgcattaagtcctggaatctgtttgccgctcgggaggacaagtgctccgtatagtactacgtactacttgcggaggtcttgcagaataactgctcttctgaactgagaattctggctggctgcgctttggaagcttcctctcgctgcgtcagcgcggagctagcgctgtgccgccggggccgggcgccggcgggatcttttcctgcatgtgcgacgcgaagggcaaatagagccgaccacgtggacggggttcgtggtcggcatgcagatgcacagcgaggcaccgaagcgtgcagccacggaccgaccacccaacgtcgcgccaggtgcgaggcgggcggggagtggaacgctggaatccgtcctgcgtcccgatacaggtggcaccggcgaccgcgacgcgcagccaccggtggagcactcgtgttgccgaggcgtatatacgtgggcatgggcatggctttgcgccgtgtcggtgataggcgccgccgcgctgccgtagcgccgccaggtcggcagcaactagacaatcggtgggcacgtcgtggcgcgagcggattagcgggtggacatgagacggcggctgaggccgatggcgggctttggtcatcgctgctagtagctgttgtttcttggttattggcccatgttgcttcactagcggttgtactcggtcaaagtaggccaccgtaatctctacttctgcgacatctagctagttcttgggagcagttattagaggaatattttttttaaagtgtgttgaacactaattttgcccctgaacggtagttccgacctaattgcccggacagtcctcctgaatgatctgtgattaaattaattcaagctcaaatcctcatttcgtacctgtatatcatgacaaactcatgagaagctttgggtgatctactgatctcgaagcaaccatacgatctctcccttggtctgtgttactttttaccggtgttacctgatatgataactgtgttacctttctgtgtgttaccggattcttgaactctgttaccttacctcccccttggtctgtgttacctcttaccggtgttacgtgattcttgatggctattagctattcttagtgttatcggattctttgaacaggctcggatttcatatctatttgtaaattattacaaaatactagcctgggtttctagattttacccgcctgtaacatagattttaccagtgggtttctagattttaccatcacagattttaccagcctgtaacctagatttaccagcctggaacacagattttaccagcacagattttaccagtaaagattttactgcattgcctctttattgactctggtttttgaag

SEQ ID NO: 2616 - DNA, 1714 bp, Zea mays
  misc_feature (1)..(100): optimal_loci_2648_G1, chr1:13559242..13560955, Cluster 15
aatcatctcgctccgagacatgtgtgtggttgtcaagtttgataggaagagcgagaaaacaagatggcagtgcactccctggcagtactgacacctcggtgcatctgaaagccacacaaaaaaaaatgagcatctcctaccacctgtttttgccctctccgtcctggacagcccccacaaggagaaaagctctctttgctgcgcaggcgagagtttcttcagcgctaagcttggaatcaaaacaactggggcgcgcgcgcgcgttaggccatgcagcagcccgcccagctagctgcgcgtggatgcagtacgtgcaaagcaaaagaaaatcctttgcttgggaataaaatcacctctgccttgcgttgcatgcgtcgccgctgcagagctagctagcacggccggccggccttcgtttcatctcaaacaaataaagttcaggacctgatatatatgcttcttagtcgatcagtctgcgtgcaaaacgacgttcttggtaccatatatatgtacactactacgtcttaattaggagatgtgtagattgtttgtcctagctagtggcggtacatacatgcatagtcatgtcgggttggacggttgtgggaggttgagctagagctacgtactagcttgtttgactgaactagctagatcgatcgtggatcagcatgcaagctaatgaacttcttaggatgcatgcggtctcgctgtgctgttggtgcaagatgtggtgtgaaagcgacgacagcgaaagagggggaggcatcttgtgtgtccatcaccatctgctgcgcgccataaggctgcgcgcggaaagcacgcaccgaccttgcctggccggtaacaagctagcttccctgcggccgccggcccgcctatagctagctagctacttctccctcacactcgctcttatcttaatctctctccttcgttcatataagtaactccctctccatgaactctctctttatctctctctctctctctctccactacaaacaatcaagcttgttctttgatcatcgatcgctcatgtacggcagttgaggggaatgttgtctggttggagacctaacaccgcgaattaatcatccatgccatggaagcagcatatgcccgcctgcatctatccatgcatgatggtggaaggtttcggaccaggcttcattccccccaactcaacactcagctgcgtcgctcttccgtctccgatccgaatacaccggccggcggacgacgatgacgaccacgacggcggcggcgcttcctcaaggctcgctctgttggcctgtcctagctaggaaccgttccgtcccatgcatatgatcgaacgacaactctttctccaggtacgactaatcgccaccggaatatacttctcctctcgatcggtataatatataacaccgcatctcgctccttgatactgtcataaattagatcgtctttccatgcatcatgatctagccaagtctcagactgtcactgaataacattgaaaatgcttcggttctttaatttggtccgcacagcttttacactgttactgatatatagcttcactggcggtcttcttctcgatcggtcggtcgttatttaacctctggtttggtaggtcatttgctttcaaatattgaatttatttgtaattttgtatctatgcctaatgcatgcgtacgtcatgcctgaagtttctttcttttctgct

SEQ ID NO: 2617 - DNA, 2096 bp, Zea mays
  misc_feature (1)..(100): optimal_loci_264922_G1, chr7:166752460..166754555, Cluster 15
tacgcccaaaacgaacgtacgcggtcggccaggctcacacgagattgtacacgtgggtgtgtgtacgtcctacttttaacttcgagtctttgactatataaaaattccataatcgatacattattttattacaatagtactaaaagaagccagtatctttcgctagctgagaagatctagaaatagccaccacaattatgaagaaaagaaaaaggggaaagacggggaaaaaaacgttggaatttacgatgattagacgacttaggttaaacaaaagagcctatgagtaacacaattgataaacagaaaatttggaacaataaattaagaaaacaaactcatacaagttgtgaaaaaatgtttaaattaagaatccatataaaaatgataaaaagtaaaaattaaaaattgtaacatcgatctaagaattcatgccacaaatacggttttttaatacagataggtgttttagtcagcgaatgttgactaacgtaaacaatactaaagatttgtttttttatccgttgcttgattgaatgaactgagaccacgtacggcgaggaaattaaaggttattgagagcttaattctttttgactaatattcacatcgtcattagctgttctcacttgataatataaaattctacacaggttgttggttaaaatgtcgtatttgactattggagattgcgtcaataacttatatatatctgtggccagagaaagtacatacgtgaaaaagaaaaaagcaaaggcgcggcactcttccttaatcaaatagatgctctatctgtcccccttcttatatatatagttgcacacagatccattagaggcctgcatgcctactatattttcgctgtggttaatttggtctatctttatcagtttcgtgctagactgtcgaccaaattatttaaagtgtgctagccgctttatttaaaccagcctcctgagccgattcaggtcaactgttcagacctcgctccaaccacaacttcctggcctgatcagtctatccatattccctgaaaaaatgtcaagggaagggattggaccggtggttcaaccatgtatgggttagctgcacctaagtatgagtgatcatcacttgtcgatcggttgtgcgcgcatgacgggatgctgaaacgacctggaacctgcgagcatgctcatgcatgcatgcatgcaatgggctttagcacatgactgccgtagtgggcacagcaagaagacatgggatgggatgaagggactcgcggccgcagcatgcatggctacccattttcagcatgtttcatcagcgacctaggattccgttcctatacggtctcattcgtgaattcttcagtagtggatcagcagaaagatgtgcacgcagacgcagggcagcttggttagctggggtagggtagcagagagacactagacagcccagcagccagcatgactatgagcagcaggagggtatggtggtttcagctgcagcaaccaaaaagctcacacatcccacaggcttgtcttgtccaacggttcatccgccaaatggcggcaggccgcaggttgcgatcgacacgacacttgaaaagatgccatttgcagaccaaaaaaaacacgagataaagggctgggtccagccaatctaaacacgggccaaagaatcatcccagcccgcctgcaatctagtctttaagcgtaagcccatttcaacaaggaaacagtagtacttgcctcgtgatgcgctgcattgggccctttcagccgccgagcccaccaaaaggagaaaagcgggtcgaatggtcgctggcaggccggactgggccaccgtgtcaattttgccggttgccgctgctagattgtttatgcatagcaaactactactccgacacacggcgagctgcagcctgcagaccttggaactggcaacctgcacgagtagcactggttcttctgcaccgacttgcacgggcacgagaagcgggaaaagcctgcagccggaaaggcggcgcctttttccccattaacagctaggcagcagctagcagtgtcttactaaaataagtaaaatttaaaatggtttgatttagattaagg

SEQ ID NO: 2618 - DNA, 1465 bp, Zea mays
  misc_feature (1)..(100): optimal_loci_265072_G1, chr7:167589137..167590601, Cluster 15
agagtgtctcctgtccaaaacctagcaacagtgcacatacatggctacagtgcgctatagtgcacacccaatcctaatgggttaggcccatgtgtcactgtaacaatttataaattcagtttttacgtcttttgcgaattcaatattatttgcatcgtgccccctggctcacgggtaattaaagaaaattacacaaattaattatattatagaagctagagctcctgtgcaagataaacactcatcggacacattttaataatttggtgaaaatgtttcatgatgaagctaaaaaaccaaagttaaaattttaaagtaaaactcttccaatcagacggatgccttgagcggatatattgtcttatctcttatcttatcatttatttcaaacttcactttacaatataaattccttattttacataatctgctgtgccggtgacatccttacttaccatgttgtctaccggagtggcgtgccggggacatccttaattaccatgttgtctaccggagtggccgagtggcaagctggcaaccaacggagcggcgtgcaccggttgacgcggacgcccgagcactgcaaaggaaagagacgcgcctgaggatttgacaggagagatgcggcgcgccaaaggactagcgtgtttaccctggcacgcacggagacgagccgcgccatttgccgactcctgcgacgccacgacacgcatcgatggccgcggccggccgggccacgaccacgagcaacaaacagctgggccaggcagacacctagtacacagtacggtacgaggcgcaccgtggttgctgctctgctgcgcgaattcaaccagccatttggctcacgggaaagccccgttcggcggggcatcgcgcacgggcgggcgcacgacgaggagggtcggacgatggcaccgcaggcgcaggagccgcacggagaccgcgcgcggtgcggcgcccgccagatgcagcaaccccagtaccccacgccgcgcgtgccttccgcgcgcggcagggcggggcggcgcggcggctgcgtccccaccgcggagacgccacgccgatcagacgtcgccacggagacgggcagttcggctcgtcgcgttcgtgctgccgtggcgcgccaggacctagcgcgtgaccgcgacgatcgaccgaggtaacgccccgtcgacggcattagcctctcccggagggaaccgccccccgcccagcgcccactgctcctgctggtccgtccctggcagtggcacgaagcctggctggttcggccgtcgcgtcgcgtggccgggtcgccatcgcctcggactaaaattccgtttgacctggcgcgtacgtacgtatcagacgatgacacgtactgccgacggcctcattgcgccggcgagtcgcgagtcgcgagtgcatgattgcgccgcccgttcctccacagcacagtagcgcgctgctgcatgcagtagcc

SEQ ID NO: 2619 - DNA, 1701 bp, Zea mays
  misc_feature (1)..(100): optimal_loci_269395_G1, chr8:13307939..13309639, Cluster 15
  modified_base (40)..(40): a, c, g, or t
  modified_base (41)..(41): a, c, g, or t
  modified_base (42)..(42): a, c, g, or t
  modified_base (43)..(43): a, c, g, or t
  modified_base (44)..(44): a, c, g, or t
  modified_base (45)..(45): a, c, g, or t
  modified_base (46)..(46): a, c, g, or t
  modified_base (47)..(47): a, c, g, or t
  modified_base (48)..(48): a, c, g, or t
  modified_base (49)..(49): a, c, g, or t
  modified_base (50)..(50): a, c, g, or t
  modified_base (51)..(51): a, c, g, or t
  modified_base (52)..(52): a, c, g, or t
  modified_base (53)..(53): a, c, g, or t
  modified_base (54)..(54): a, c, g, or t
  modified_base (55)..(55): a, c, g, or t
  modified_base (56)..(56): a, c, g, or t
  modified_base (57)..(57): a, c, g, or t
  modified_base (58)..(58): a, c, g, or t
  modified_base (59)..(59): a, c, g, or t
  modified_base (60)..(60): a, c, g, or t
  modified_base (61)..(61): a, c, g, or t
  modified_base (62)..(62): a, c, g, or t
  modified_base (63)..(63): a, c, g, or t
  modified_base (64)..(64): a, c, g, or t
  modified_base (65)..(65): a, c, g, or t
  modified_base (66)..(66): a, c, g, or t
  modified_base (67)..(67): a, c, g, or t
  modified_base (68)..(68): a, c, g, or t
  modified_base (69)..(69): a, c, g, or t
  modified_base (70)..(70): a, c, g, or t
  modified_base (71)..(71): a, c, g, or t
  modified_base (72)..(72): a, c, g, or t
  modified_base (73)..(73): a, c, g, or t
  modified_base (74)..(74): a, c, g, or t
  modified_base (75)..(75): a, c, g, or t
  modified_base (76)..(76): a, c, g, or t
  modified_base (77)..(77): a, c, g, or t
  modified_base (78)..(78): a, c, g, or t
  modified_base (79)..(79): a, c, g, or t
  modified_base (80)..(80): a, c, g, or t
  modified_base (81)..(81): a, c, g, or t
  modified_base (82)..(82): a, c, g, or t
  modified_base (83)..(83): a, c, g, or t
  modified_base (84)..(84): a, c, g, or t
  modified_base (85)..(85): a, c, g, or t
  modified_base (86)..(86): a, c, g, or t
  modified_base (87)..(87): a, c, g, or t
  modified_base (88)..(88): a, c, g, or t
  modified_base (89)..(89): a, c, g, or t
  modified_base (90)..(90): a, c, g, or t
  modified_base (91)..(91): a, c, g, or t
  modified_base (92)..(92): a, c, g, or t
  modified_base (93)..(93): a, c, g, or t
  modified_base (94)..(94): a, c, g, or t
  modified_base (95)..(95): a, c, g, or t
  modified_base (96)..(96): a, c, g, or t
  modified_base (97)..(97): a, c, g, or t
  modified_base (98)..(98): a, c, g, or t
  modified_base (99)..(99): a, c, g, or t
  modified_base (100)..(100): a, c, g, or t
  modified_base (101)..(101): a, c, g, or t
  misc_feature (101)..(139): n is a, c, g, or t
  modified_base (102)..(102): a, c, g, or t
  modified_base (103)..(103): a, c, g, or t
  modified_base (104)..(104): a, c, g, or t
  modified_base (105)..(105): a, c, g, or t
  modified_base (106)..(106): a, c, g, or t
  modified_base (107)..(107): a, c, g, or t
  modified_base (108)..(108): a, c, g, or t
  modified_base (109)..(109): a, c, g, or t
  modified_base (110)..(110): a, c, g, or t
  modified_base (111)..(111): a, c, g, or t
  modified_base (112)..(112): a, c, g, or t
  modified_base (113)..(113): a, c, g, or t
  modified_base (114)..(114): a, c, g, or t
  modified_base (115)..(115): a, c, g, or t
  modified_base (116)..(116): a, c, g, or t
  modified_base (117)..(117): a, c, g, or t
  modified_base (118)..(118): a, c, g, or t
  modified_base (119)..(119): a, c, g, or t
  modified_base (120)..(120): a, c, g, or t
  modified_base (121)..(121): a, c, g, or t
  modified_base (122)..(122): a, c, g, or t
  modified_base (123)..(123): a, c, g, or t
  modified_base (124)..(124): a, c, g, or t
  modified_base (125)..(125): a, c, g, or t
  modified_base (126)..(126): a, c, g, or t
  modified_base (127)..(127): a, c, g, or t
  modified_base (128)..(128): a, c, g, or t
  modified_base (129)..(129): a, c, g, or t
  modified_base (130)..(130): a, c, g, or t
  modified_base (131)..(131): a, c, g, or t
  modified_base (132)..(132): a, c, g, or t
  modified_base (133)..(133): a, c, g, or t
  modified_base (134)..(134): a, c, g, or t
  modified_base (135)..(135): a, c, g, or t
  modified_base (136)..(136): a, c, g, or t
  modified_base (137)..(137): a, c, g, or t
  modified_base (138)..(138): a, c, g, or t
  modified_base (139)..(139): a, c, g, or t
  modified_base (590)..(590): a, c, g, or t
  misc_feature (590)..(689): n is a, c, g, or t
  modified_base (591)..(591): a, c, g, or t
  modified_base (592)..(592): a, c, g, or t
  modified_base (593)..(593): a, c, g, or t
  modified_base (594)..(594): a, c, g, or t
  modified_base (595)..(595): a, c, g, or t
  modified_base (596)..(596): a, c, g, or t
  modified_base (597)..(597): a, c, g, or t
  modified_base (598)..(598): a, c, g, or t
  modified_base (599)..(599): a, c, g, or t
  modified_base (600)..(600): a, c, g, or t
  modified_base (601)..(601): a, c, g, or t
  modified_base (602)..(602): a, c, g, or t
  modified_base (603)..(603): a, c, g, or t
  modified_base (604)..(604): a, c, g, or t
  modified_base (605)..(605): a, c, g, or t
  modified_base (606)..(606): a, c, g, or t
  modified_base (607)..(607): a, c, g, or t
  modified_base (608)..(608): a, c, g, or t
  modified_base (609)..(609): a, c, g, or t
  modified_base (610)..(610): a, c, g, or t
  modified_base (611)..(611): a, c, g, or t
  modified_base (612)..(612): a, c, g, or t
  modified_base (613)..(613): a, c, g, or t
  modified_base (614)..(614): a, c, g, or t
  modified_base (615)..(615): a, c, g, or t
  modified_base (616)..(616): a, c, g, or t
  modified_base (617)..(617): a, c, g, or t
  modified_base (618)..(618): a, c, g, or t
  modified_base (619)..(619): a, c, g, or t
  modified_base (620)..(620): a, c, g, or t
  modified_base (621)..(621): a, c, g, or t
  modified_base (622)..(622): a, c, g, or t
  modified_base (623)..(623): a, c, g, or t
  modified_base (624)..(624): a, c, g, or t
  modified_base (625)..(625): a, c, g, or t
  modified_base (626)..(626): a, c, g, or t
  modified_base (627)..(627): a, c, g, or t
  modified_base (628)..(628): a, c, g, or t
  modified_base (629)..(629): a, c, g, or t
  modified_base (630)..(630): a, c, g, or t
  modified_base (631)..(631): a, c, g, or t
  modified_base (632)..(632): a, c, g, or t
  modified_base (633)..(633): a, c, g, or t
  modified_base (634)..(634): a, c, g, or t
  modified_base (635)..(635): a, c, g, or t
  modified_base (636)..(636): a, c, g, or t
  modified_base (637)..(637): a, c, g, or t
  modified_base (638)..(638): a, c, g, or t
  modified_base (639)..(639): a, c, g, or t
  modified_base (640)..(640): a, c, g, or t
  modified_base (641)..(641): a, c, g, or t
  modified_base (642)..(642): a, c, g, or t
  modified_base (643)..(643): a, c, g, or t
  modified_base (644)..(644): a, c, g, or t
  modified_base (645)..(645): a, c, g, or t
  modified_base (646)..(646): a, c, g, or t
  modified_base (647)..(647): a, c, g, or t
  modified_base (648)..(648): a, c, g, or t
  modified_base (649)..(649): a, c, g, or t
  modified_base (650)..(650): a, c, g, or t
  modified_base (651)..(651): a, c, g, or t
  modified_base (652)..(652): a, c, g, or t
  modified_base (653)..(653): a, c, g, or t
  modified_base (654)..(654): a, c, g, or t
  modified_base (655)..(655): a, c, g, or t
  modified_base (656)..(656): a, c, g, or t
  modified_base (657)..(657): a, c, g, or t
  modified_base (658)..(658): a, c, g, or t
  modified_base (659)..(659): a, c, g, or t
  modified_base (660)..(660): a, c, g, or t
  modified_base (661)..(661): a, c, g, or t
  modified_base (662)..(662): a, c, g, or t
  modified_base (663)..(663): a, c, g, or t
  modified_base (664)..(664): a, c, g, or t
  modified_base (665)..(665): a, c, g, or t
  modified_base (666)..(666): a, c, g, or t
  modified_base (667)..(667): a, c, g, or t
  modified_base (668)..(668): a, c, g, or t
  modified_base (669)..(669): a, c, g, or t
  modified_base (670)..(670): a, c, g, or t
  modified_base (671)..(671): a, c, g, or t
  modified_base (672)..(672): a, c, g, or t
  modified_base (673)..(673): a, c, g, or t
  modified_base (674)..(674): a, c, g, or t
  modified_base (675)..(675): a, c, g, or t
  modified_base (676)..(676): a, c, g, or t
  modified_base (677)..(677): a, c, g, or t
  modified_base (678)..(678): a, c, g, or t
  modified_base (679)..(679): a, c, g, or t
  modified_base (680)..(680): a, c, g, or t
  modified_base (681)..(681): a, c, g, or t
  modified_base (682)..(682): a, c, g, or t
  modified_base (683)..(683): a, c, g, or t
  modified_base (684)..(684): a, c, g, or t
  modified_base (685)..(685): a, c, g, or t
  modified_base (686)..(686): a, c, g, or t
  modified_base (687)..(687): a, c, g, or t
  modified_base (688)..(688): a, c, g, or t
  modified_base (689)..(689): a, c, g, or t
  modified_base (1172)..(1172): a, c, g, or t
  misc_feature (1172)..(1271): n is a, c, g, or t
  modified_base (1173)..(1173): a, c, g, or t
  modified_base (1174)..(1174): a, c, g, or t
  modified_base (1175)..(1175): a, c, g, or t
  modified_base (1176)..(1176): a, c, g, or t
  modified_base (1177)..(1177): a, c, g, or t
  modified_base (1178)..(1178): a, c, g, or t
  modified_base (1179)..(1179): a, c, g, or t
  modified_base (1180)..(1180): a, c, g, or t
  modified_base (1181)..(1181): a, c, g, or t
  modified_base (1182)..(1182): a, c, g, or t
  modified_base (1183)..(1183): a, c, g, or t
  modified_base (1184)..(1184): a, c, g, or t
  modified_base (1185)..(1185): a, c, g, or t
  modified_base (1186)..(1186): a, c, g, or t
  modified_base (1187)..(1187): a, c, g, or t
  modified_base (1188)..(1188): a, c, g, or t
  modified_base (1189)..(1189): a, c, g, or t
  modified_base (1190)..(1190): a, c, g, or t
  modified_base (1191)..(1191): a, c, g, or t
  modified_base (1192)..(1192): a, c, g, or t
  modified_base (1193)..(1193): a, c, g, or t
  modified_base (1194)..(1194): a, c, g, or t
  modified_base (1195)..(1195): a, c, g, or t
  modified_base (1196)..(1196): a, c, g, or t
  modified_base (1197)..(1197): a, c, g, or t
  modified_base (1198)..(1198): a, c, g, or t
  modified_base (1199)..(1199): a, c, g, or t
  modified_base (1200)..(1200): a, c, g, or t
  modified_base (1201)..(1201): a, c, g, or t
  modified_base (1202)..(1202): a, c, g, or t
  modified_base (1203)..(1203): a, c, g, or t
  modified_base (1204)..(1204): a, c, g, or t
  modified_base (1205)..(1205): a, c, g, or t
  modified_base (1206)..(1206): a, c, g, or t
  modified_base (1207)..(1207): a, c, g, or t
  modified_base (1208)..(1208): a, c, g, or t
  modified_base (1209)..(1209): a, c, g, or t
  modified_base (1210)..(1210): a, c, g, or t
  modified_base (1211)..(1211): a, c, g, or t
  modified_base (1212)..(1212): a, c, g, or t
  modified_base (1213)..(1213): a, c, g, or t
  modified_base (1214)..(1214): a, c, g, or t
  modified_base (1215)..(1215): a, c, g, or t
  modified_base (1216)..(1216): a, c, g, or t
  modified_base (1217)..(1217): a, c, g, or t
  modified_base (1218)..(1218): a, c, g, or t
  modified_base (1219)..(1219): a, c, g, or t
  modified_base (1220)..(1220): a, c, g, or t
  modified_base (1221)..(1221): a, c, g, or t
  modified_base (1222)..(1222): a, c, g, or t
  modified_base (1223)..(1223): a, c, g, or t
  modified_base (1224)..(1224): a, c, g, or t
  modified_base (1225)..(1225): a, c, g, or t
  modified_base (1226)..(1226): a, c, g, or t
  modified_base (1227)..(1227): a, c, g, or t
  modified_base (1228)..(1228): a, c, g, or t
  modified_base (1229)..(1229): a, c, g, or t
  modified_base (1230)..(1230): a, c, g, or t
  modified_base (1231)..(1231): a, c, g, or t
  modified_base (1232)..(1232): a, c, g, or t
  modified_base (1233)..(1233): a, c, g, or t
  modified_base (1234)..(1234): a, c, g, or t
  modified_base (1235)..(1235): a, c, g, or t
  modified_base (1236)..(1236): a, c, g, or t
  modified_base (1237)..(1237): a, c, g, or t
  modified_base (1238)..(1238): a, c, g, or t
  modified_base (1239)..(1239): a, c, g, or t
  modified_base (1240)..(1240): a, c, g, or t
  modified_base (1241)..(1241): a, c, g, or t
  modified_base (1242)..(1242): a, c, g, or t
  modified_base (1243)..(1243): a, c, g, or t
  modified_base (1244)..(1244): a, c, g, or t
  modified_base (1245)..(1245): a, c, g, or t
  modified_base (1246)..(1246): a, c, g, or t
  modified_base (1247)..(1247): a, c, g, or t
  modified_base (1248)..(1248): a, c, g, or t
  modified_base (1249)..(1249): a, c, g, or t
  modified_base (1250)..(1250): a, c, g, or t
  modified_base (1251)..(1251): a, c, g, or t
  modified_base (1252)..(1252): a, c, g, or t
  modified_base (1253)..(1253): a, c, g, or t
  modified_base (1254)..(1254): a, c, g, or t
  modified_base (1255)..(1255): a, c, g, or t
  modified_base (1256)..(1256): a, c, g, or t
  modified_base (1257)..(1257): a, c, g, or t
  modified_base (1258)..(1258): a, c, g, or t
  modified_base (1259)..(1259): a, c, g, or t
  modified_base (1260)..(1260): a, c, g, or t
  modified_base (1261)..(1261): a, c, g, or t
  modified_base (1262)..(1262): a, c, g, or t
  modified_base (1263)..(1263): a, c, g, or t
  modified_base (1264)..(1264): a, c, g, or t
  modified_base (1265)..(1265): a, c, g, or t
  modified_base (1266)..(1266): a, c, g, or t
  modified_base (1267)..(1267): a, c, g, or t
  modified_base (1268)..(1268): a, c, g, or t
  modified_base (1269)..(1269): a, c, g, or t
  modified_base (1270)..(1270): a, c, g, or t
  modified_base (1271)..(1271): a, c, g, or t
cggggccgaggccacgaatcaagctgaacatcagagtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgatacgcgcggcccagcgctttaacgaccgcatggcaaatcagtttggcgcggcgattaccaatttctcgttcctgtcgatgatccccatcctgatgacgttatttgaggccgccggttttgtgctgacgtccctgccacgacgtgcagcaattgtgcgattcgtataaaaaagaagttgctcgtggcgctcgatgttgatgaagttagaccgaggtcctgaacaaattcgagcctggcacacctagcacagcatattctgaaaaaactgccgttgtcacagcgagacatccatttatatgatgataatctcttacacagccgaaatcagattttaatttattatatattatacgatatttcttaattaaatggtggaaagagaactagacacatacaaattacactcaactcgtctacgcaacacacatattcttatctgtggcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaatagtcgcctcccccccacgcgccagggcccccacaacagccaacagccccccccaccacgccccgaggagagacagaaaggagagaagaaaggaataagttagggctcggagctcgaatgcgcgcaatgctgtttttgactattttattcgtagggtctggacccgcgtgtttggcagagggaggaggaggccaccacctcctctcctcgcgatcgaaaagtgctgctgaaaaaaaacgttattgctcccctcctccatcgaggaataacggaaacaaagactcgcatgacgtctctgaggccacgagagatgttgatggaacgtcacgctagagacgtgctctccctcctctcctcggaatggcaaaaaggctgggacgcaggaagtgcgcacacgtccgcccaggaagcgaatcagtccccccctactccatttgaatatttttagttttttcgtgtcccgggattttgagaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggttttggtttctttgtcaaattccttccctccccctggcagaacgtggacatattattttgagcctcaacccttccccaagcaaagacggggggttgtgttttcccccgggggggggggagccccaatcccccccccaaaaaccaaattgggggccctaggggccatttgtccccgggccccccccccccaaaagcccccaagaagaaggggaggggggtttgggggaaccccccccccccccaaacccagattcctttttcccttgcccagccccaaaagccgggccgggcaaccccggggggggcccaagcccgggaaccccccccgggagggggccccctccgggcccccgggcaggccggttctttaaaggggcggggacgggcgcgggaccccatgccggggggggggggtcgggcacgccgc

SEQ ID NO: 2620 - DNA, 1515 bp, Zea mays
  misc_feature (1)..(100): optimal_loci_271429_G1, chr8:26102652..26104166, Cluster 15
ccaaaaatataaatatcgctgggtaattgtgttagtcaaactttcttaagtttaattatatttgtagaaaataattggcgatttttgtatcattagatgaatttatatgacaaaagttcaatgatctatttaataatgctaattatatatatgtgtgtagatatatggtcaaagttaaaatcgtttgactcatcacaaagtaagactttttttaggatggaggccgtatatatgaaagcggaatagtctgagatttcttagagcgatattttgaaaactattgaagaaactcaacaaatatacttctaatttttttaggcgttaaaaaaaccgttggttttttttaagtattcttttgggaactattagagatgttctacaacatcaaaactatttcgagacaaacttaaattgaataatcctaaatcgccgagtattatatgctaccacagcacagattcaatctatggatggatggtcccattctccccttgcggccacaattcagataagatctagcactatttcctgttcctatcctgaaatcatcttttattcctttggtaacaagttcgtttaaccacacagcacatactttttgaaacgaaagcagccaaaagctgtggcgtcgctgaataatacgcacaaagattttattttggaagcggagaagggggggcaatcgtgcgtggtggacagggctaggaccagagggagagggatgcagagcgccctcgaaaaaagtcaaccggcgtcgtcgtcacgccacggtcaccggccggctagggtatagcgttgttagcatgcgccgtgccatgcacgcatgatttcccggcatgcatggtccaagccgcccaggactgggagggatcaacatggtgcacgcgcagcgcagaccggccggagagaccaggcgatctacacgcgccggtcgggccatggtggcgagagcgatggcggtgaggctgttagctagggattgttcgttttcgtcccccctccgccccggcggcggtcgtcggctcgaggagatattctggtggctggtcgtcccgtgggtactgcccactgcgcgtgcggccgggatcccaaatccgatccccggcggagggttggttacgtgacgtgagagagagcgcagggaagatttggcaggagacgctagagctagctgctcgcctgctgcgaacgggcacagtaataataaggcgacaagacgaggcggcgaattgaaggcaaggcaggcggcacagcaacgtacactacacgcggccgtggcgcggcgacggagcgtggccaccacgggcgccactcgtccggggaccggacggatccggcgggtgggggtcgcgcgttggaaagagagagcccagagaaagagatggttttttgtcgggatcgctttagattctagcatcagcatcacccgtcaattcagatcttcagctccctacgtggaagaacaggcacacacacaccagcccacttaggcccatcaacgccccaaggcccaac

SEQ ID NO: 2621 - DNA, 1527 bp, Zea mays
  misc_feature (1)..(100): optimal_loci_283035_G1, chr8:104811440..104812966, Cluster 15
tgccactccaactccgttgcggcatccattaatcatcaagatgggcagatcttgcctgttttgcacgcacatggttctctaaaaaaaggggggggctggggaagtgcctcctgctaacacatggttcgccagccgtcggataaaaattccccctggcgcggcgaggagcgaaaggcgccgggccggatggatgggtagctagctaagctagctagctagctatacattccccacctggcgcccggaccagcgagctgagcacggcgcgcagaccaactgttgatccagggctccaggcccagccgcccagctcgctcgccagagaggtgcgtgctgctcaggaaaggcaggctcagctagctgctgcggcgttgctagatcctagcttttgtcctagctgttgcgtctgccctttttcctgattcctccaccagatctgggcggcaggcgaaagcatcagcgtactacgagcgaaccggctggggttttttcccctctcccgcagagcacgtgagcagcagcgtgtgcgtgcaagagaaccaggggaagtagaatggtggctggatcggcgacgaaatgtgcccctccggtgccgcgttccgtgcccgccatcattgatcatgccgcatgcctactctccggccggtctttgttcatcgacggcgcgacaagtaacagtgactccggcggccgggtcatcgaacaccacgtccgacgacctcagatcggccgtgccgtgagcccgtggagcagctagctcgtgcaagctggtgatgtggatcgtgccctccggtggcgaaggtgaaccgaaccaaggcaagcccgtgctgctccatctccatgccatggcggcacgtccccgaggcgacgggacagggaggccgctggctcgctcacctgaacaacaaaacccacacacctcgctcgcgcgcctggtcctggtcgctctcgtggtcacgtcgtataaaagcctagtcatacctgccgcctggcctgtccaatgagacacacaaatgcaagtacagtactagtagtatgcaacaccttggtttcttctccatccgattctctctctctctcttcccaagcaaagcattctgtgcttctgtcctccagcctagggttggtaggcaagtgttggaaaccgctaaaaaagcaattgcgccgcaccaaagaccacaccactggcgataaactaatccagatttagatgcacccgtcacacatcagggtatccaatcagagggagtaggaggaagggatgagctcctctctttcttaacagcgacatctgttagggagagaagaaggggaaaaaaaaccagagacgcgatgcagagcattaagaccacatacaacggttgtctatagtatgtgaattatccgtttacacatacaatataaataacaactaaaacagtgagttatccgtctacacataccgtctacacatctgttttagactggctccaacaggccagctatttggcaaggcaaagctaatttagctccaatagcccagctatc

SEQ ID NO: 2622 - DNA, 1705 bp, Zea mays
  misc_feature (1)..(100): optimal_loci_28560_G1, chr1:174513023..174514727, Cluster 15
taagccaccgatgactgaaagtagggacgttccatccgaatcagtataaaccttacaatctcaatttacttgtcggagcaaggtatgaaacaacgacaatgttattttagcttttctagataaataacttttactatgcacctagatatacatatgtttagatatatataataaagattgtttacctagctagaaattgcaacgatggagggagcaaatctctagaagatttgagcagcgtgcatgcatggttaccataacctcgaacattttttttttgcattggttattgctaatgatctccaacatcatcacactctctgattagtataatgacctctcgagctcgttctccaaagaatgcttcgtcagctcattgttaggctggttagattcaccagcgtcagtcactaacaatttttagctttgattaattatcttccagatcgatctacaggcgggaaaggacactgatcggacgcgtgtcccggcagaaaggagccacttggaacgtaagagaaaccagcatcgaatcggtgccgtacacgtgcccttttgttccttcaggagaagttacttaggtggcggtccacgtcattctccacgctttgtactttaatcgccgtgttgtgcatgcatgcactatatgtatttcattataatcaagggaaggatctatgatctatctaagctcgtgtgttaaattatggacactcataacctacgtacgtagcacggatataaacacacgtacctcaggatacagtcatacagatacgtggatataacaattttaaaaaaacgatatgtgaatatgtttgagcatttttaatacaaataaacaataatacatactcattccatctcaatgtataattcgtttaacttttttttatcaattttgaccggcccgaccgttctcccccaccgatcgccgcggagccacaaccatgagagccgccaagaggggtcgcgacacattccacccacgggctgcagtggtgtccacctgcctcccccgccatttctctcttccatagttctgtgaaggtcacacccgctggcgtgcaggtgcctgctgcagcgctgctgcagtacgagcatgaggtgtccacagtgtctaggaggatgagggaattatggtttggtggatttttgtccaaagatttggaggttcacatgcttggattctctgccgcaacatacgcgtacacgagtaagtggttacctaagcataaggtattttttcactttcgtcgtttttagctatgaattgctttagatcgtgttataactattttcttagttacctcagtaataccttaattttggtgcgtcctccgctaccatgtggtgtggtgtggtggggtggggtgtggctccttcgatcattatagtcctcatatgcgttaggtgtcgggtcggtgcatacatgcagtgctgacgtgcggggcggtgatggtggtcaagcgtacatacgtcgtcgttgctgattcgtctatcatgagctacggttggcagtggcatgcaactcccgatcgtcgttcatttcaggcatgcaggaaggcgatccaccggcgcgctcatcttctcgccgtgcagtaggctaggcgagaggccctccatcatctccctctgatatccctagctagttagctagctcgccacccaggcccagccggcctgtatagtagagtggtagaga

SEQ ID NO: 2623 - DNA, 1859 bp, Zea mays
  misc_feature (1)..(100): optimal_loci_28998_G1, chr1:177595771..177597629, Cluster 15
ctgacagtgttggaggaatgcctcgcctcaaacacgtgcaaagtgcagaggtcaagcatgggtttccggctactgggaagtcattaagttcagggattatggcaacggctgagtcgggggagactttagtacaccaggctgaggtggcgaaagataaaggcaaatggtgctccagatgtcgaagtaaaggacatgtttcagcagaatgctctacggttcttttctgcgacatatgtgaaggttctgatcatgttgcagcttcatgaccgactaagaggaagctggaagcctaaacctatggcgtactcagtcggatgccatggacggtctggtgttttatcacattccacatgctccttttccgtcggcaaaaaaaagaaggaaatttggctctgatttcagttgaagggggtgtgctcactgaagcggaactagtctcccatcttgaacggttggtgcccggaaaacatttttgggatgctcaaatgaaatcatcgactatgtgggtgactgcttttccttctaaaaatgagctgaagcgcacggtaaattttggagtggctgatctgaaggatgggagacacctcaaatttgatttgtttgaagaggaggagacgaggagtacttgcattgtgggaagaactgcctcgtgtcagcatgcgggtgcttagtttgccggctgttcttcgggcgtatgaggtgttgtgggctattggcactatgttcgggggaacgaccaagatggacatggtgacaactagaagaaacaactttgggcgttttgacgtggccgtgcttaatccggttatcatcccgagtgagatggatgttgttattgggacccgctggtttgaactaaaattcagtgttgaaaatgaaccccgcggcgaggctgctgctactcaggaacaacagttctctgtagcgggtggccttggtgatggctctgttcattttatgaagcaatacgattctagttcaagcaaggtggctgaggttttctccggaattccttcttgtaatgcttctagcttgcaaggagagaagatggcttgtgatatggtggaggatgaagaccttctaggagggcgccaggaggctgattgtgccctgttgctgccaacagttcagtatgacatccaggggaggcgcgtgtggtggtccatgtgcaacagccgaatgctatgggggttgacacttttggtaactcctcttctatcatgccgaataatacagagaaaagagcaatggtcccaggtgatggtggatctgattctggaaagaatggacatcaagggcttgatcactcgggttatgggtctcagcagctactaggaagcaaccttaataaaaaaccgaatgatgctgctaacactccaagtaagaggagcaagcggcgtgaggaatcaattgatgagaatgctttggagcgggctaagagactaactgcgattaagaacctagatggaaaaggtatttttcctgtttttttcagtgctctccgtgtctaatgattttgtttctaatagatgttatagtctgggcatctctttaggtaatagggatatggatgtccttaattcagttcattctattatggcttcggaaagggatagatttttagagcaaagtttcaaaccgggtcacgatagccgtcacgggttagtggaagacaagtcagatgatgaggatatggtgttaaatactctgagagaccttagtggaaccttaatggaggacaccttagaagtgttaggggaagatgaccttaacactaaataaagtttttaatactaggaaagtgaaaaagaaaattagtgggaaagttaagaaagtaagaaagtagtaaagatatcagc

SEQ ID NO: 2624 - DNA, 1514 bp, Zea mays
  misc_feature (1)..(100): optimal_loci_291731_G1, chr8:151229201..151230714, Cluster 15
ggaagttatttcctgaaagtcttctcaaattaatattgttttatggattctcctcctctggtggggggcaatgctaggaaacgaaagggacacgataggagcaagaccatctcgtggagcatgtggtcctggcgcgccacgttgctccggttggacacccgattaccctatcggtacgtgcaaagaaagcaacgcaacgagaaaacgcctccctcgatcgtacgcagatagcccccacaaaaagccaaaagcgatgccccgccctccattagctcggccggccggtcgctgataaggagctgcatcgatgccctctcttcctcctcatcctccaactccatccaactttggtcgatggacgcgcacggaatcgctcctctctttggactcatgtgtttcaggcccggtggaaaagaaccccgagcgattcccgacaccatcacaggaggagaaaaaaaaagaggcttcagccaccaaagcgacctggcgctcccgcccggccggccggccatctaatgatgcggaattaaaattaaagtagtcgtcgcgtcattgtaatgggcacagaatcgggcgtgacagaggcagcaagatctcgtaccgggtactttaatctgctctcgctcagcctggccggtcctttttggcttgctgcgagtctctcggatcttctttcgatcttggaaaaaaaaagaaactgttattagtgataagagcaaggttaataaataatacaagctgtatatttaatattggatttatctctcctctcacaacatgtcttgaagtgtgtgagaagtctgcttcttttttcttctctatttctcttccttccacgccaccttaaatctgttgtggcatccttgcacgtcacttattatactcgctctaagttgacctgccgacagtaacaccgcgagtttggaaatggagggtgatcggtcgagggatttttacatatcaagcgcgatcgatgcgtgagcgagagtgatggctcgtgtgcctgccaaccacgagcgaggaaaacaaaatagagcagcagaaaacttacgtggaaagaaggttgagctgatgagtgagagcacccgttcgcactccatgctgttgcttccgttcgtactttcttttttttccctttccaagacggagaggaaataaaatgaatgatgcgggggcgagtcgggttcagagttgtgttcaactgtcgtgcttctttttccataccttggtcacctcgatctacgcgaattcgatcacacggtgaccctgatgaatgaaatgaagaggaaagctccgaatccgaatgcgatcacagacgacgagatcttcaagctaagtatagtaacaagatatggctaaatgctgagatagagaagagaagaagagagaaaggagaaacagatgataaacttatagccgtattagatacgacaaccaataataaaactttttataaaagataagtgcatcaaacatattatacaggtagactaaaaggttgacggtacaaaatt

SEQ ID NO: 2625 - DNA, 1802 bp, Zea mays
  misc_feature (1)..(100): optimal_loci_291764_G1, chr8:151345744..151347545, Cluster 15
tagaaatctaaaaacctaattgatcgtttctgtgttcaacgatccgcctgcgttttcgagctgctagctagccggcttttggcatgcatacatggacaaccctacgatgagcgatgagttcttgtacgttctccggccaccagggagatgggtggcggtaagcgacagcaggaagcagcgctatcttcctgaccaccagctcaaggagcagtagagtacaccattccatcgatctcgctcgccccctagcgtctgtcagtttgtgcgcgcgcggctgccgtgtaacgcatgcatgcatatgcgtattatattctccggcggtgtttgatgatgtgctaaccatcggcctacctaacgcaggcctcgggcctccatcccaagggcaaggtcagcgcttcatgctgctcgcacatcaatcgactcagccctatctgggacggtacggcaaggcgcatcacggccctgcccctggtccagcgattcttcctccttttcccccatggcctctgctctctgaaaccacgcacgtctcgcactttgctattcccgtgtgcgttgtctggtctcgtcttggtgcccgcagggccagatcgagagcgtaatgttccaaatattcctgcagtgcgaggacagggacggcaaggagagagatgccaactttccagggacgcaatctcgcaaattaaaggccagtcggaacagatcttctctcgagcgccgtggatcgacgattcgtccatctatcgtcgagttcttcacagcatcgtcgtgcagcatagctattgccagcggggcagggcagggcagggacggaactgaatagaccggccgcgcgcgactgactactcatcgtacatcacatcactacccacgcccgcccgacgctcgcgcgcgcgcgagaaagaaaggtggcggcaacgaaagctgtgtggcctgctttaatttactagcaagtcacacagtgtacgtgttgcggaaaggcagctccatgattgtcagccatcacagcagggagaacaacgggcgcgacgacgacggcgaaacgaggcgtgcggatcgatcggcgatctcggacggggcaacgacgcagcgcgggccacgccggccgagccgccgccggggcggggtcgcacacgcagacgacaccggctagtgcgtgcggggctgctgagatagagacccggccggccagtccgtccggccgagggccgatgccgatcgatctggggctgtcagctttgcggggcctagctagctagagctttatccgcagcagcaggccggcttaaaaggaacgggttgacaattccctggctgtgatcatgccgccgcctgactggctggctggcttctgcccgatctcgaagcgttgctttgctgtgctggactgctagctggtgctggaagatggaggatggggactggagatggagagagaggcgtgtcaatgaagtccacccagtctatagctagctaggcccggccggaagatggcctgactgctgtcgtgtcgacctttttttttgccccaagcgatcatcggagagggtacggtggaggaggagtgtacgtagcagcttctgttcgttgccaaacctgggggcgtagaccagatcagcggctaaacggtgggctctgtgtaccagagatgagaacgagagatggtcgtcgtcctgaagcccttttccagggaaggagtcggagaggtctaatttaagcgtcctattcgctcgctcgtacctagtcctagctagcttggaactccatcgtgtgtgcatgtacgaccgtgtcacactgcggca

SEQ ID NO: 2626 - DNA, 1960 bp, Zea mays
  misc_feature (1)..(100): optimal_loci_292060_G1, chr8:152952335..152954294, Cluster 15
aatagggaacaacaacgtctgtcgtaagatccctggaaaactatttgacccagcaggcacttagcgaggaaaaggaaactaatgatccagctagacatggttggcatcttattctgatattgcctcggtccagacggaatcagaactgaagtttcggaggaacaataaaatggcagatagttttattctaagcttttctatttagatgattacaagatcctaaagcctgtgaaatggaacaaatacatttagaatccggtccaagcttgcgtgggcatattcaagctttatgccatggtgaatggatgacctgctccaactgctgatccgtattccatacatatctcgtcttagcctcggggtaaaaaatagcgtactacatttcatcgacataggtagcttttcgactttcaaaagccaccacgggtgagcctctggctggatgcaggctcaatgccttgttgactcaggcggcaatacctgccgcgcgcagccccgtagctccaaccaaaagcgggctggctgctgaactgccgcatcctcaagggctcagcgacccgatcgagcttcggtcgcccccggcaggtaataaatgagccgtgatccagttgcgtttaattatactattatgcacgctagtggatagtgatggtgtttcaattgcaatcaggatggtaccatggaaagccatagcaagaacttcatctcccaagctgtccactcctgtggcgagaggtcggagaaaaagtagctcgctgccgtcacgtcgcgcgtcgccggcctatcgatagaacgtgtgtttgtttaaggattaaggaatgagatagtccatcataatttgacttggcatgcgacggttctctctttcctttgctccttggaagtttattctagtcccgcgaggttgactccgcgcagcaaagctcggccaatccggtgtcaacgacaacgccaggctcgacgtttcaattcaagcagttcaaggccatctttgagtctcgcaaggaatctagaatatttttttattggcgagtgatggggttgcttttttcttcttcttcttttgacacgcccccggccgggtgaaagtgttcgatatgcctttatatagccggagctaaagcgaaaacacacagtagttttcagcgcctgaggataagaaagcaaactaaactagtttttttttattatggtactagtggtttgtagttggaccgttatgtgttgtcgtgttgaagctcagaaagaaccaaaaaaaaactagctcgttggttgaggaccagaactggactgaaactgtcccggacgattcagcacggacagagaattagaggttgctcataactcgctgctaagctggtaaagataaacgtcaacgcctgaggggagtaacaaggaaaaacaccggcacacactcctgtttcgtcggagttagtttactgtcgtgcttgcgcgcgcgctgcctcttcacacatcgtctgcagcggagcactgggagttgatagatggtggtgggtgggtgcgatgtcattccaattccacacaaacacggacgcttttccaagcatggaactagctacttgtcactggagatgcgccgtcaacgtgacgtgtgcttcacagcgtaagtttcctgctcggaattaatcaaatcaaaaaccatgccgatcgacctgactgactgaccgatgcgtcggcaatgcatctcccctgcatcgtttcgttcgttcgttcgtcagccaccatttgtcctatcgttcgttgacattgctcacaagtcaacgtgcctaatatatacagtaaacccgcggcaggaaaagaccaagcattcacggagatgtcggaacggttgacctgctccaaaatttgtatactactccgtaccgaaccagtggactcgccctcgccccagctgcttgcacatcggcgtgtgagctgttgaattcacagtcgggcgtgt

SEQ ID NO: 2627 - DNA, 1987 bp, Zea mays
  misc_feature (1)..(100): optimal_loci_294226_G1, chr8:164018705..164020691, Cluster 15
attaatgcaacttgtcagggagctttatttttgcgcgcactctcgataggtaggtaggttgccgttgatcgggggctagcggctacctggtaaaccgcagccggcgaccggattgtggtacggttctgcatggactggactagccggtgatcgtcgtccgctcgctccactagtccatgccggtcgccggattgcggtacggttctgcatgcggcaccagcgagtcgacgcgcgcgtggcagcataagcggcggcggcggaggatcggatgttcggctgacaccgataccgatcggccggtgccggacggttggcgcgcacgcatcgtcgatcgtcgtgtcccgctcgatcgcgtattcgcgtcgcgtgccgcttcccagaaacttggaagcagtgcgcgcgtacgtatatggaatgcccctgcgtggaagttggaaccattgtgatatatacatacaaatactgtactacgtgtacatgtctgcgtacctacgtacgtatgtacgcaagtccagccagctagcgaagacaagaacgtgaccgagtagatgatccgtaatctgttttgactgcacgcacgagcacgacgcacgcacgtcgtcgtcccgtacacgtaacagtcgctggtcggcacagcggcgtctgtcgtcgtggtcgtcatcgtggtgaaacccttttcctttggaattttggatatttactttttcaggcgctgcgcgcaacagcgcaggtgtacgacgatggattaattagcgaattatcaacggcttgtataaccagttttattactactttaaatttaatgctttgaattaaacgcaacataattactgtaaaaataatgatactaacatgctactcagttttcggatctgatatctacggcggctatatgtaatattcttacgtattgtgcttgcttgtcatcaacttcatgcattgcaggtggttggtttccggtggaccccacacagtatgtgtgtgcgtggtgcgggcgccacacactgcacgttactacgacaggtcaatcttagttgagagttttattagatgtctattcatatctaataagttgctacataaatacttcaaatcacatgatagtattttaacgagtagaaaataagaattatgtttcattggagatatattaaaaactttctttggcatggttaataactctttatgaaaattgaagataaatattctataaaattatagaatcgctactatttaaataattatatgagaaaggagcaaacagtaacagatgcgggcacaaatggtgaccacatcagctaatggtcaggagagcatcagaaacaaaggtgtcgaggtgatcgcctttagtacgtcctataaagaaaatagatcttaacccatttacaggttggtgtaattctggttgttgattgtcaataatatgatcatttgaactagcattatttgctaatatttttatgtataatccgaagtgtgtaaagtagactttggcataggcgaagtggtaatttgaatgagcaacatctcaaataagaccatagatggcatgttgaagatctataaatacatacaaggagtatatgaaacgagatggaaccaaaacggttgcaaagagcacgaagaaataagtctacaaggcattggaccaaggtgccagaccaaccctaagggcatcgaaccatacgccagagcaaaccctaattggggtattcacaatggtgtcacaccaagaaaagaacaaggagtcggaccatacgttgacacacctgtaggtttgaacatggcatcgaatcataaggtggcattattcatgcttaatatatagaaacatcggaccaaggagagacacatgagcgtaggaccattggttaagtcttatggcccatcgaaacaaaggttctagtgaggaaatagggacgtaagactggtccaacaaagggcatcagactagtgcacgccaacggtcggtaaaggatagttctaa

SEQ ID NO: 2628 - DNA, 2059 bp, Zea mays
  misc_feature (1)..(100): optimal_loci_2993_G1, chr1:15274517..15276575, Cluster 15
aatattacgaaaacgaagccccctcgtgcgggcgcgcctgtttgctgcgcacacgaggaagtggttccagcagctgggtcgatgcagctgctagctagctagcggacggccggtctgggagagaacgacgaagccatgtaccggtagtgtgtgtataaaaaaagttgcgacgtcgtttaggagttcgaaaacaggccggggcgacacgctcagattttttttttgttcaaacgccagggctggccccagtacctagagggtcaaactttttggcttttacctggcccaggctttctgtcatcattatgcatgggggacaccggcctcaagaagactgataaactaaactatcgatgatggatccatccactggattactggagagcaaggagaggagtcgatggcttcatggctacaagtagtgtcttgggcggacaggcagtctcattgtctcaagacacggggtccccacaggtgtcgaccgcgctaataagtctgcatgcaaagcaagaaacttcttttctagacacatggtggcgtcgcgtcggatcgccgctccctagctagcggagactactagtactagcggccattgccatcaccgggccggcaggaatcaaggctcgtgttggagatacagggacagcaagtacttggcccttaactagcgaaggcgaggcggccatggaaaaccggccaggtcttgatggattcgattggacatctgaagctaagccatgcatgcatggccggaagtgtggctgccgggttcgtcagggttgaagctagctagggcggctcactcttcttggactgtgacgtatttctctgcttcttcttctttctcctatttcttttctttccttcccctttcctccttcaggggcatgcaaatgcagtccggtgcgcgtgcgtacagtgcagcgatcgatgatctgcagtccattccaccactctcgatcgcgtgcgtgccaaaccaaaccaacgtacagtgcccccctttgtccctactagctatatatatactgaccgaggcgctcaactagctgcgtgcactgcagtgtgatagcgctgagccgctgacgatgtatagatacatgcacagagattaaattaataaagcagggatttatatattgatgcaacagcacctgctgtgctgaaatctcagggactgtgcaggagtatccgggccttgctctggggcctcggcatctagctagctagctagtcgatcagatctgtatcagcgggctgtgcacgcagatgcgtccaaaaccttccgtccaacacgagacggattatcctagctacctagcgtttactactagcgacctcccctcccgtttactatttcaagacgctggcggatactatatagtatgagcatagtttattgagccacatgcatgcacacgcttaggaaacgcatggtggctcacgcgcccgctcgcggttcaaagagaggagagatcagcgtgcagcgagatgcgcatagacaagccattcctggtggaccagcacgatgtgtttgtttatggagtgagttccgaaaccctggagcggcggcggatgggacggcgacggcgttcagccggagcctggagctggccgggcgggccatgcagcgtggaaagccgagctccgaacccacacccaaggtgccgtgccgtgccgtgcgtacgtgtgtcgtcgagactggccggcgccgggcggtatactggatggtttccggagcgatttgaggagctttttgtctgcgatgtgaagggcgggtagctagccaggcaggccggtgcccacataagcaggagctgtgtcctggaaatgtgcttcacttcatcacttgtcttgtcagtcgtcaagcgacgagctccgatccgccactacacgtacgtacttcaccaggacaggcgcacacacgcacgtacgcgcgcgaatgaatacactacgtacgtactaataatgataataacacaaggggttgggttcgtcattcgtctcctattctgctactagctagggcgtgctcgatccatcgatacatttatgtagtacg

SEQ ID NO: 2629 - DNA, 2289 bp, Zea mays
  misc_feature (1)..(100): optimal_loci_299898_G1, chr9:12801764..12804052, Cluster 15
ccggcctgcctctcgctcgcatcggtcgacggtcgtcggcgacgatgaaaatgttcttgtgcccgataatattcgcgcgacggaatcacatgcgcgagcccggccggccggccggccgccagggactcctggccgctgccgccttcccccgcacctcttttgaggccggccaggtctctctctcagatgagatgctcgctggccgcgcacgctttcgctgcccgtctcctgctgccggtgccggtgccgtagcccgtagtggcgtggcgtggcgtgccatggcctcgcaactcacaaagcctgccgcggcgcccgtggccgtgcatgcatgcacgcagacgcagacgcagacgcagcagtggatgcctcggcctcgctcgcgcgctgcgctgcctttgtgcactactgcactagtagtacctgcgctggcgcaggcgggcagccaaactattcgtcgcctcgccagtcgccagtcgccagtcgcccccgtcttctttttcccgcccaccctccagcggctccacctgcgccagccaggcaggcaggacggcaggcgaccaccatggcctgcccctgctgcgtgccgctggatcgagcgagcgctgacgctgctggcgcgtgatctttgacgtcgccatcggcggtccacgtccggctttttgctctggccgttcgtcactcgctgcgcgcgctgtcgatctttgcttggtgcgctcctgccggcactggctcggagacgcgtgcaggagaagacgtgcgtacgcgtgcgtgcgaccacacccacgtacttatacgtaccggctccggataccgtaaatgcacggtacagtagtataccgagagcgggacgtgccctgtcagaaataaaggcggcaagggcgtgggcgctctgtgtactgtactctacacgtactgtacgtactggacacgaatctctgcatgcagcttgtcttgtgttgcgttgcgccaccacctttgcctagtattcagtgtcaccccccctcgccgtatttatgttgtggtgcttggaccaaattccggccaagcccctttgcacaccgttatttttattcgaggtctctgcgtatttgggcacaggcacagtggcacactagcctcaacggaacgcatgtttctcttggaggtttaggtatacacaatatgcgaaacaatctggttgctagagaccaacatatttcaccgccgcagtgctagtatatgtataatccggacggcaaaagtaagtttgggtggtcataaaccaaacccaacagccaacactcttcagcccctgctggattgcagtagtgggatgttcttaacactgtgtttgattttaggccatgtttatttgcttacaagactataatccagcgtatatactatataagcatatattaacttgtttatgtattattatagtctaggtatctagattacataatttacccgataatctgtgttgtttgtttaacttccaacttatttaagctaaattatggcgacgtttggaacaagcagaattttcggaatctggatagtgcacactgcacactatccaagcaagaaaatgcaattcataaggttgataattggagattctgtgatgcagcacattatccaaggcatagaatacaaaaatgtttggtttctagccgataaaatctatctcaccgtaagaatgagtaacaaaacatggactataatctaaaaggtaaataaacatcagccttattaatagagaacagtaaaaccgaagagctgtccagtggcagtggtgcgcttcaatgccggctactgctccgtagtactagtacagcactaggcctgcctttgtttctccctttttgggagtgcagtgcaggggggctgccgctcctgcaagagacaaaaagagcaccctagtaaccttggtaacctagcgtcctagcaggcagggctggctccaaagccaaagcatcaccatcagtaatgttgtgctgatgcagcaatctcaagcttttatcactcgcaaggaattcgccagaaactgccaaacagctttcgatgaaagctttgttggtagagtctgtgtgtggtttgagaagattctccaaatccatgacaaaatatatctcttaattaggctgtttgcgctgaggcaccttacaaaatactctatcctaatcctattggagtgtattatacagtaccaaaagagctgcagtggagaacggcatagcctacggtaagtaggggcgtgcaacaaaaacgttatttacatagtgtgcatgtgtgcccgtgaagaag

SEQ ID NO: 2630 - DNA, 1638 bp, Zea mays
  misc_feature (1)..(100): optimal_loci_301438_G1, chr9:21815512..21817149, Cluster 15
agccaatttgaaatcctatgaattcctcccactctcccgaacgggcctgcaggtggtgggactaaccatggataactcataacctacataatgcaagtgacagtatcagattttacggagtccatgtaaacacaacaaaacacaaatacccaaaaaaaaacagcatgaatatgcagtatcgcggtagaactgctgctgctgtagctgaaccggaaaccaagccatgcatgcatggatggttcagctagcaatcagcaccgaccatcgcccaacaaatatcttagcagcccatactctctcgatttcaggtgattatctgggtatttctcagatatatatgcaatggcttctccttttttttatgactaaaaaggtgtgtgtggctcagtgctggtacagcaggtcagcactcgcgcactgcgcaggcgctggccagcatgcctgtatgggcacaaccaacacaatgttggcttgcgctccccacgaatttggcaggccctactatagaataatgaatgaataacaacattaaaaactttatcgtttgactaattgctggctgaccaactaaccactcaccgatcaccgttcctgagacactagaacgaatctctccactctactttttttcttcaatccccctgatggtgaccaagaaaccaatgcaagcctggaggaaccagctccctttgcgtgatgccgatgttgctggagtatgctccgatcctacacgctgccactgacaacagccggcatggccgtgttcagaaaccagctagaggcggtaaacctgattagatggatataatatcgcaagcatgcatgcatgaagagatgggcagatggccttgggacccttttgcttcacccaccaaaccagcaagtgccgggcaaacagatgcgagcgtgcagggaggggcagcaaggtacgtgcacacggcacagtcgtaggaggaggtcccgccattcccagatcaggaccaacagtggccgcgagattttcaggaagatcgcatatgccctgctacctgtccttcactccttcagtaccgcgcagtacaccggcgcggccggtagtagtgatagacaggcgacaagcagacagacgacaggcatgcacactgcttcaataatccccttgctcccaaaaaagcccgagtgagatattgatcaagttgcatgcgtccctcccatcctgcattggcagccagacagctaggcatgcgctcttcagagttgcatgcagttcagtgccctgctcctgcagaccatcactgatcgatgggcaagctagctacttttgctagatcgatgaatcagttaattaattagagaaatgcattatacggttttcagattcattcgcgcagatgcaaaagacgtagtacggccggtaggagctgcaggcacgcggctggttgggacgtacaaatcagggtagacatctagaacactggtgtctggggtcgatagcgagtgcggtggactcgtcgccgtcgccaggaaaggcggcactcgcggccgcgcgcaggcgagagtgacaccccgcgtgcatgcaggcgcctgtccattccgtggatgcgtttggtttgcactttgcacacaccaaaccagccgacgggtaagagggaaagtacc

SEQ ID NO: 2631 - DNA, 1422 bp, Zea mays
  misc_feature (1)..(100): optimal_loci_301467_G1, chr9:21972196..21973617, Cluster 15
tgagtacgtacgtacacgcgtagaccgagagacgtactactgtcagatcggagatagatagtttgtactttgtacagtgtgtagtaaacgtcacagggatgtacacgtagagcccgtccttcgctgacgagagaggggcgccgcgcgcgttccaatctccccctcgttttcagcagcacacgaacatgcatgcatgtgcatgtatgtatatgtacgtatgacgtacgtatacacacgatggcggtgacaacgacggagtaccagcagagtcgtacgtacgtacagctgacagcaacattctttttatagttttttcttcttcttccttcttccctgctctgcagctgcagctgctgatgccatcggtcaggacagtgacacacgcacgacgatctctgacacttgatcacctgtcagtgccggggcggggggcatgcagtagtcatcggtcgtgtgcctgctcctgctcctgctccggctgccaccacgcccgtgccggcgcattgttgaccaccgatcgacgacgacgaccggccggcgtgagggaaacgaacgcacgcacgcacgcacgtacgtatcccggccctatcgctgtcagagtgcctgaaatgtggagtactgtgctaccaccaacaggcaggagtgcgtacgctgaatgaaagagaccaccccggaaaatgtatactgtaacagtcggtcttgtcggacatgtgtgcgtgccacgaccacggccacaacaccctagatggacgaccggccccggccggcgacgacgtggtgaagcaacccggcgggcggcggcatcgggtacggtggctctcctagctaggtgtcgccgtcgacgccactcgcgcgcgcggccatggccatggcccatggcggcatggcgtggtggcagtcatcggtcgtcccggccgtacgccctccgccggccggcctcagcgctgcgcactactgagcagttgagcactcgcatgcatgaagagacgagacgagacgagacggcgacagagaatcagagatccatctcgccccggccggatcgaatctcctttggggcctgcctcacacagcttacctctgaccgtgaccgaatccatcgcctacacttttgtttcggctattcacattgctttttggcattttggggacaagtatatatatatgtagtccttttgttcagctcgtcatggataatttttttttctctgtaaaatccttgcattccaaaagagtgagtattttattggcatcagcatgcatagattattaattgtgtgggggtgaaacaccaagattcctcagcctggtttgttttagtataaagaagggaaaaggaccgatcattatgctggcgaaagccacgcgtcatcgccacgtgtaaccatgtggttgcgcgaacatgcaacctatctcgctaac

SEQ ID NO: 2632 - DNA, 2194 bp, Zea mays
  misc_feature (1)..(100): optimal_loci_301774_G1, chr9:23468085..23470278, Cluster 15
ttctgttggatgcctcaagttgtaaaggtgttccaggatccaaagagccccgaaagcttatcccgctatgtgtctcagggcgcgagagagagggacctcatggccttatttggtgatggatgtcttaattaaggactagatcatcagtaatgaaccagggtgacaaataaatactagttttgtataagcaaaaaaaggacgagctaggcctgatgtggtgcgtaaccacccgtgtctcccggacgaatgaccagtagcctatcaaccctcctcgccctcgtcgtctgtctcatttgcccatgctattgcttacacaccgcacacctagcttctctcccatttaagtgaccgaaattgcagatgcacttgcctcttctgtcttgtcttctgatgtgtgtgtgtgagagagagagaaaagatcgagggggtgtgcaaatgcgaatgcggtgccgcgcgcaactgcatgcatcagagttagttctataaattatgcccatgtatatttggagcagaaaatgtatgcatatatgagaaaacgatggctggttgggcctgtcgccctgtctctgtcttctccgcggcgctagcaggggagtacgacacgcggcgagtcgcaggaacacagctatcatgcatgccactttcgaagagaggacgacgaagaacagaatagaatccaagggaaacagattcgtcagcttgctaggaagaaaagagggtcctatcctatcattcctccctaactcctttcaagtccattatgtcctgatttgcaagagagaggctccgcttcatgcatgcttcgagtagcgatagccgctccaagcctccaacccattcgtccgtcctgtcctggtgctagactacatactctgatactcctgcactctacaaataatatgcgtgggagtaaatcagttctagatttagtgacattaataatttatacggtgaaaatatatgtcatgtaactagatacatatatacggtgcatcgactgacactaaggatggacgcagtggcggatttaggattaaagcaaaggaggggctatggcaactaagataaagcacatttagtgggccactgtatgcgatggtcgtattaggggcagcaggctgaggatgagctccacaggaacgtcctcacaggccttgtacgctgcaactgctagctactagaggtgtgttgatcgtgcgcgttgctaattgctggagatgtgttggtcatgtgcgctcgctcgtggctgcgtgtgtgcgcagtgcaatgcacggtatatatacaccatgccctatgcagtagtgctggcactgcagcagtgctgaagcacaaatgaggtctaatgtggatgcatgtgcttccacctagtggcactggcggaggctgaaagcatttgctaaatgttacgataaaaaaaaggaggttgtggtctattttgttactggaacgcgatataatataggtgttattaggggcaatcggagatgtagccccctcgtgtatccgccactggataggcgtagtgtggttcggtagcgactctaaactactaggtggtgccgatgacgttggagatgacgaactggtctgcaccgatcactctagtgaaccaaccgagcggtaccgaccaactttatgtaattttatttataaattgagttcttttaattattttacctgagttatgtaatttttagttgtagtttggtggactattttttaccggtttgtccggctcacgaaaaaactaaaaattcaaagtcatacttaagacatattatacggtaaacgatatcacagtaaaaaataaatattaactatggatttttttggataagaggaatcgatcaaatttatggtaagaacggaggaagtatgtaattccatccgcttaactacataacgggatgtatttaaaattaaataaaacgcaatgttccaagtcaactaaaagcctgttatagaaaacctgatgtggcgataaggtagctataccctatatatagaagtgcattagagcgtcaccataagtaactcaactgacaatcatcgatatagacccggttgatagctgatgcaacagtaggtatataccgtcaggctgcaaccagcctaattcgtacgtcctactcctaccatgcatgatgcccagctagctgattttcggttctaattgcacccatcacatttaatg

SEQ ID NO: 2633 - DNA, 1444 bp, Zea mays
  misc_feature (1)..(100): optimal_loci_30432_G1, chr1:187330246..187331689, Cluster 15
ctacgctctagctacccacctgcatagtactggtatttcatgcactcaggtcagtctaagccatgcatgacgatcgatgatatcctttaatttgggccggcatatatacacgcatggatcgaagctagctgccctcttgcatgcgtgcgtgtggtatagattatcggcgatcgatgttaattactcttcgtctgggagctgctgggagggagcctgggactggccgggaagggaggagaccaggaggagcagatcgagaggcgatgaggaggaataaacaaaagacgcgctgttccgtcgcgtcgcaggaacagctagcttgtctcgccggccggcccaatcagctggtccacatgcacgaggcgcttttcagtagacacctacccagatctagctagctagctaaacggccggcggccatgcagctcgatcgcattgcatatatgcgaacgctaaaaaccctagtagataattaaacggatcgagtaggttgctgtgtgcttgcggtcgtctcgtggtcctgctccgatcaatggcgcgcggatggtcgacacatgatgggcatgggtcgaaatgcatgcatgggcggagcacagtagacgccgactccgatcgacgacggaacacgccgcccgtacacgtcggttcaccggccgacatgcatcggcataatagtaggctaggctagcccatgcatatgggctcgatcggtcggtatcatgcacgcacgcacgcggtatgggggggaggcagatgaggtggagtaaatgcccgtacgtctcggcaaagagggtggtagcagtagtgcacagcgcgcgtacgtgctgtgtgggtgtagtggaacagtggcagtccagtagctgccgcaggccgcagctagctatcaggaaagaagaagggaggaggagaagtcgagggagcacagggagggcactgcgcagccgcatgcagcgcagggccgggccggaagcagctagggacggacgacggatatgcatgatagatggaggaaaaagacggatcgatcggaggagtaaatgctgtacaacgtctccgctcggccagcaccagcagacggagatgaggtcgtcgtcgatccgtggtggcactggtcgtcactcgtcaggtcaggtacacgtcgccgctgtagcgacgacaagaaggaagcaaggaaactactccagctgcggcatgcgaattaatggccactggccggccagacggcgaatagacgatccatccggccatgtggtgcagcagatcgacgacgagggataggtagcacacaggattcgctcgagcgagcaggtccgccgggcgatggaatagaaaaggcggtagcttcgtgctggcactggcagcaaccagctcagctccatcggagtcggagtggcgtacgtgctagctagatagagctgcgcaagctaggaagcgtgcactgcag

SEQ ID NO: 2634 - DNA, 2722 bp, Zea mays
  misc_feature (1)..(100): optimal_loci_30715_G1, chr1:188932999..188935720, Cluster 15
tcggctactgttctatggaccccagcgcccgtgcagtcagctactgcgctcacacgtttagaaataaacaataaatatttaaataaatatcttaatacatatttatatttatatgatatataaaaaccataacacagcgcgggcaaccggttactactacgactcgcattcgtaattaatctcgtacagtggttctacagtagtaccagtactttccaaaataaaagtcttgagtgcacgttttgcctgacgcacgcatgcatgcgagcagaaacttcaaacttgcagtttctgacaaggcgtagcaggcaccatgcagagcaaggtgcagggggcaggtctccggcctcctctccttcccttccctgcagctcctcgcaatccacctgaacggccagccaggcgcagacacggctgcctctgcctgcgctccgctccctcccggctccaaaagcttcctcctcgcaacctagcttgaatgcccaacaagacaggacctgcgctgcgctgcgccgcgccacgcacgcagacaccaccccgtctctctgcctctgccccggatggtctgctctgcgctgctgcatcccagttcgcctctcctgccgttggcttctcgctctcgaacggtaggccatgcatgattgctgggagcaggatagatgatcacttcacctgatcaggcagtaaacctagctagtgaccctcatcttacacggagctctagcaatataatggcagcatgcatgcacaacattagttttttgttttgttttgttttggaagtcatcaaagagataaagagaacggatggaagaagctagctgcagaagaatggcagggttgcttgctggccactcgtggccggccggccggggttcggcgctgctgcactgcacggcgctgcgtttgggcggcgggcggggccagaaagcatgcagcaggaaaccggcagtgggctgagcggtgccacacgaacacggaactgccgcgcgcgcgcgctaaggcatgcacacggagtacacagggtactactgtgacggggccgggtcactagcagtcagagatcttgcttgccgtccaccccctggctggccctggcggcctcatctctctctactaggccatgcgacaggcaggcgcgagcaagtgtgcgtggacgtgggtggatgcagagaggagcacaagaaggcactgtagcaggctagcagcaagagaggatgggctgccggctgcggcgcagcgcatagcaaagaaagctgctgcagcgtggattggacgatcgcgtgcgcgcgcgcacgagcgttcgtcccctcgcctgcgctgcgccccccacactcacccgagtcgtcacctccgcccgccgctctcgcacgtggccatgcctgctgcaggcgtcgtagcagctagcctgcgacgtgcgacgacctccctccctccctcccagggctcccacacagaggactgctgcatctgcatgtgggccatggccctggtgagcgtggtgtgccagtagtacgtttggtgcctgcgacgccgcggcggattaaaggctgtcccgcactgcgcccaacaaactccgcgcgcgtgtgccccatggacccctgcttcctccccttcttatctagcgtctagcccttctccgcccgggccagcgccaacaacagtgcgcgcctgatttgcactgcacacacgctctgcctcatcctgcgatctttgcatggtcgctcgtgtgcccaccccacacccgtgtgtgccccatggttttcttcgcgaactgttcgggcgctgcgctttacccggccggtcgatatcggctgtacagtacagtacgtgcaggaagagaattaagccaccgtgccgtcctcgtctatatcacattacattacatgtccggtttggctaataaggacgcttttcaaaccgaagcctgccatgccgctggtgtttggctaccacgtactgcacctctagcctttaattatatatatatatatatatatatatatatatattctttgctatctccattcaccatatgcatgctgctgctgctactccagttcgtgacgacgccaatgattggggcaaacattagcaaattattgccacctcctacacatcagtgcgtactacgtagctagccactaggtcatttcatttgtttttctcacctactagctagctaatatatactaaggcaggcattaaaataccttcaccattcaggaacgcacgcatgtcgtcctggttaaccaggccggcctcgctctcccgcggccggccggtctcggaagtagcgccgtgggcggccgcagctgcagccaacgccaggggccctgaatggtgccaaagacatctgggcctgccctgccccgcctttcttttcccctctgcttcttccaacctctctcgctctcatcagtatcagggtcgtcctctcgtcttcttccttcctcgggggcgccaagcctttgtggactggcacacggccgcccgccccgggcaagacagagtcgttgcagtgcctcaccccagccagttccccttgtgctggagctagcgtacccggcctccaccgtacgtaccctagctctctcgcatgcaaaaccgggcatgcgtccaatgatcccgagttttcctaatatatatacaagtagatagcatgcctgcatgaagtgtcgtcgtcatcgtcgtggatctacatgcatagatagaacacacg

SEQ ID NO: 2635 - DNA, 1709 bp, Zea mays
  misc_feature (1)..(100): optimal_loci_309862_G1, chr9:76469941..76471649, Cluster 15
agcgcgaaagttaagacgctggagccggtaccggttcaaaagcaaccggtattgatgttcttggttggaagcccggttcaatacaagtggctcagttggatctgaatgttgatggactatattgattctatcacgctaggtgatggatagttggcttgatgccatgcatggaccggagtttggtgagcgacgacgcgaggtataattgccgaagcatgttcatagcaccaggtcgtgagctcgacgattgactgccctgtctgcgcatggaaacatcgttttcgtgccgtggtccagtgctctcgctccgatcccttgagacgcgccaagccatggaacaatgaacatggcatgcaatgccgttcgtctctctatctcagggtcagccggtcagggcacaccaggggccggccggtggtgggtcgtcttgtgaggatgtgccgtgaccattcctcttttttttttctctgttgctgactgctgccgtcggcttcatctggtaggtgaggtcgtcgcacacagcaggcagcaggtgaggaacagatcacgaggggggatggagcgaaagggagggaggagggaggacagggcgtgcctctctctacgtacggtatcgacctgctgggtgtggcagcacactactcgtgagtacagtcgtcactgtcacactgttgcctttatatattcctagccggtagctcatcacgcttgaaagacgcatgcatgcatgcatggcacagttagtttgctctctgtgttcgtaattaatttgcatttgctcttgcctgatcaaatcaaaagcgatcgataacctatacacatcaaatggttccgaatgtacgtacgtgctatgcccaaagtattttacgatgatatacggtgcatgcatcgcatactgtatgcattatacggatggatggcaatggcatcgaccacacaatagcatatccatggatcttttatagctaggtacccgcccgcccccaatcaatcatgaccctgagatagtagtggtggctaccgcaacgcaacaaggccagcaggcatagatggagcgagcatgcatgcagcacatcatcatttgcactccacatgttgggctactacctagagcgcacatgcagggcggtagcaccagcagccagaggcagccacaaaaggatctggtgccggtcaaacatacgggccagcaactgaaacacaagacatatatggcaactgataataatatactagtgagcttgcaaaatggtgcgtcgacatgacagtgcatagcctgcaataagtaattaaggtgtgcgttgctggtgccggcgcggccagccaccaaaacttgcccgactaccccggccacttgtgctgagccaggaagaagccgatcgacttgttgttcgtggctgccacgcgttctggtcgatcgaccacacatgccagcatcttcttaattgtcctgtctcttcttgtttggacacaccataacacacagcttaatctagcgttcgtggttgcccaaagggcgttggtcgatggtcgctagtttaagacgacactggacaagcagaaatagttttctgaagagcattttgttccctcacacccgactgcatgcgctgctacagacgacggcctagagataacctccgttccatgagagccccaccacgtactagaatgcacttcctcctcctccggccgggtactgtgcacag

SEQ ID NO: 2636 - DNA, 2169 bp, Zea mays
  misc_feature (1)..(100): optimal_loci_315881_G1, chr9:111099348..111101516, Cluster 15
cgtgaccagaccacctttccttggtcaagtcaagctactgcttctggtggagtggtggaacgacgagtgcctacaaacgacattcaccgcactcgtgccgtccctctgaactcggctcggctctcgtactttttttactgctctctgctcacttgccgacacacagtcacacagcgacactgactgcactcgccgtgaccgacgttaggaggacgccccccccacgccggtatatgatagtaggtctatatcgatatttgaatagcgccaacggtttcataacgactagtattcaaatatcgaaataaccgatagcgttatatatatctgacagttttcatacagataaatcaaagaatatatatatcaagaaactcagtcaatgtgcaccaaacgcccggccacggcccacgggcgaagggtgggtgggggacctgtgtgctacgtgctgccacagtgcccagtctaggacactaggtccagtgcctacgtaaaaaaatatacgagcactgccgctgcaggctgcagcctgtagactgtagcagtagtagtaggtgcgcaccgccctcgatgggtgccgagaccggacctgcccgtcgtcgtcggtgtcgcgtactgtgtagtacgtatagccgtccggcatatgtacggacaagggcgccctacacagccaaaagggaggtggcttgtcagtgtcaccctgcagttataacaggtaccactacactacacctgcagtgttgatagcaaaaaaaaaaaaacacgagcaccaacttttgtttaatattcgaaagaatactgaattccacgagcgagctccttgaacttattggcatatatatactagtactgtcttgttgttttcggattatacagaattggatttacggtgtatctaagtcatccccaactaaaaattccaatttttctttagaacgagttcgttggtatgtgtttttgttaaacagaggcaaaacagttacattttacgactcgcatacgccagtacgtgcaatgatgcaggagacgtggacgctggtcagcgcagacctccacggaggactagccagggccccgggtcccccgagtctcggctcacctcaaacacgcactattgagctacgttgttgtactagcaagctactcgtagctactacaagacatgtggtgattgcatgcaccgtgaggtttggccatccatggtatatgctccaactccgcgcgcgcgacatggcatggcatgccaggcatgtggtgcacgaccaccatgcatgtacgtacgcaactcatgcttgagaatgaactaggggcgggcacaatgcaaacaatatgtccacacaggtttatatctcctagatagagaagagatggagagattttcctaatttcctttatgtatgccaatttccgcatcttaacaaataaacacttggtatcgcttggtggacacccgtagtcccgtaccaacaacaccatcgcgcacacgcgaacgtaggacgccgctgcccgctagcaaagcagataccagcctaccaggtagtgttggtacgcaacgcaaggagggggggctcgaatctcccggggggccctcttgtacgtctggcttcgccatttccggaacaaggagggacgccgccggccggccgaaacgtggacagacacgtccggtgcggtatctatactcctacctcgcgcacgttacgtactgtcgctttggtgacgtcctgtgctgctgggcagcacctctgcatagatttttttgctggtactacatgttggtcttgcttctcagttctcacaacaatttggcacatgaagcaccgtgcacagcgcgtactacgtacgtgatgtttgcgtttgagaacccgcaggccacagccacgatatcggaggatgtttctcgtgcaattagcggagagacaaacaagaaaaaagagaggaaagaaacagccggcgccagcctgcccttctttcttcggtccaacacacactagagtagccagcgcgcgtatccgtttggtgccacttcttcaaacccgacaagcagccagactgccagagtgacgatatatctcctctcgcttctatgtgtagacaacatcatggcaatgggaaacaacgttcaactactagcgtgagttcctggagaaagaactactacaaggagac

SEQ ID NO: 2637 - DNA, 2884 bp, Zea mays
  misc_feature (1)..(100): optimal_loci_31669_G1, chr1:194685000..194687883, Cluster 15
ggccggttcacgacaaagacggccgcgccggcgcgcgctcaccggcaccgctcacaaggaatcaaagcatggcgatgcgatcggctgcatgcgtcgtcgcgcgccagacgcagacggccccgatcggctcctgcgaattcctcgcctcggcccgccgtcgtctctcgggaaggacggcgtacggcgctgccaacgccaccacaccggcccggtcgcgcgcccccatgcacgcgcgggcgcggccctgtgctgccgggaccgagatgtgcgatgcatgtgggcgcgtacgtacgttggtcgttggtccctccttccgtcgtccgtggtttcgtttagttaattagcgcccgcgggatctatctagctatcccgccggccgccatgcatgcatgcatgcatgtgacttgctatgagccgccgacgacagccacgcttggttctatcaccgaaagctgcgtgtcccgcagggtagttacggtgcaagttgattagtggttaaggtgcaagttgacgcgtggttttctctctctctctctatgcaccagccaatcagccatcggccatcactgagctgagacatgcactgtctagtctaactagccatgctgcgcgctgctgctgcggcgcgctggccgggtcggttaatttttcttttgcttgcccaaggcctggacggacgcgattagccagggcctctccgtttactgctggacctttaatttaatctaccagagcgctttgtagctataggtgtagataggcacgtacgtacacgttttttattttggttacaggatggaacaaaccggtcagaaatacagttaagcacgtgcgcgcgcgggggttatagaccggccggcccctgacgtggtgcactacctgcctctgcctgtcagatcgatggatggtgcgctgggcatgggcgcatggctggcttcagcaagcacacaaaggacatgaggcatgcagagacagggtcggctagggcgctagtctgctggggcaataaaatgaggggaggcgggagccgtggctctctcacttttgggccaacacacacgggccagactgtagaggagagacacagatcacgtcctcgagttgggtggcgcgacctgctgcggctggcccacttggcccatcgcccggaccaaactggggggctccatcccggatctccacgggcctacactgcccagccccgctgtccggattccgtcccaactcccaacacgcgaaacgtacggttgcttcaagtggggaaaaaaatgctactgcttacaaatgtatcgctttccctccctactactccaattcattagcagcgcagcagcagcatgcacagacagggtactgccaagttgtatgagagagagagagagagagagagagaaacccctttggttagctaggtgacaggcgacgaagatcttctcttggtcacggaaggcgtcgccaagattttgccaattatgggcgcgggattcgacgcccccccactcgcaagagctcctacatgcagatcgaaacaaacgaacgaatcatcatctattgccaaaccgagcgcggcttgtattcggctttgccaattaattttggtgaaacgtgtcaagctattagattcatgttttagaatccgacggtgactgtatattcttttttaacagtagacgatgtgcacgcccaaaacgagacgtcgtctacggtgaggctttttgtcgcttttggagattttaatctgtgcgtatatatagacaacacaatgcgacacgtgcagtacactctattgattaggagtgtgagattttctaggtaccgctcactctttcagcaggctgggagtgcttatatggatgagtaggggtatgagtgcgtgtgtgtgtgtacctagaaaacaaattaatggatttatgttactgtacaaggctatacttgctgcatgtaccggccggttttggacattcggtggatgagactccaattcgtcgtgggcttggattccagcccgtctagagctacacgatctacatgactacatatgcttttatttttgttttcgcgcgatgtacacagaagttggcccttggaccttggtcacttcgcttttcgttctgcctttaggccggtacacttgcaaagttccttttgtttatgttagcgtcgcgaccaggctagctagctagctacctacctctgcgtcggtctcgtgcgtgtgtgccgagtgcacgaggaccagccatcggccgcgcgacggcgtgcggtgtgctgctgctgcgacgaacccgcggcgaccacaccacacgtggaatttggcacgcaccatgagggcctcgcctcggtacctttgctgctggctctacagggagcactcgaccgttgccatgctgccacgcggccgagattctgtgacctcagctcgtgacgacggcgacgacgacacagcagagcagacacgatctgattctgatctgggggactttgggcaccggcggccggccggcctatgcaaaatatatcgtcgtcccgtctagtgcatgtcacattcgcgcactctacgtacctgcatgcactgacaaaaaagtcgcctttttgttacctattactactactaggctagatatggaagattgtaaatcttcccagccaggtggtggttgtttatttgttcgccttcgccttcgccttcgcgtggtgaatgtggttcggcgcgcgcattgcccaggaatcggagtcgaatcctgaacgtggagctggcggaaatgggatagcgcgttgccgactcgccgttggcgctgcctccgcctgcctgcctgccgtatcggttctgtattttttttcctgtctttcaatgatcgaccatacagcagagcaggctgagcgcagc

SEQ ID NO: 2638 - DNA, 1470 bp, Zea mays
  misc_feature (1)..(100): optimal_loci_31712_G1, chr1:194944003..194945472, Cluster 15
aactggattcagttcagacaaagacgacgatgatgtgcatccacctccacctacacgtacggccagtagtcgagttcctctgggctgccccagctgcttgcactgcactgcacgcgttgcagttcgcaggcatggcatgggttccagtcgacgacaggaggacgaggagccggccgccatgtggccaccagacccgaacggtcgaggcaacagctagccggcccagctgccactgcgccattcctccccggaactggagccgcgcgcgcgccctaacagatcattaagcccccaaaggatcagatcgcatcttatcggatcggatcggatcggcagcgagccagcgacgacggaacggcggccagggcgctagctagctttcgcggtgcaccaactctgccatctcccccaatcgatccagctagctacgtaccgagctggcggtgggctggtgcatgccgacgcacggctgatgtggcctgcaactggccattgccctcttcccccctcccagaggtggcgtcgtggtgcgcgtgcatgcatgcagctaactagatagctagctactagctgtgtgtgtgcgtgcgtgcgcgcgtgcgtccacggctccacgccggctggctctggatcggaatcggaggcagagatgaacgaaccagctgctagcaggggagggcggctccgatccattagttccactatacgcagtgcaggcttcctgccactgccattccagctagctcgtgaccgatcttatcctgcaaagccgacggcgacgacgtgctggtgctgctgccgatgtggccactgcttgtatggatgctctctctggtcttgtttatatatatggactcttgtgtgcattattaaagacgagcgcagcgagatccggggcaatgcgtccaacaagcaacactgtcgtctcgtccgtcgcgcgcgtgtacgaggtttcagagctagcactgcagtagtagtagtggctagtagctgttgcctgttggtgcctgtggctgtggcgtgtgtgtgtggggacgacgtcgacagcgtagttgcgtctactcgtcgtctagacagcagctgctgctacgcgcgagcgccgagctagcctaccaatcgtggagagcccaatcatgcgggaacaggatcccactacttccacagttccactaacaaagttttggaagaaattcttaccggccggccgaatcaccgaccgtatccatgcataagagtggagcaggattacactttcattcactacccgttcagaaatcctatcactgtagattttctgaaccggtaaaacaaaagtgccaacaatgaacctactcatcactgtcggttctagatagtggtgttcaaacgcgccacccgacccggtcccactacaagaatacttaggactcccgtcggctaatataatccccatcagttttgtcgtaagccgacgggagttacaaatgttaggac

SEQ ID NO: 2639 - DNA, 1758 bp, Zea mays
  misc_feature (1)..(100): optimal_loci_3203_G1, chr1:16449269..16451026, Cluster 15
caaagaaaaaaactagtatatatccagattatcttgtacggtgttggttgcacttgacgacatggatgtggcttctagaaactagttgacgaccttgtacatgcctttggttggcgtgtggatgtacaggctagcgagcgagcgagctgaaatcgtactgcgcagtacggtcaatgcgtacgttgcaggtagggaggacgcaactcccctggcacgcatgaaattaataagcagcttccttgcccccggccggccgggctcccttgctgcattgtagagtgtaggcacagacgtacggacgtcgtacgtgcatgttttctgtgtacggggagtttgtttacaaggcaaagattcagctcatcaaggaacacacacacaccgcttaatttgattcgaccgacaacagctattatatacagtgccattcgaattcgtcgtagttgtttaaaacaaaactactctttattgcagctagctgtgtttaattcttcatcccatatatgtcgcgtagatattcaaaccgttgttgcattgcattgttggccggcctagtgcgtgcagtctgcagtgtcgccatgcaatgcaagttgattgacctaacgcaaagcacgcgcgaactgaaacagaaacatcgtccaatcttcggaaaatcccagcgcggtattgatcgaccactattaacgaccagaatacatattacagtggccaaaagattagatagagttgcaggttaatttctaccacacctgctgacgtggcatggatggtcttgtcttgccgagttgcgccggcccggccaggcattcgtgaggaggtcgatagatcgtcgccgaccggccggggactctttaccgcgcggcctcgagctgtctgtgtgcgcgcgcgaaaagccagcgctggactcgatccgtccggaagcggacacgcggtttcgtgggcagctcgtcccggtggcccccgccggtccctctctcccaaagacgaccccaccagaggccttagcattggccacgtctgtgccactgtcactgtgtgagtgctgccgggtaccggacctgcagcgcagcgcgcataggtgtgatgagtacgcaagggaagagccggggaagccatcgttacttggcgcgtcatcggcggcgatcgactgaccgtctgagtctgatggcctgggagtagccaggtcgtcgtcaggcgcgcggcgacaccgctgccagctgactagtgatgtgatgcccgtgcaaaccacaaggaacatgccacgcgtgctagctagtttaccaattaagccgacgaatcacagttcggcagttcgccgatacatgattgtacagggacagcaagcagccagttcagaactatgtgtgatgacgttgtaacctatggacgtcgatctctctatctcacaccctatatatgaataatagacacacacacacacaccaccgtacgtgtgccagggatttcaaaataacagcccggctgcggaaatgggggtttggtgagctgacgacgtgaaaacgtttaacttttcccccctccctcggtccctcttgaacgaatgaacgtgatgtcacgaaatgttggttggcctgcccgcccgcccgcttgccaagcgcaacgcagggtcgttccatgcacatggcatgaaccacgccaatttatccctagtttcgcctaaccaacgcatatatgtatctgtaattataaatcatcatcactagtgtcccactatgagcacagctgttaaaagttaacacg

SEQ ID NO: 2640 - DNA, 2337 bp, Zea mays
  misc_feature (1)..(100): optimal_loci_320529_G1, chr9:135834671..135837007, Cluster 15
gaacaacgtgagatggcggagtgcgtgacttgtgaaggagtggccggcccgtgcagtgatacgatacggcagcggatctgtcacggtgtgtcgtgcacgtacacgtaaggggtgggcagcagccagccagaaacccgggcaacgtgcatgtgagccgcacagtttccttcctaaccaaacgctgctcgacaaaaaagagagaaccaaaatgatgatcacccaggccggcggcgggtgaagcagatctactgaaggctgcggcgcgcggcgatcaccaccctgtagtagccggcgatctactgaagcagatctactgaaaggcagttgccctgtcgtctgatctccgatgagatgacgacctgactgactaccagaacttgggttgtagtagtagatgagcaagccgtcgtcgcatctgctcggtccggccgttgccggttgggcgcgaccggcgtggagtggatcccgcagccccgcagcccctgtacttggagtacagtgccgcaccatacgcgcctgccggccgtcggcctgctcatgtcatgtgccgcagtgccggtgcccaacccaactggcgggaggctgggtgtatatgccctcgacatggcattttcgaaccaaacaaagtccgcaacgtgctttctattattataccgaacaaaacgttagagccagccactacctcttgacccggtccagcgttttctttcttcttttcaaaccttgctgctggtgttgctccctcgtgtcagccagcccagccgatcgcgcggcctcctgacagctaattttttgtccctcgtttttttttattgttattacgccattatcacgcaaccatcatctatccgtcgtccatcacttcaaccccccgtgcatctcgacatcttgtcacggccgaacagcgcgccagacaggggccaggcgtagcatacgtcagggccacgtcgtgccatctctgcctagctaagctagctgtatcctgcgagtctgcggctgcggtgcgctgctcgtatagtagtaaaacaaaaacaaaacaaaacaaaacaaaaaaacgtcgccagaaacaatccacgtactaccgccatgtgctttcctttgctttgccggtcactgtagcgtaaccatatataataactcagtacggtacataccacatgtgattatattaccaaaaatgagctcgacgacgaccacgtcgcggctagagctaccgtaacggtccggtaatgcaggcagcagaaacgcatgggagcatttcgtgatgttgatgagcatgaggcagcaagtggccggtgcgtgatccgatcggccgatcacgtacccgtgccggaaagctggatttaaattccggggcggatcgcccgcgctctagtttaacccccgcgccagagtcgagtgtgtgtgtggccggtgcgtcggagctgtacgtattcgaacgcgaaaccacacaaacggacccccaaccccacgccaccccacacacaacaacaacggcggactaagtacaaatcgaaagacgaaagtgccccgcgtcctgcccacagtacaaatccgttgtacgatgcatcgtcatgaggtcagggtcggttaattagttagtcgatcggttaacttaatcccccccggaccgtagcggatagcaagtcggcacagaccgtcaccagttaaactgcaggtaaagtaaaggagacacacacactcacggcaggcagtactgcagtagcgaacacgttccctggactccaagcagcagcctacgcgggtgcgacacctgtgctgtgccgccgacgctgtgaaaaagcatatactactaggcgtcgcacgtttctactcgctcggttagcgaaaaaagctcctcctcctcctaatcatcattcaaattaaacgctgctcccgaagcgggcgaggtgacggtcgctcgctggctcgtggtcgtgggccggccagctcacgtgccccgcgcacatgttaggttggtttgccttggattcgtcacgctcgcaaccgtcagctcggtcagtcttatcgcctcccggtggcgattttctgagctcccaggtcgggattaaaaaaaaaactacgggtgtccgggttcaggaaccctgccccgtgcgtcaccattaccaccaccccgacgggcgatgagccgatcgctgatggcacggccttgccgtcgaatcagctgttggcgacaacgaatctcctagcggatatcagctcatttaaaaaaaaaagtttgacttcttaacaagcgaaatccgcacttattcctatttaataaactaatttcctgttcatataaattctacagcagttctacttaatcgtcgtcgg

SEQ ID NO: 2641 - DNA, 2434 bp, Zea mays
  misc_feature (1)..(100): optimal_loci_320539_G1, chr9:135862432..135864865, Cluster 15
accacgactactacgtacgtgcatgcttcgaactggataaaactgtttgtatagtagtcgtcgcgcaccctcctctatttctacacatcacgcagtattgttgttctactccagcatatgtctccatccagcatgtgtgcttcactttgctccacagcctgtccacgtcgtcgtgccgtgccatgccagttggcagtacacgctgctaccactgcctttcgttctgctaagaccctaaactattgctagattagatgaggagggggcactgcatgcgaccagcccagccagcttgcctactacgtctacgtgtaacgtgtgcctgccatgatggcccagcacgtccgcgccagttgtcgacctactactggggctctactgttcccattggccagtagtgtgctttagctttaggacaggtaagcctacccctgaactctgaacagcttgtagactagatatatacgctttccattggtctacgtgtaccattgggccatatacagaccaagacaccctgtcacttccgacaagctaagctagctcacgcgtgggcctcaccacggagtatgaaagcttgctctccaaggtccaagctctccacacactccacagtacagtcgtatccatagttccataccgaactgcattcatattttttttatgcattctactctctcctttttacgcatgtgtgtgtgatttctctgacagggcgcaatctattagaggctactgattcataacgtaacaaactatcgtcaagtaagctaagcttgccatgtgattatttgtagcggcagtattttcacatgcatgagcatgagatcgatcgagcgcgtttctttttcacgcatgccagttctcgaaaagcttgaaggatttttaatgtgcatgtgacgtgtttgctgtagttaaaatctctactatgtaagtattttattggattattctcgtgtcctagctagtagctactcgatcccctgtcgtcgtcttggacagcaagaatctgactagcaaatcttatggagacgatttaatagatatttcggcaaaacaaatgattaattgtgcatgcatgattaatttcgttccgaaggactagctagctataggcagtgtatacgtaccccgaaatgaagttggtgtaccgaacatatatatcatgcacatgcatgcgcgcccataatagtctactttctagaacagtttttggtgtaccaaatgtatggggggcacaataagatcgatcgaaagtcatccaaagcgagcaacaaatgtattggttctatggattgctctcttgcttgcttgtattggagcgatgatcgaggtacggtggtgtatatggtccatgacgaccatgcatccaagccaagccattgcacggagcatgccgctcgcgcgctgccagatctaatcttagcggtcgtaacgtctttgagacaacagtaagcactcacgcactgagctcaaaaaataaatgtggagtagcaattctaaaatagataaggttcgcagaacagatactactgtttggaataaatgcgacatttgacagacactaggagggaatcttgttgcgctaggcaggcaggcaggcagcattggccaggcaggcggtgccggtacggtagtgggtgaagagccccccaggcccagggtcaatgcgtcgcggaaagttgcgcaagaagccaagaacaatctctgcatagccttccgagccgcgcgcagctagttcgtagtacctcctacgatcatgtttttaagctccaccatcaccgttgctttgctcgtacgtctggatgatgtactgtaggagtacgtagtactagtaggccacccttaccgccgtacgtgtacgtgcgtgcagcttttcttgtgatcttgcgtcggtcgccccttttcaccgcttcctcgctagcgctagctgcggcctcgatctctttcggtccctcgtcttttgtttgcctcgtctcagtatcagccctgaatcactgaccatgcatcatgcatgcatacctcgacgatcgttctacagctgccataataagtgtagtgtgtacatatatgctatgttctagtagtagacagtatgtaccagtacacactacgatccgctggtgcgttcacctagagtatgagccttatgttttttatgagaactgatttggtggacagtgaattatgaaatctccgttatacacaatgtatgtataatctacaaaaaaaattcttcgtaaaaaacaagacgtaaaatcttcataaacaaacatataaggtgagaggtccaagttcctaacaattttttccatactgttagatgaatcttcaataatctgttggatttttttttggctggcgtctcccttataaaatcactgtgcatggaagcaggtagcagcaggtatgacaggcacgcaggcaggcacgc

SEQ ID NO: 2642 - DNA, 1438 bp, Zea mays
  misc_feature (1)..(100): optimal_loci_321636_G1, chr9:141442264..141443701, Cluster 15
aatcagattacaacccgtaccacgacttctgaggtaaataaataaacaacaaaaactgtttcatggtcatgccgtagaatagaatagatgcatgtaccttccttttctcgggccgtggaatgatagagcgcttccaggcgtacatgagagaaacgaaacggacgtgcactaagcctttagcccgaggccctgtaagcaccttttgggccagtgtagtaggaaggggcccggtcgtggtctcggcaacattaagcaaaagaaaaaaaaaactttttagacgtgcccttcttctcttaaaaaaacaacctagtttttaaaaaaatagtttttatcttttagctagaagagactaacttcttatttttttaaaaaaccccgggaatctaatttctataaatatgtagaaccaaatcaatttttataaatagtttcctaaaacacagggtgcttgcaaacagggtctaactaaatcgcagtaccagaagaaaacatctgccattagcacttgcactgtagcagaaaggtccccggatttcttagctacttgcggagtctggactgtgcaagtccggagcatagaaacaccatggcgtagagttcgtagtcgtgacgttctgctgcgtttgaccgtcgcaagcagacaaccgaggaggaacaatttaaaaaaacggtgtcgcaagatgctgccatgccaagccgcgctggcctcacgtgatctccccgcatgacccgccggcagcagaaacttctcttctccattggatccaccggcgtgtctcgtctcgtctccagtgggatgagaccggcgaaggacattggtccgtcagaaaatttgtaatggcaagctgtcttcagaagctacgatcccacatactaggccgtggaaaatagacctacgtacggacctgaatggctgagcaaagtaaaggagagagaagatgagagagagagagaggggaaaaacatgctataaattagagctcgtttagacgcaacaaccaaaaagctttgaacttcctttggattcaaattataatttagactgaagggagtaaaggagataatgaggtcatgtactaattgactactatatggatgagctaattaagtagactgcaaagatttttacagctgccagtttgcgtaaactatatggatgaactaattgactactataataattgactactagttgattaagtaggctcttctgtttatttccggtttgcgtggtagctcaaacgtcacgtgcgatgaccggtggagggatacagtcgtaggctggctggaatacattttaccaaacctcccctggcattcatcatatttctgcgaagggtcggagagactttcacgcatccagcggtaatacagccgtacctgctggcgcggcgacctgatttgtccacacggcgttagatctgttgcaatctcttgc

SEQ ID NO: 2643 - DNA, 2140 bp, Zea mays
  misc_feature (1)..(100): optimal_loci_322257_G1, chr9:144848591..144850730, Cluster 15
cggtaacccacttcgatcaatatggcggcctaaaaaattaattaattctcatgggtcattgtgttttcttacaccttttcaggcttttcctgactctgacattgtctgtccgattgcaaaaccagtcgaagataccaaataaacctgacctaattgagccgatgtttgccatgcgcggacagccacgctaggagccacttttatttcgtgggagcagccacgagcattggcttgcgtcataagcagcagagctcaccgcaaacaccccgcgttgcatccgggggcgcagccagatcgctgggcaaggtcgcaaatgcgcccctagtacatacatgattgaacgcgccactggaagcggcccccccaggaggccaggacgttgcccctgtgcaatgcggctgccgtgctggagcattgatgcgcccatcggccagtgatttgccggcacaggaaaccggaagcgacggtttgaccctcaacattggcggcatacgccaagggttatgcatgcacattgcacagtgctgcagccgccggccggggcgcctagccgcctgccaccgcgcgggagcgagcccttgccccttcgctgttgcctctctcctctccagattcgacaacacgtgccgcgggaccgctgttccagctagagctagcgagcgtagcgaagcaagctaattccccataggccatagagtcgccgctttgctcgactgcccgtgctcggtgctggctcagtcccatgtgcccgccggaactggcccgccggaggcagagcccgtcaggcgggcgcgttgaatgaagccgtaagccgaggtggcgcgcacggcatgcaagcggtaggtccgcagggatctcattccccgtgtcacccaccgtgtgtggcatctcaggctcaggcgctcagctagtggggactgacgtgcatgtggatggtgagcgagccgcgactccgcgtgcgtcagtgcgccggcgtctgaggacagcgtgcgtgagcctgtgtgacgcgccgtggggaacgtgctgcgctcgtttctgccgtctgccgcccgcgcgctcggcgacgcgcgggaagcgacaagggcggcatgggctgctgcatgcggaacggggtggcagggggaagcctgctccgccatcggcagcagacaggcggtcgatcggcagcgcgtgctgtgtcgtcttgtgccttccgcctgcgtttccgccggccgctgcgcaccacctgcccctgcctgcgtctcttgttttcttttggaaagaaaaaccgtagcgctgtcgtcgtgtctcagtctgctgcgtgctctgtagtctgtagtacccatgcatgcattctactactacgtcgtacagttcacacatgcatcgtcactactttgcgcgacaccgtacctcgaccgcggtccgccgcagaggctagctgctgccgacgcaaccgtccgacggccgagaccgatgagtgctagtagatgagatgaattgaagaagctgagggacaagatcgatccagacgtagagtattcttaagcttcatcatcgaaagaagctagtgctagacgatcacgtacgctgtttcgtactcaatcaagttcgcatatattacgcgcgcacgcagccggcagcccactgctgttttgcaggatcactgttcactggaggaggcaccgatcaggaacgagtacatagcactgcaatctaagctaccggtactgctatttgcagtcgcaggcttggagcccggtcggccggtcggtcggtctcggtcaactggactgcttgctttgatcggacctgctcggctcgggaaaaccgaggttcatgttcgccgtatgcccgtatccctcactctcactgtgctgtgcctcgcatcagttatcaccatacgtcacgtcacgtctgtcaatgctctcctcacgcctctgggctccgctccggacaagcaccagttcggtgacaagcatctgtcgttctcattcaggtacttgaactctctttgtgcctgctcggccagcaagtttgttccctccacagtttctgctcgtgcaaccgtagccaccgtgccaatagtccaatagtaagtgcgaaaatttgagaggaattaggctgcgtttggttccgtatggattcttgttatcaaata

SEQ ID NO: 2644 - DNA, 1528 bp, Zea mays
  misc_feature (1)..(100): optimal_loci_323067_G1, chr9:148776884..148778411, Cluster 15
acagtagtggtagtatcaaaggagctaggaatgattgcggccatgacatgcatgagcgccaggaccttgtgcatgccttttcaccggcacaaggcgatcgacccagccgccagcgcatggagctgcccagggtttccgacacatgcaactcccacggaacaggagaaaagcagcctgtgaccatgcatatacgatacgaagagggagagagggacagagacgaccggacgtgcagcgcagccgagcatggaaacaaaaggaagattccatgtggcgaggtctttctatcccgctcgtgacttgtcgcgctcgatcgcgccacccgtgaaccgccatgtgcatgcggccgcgcgcgagcgggggcggcaggccgcggcagcaggcacggcgtgccgcacagtgagacgccgctgcgcacaggaagatgcatgatggcggccacgtctcccgccgtccgaacgcgctgaagccagggaagcaggcaacagcacaggacaagagctcgcgtcctgcgtccatgcatgcatgcatggcccgggattgagaaggcgtgcgggagcccacgcgcacaatagccatgcatgcatgatcgctttttgtgcgggggcgggtccgatcagccgagcagtggtgactggtgagccggccggccggtcgcttccatgcacgttcgctcacaggccggccgatcattttccggccggcggggcgtggcgtggggcgcgcgctttttacccccaatcattttactcagctcattttacccccaatcgaacaaaatgattaggtgttcgatcccgagtgctctgcaagaatttctcagctccattgtcaacagtaattcaaaggccctcctccatcgatgcatggatgcgtgtttgtcgtagccgtagtagggcgtcaaatcagatgaggcggcagatcgtcgtcgtcgtcgctctagctagctaggcgcgccatggacaagacaacgacgatcgatggcggaggagacgaatccatgcatgcatgccgtgtggtgggttgtacgtagtaacaggctagcgctcatcatgcacacagtcacagcgtctcggatcgggcacatgcaatgcctcgtttccaggaatcctgtccgagagagtagcgtccaagccaggaattaatggcaagggccccggcccggccggccatcgccccgctcatgcagggggcagggcgcacgactgtgcaggctggagctgttagctacagtgacgggcagtgcggtgcggagcggcacagggtggttgtcgccggagcagagcagctgcgttgcctgcgcaggcgatcagaagctcatcatggcgcgctgctacctgctggacccgtgggggtttgttttctccgttgcggctagactagagcgagcctctatggctctatgtcagggttcctacctccaagcaccaagctgctgcagatcggcctgcagtatgcatgcagaccgccggtggcgctagctttgggctttggcgtgcattgacgccatacatgttagctacgcttc

SEQ ID NO: 2645 - DNA, 2150 bp, Zea mays
  misc_feature (1)..(100): optimal_loci_323226_G1, chr9:149723968..149726117, Cluster 15
accgaaatatctgatgatccatcaaattccgggcaggtgaggtctatggacatccataaatgtacatgctacagttagtttatccatatatacttggtacagttttttttctttcttctagctatctagcttagctaggcagagacatatatacagtgtggcatgcatgcttctacttggtagaactgcgaagtgcatgccagctaacgaatcgaaaccctgtttctggttaataagtcatgcaacggacaaactcgatcgatcgatcgttcacttcctctgaatgtttcaataacaaactgcatccaggcaaaaccgatccagccatataggatggtttttgttaactagtaggagtactacgtactagatcgaacctatatatgtcggcacgggaatcctgtccctcgctgcgtgtagacatgcaaaatcaaaggggaattttgtcattattattaatgtccatattgatcgtacctaggcgcctaatgcgtcgaaaacctacactgtcgtacgtgcttgtgtacgcgccgcatatatgtccccccccctgcctgcctcccaggccggacattaattctctaggtcatgtgtggatggtgttaaattacgtgcatgattccgtttcgacagcgttggttcatgtacacactccggcctagctagctagcatagccctagctagctactgctaggtcaatatatagtacgtagttcggaattgctagctccatgggcataagtaagaaaggcattttttgttgtgtgattttagtttgtttttttgttttaaaggaaattattttatcatacaaaatctaattaattaatgcgtgcattttatacctagaaactgcctagttttaattagtgtccagttatgctggatgtaaactcagcttgtactagagttatagtaatattgtagtattattttcagataaagatttatgtaactaaaagagacaggtgtatgaaaaaaaaaactagagtcacactgagttgtgacaagcagccagcgcgctaacccccctcacagtcacaggctcccacccacccccaccctcacaaaaaaaaaaaaagaactaaaaacaagaagcgacaaaaggttatcttcctgctgtaacagcagtagcttagtactagcgatcaacagcatgcagggtagcctaacgtgacaaatagcaccgcagtgtctggccacgccgtgcacggagcagttccgggccacatacgcgaggcgagctcgtgcacgctggccctaccgcgccagcaatcatctgtgctggctggctggctagcgcgcccccctttttcgcgcaactgcgacgtgaagtcgcgtcgcgtcgtgcctgccgcagcactactgggcgctggccggggttcctgttgccgcagctagcggcggcaggcagtgcccccgcccgtcactgaccctatgcctgtgcggcgcacaaccccgaggatttatcccacggggcacggccggataggacactccgtccgtgcgagcggcagtccactggccccgtccctggttacgctacgcgacgacgacgacgatgtcacgcgcccggccgacgagcaggttcggacggcacgtgcagtactatggccatgtcatcgcgtcaggcggcacgcggcgcgtacatgcatgcccccggctcggctcggctggctctggcgtccgaggtcgtccgtctcatccgtccgccgcagaaaccacactcgttgcggccgcctggtttcgtcgcagcgcagcagcaggcggcaacggggcaaggcaagcaagcgcgacgtggaggaggggaggggaccctgagccctggccggagacaggaagcgacggccgatggatcctgccctgccgcagcgcgcggctacaatttccgaggtcccgtcacggcaggggtgtccgcccggcccgtcaaatgattccgggcctccgaatcatgaggccgcggatccacgacgatccatccatctgcggccggcccggaccagcgcaatcatgtatgtgcctgtcatcgttgcgttgcgtagctcggtagcccctaccgcccggcctcacgttcctcttgcccatggccatggccatggacgagcgatcacgtcctctccggccagctcggtgaactccaaacagtctg

SEQ ID NO: 2646 - DNA, 1583 bp, Zea mays
  misc_feature (1)..(100): optimal_loci_325839_G1, chr10:7111631..7113213, Cluster 15
aaatgactatcataatgtaaaaaaagatcgactttggggcgctgttacgcatggcctgaagcacggtctgatgaagcaaacggtccattactcgtagctaatggtgtagttggaccaatgagacatgtgtggttaactcgaccgggttcgcgtgatagactttcagtgtatatatcactctatgtgacaaataacattgcgctgtatatatataacctaaaaaagaacgtgaaatgcttcattgcaacagggcttcgtgcacgcatacctgctgtcctgtctcacttggcaatttgacgtgctgacaaggtggaccaggtgtacgacaggtaccctggcgccgagatcacctcaaccggtagagaagaaggccctgaccgaccggagtcttcctcgacgagctccgcatgcaagccgccgttcatccgaccgtcggagaaacgattctactttctaagagcccaatcggtttagtgagcccatgcaactcatgggccagttgatacatagatagtagtggaaggcctgctgatcctccgttcggccgacttttttttatccagacagcgctgctatccaacgtgggctgggctcagcgtgggcctcgcggccccgtccaccagcgctgtgctggagagaagtgcaggcaggcagttggtaacttggtatatactggatggataacgagagagggagggagggaccatatgcagctgcagctgcaggtaggctactgcggccaagcccattgatggagttgcaggagctacggacgggacggacaggggatcacaggagacataaaccaaacgcgaaatcatttctcctcctccttccatcaccagaaaaaagaacagcattcgcagcagcagcagcagcaggaggcagtatgttctttgacttactgtagcatttcatttaaaaaactcgatttgtggccggtgaagtaggctgcacgccggccgctgtgcgcctgtgcctgcgagtgggagtgacgcatcagcgatggccgcagaagtgaagtgacggcacctcccagtcccagtcccaggcggcccgccgcccgccgcggtagaataggggcgggcgggaacgaccaatggcaacggacattcctgcggaatcgcgtcgcactggccatttccttttctttttttcttttcttttcagctgccctgccacctacctacgaccggctggctggctggctggctacggcctacgggaggactgaggagtactagtaccgcttgtttactgctgcaacgaccgacaaatgggctgccgagcgatctggctttccaggcgcgagatctgtccagtccagacgccgccgccgcactttaatccactgctcgtcagtacgtacgctgccggcttgatctcgttctcggctctcgccactgctcatcgatcgacctgtcatgtatctgtgtttttccgcctcacccttttcgccctttataactgtgctgttagagtgtctccaacaacaacaaggaccgatatatggtcttgtccgctaaacttagagcatgttgagagttcctttatctacgcgtccagcaacagacgtaaaaata

SEQ ID NO: 2647 - DNA, 1496 bp, Zea mays
  misc_feature (1)..(100): optimal_loci_3278_G1, chr1:17001197..17002692, Cluster 15
taacggttgcggatagcctaatagcacggcagcacgtagcatcatcacacgcacgaacacaagcacaagcaggaaagagcttggaggttgcagcaagtcagcaacggcgccgcaaagcgcaatggaggcatggagccagcgacacgagtagagcaagccgccgtctcagccgggaccccggccggtggctagctgggtcatcagtcatcacatggtcgaacgcgtacacgcgtgccggaaatcctagaaaatcttctgcgtggcgctagccggaaaacgaaatccagccgccgccggtcaaggttggactcagcgccggtgttgtatgtactactagagcaaatctgtgaccggccgtagtcaccggaccaccgccgagatgatattccttcaccgtcgtcccagggcaagtcgtctgacctcattcttacttactgatcgatgacacggaaacatctgtatctcaggctgatgatatcccatccgcggcatgcatgtgtgcgtggtccgccgccccccgcgcgcgcgctggtcgccgccgagcagttgccgtgcgcctgccccgaagccggatttggcgacgacgacgaagcagctagacgcctgtcgcgtctagctaggatccagggtgacgcatcctgcgccatgcgcgcgcagtcggtgcgtgcatgatgatggaattagtggaagagaaccaagaacccaagatgtacgcgcgatcgactggaaattgttggaaagagacaaagattgaatttgttcggtgagctgctgaggggcgtcgcgtcgtctcgtcgctgttccagtgttaacgaccaaatcggcaggcattgggcaacgactgtttcgtgcctttcgccaaaagaaaggaacgcatcgagatagaacgtaggcgaaaacaaaaggggcggtcatacagacctgttacaccatacatgatacgtgtacgtacaaccaagtgtgagtgtatatatacagtatatgtacgtttccttctgaacacgtagtcgcagcaccgatctgttttttttttatttcagcatctttttatcgaaatctttcgtttacacctctagcggtacacggatcggcgctataggttacgacacaaatgtattatgtcgtaagtggcatgaatatcaccgtagctctgatacggcagtatctctgtcaagatctatgacaccaagatccaatttaaacggtatttgccagttctatggtcgatgctaacctcatttgtttctcatctatttctctctccccaatccttccaaccttctctaatttgttgatttaaacttggaagcttgaatttgacttgtagatctttgagagcaaggcaccttccattccctcaattacacacattcatttgatctaagttagatgtattttgcaatcctagttttcttggtagtgtggtagcgggaaacctacggtcgatcgtctcggtagccagcacacaagaagccgagaggtttgtaattgttgtg

SEQ ID NO: 2648 - DNA, 1425 bp, Zea mays
  misc_feature (1)..(100): optimal_loci_342211_G1, chr10:105903497..105904921, Cluster 15
ttatttgaccggtaaaattggatctgaatttatttttcatgtaaatatgaaattgctacgcccacgaagcggccaggtgtcctggtcgattgccacgcccgtggccgtgtcgacagccgccatgttcaggttcgtccacgaagcggccatgtcgccgcgagccgccaccgtcctgccgctgccgctgccgctgcgtccgctgtccgtccttggattcgcgctgcatgcacatcccatggaaggcgcatgcacgcggtattacctggccactggagctaattaaacgccttgcactatcttcactgcagcaccaaggcagcaggttggataaaggcgtgctatagtcctctcctacacgcacgcgtgcgcgcatgtgcagcagaggcgagacggatcagcggcacaggcaggagcccggggaatgaggcgcaggccgaccaactagctggcgccgacgtgcgcgctcggtgctcgcgcgtcggggcgctcgagcgcggcgactgtgggcagtgagcacagtgggcagcaggcgcgcgtgcatgtgacccgcgccgcgccacggccggccagatcgtgcgcacgcgcactggttcaccacgtgatcgagccggccggcgacgctccggcctccgatccccgcagcgggccgggggtggcatgccgtgccaccatgtgccccatgcgtggagctgcgccgtggcgtgggcgtgggcgtggctcgccgtcaccgttgccgatgtccgcggcgtgggcgcgcacatggcgccacgcgcgtgcgagcctgcagccagcagcgagggcgtgcgacccggtcaagcatagctgcgcggcacgaggaaaggccgagaagaagcaggaagcatccttgctgcttccgttgtgcacgcgtccttacgtcagtgatacagcatgtgctcatgctcatcagttaaccgtgacactgcttgcttaatgaccagtttagctagtggtgcacagcatgaattccgatgcaggcattacgattctagtactggtattattgccattcaatgttgcatgcatgtacctatctctgtcgggtgtcggcagtgtcgaccatttcaccgtcgatgtatctccaatgttaactcggtcgcttgctcgatgtggaatacttcgccatctgctgcataatacgaaaatatcgtaagaacgcttgattcgaataaaacgagtatgagaggagaacgaagaggtggtagagaaatttgaagtgaggattatatatataaatgagctcaagcacttctctttttatagatcaggttgttggttttttctatttttttctaaaaataaattaaaaaaatagaacaaaccaatcaaattacgtcgtgtgtggcaatagacggctgctaccgaatgtgggggcaacgagccgatcgtggtccaaacaatgtcaat

SEQ ID NO: 2649 - DNA, 1629 bp, Zea mays
  misc_feature (1)..(100): optimal_loci_344663_G1, chr10:119143167..119144795, Cluster 15
acccacatggagatgcctacgagggagccaatatgcaagaacaactagtgggggagctactagagacggaagcaacatgggagcccatccatgggaagatcatccaactcatttgtgctaggatgacattaaccattgtgcttgcacacttcatggtgtgatagattgccttgtcatggatctactccagcactaaggacctattgtgcgtccatcagtgtccccactaaaatctcagttcctaggttgtgggcggggtcatgaaggctcacattgaatattttgatgatagtatgttgtcgacattggtgggatgttcacatcattaaaggatggggcaaggctctaacacatggtgaggcatatgtcgagctgtaccatcactaggatgagggagccaatggggaacatgttattccctgtcagtcgaatgaccccctaggactaaccttggggccatcataggggatgggaggcctctactagtgagggagctaacgaggaaggaaagaagacaacttatgtgaaggatgtgaacccctaaaccaccaaagcttccatagcctccagtgtcaacaaaggtggagtgcagtgaaagagtaggccaagcaaaagcggcgatagttccacccccaaactagggatggcaatagggcgagtgggggtggggaccgtcgttccctgaaactcattccccatccctgccccatttagcttaatggggacaaactcatccccatccctatccccgctgatccccgttccccatttagggacccatgggaaatactatagcacgtaaaaacattcattacatgatatctattacatatatatcaattatcaaaagacatcaacaataatatctaaaacaactaacaactttataaagattcataactcacaaatcacaattatttcaacctaacaatagcctcacactcacaaatcacagaatacataaatacacattatgatttcttatcgagtctccaatggagccatgtggggtagtttattccctgtatccatcccattaatttttgttgccctgtcccattagccccacgggggggagaaaccaccctcatacttattttgaacaggtcggatccctgcggggtcccgcccccatactaaattttaccatccctacctcaaacacaaaagactatgcatgggtgcaaattaggtgttgttcatgggggcatggcatcataatgatgacatgcctaggtaggcatctatatgtggatgtttttgttcttctagcacttttgatatttctctttcaagtcgatggtgggaggcatctccatagggccctatacttggggggctacaactaggaccatgattggtggccctaaattagctcctacaagctatgactagtagaccacaacaaccacaatcagaggtggtgagcccctagttatgaacatctctagtgatgcacccagcgcaaaggaaggcttaggcttggggaccacttgcactgaggtgcaccctgagggtatgttagtggaggtcctagatgctagcatcgagggaaccttatgaagactgaaaatccctaggatggggatcttcccttattagacgtgtcggtgcccacgagagatgagg

SEQ ID NO: 2650 - DNA, 1665 bp, Zea mays
  misc_feature (1)..(100): optimal_loci_347658_G1, chr10:136131942..136133606, Cluster 15
gaactttctctgacagtgataaacactaggaaacatccggcgggacagatgttgagtgggctcgccgtaggttgggctccctgaacacgggcgctactctttgcctgcctgcctgcctaatgttgcatcgccgtccattgctgtaatccatggaccatcgtcgttagctagtagtactacgcctacatctacatgacaggatgatggttgctatagtgcatagaaatcattgtccgggacttcttttgaatcagaatctcttgccaaatcttggtgatggcccgacacggttacacggaggtctctatccgcaggccggagagactggtttcactgggactggattaattcaccggccatgactgaaccttttgatctcaccccagaaaagaaaaggtgaagtgtcggacgatttaacagcacaacgcaacagagagagagagggcagacgtgaaatgtcgaagtttgaatcgtgcgaagacaacaatgggagtacagtatacacagaaaattgaatgaaactgtaccagttgccctgggtcatccaggccttgtcacagacaacccccgtagcagtacagcaatgggcaggttgccacatgccaaccatgcatctgcgccgttcgcctagcatgctcctgcagtcctccgtccattattgccaacttcaggtctagtccttagtcctggcgctggaaatggtggttccatggcatttaggtttggagagttcaggcaacgcaaccactagatccaaaaatgcacacccagcaccagaatggacaaggccgaccactactcgaccagtttggtatctgttcgactgttcctcccactggatccggagcgcgcgagcatataaatcatcatgaagttgatgagtactctactagtttctctcattcagtgacggtgtcaaatcagtcgccatcgtgccttaagattcgatccccttttttctccgagcgaacgtgaacggcagcaaaatggaatggcgtgctctacttgttggttgttgcaggtactgccgtcgaccgtcgtacgctccaaaatctcccagctgggaccccatctgactgcatcagctgagccaggctagagccatggccccagtgatgcagtgctgtgctgcacaggggcagtagaatacgagcagccaattcactgcttaatgagtgtgcagcgatacagactagactggagctcagaagcttaactgcctcctaatcagcacatgtgcagggcggcaggcaacgtcttgcaaatctgtcctcctttcctttgccccggtctctgtacagagattctgtaaaagcacccaagttgatatcaagacttcatttggctaccctacacattcactaatcacggcctagggcgtaatggccaagttgatttttccacccccgatgcattgactcgcatttttcaaacccaggtcaaaactcatggtgaatcttgggtacctccacgccaccacacagagcgggcaggacgcctgctgaaacgagactgtttcctggtccgtactgccacacaccacagtggcacagtgctccaataattcatcaaacggccatatggacgcgatctgccactgttcactgggggacgagcaacagcaaagccgtgtcagctttactggcccgttcgtttctacataaa

SEQ ID NO: 2651 - DNA, 2868 bp, Zea mays
  misc_feature (1)..(100): optimal_loci_348267_G1, chr10:139309547..139312414, Cluster 15
catcgcgtcgtcgttggtattggcgtattggcgattgtgcttgtgccgctgcggtggaatcggctttcgggacccggacccggtccggggtaccttgcgccggccgcgcgtcccatgcatggcacgaagaggcggggcgcgaccgcgcgagcgtgctgctagctgcgacgaacgggagctgaccgtctgcgtatgggcctagtcggtctgttttgtccggttgccggtacaatggttttgctggcagttaattccgcgcttgaactacctagctagctaggagtagtagtagaaagcgaaccagcaaagcgagagcgatcgagacaggtctttttcgacgcgtatcgtgccgtgggggcgccaaatcgtagcgaagagagatcctatcaagtccatggacacgactctgactagctagcacgggccggatgactcgcgcgcgcagacaagaacggtctagtcacgtttgcgctgactcggaaaccgctggcccaattaattgtaccacagagatccattgagtcgtggccagcatggagtggagatttatataacataactataaatataatactacgaaggagattaactatagtaatgaataatgtaattttcacctaacaccactagagaggtgcatatatattatatatagttagatacatatgtatagaactagcacgcaaacaagggtgtgtgtctgtacgtacgtacaggactagtgcacacactgatagacacacgtacgaacaattccatgccctacactacattcgatcggtgcgtgctcgtgccttttgcccccagagagcagtaccagtacggcctctttaccgcacgcgtcctactatcctgcttcacccgtacgtcctttcacgcaaccattgcgttcggtcggctcgtacagcgtacatcttcaactttaaagtcgttgcatctagatcgatcgatttattatttcacgcttgcaaccatgcaaagagcgaccattttgtacgtgtgcggtggtaccactactagtctactaccagcaaaatcgacgataatacatcccttgttaaaagcgtcgtcggcgtgtggagtggaggtctatctcgcccctcgatcgcccagctttatctgcactgcacgtaccaattgttcttgccttgccggccatgcatgcacatgcatcgatctgcatgcatgaatgagccaaaccatgcatgcagccctgacttctcgttttcatgttatgcaacttgacacgtgaccgacgcgcgtcgatcattgctgtgcatcgtaattaccggaggaaatgccatccaaatcttgccgatacggtgaacacagtgacagattcgaccgtctaacggaagcgtcctagtgtcctaccgtgccttcgttcctccccttaatctgttttacgagacgacaacctggctggattctctgcatgcatgcagtgcagtgcaggggttgttacacttcctccgttgacatagagagagtttcatcagccacacagaacagtttagatatatgtcaaccgtatgcatacatacactgtactgtacgtgtagagtggcagcagtgtgtgtctgtgggctaccttggacggcaccttaattattatcttatttgtgtggtgtcatttattttgactaccataccatcagctccattgttattttgatctcacggcacaatgcgacaaaggcaagtagcttcttctatagctactcctactaccttttttctcgaccgtcacatggcgccaccgccatgctgtggtctagtttatctgttggaaccctagctagacagggatcgtccttccatgaacgtgacacccgatttgtgtctttgcttacgttaatgtgccaacaacaacggccaaacaagtctactgatccatcaaggacaaggcatgcgatggcttattatatggtctcactcacaccctcatctttttggtaaataacgccaaaaaagcagcacactgtgcaggggtccgtacctcatacacagtgctgacaaggacatggactttgaaagcttgttgttgcacattaggaacgcaacatagtagcagacacacagatgatgtagaccatttagattagccagcagcagcggcatacaatcatcaggtgttacatcgctctaacctctttttttttggggggcgaatcgtttacatcattctaactgtgcagacgagggctgcagtagtggtcctgatgatccatcttcctttcgagctagctttgcttcggttgtttggttcttgctacttctgtaaacatagtgcttaatcctcttccagcccttatcctcttcgatcttagccataatacacatttgccaatcaatatgttggccaataatggggagcaacgtacacaaacaagtagctagcagaacatggagaatattttcctctttctcacatttgtgcgcgcatgaatttgacaaacaattggcagtccgtacgtgtgagtagtattattttgtgtgctgagattagttcatggaataatcatccacgtgtcgccgtggtcatcattatcgtcattcaacaaattggagtggacgggcatacgatataattttctaactataccaagataattatcagcggcagcaagtatgcatgcatgagaatattgatacagccaataatgccggattcgagcagaaataatattaattaggttacccagagagcttaattttggacgattgttttttaaagtttttttttaaaaatatataaatgattttttaggttgagtgtcatgctccaaattaaaagctagcacatgattattaattgtttctggccatatatacgcacatgcttgtgcggttgtgccccagaatagg

SEQ ID NO: 2652 - DNA, 1417 bp, Zea mays
  misc_feature (1)..(100): optimal_loci_348681_G1, chr10:141529253..141530669, Cluster 15
tagccgggcagaaatgacagaaacataaaagatcggagttatgagaagacacgagctgctggaccggggctgccgaggctgcagcaccggcagcctcggtcctggttccgcccctgatccagacaactaatttttaagggaatggatcgatagaaaaaaaaaactaaaaaggccattcatcgtgcccgcgtctttttcatgtacaaccacccaacaaacagcgcgggaaagcggggccgcaagcacaggcgcggcagtgccgtcggcccaccaaacgcaccgttggcccgaccattccgcatctcctcctaggcggaaggcagcccacggcccatattacccagagtagacgaacgaccggctcggctcgcgtattatccattgcgtcccagggttgaacacgcgcggagacctggggctggctgatgtcgacgacggacgacatttccaaaaggtccgagaagatgatgagcttgcatgctaaaggtagctagccatggacgaatctgtggtctgctgcattccatgctcatttaaccattgtactactagtaaacatactgtaacagctactactaatcatactgcattccatgttcatgccgctttcttcgtagcgttccatgacagatgagcccggtcttaaacatactactgctttcctcggccgcaattgctgtggtggactgtcactactcatacaagtcttgaggcctggcagctcaagttactgcagtgcagtgaaagctgaaaaaggcgagggagggtcggtcaatgcaagcgcagacatgacaggtgaggttagtggcggccatcgcttttgcgctccaccagctcttgcgctttttcctgtgcaatgcaagtagagcgaacagaacactactgacgtctgacggagagacgcagcatgcgcatgcccgcggaccagccacacgcacgcgcttgcaagtcgtcggctcctcgcattcagctgtaggaaaactgcatgcattttcgactagggagaaagatcaaacgcacatgctgggcaatgcactttgacgagcgactcaactgaataaagcatgcatgttggcctctagcatggttgcctgcgtggttgcagcattctccaaagccagtgcatagttggcctctagcatctgctggccaccaatttctattgcgtttcaaaaaaaaagtagagttgtaagtgttaccattatatctatcgatcaaccttctcaggcacacgcaacatttcccgtgcaactctcatgtgtgcggtactgtggttggaaagagacttaagtcacatgttttctgctgaaaattcagtagcgaaaacgaacgcacacatcagccggagaaacttgctacaacgccatatcgaaaccgcccctgcatattcagctttcagttttgacccatcatttgc

SEQ ID NO: 2653 - DNA, 1679 bp, Zea mays
  misc_feature (1)..(100): optimal_loci_349462_G1, chr10:145520710..145522388, Cluster 15
cacatgaaactgtgtgtgcgataaaagtgttgcattatagtagtataaatatagatttatatttatattcgcggaacacaaaaaaaaaaaaactcatttgacgtccctgtcgacttgagaaacaagatagcgctaccactgccgtagacaattgaaacaggcttggtaacgtgaatgaagcgtgaaaggcagcgccgcagctggagtgcctgtcacggcagtcggaggcagtagtagctagctctcactggtagggcgcaccccgccgcctgtgtgaggcagcagccacagcctcagcgagcgaccacacgctccatctcctgccgcgatggcgcgaccggctagttattaacaccactagacgatgcagacacgcagtgcagccgtactggctgtgctagtctgcttctaacacggtggcagatacggaatgagtttccatcatgttagtgttcggttaggagattggaagcgtgcgaatgacatagagagttaccatcgattacggcaagaacttcgcagttggaatggatgaccaataactaacaggttgacccgcaagatctagtttttaatctaagctcgttactaatccggaatcagcggagatcaccttccagcgtcaacaggctgctgctcctgactgatctcgctcgctcggtgatctgatctgacccggttgctgaatctggaattctggatgcacttggaggagcaaacggatcggcactagaagatttttcttcttcacagtactatacagaaagctatacgcctatatatatactagctacggcatgcatgtggcgtccaaatgatcgatatgatatgtattattgtcgtgagagaccgatgtgccgtagatccgggcgtgaccggtggatcggatcgaaaccatgctgctgtagcggaggtcaaagccagccgcgcgcacgcaacgcagcgctgctcgagctcgatcggccggccacgctcctggtcctggcatcctgtccatgtccagtccagcaatagctgctgagcatagctattacggtagcgtacaagcatagcctggcctgcagtgagcagtgtgaagttgaactgtgtcaatcgtgaacacgtgtgagcttgaaagatgcccctatcagtgaaagtctatctcatcgtttgcattactgtaacagctttttttttttcctgtcgctttctcctgtcatttctcatttgggctctaccttcccgaccaggctttttaattagcctttcagggctgattcgatgataagaaattcatcaatgagatccatgggagagaaattaccatgatatgctatttaaaattgaatataaaaggatttcttttttatggatcatctctatttttctgatcaccaaatcagttctgaataggaagggaattccttccttatagatcctctccaaatcacttgccaccaaattagccctcaacgttcgtgaactctgaacctgatgcgctccggttagccagtcacatttccgggctatttcgtctctgtctctctgcccctccctccctatcgtgtccttcctgttttggtgacgtgactcatgtgaatgtgatcgctgcacatttacaagagatcatcacgactcatgaaaaatagaaaaggatctggctcattctcgttaatatgtcctacacctcgatcaccagt

SEQ ID NO: 2654 - DNA, 1599 bp, Zea mays
  misc_feature (1)..(100): optimal_loci_3606_G1, chr1:18642407..18644005, Cluster 15
aattgctctgcactgaatcatctctgattaaagtcaattacgaccttgctgaaagatggtgatacaatacaattaaggcaccgctagctatagcccagactgcccactttgctgcaccctggctggcctggcctctcgcggtgttgcaaaataaaaatgtaaaagaaatcattgatgtcaaatctcgatttttttattcaatggtttttctgctctccacgttcgtagctgattgacttgtgcagcaaaacctacaccgactctgcagaacacttttttttaagaaaaaaaaggcactgcacggtgccatgtgactccatatcagcctctgtacatgcatgaaagcatataattttctcgagtatttgcgacgataaactattttattccgtggtgggggggaataaatctgtcccatgttaatttctactaatatatagtgctgaccatacgctgtactttctacgatttgtttacaagctggaatcaaaaccaacagtctagagatccctaacgctaagcattcacatgtagcatggcactaatcccatgcattattgtataagtgtatctaaactatcaacctaaaaccagccaattgtgcatatgattaagtgtgtatggcttaaaagaactgttttttttttggcgcggaaaagcgattattttcttcttctcatattctagctttattactgtatcctcatgttatgtagggaaaggccacccttttccccagttttcctgcagccgtggctgtatccccgtctcgaaaggaaagtgcgttgcctttttgcagcctacgtgctctcagtctcagcctggttgcttcaattgaagtccaatgcaagcaaacgaagatggtggcgaatataatagtaaactagtaatgggcattcagagcagagggatcgatcaggctaaagcgacagtactactaaccgtttggtgcgtgcgaagcgttggtggccagtgaccaatctgcgccaaacttttgctgtcagctgtgcctcttctgctgcatcatgtccattgtccaaaggtggttctgatctttagttggtggtaggccgcacgcacgggctctgcatctgagctgcgcaaggccgacgccacggccgtgtgtcgggtcgggccggtcggaagcgcgtggccgtgggcaaaagacgtgcaggagaggacaggagctgcggccggccaccggcgtggatcagaggcgaggctgcaatgcatacggcatacctgctcctccctcctcctccccagcggccccgcctggttggttccttcccgcacgggcgcacgcctgcagcctgcaagcatgactggacgaggtcggaggtcctccagtcttctgtcgcgcgcacggctcgagagggcggtggcaccggctttctgggccctgatgtgtaagtgggtagcctgtgccctttgatacatacaaaaactggacgccgctggatcgcttgcggatgcgagctgggccgtttgcctagctgcaaggccgggcacgagaggccctggcctggctgggtgctcgggtaaaggaaggaagaaggcctgactatgtggtctacatgtttgaaagactgaaactct

SEQ ID NO: 2655 - DNA, 1433 bp, Zea mays
  misc_feature (1)..(100): optimal_loci_43377_G1, chr1:255330358..255331790, Cluster 15
gtgtgtacacaataatcaggtacccatcaaacggccagcgggccaggtctaacatgagcaattgcctttactgatataaatcatgcctcataaagaaaagaccacacgtggataaaatggccgatggtgtcttttgttgggaaaaaaatacctatcacgaaaagcaaagaaaaaaaattacactagtttttgcatagcaccggggaaatagaattgaggtgcgcgtaatctttgcatgtgatgggagcgcgagctagctgaaaccagctagctctaagcgacgccgaagagacgggggcgcagttgagtttcgaggacggtgcggcatgccacgccacaccacctacaacctgcaattccattcagtcaaccaacttttgcactgccaagtgccaaccatcgacgacagctagcgccagatcgatcggaggtctactctagagacacagttgcatgtttgcaagtgctttctgctctgcatgcatcgccaccagcgtttcagcaaaactggtagcatcagtcaccgtcatcggccacccgctgcactgcacactatcgtctccaacatatgctaatataagaggtcaggtaaaatagaggagcacttgatcggcagctaaatctagagaatccttattcatccggtatctgtctttcttgtcgctgtggatgcagccgtgcgacacacgtactgcggcgtcatggccatggggccgagctcggacgacgtgtggcgacgatggggaccacgaccacatcatccccctcaccgccgcgcattcctacgcgagtggtgcatcggtcggcgctccgctaccccgtatcgtggcggccatctagcgaggctgcttgcaccagctcacgcgccggggaggagagaggaccgacattggagaggacgagagacgaccgacgtcgagacggacgaggagagagtatctacgacggggaggagaagcacctcactgcgcttcgtgatattctctcgagagcgcgtggcagacgctaatggaggaggatctccatggattcgtcgagacgaaccagggaagaacaaggcgtttgggcctttgagggatgggttgggaaaaaatggtatgtgcatactgtgaaaatacgatgaccactgcagttctaaaatatattaattaatctgaatgcaaaaaccattttgcaatctatatttcagttaaatttttgtcgaaaaggtatggggtcaaaatttctgttgatatcgctggttaaactatggacgatatgatatagagaatgaaatttagaggacatcatagataatgaaatcttttaaagtgtgttataaatgacataatattattttaaaggataaaattcagagaatgttaaggagaagttgatctgatgctacgcacatccagattgtgtagaaattaacaacagaaaatttgccatta

SEQ ID NO: 2656 - DNA, 2211 bp, Zea mays
  misc_feature (1)..(100): optimal_loci_43690_G1, chr1:257179673..257181883, Cluster 15
cacctccaattgggcccgccccatggagctcgcctttgaggagacctgatcaccatcctgtggtcttgactagtcttgcgtacatgggttccatggtgtcaaagcagccagcttggatgtcacgtacgcaaaaccgggtaccaaaaccactataaggttgtttgtgttgtttaataaagcgtaatgtctacaatatatttggtcttatatatatatccctatatagtctattggattatataaacttttttcctcttgtaaaaggatatcttgcaggccaccgaaataacgatggaggtgttccacaacaaacgagtcgtgggagacaggctgtgaaagcggatgagaggtgcattgaggtctagaggaacatttattggtagaaggatgacaaaatattgaaacctgttgagagtcagagagaaatagagagagagagagagagagagctcacctagtagttccagaggatggcccagttccatacaaggttcgcaatcacgtttcatctcatgtttaccgctccttcacgagatcaggaaaaatagccaaagccgaccgaaaaccgctcttcctggacggtttaggcattcatatttgaaaatcaagttttcgttagaaaaccgctgagaaactagctataccgagcagttttcggtggattaacatcgagaaacccaatttatttttttgacacgaaatcatatttttttaatacaaaatatattttaaactcttgggaaacctctagtttttatacattcttgacgtttttatgctttttcgaaattctaaaatttcaagtgaaaaattcaaaattattcgacggggaacccgattccacaatgcaccgagaaaaagtggtggttaccaccgaatctagagcgagattttcgaccttggtaccatacgtaacatggatgtgtatgccattttttgtcaactcaattggcaacgtgaaatccgcatgggtgagagggttgtgctcacttttacccaggattcttgactccacattgacaaacgaatcatgcatttttgtctgatctgttttcagaacatgttaatgctaacatcctatacacggaatatattattgtcgtcctccacgactgatgttgtagtgttgtacttgtacgatgtgtacctaacctaaggagaaggaagcccaggtcgctacctcttttttttccaggtcttcccgacacgtgtcctcgtgcaacacctgtgccaactggggtggttatgttttagttgtttattagtatgttgtttattattgctggtagatcagtttttttgatacaggagagaacagatcagatggtacatatggtttggggctctgggctttcttcacgagaccgagtgaatcgtgcatgcatgatgcatgacgaccttttcgtggtcctctctcgcctcgcagcaaagtgacctcgggcctcgttgagcccaagaaacctccggcttggcccaccagttcagtgatgcggacccgggccagattgcatcagaaacaatctaaacgataccgcatgatgatgacgtcacgatcccgttccctcgcgctgccaggtgtaacggctgcctctatataggaggaggaagactggaagaggacaggcagtaggtcccacgacccttccagggaagagagtgttcgtgacgcgggcggcccccaaatccgcataacaatctctgttgcccccccgccaaaatcctcagatccccttgctgcagtgcagatctctctataatccgcgctcgtggcgacctctcctccagcttccgttcctgaaatccatctctagtttcgccatttgggttttttctcgagggtttcgctcctcactcatctgatttaacgaagggagctgggtcacacccacaggccgcggcttctgaaattcgatggccgtggctgcagcgcgcctgacgctcccagatcgattcgacgaggtttacatagcctctgcccggtgaaaagatgggctcgtgggttatacgcgcctcgcacatgcacgagctgaatttcttctcgccttttcgatcatgacgtctttcgtttttttgacgtatatgattttccctggtgctagcgccgagcgcaactgtggttgagatccaatgctcctcgttactccgtccacctttacctatggaccagtttgcatgtagttgcagtctttttctaatgtcgataatctgatg

SEQ ID NO: 2657 - DNA, 1762 bp, Zea mays
  misc_feature (1)..(100): optimal_loci_4472_G1, chr1:23234042..23235803, Cluster 15
gaacattatccatgttctattcggggctacacattaatgtctatggcggcctaggttcgtctcagctgcgccatgctccggcatgctttctaattaacgaccgtgcaatattgaccacggaagcgtgacgaacaactccttgtggtaccaaaaaatggtgtgcggatggggggtgcacgggaagagcagttgcacgtacgtgcgtgtggacgcagcactgatccggggactcgttggcggccatgcatgcttgaaaggaaaggaccggtgaggccgactcttttatctgtaacactttgtactgtaatctgtactgttcgtagagtgaggtttaaatataggtataaatatgtgcgtgaatataggtataagtaagtgctctgagaagtttctccctcgaacagtagctgtgtgatgcaagaaaaacagtacacgtctctctctctggcagggccgtgttgcaaaagacacgacggtacgtgagcgagccctcaaatgatgagccgtatactagctagtaggtagcctaagctaggtgcacaggaggaggcatacatgttatgctcttgtacctaacaatctagacgcttttgaggaccgcgaagctgctgctctatatatctaaagtcgctcagcaggtcgttgaagctgactgactgacccggcgggaccgaggctcctgccgcagttagccggccggtccctcgctcctctcgatcggtcggtcctccatgtactggcgccctcttcagctcgaccactaccagagagtggttgtgttgtgtagcccgcccgcataaatatagtatttgaccacatccacatgcacgcacagatgcactcacgcatggataaggaacagtgcacgtacgacgacgaccggcgatacgtgctcggtctcaactctcaactgcttctgcatgatgagatgcaggggcccggcgggggggcaccacggatacaggagcagtactagtgcctagctatgctagctagtgactactgactactcgatcctagtgttggtagtgcacgacgtacgtacgagacttgctggtgagtttcttcttccaacaggagaacacatatgacatatcctgagcgccaaaccatgtacggttgccgatttggcagcacatgcgcttttgatacaatacacacacacatctagtatatatagtctacgacatggaagcgcacgcaaacgttgccaggtttccaaaaggcgtgggcgtggccggccgtcatccgatcccatcgtcggtcgatccgtcggctcgcccgcccgccatcgatcgcgtactcgcgggaaagcagcactgttcagacgatatctctctctagtaagcgagccgtgcgtgcacccaactcaatgagagcgaaagggacagaccagctgcttcgtcgtcgacgacgacgacgccgagagagacagaagacaccacaagaaacctcctctcgtcgtccacaccccacatgatccatccatctaaacttgcattgagttgggtccgacgatccgtccggccgagagaacacgtcgcggtcaaatatttacacgcgacagatctacacacagaccagaaaacgcttcgcccttcacgtgctcgatcgttcgcccgcccggtcgagctgatatataattccacatgtacttatttaattattcccgtgtacttttccttgcgcgcgcgacgtaagcttatagtatatagtagcgtgtgttatataaataatcagcttggaaatggaaaacttatag

SEQ ID NO: 2658 - DNA, 4012 bp, Zea mays
  misc_feature (1)..(100): optimal_loci_46676_G1, chr1:273228748..273232759, Cluster 15
cgtatatagtagtgtgtgtatactaaatgttaatcatcacctgaactaaaaggtccaatcaaaccagcccaccagggtactaattatattatccacatcaggcaaacaaaaagcaccagtcgcgtgtgattaacaggaccgatctacatgtcgttcgcaacaccaaatattcagccattcaagttcttagctcagccgttcaaggtttagttctttatcatacaacaacaacaaatatacaaccattcaagattctttagccattcaaggtatacttacattcaaggtttacttcaatgtatatcataaacaaatattcagtcattcgagaattactattcaatgttaactttagtcattctagatcgaggacgggaggcggttgttgttggtgggggcaggggtcggtatatatgccgaggggttaatcatcgggggtggtgggaggcactgacgtgggtgggaaacgacagagagggattaatgggggtgtggctaagaaaggagaattcgagacatcatggacggggtgagagtatccgttggggatgtatcggttgctaactctaaatcaaagtgacttacaaattaaaacgaagagtattacactctccctataaaaaaaattgccattctagctttttactaagtcaatgaactatatcaactacataaagtgtacgtgtgttacactaaataattataagtaaagtacttaacaagaaatatatttctcgtgacatatctatttggaatcataggtgttcaaagcattttctacaaactaagttaagtttaagcgaagtttgatttgaatccaaacccaacccaaaagcagtgacttatattatattcagttgacggccgatcgaccgggcggcgggccggggcgcgcgtgagtgactagtagctaggtccacctccacgcagaatctaggccacagaatggttccacacaccgatccccactgtttttgttcccacccccatgcaagcagcaagatattattctccacccgacgactgagccgttagccgtagagtaccgccaagctggtatgcaagcctttcgtgtgtagttctattcatcggcgtaatcgatggataggtgactactgtgtctctctatgccattcccatgcgaaatatatgaatataggcatgcaagagcatgttacgtggaaatcaactaaactgattggtctaaaccatacagatcaacaccgagatatatggaagggtcttttttttaaaaaaaaaatatctagaataataggtgaaattgttattttgaaatacgatatattgttttaaaaaaacatttccatgttcattcatgtattgatgtgtattaataaattagtttacacgtgatataactctaggactactctagacgtcgtctgacgtctgtgagaaaataaaacatttccagtagtatatatatacagtatctatgacgtggacgcccacactgatgtcgtttacattgctgccgaacttttaacggcgacgacgacatctgacgtctgtgagaaaataaacacagtgcaatcgagtgagtagcagaaggcaggtggccaggtcctgattcctgaacgggtgccgcagctcgcaggcacaatcatgaatccataatgacacaggggaggggtcatcatatcatgcggggaaagaatattattacactgctgctgctgccgccgctatactctactatactaggtttttttgaaaaagggagtacaagtagctagtatgaccttagccagcccatcatgcgaggctgggagagggaactgtagcgtgtaaagcagagctgtgagtagtcaattcaattccatgggcgatggatggatcgagtatatatgcatggtattggtagggcagcggccggagcgtataggagggaggcatgcatgccgccaccgcaagaggggtgtgtgtgtgtgtggtgggggagggccggcgggcgggacgacgctggcagtgtgggcaacagtgtgtgcggcgctgatcgatacgacgaacaacctgtgcacatctggagctggtggcctggacctggagcaggcagacgacaggcggtaccagatcccatgccatgcatcccgcccggcccaatcactgtggtgattatttgcaactggcggccatgcatggcacctgcatgcccaacatctttctccagttagtcactttctccgcgcgcccttagagtcagtggcgagtccttttaaggcactatactatactacacgacccacgccacgctgctagtactagtagggcttgttgctgaatggtacgacgccgcggccggccctcctggccatcatgcatatatttcctcttctgggttctctctctaactgcgcatggcacgataatatctactatcctaacctactagtaataatattacacgtacaggagaaaacaattaaggctctctctctctctctgtgtgttatctccctgtcagctggctgtccctttccctctctcctgcgccacaggggaaaaacggagaatactaaagataagaaagcgacgtgtgtagagagcgagcgagaaaggggggaagaagatgggcgttgggagatgcccacaacaacgacacccacactctcgcgcaagccccaaccaagcggaggaggctaggagggggaagaatcgccggtgcaacaacttgccgcccgtggtaggccatgcccggcaggcccataaccacactgcagctggtcataataaatcaataaagccgacagcatttcgctagctgccgttggcatccgccgctacccgcgcccacgtacgtggcccgctctgccgccatatatatacctagtgttgcgtgttaatttgtgttcactgcgtttgaataatttcatcaggagaactctagctagcttgctagtgtgtatcatgttgattattcgatcgtgtatatatatcctagtgtcgtgtattaagctgtgtcagcaccagcatgcggcaggccagtggtatgtaagagagaatcgagaagctagctagatggagttattatataaggaggagaagtggatggaagcagaagcagaagcacaaccacaagctccgctgggcgtggccggccagaggggcttgtcacaggagatcttctggttgttggtgtgattctggttggttcatttaccgggggggaccaggggcgggcgggcgggcgcgtagctagcttggagttgagggcatctggtcccaaagagatgacggacaactgctttgagctgtgcttgcagctaaaacccaccacaatactcttcctccaccattgcacggggaccgcgcgcgccccgcccggcccggcccgtcccctacgtacaccatcacgcgtacagcagccgccgaccgaccgggtccactcacgagtacatacatatatacacacgcaccgcacgcacggtatatatacgcttattgctcgtcgtatatataattatatatgcatgtcttaccggtgtcttatcagcgtgaatacacatacgtatgtaaaataacgctggctctgtaggaacgacctacgtgcgtacgtggcatgtgacaagcccagctggtgttccatatgttagtttctcatcgccggccgatcagccgctgtgtgggctcttgggtatagtgggcctggattgtagtagtagcatgggggccctagcctggcggcttttgtgcagtgcagcggccagcagcatccatcatagagatcccacgcaggcccatccatctgctagtagctctgtgcccccccatggccatgagtgagagataacaagctaagctatcacgattattcacacctcggccactgctactgtgcacgcgagcgacacgttagtatccggtggtgtggtaaagaaattaaatagtaggagcggcacaccatctgctgagaataagtaggccggattcaaagcccgcatatataatggtgcatgcgtggatcgggtggccgttaaggggttaaatcatt

SEQ ID NO: 2659 - DNA, 2428 bp, Zea mays
  misc_feature (1)..(100): optimal_loci_46677_G1, chr1:273232793..273235220, Cluster 15
gaaacgagcctctggtaacggcggtaggtgaattcgttctctcagtatatagtcacacgcagaggaggtgagagctcgtcgctcttcacagttggagtactgtgtactagcaagcagagaatctgcccgccccgcctgccgccgctacgtacgtagtatagagtgacaaaacggatgcagcagtgggcgcatacgtacaggtacatacagttgccttgcctgacagacagtggcagcagcagcagcagggggctactgggttacgttctcgtggtctagtaggtatccctgctgtgcctgtgctgtccttcagttccggccgcgtacgagtagatggatcacatgcgcgccacgacagaagccccgctgcatcgcatgccgattgccgatggatgaatcacgaaccgatgatgatccctgacccagccaggacggccgccaagcgcccaagatgctcacagctaggctaggccactgccaatgcgcccacggcaccgggcgtcggcttccgccccggccgccgcgcgcgctgccgccgtctgtctgaggagaggtctgagtctgactgactccctgcgagttttttgaaataaaggcgcgcagcgcaggtcccaggaacacaggaggcatgcagcagcaggcagccaggctagccagccgccagtctcggccgggccccgcgccgcgctgcgcagccgccgagtgatccaaggcgcctgcctctgctgcccttctgcctgccactgacgcgcgctgcgcctgtacatgcacgtcgtcgtcgatctcggctggggcctatctagctccgatcctgcgatccattcatcagccaccgcgggccacgtacctactgctgctgtacgtactgcatatgctagctggggcatgcacgcgaagggaatgcgcccttcccgagggtgcagagtgcagacacgacgagctgtcgacgacggacggacgccagcagtggcctatctctgccgcgcgcggcgacgacgacgactgaccgcgggccgccccgtcccgcagcccgtcgtcgcggcgcgggtagagagcttttgttcggatgtgctgtcccattcgatcaggctgcgcggcctgcgtcctgctgctgcgtgttcagttgctctgatctttcacgtacgtacgtacgcactgctggagacttgtgcttgtgcagagatcgatggtgatgttgatttgctacgggaaggggatatgacagggggagacgaaacgggatggagatcggtcgttcaagggccggagtggcccggccggtcgaacggtcactgtcgtgcgctagctgctcatgcgtggtcgagggagtaaccgcatatgtatggcttgtgaggaacgcgtgctgcttgctgatcatgtacattgctttccccattgatcacctcatcggcgtgttaatcactccaagtaaaaacacggtataattgtcagaataattgtcttgggcgcatgcatgtcaacgtcttcaggaaactagaatggaccagcacggttagcttcttgggcaatcctctcctggcatctggggatccaaggctgctggcttggataagtacttttacagttttacctatggatagatcaacctatggaaaaaactgaaacaactaacattttagaataggaagcagaaatctaattatactccatctatttgtacgcatcgtattaattaggcttgtcctaagttaaacatttctatctttaactattaatttcaaataatatgtatgtgttaacaacataaaattaacgaatctatgagaaacacttccataatggataatttgaaatcgatatcaaagttaagagcggttgacttagaacaaacatactacgctatgtaaaaaaagtgggagtatcaattttgtgtcataaaaatatgcatttatagactaattgtaggtcatagtttgcccaaataaatattctatatctatatgtacacctaataaggagtcaatttttttgttctaattttctcacccacgcctcaaactactacgacggtggagagtttttttttctgtctcactttttgtatttgatcgggactcataacgcatataagtctgaacaactaatgatggagatactaataattaagagaaaatagtcttgttcaaatcagggaggttgaagtgcggtctttcaccttcggccaattcaatctgtgggcctcatggcattccaaacggcccaataccaagacttgaacctgatcacgaaacctaggtggcccattgtgatttgactgggatggattgtgtgcacgaacgaccgtgcggcggcattgcaacttgcaagctaagcccctgggcctgtgcagggcagctgggctaagccgagcgagttgtgacagcaccgtcacgtgaaatggagcccgggcgttcgtcacggtcgcagc

SEQ ID NO: 2660 - DNA, 1731 bp, Zea mays
  misc_feature (1)..(100): optimal_loci_46695_G1, chr1:273292548..273294278, Cluster 15
gccggccaacgcgagtccagactgagaaaatcgccgcgggaggcatgcagcgcgatcccgcagaaaaaactggcggttccggtgcgcgctccggtcaggcggcaggcaggtggaacgcgtggacacagaggccggcagggcggctagacggacggagtcatcaatcactacctgatcgagcaaagacgcatcgcggcgcgcgccgaggcaggtcattggctggtcgatctggcagatgatgcccaccccctctcctccgcctctttctccttgcgtcttgccttgtcctgctgtgcctgcgatttgtgtctgcattattttgcccccgtcgtgcgctgtgcctggtttcttgatgaggcggcttcggcgagacgccgacgtctcaaccattcctcttaatctttgcgattattattttctttctcggcttacgtacctgcgtccattcgtattgtatcgtcgttgccgcgcgcgcgcctattaattcagctgctgcttgcctcgcccgcccgcccgcccgcccgctcgctccattgccagccaagttaattacgtgatgagctgggagctcgggtgtctagtcgtccatggcgccgatcggtgcagaaggcttgcgagattgagaggtggtggcgttgaactggttggctgagagagtgcgatgttggcacggttcaatcaaatcgccggccgggttgacttgttgattgagccgtgccaatatcacaaccttctctagcctaggcggccgggctacagttttggatgctactatgcttcctcaaggtatacatggttttctgtgttgttcttgtcttcctgctataaaaaaagcctttgaaatttacttacgctttagtttttcatcgcgtgatgtatttcctttgtttgaaattataacttttttttgggtacatgtgtgtccagatatgcgttagattatatctagatacatatagcaaaatagatacaccaaaaatgtaaaacgaatttataatgtttagattggatagagcactatatattctttatttctagatatatattgtaaaatagatataaaaaataattcaactgttctctatttcttggaaacaaatacagtaccagcgggctaccaggccgcatacccatccacatccacatccaggcatccagcatccagtcgtcgtatagtggcccgcaggccgcagccaagcctgcggcggctcaggtttggtcaagtggccgctaggaggaagccaagggtagtctagctagcgttggtcaaaacttgttttcattgttctactattgttgagcattccgaattcgcttgtcaaaagactacaagagaatagctgatatattaattattatcatggctaatataatcgtctatgttgctctagccctgcatagttgtaggaaatcaaggtgcttctatccctggccggacatataataatagtatagtagcatactatatatatcgagatagacaaggacaacatatatcgaggtaggcaaggacagcatgagagcatgtttcacatgtgctattttataatgttactgtattaatatcatttatgtatgtgcgggcactggcaatagtttaagtatatcacttttaactatatcaagctttcgtattagttggcatctttaatctatactaacgtgaatgttttaatacaaccggtactaaatgcattagtacttcaataggtactacaaccttcgcgttat

SEQ ID NO: 2661 - DNA, 1675 bp, Zea mays
  misc_feature (1)..(100): optimal_loci_5303_G1, chr1:27139838..27141512, Cluster 15
acgccaaccgccttgtccggccctcgatcacgtccgtccgtcgtcgactgtgtggctacacctacaggctacagccgggggcaccgggacccttgggccgtgtggtgtggctacagtgctagtacatgcgtacagctcatctgactgagcgctgaggggagacgtggacgacggacaagaagcgcgcgcgcgcgcgggcaaagattagtggcatgattggtttcgtcgtcgtcgcactcgctcgtccacgcagcgagccggcggcccgccgtaatcatgctgttgggctagtggagtggcacagatcgtcgtgtctgatgaagtgatgggactcggagtgacttgtgtcaccactactagtgactgagaacccaataacgaaaaagaacaccacacgtacgttcgtacgccaaaagtccgcatctatgtcttgttgtgtacgtgctgtgcctgtgcgcgtcactggtggactatagtagtgtttgaattcggatgagcctgcatgaaaaaggtgcaagtaaacaggtgtcgatccaacggccagggcgaccaaccatgcattatgcatgtttggtgccggtcgtcggcgctcatcgcttgcaccgtggactttcacgcacgtacgtacgacgagcacttgtaggtaggtacctgcagacagcacatgctgtttttttttgtttcaaaattttgaatctgacctactactacgtactagcggctagtcccagcagagatactactgcggtgcttgctcctcctgcacatggtgaggttggccgcgcttggcggctctcaactctcatcatagtgaactcgaccctgccggcggttgaggaccaatggacgcctctgcatgcatgcatgggagcgcgctatagccggggcgagaaggaacaacgaacaagacaagcaagggccagaggtgttccacgcgcgctagctactactacgtgtacgcacacttgggcgtcgtgcagctggtcgtgtcgtcatgactttgggctttgtggaggggagctgcactactgcaggttcccacgcccacccacacgcatatggggccgagagagggcgagatgccgccatttttggcaatcgtaaaaaagagcagagcccaggcataattgtcaatgatgcccgaatccttgcatgccccggcccgcatgtatgttggagttggagcacgtacgtccacgcagcgattcaaacacggttgaccccgcgttagaatccacaagtatataaatactcgaacttttgggacgactttgtctagtgcttacattacactgcgcatctttgatgcttgatgacagcggttaagcagatatattatacggttacagtacgcagcagcaggcaggctagctacttagctttgcattatgacaagctaagtcgagaacttggctacaccctattagtcgacgctcccatggaatagtaggcagggctgctggtgaggggaggtacgtagtagggggtgcggacatgtgggcccccacgcccgacattccgcggtggtccgccccggtaaattatactaatgctgtgcggtgccccagtggtcctcgtgaaaaaagatagagagagcaagggcgctagctgcaactgcactactgcagcctgcatgcgatgcaggaacctaattcagtttcatggtttttgtttc

SEQ ID NO: 2662 - DNA, 3200 bp, Zea mays
  misc_feature (1)..(100): optimal_loci_53276_G1, chr2:7950349..7953548, Cluster 15
ttgtttttcggtttcacgatgagcagtatctgacgctcgcagccgcatgcgtgcgtgtcctccggtcctcccgcaccatttttttttattctctggggtcggcatgtgttgtcgtgtacgtacgtatacgagcgtgcggtatcgatgtgctgtaggtgtatatatcacacacagactggattgtggattattatgtatgggttgactagctagtagtaaaaccgcgcgtagagctgtaccgtgaagccaaggccaatctgcttggtgctcttcttgttcccaagtgttagtctaagcaagagtggtgtgttattaagtaaacggcacacacgcgacgcatgtgagtagactctggaattatgtggggttgacctctcggctgctggaccggaggacggaacacgcacgcacctaacctgcccccctggatcactctggatttcatgttaggccggctgcacactcacacacacacacacaatccgacagtccgacgggcacactcgttcgctctcgtcgcactgtcatgattcgccgaatcatctgtttaattaattaaaaatctatgcgctgacaagaggacactacggcaatgggtgcaaccaaccaccgctagggtccaggccgggcggaggaggctggccaagctagcctggcagctgtcgggggcggtggaggagcaaaagtcagagcaagctttgacgcatggcgaccccggtacagcagccagacaactgttagaaaaatgctagatggcggccacaaccacactgcatcaggtcgtcgcgcccgtgccatgtcaacgcgcagctagccgcctaaccgcggcatcgcatcgcatcgcgtcgtccgtgtccggcccgtcgcgtagctatgctaccacctagcacgattggtctcgggattccggtgccccgccagagccagccgatacgtcaaacactgccgtccgatccgcccgcccgttcctttccgcaacccctgagaaacacgacgcgatcgggcgggcgcgggtcggcgtcgccgcccccgcttcggtcggcatggctcttgggcgcgcgtagtacgtcgccgccgacccacatcctctcggtgcgtcgtgcgtgcacgtgttacacagcacgggcggaactctcgcgcgcgccggtacggtgatgacgacccgtcgtcgtgtggcccgcccgccgctgcattcttcctgcgaagtggcgcgcgcactagctagctagcgaggtgcacgtacggtgcacctagctatagcgcacacagctccatcaccgcgggcgcgccgccggccgtgcgtacgtgtacgtgttccgcacaggtacctagcagagcaccacccaccgcaaaccgcaaccgcagccagcaggccaggcctggattgttctcccgcgcgcacgcaccgcgcgtcgagtcggatcggatatccggatgagtcgtcgttgcgtcgatccatgtgccctcggcggcacggcacggcacggaacggcgcggcggacgtgtggccgtccacggcgacgactccaccacctccaccaacaacaacaagttttaacttttttttcgtgaccgcaccgtgggttgattctgagtacgaccgccggcgccgattaaattgtatgtttgtgtgtgtgtgtagaagtacactatatgtgagtgagtggctgagatgatgacaggcgtggagagaaattacagcccaagtgattatgataacactttgtttcttctgctcgatccgtcggtatatcgagagagaggtagtaattgattttacgtacgggaaacggtcgtcgtcccaatccatccagaggtgcgtgctatttagtactagtataatataatccacgaccagctagctaccccactgcggactgcggtgctactagcccaatcaatcccgtgaggccgtgacgaaaggtcgtcgtcccccaggttctcgttctctctctgtcactcacgacgagtcatgacaagaagaagaattgttttcatgtgaaccttattcattattctattagtgcaactagcagctcgtcgctgtgtctccctgattattacaatcaatcaggatattcgattcaggcgtgtgcgtgtgtacgtattctgcgtgctcagcaaatgagtacgggtttgacccagcgacgattaatctctctctctctcgctggatctgaatggtcaaagctttgtcgagacgtggcagcgacgtacgggacagagcgtgagataggatcataggagcaacgctatgcaatgagtgagaagcgcagagacgagagagagagcacagcacggtgtccctgtcccggccggcttttaattagctcggcctcctaccacacgcacacggcctgccggatggagagtggagtggtgcgtgtgtggtgtggaaccaaggccaccagggacgcgagtgggcggccgcctttttccaggcacgcgtgccaggacccggccgcccccgtcccccagccttttgacgtgacgccccctagccgctactagtactagctcttctcgtccgccgtcgctctccgtccttttttttttcgtcgtcgtcgtcgtcgtctccgcgccctgctgctcataagcatgacgtcaacgggtcttctccccttgccgtacgtcttgccgttgccgagcgagcttcctccgtctcttcgcgccgccgccgccgcagtagtagtcgagggtcacgggtcgcaccgcctagtcgtaccgcgtacgtaggccggccgccgtctcggtctcgcgatccacagcagatcgatcatctcttgccaggtacgtacgctgccgtcgccagccgcccaggccagccaatgcgaagggaacggttatgtgccgaccgaaaggtaacagcagcaaacccgcgatcgacacgacacgtacgacacaaaaccggcaacagcttctgctacccgctgcgacggtacgtactttgctcgcgtacactacatacagttacgttgtattttcgtcgaattatcgtccgtacggtacatgcaggcagctgctggaaggcgaaagaaaacgagaggaataccgaatacacaatacgcagtggggctgctcgcgattacattacatacaggtagacggaggaaaaacatccaaaagaaaaagaaaagggcacatcgaatcgtaacagccatgccaaaatcacgggggtgccggcctaacgcgattttccg

SEQ ID NO: 2663 - DNA, 1560 bp, Zea mays
  misc_feature (1)..(100): optimal_loci_53577_G1, chr2:9601105..9602664, Cluster 15
cttgttgattgcccccgtacgtacgtggaggggtgccagggatggctggagctagcagctatggctagctgcaccggcaacggcatttatttgcagcggagtccgccggatcgcggcccgaattattattgcgcgcgcgcacctacacgatctacatctcccatatcagcatgatatcgtcgtcttgcttgcattggatgggtcgtctcgtccgccggcggtccagtccacgccgtggcctgtgtgcgtgtgatgcatggctcggcctcggctcgtactacgtacgtcttcttgtacgcttgcgtcgcgtgtgggtccgccagtgagctgtctatctatctagtatctccgttctccatgcacgcacacgtacgcccgcacgcggagatcagagaggcagagctagcgaccacctctgacgacgtcgtctcaaagaagcctggacagcggcagcaggcaacgagagtgagcgagagaccgccctgacgggctggtgtttcgtctggaactgggatagggaggagaaagagaaggagaaggagaagaagaaagaaccgacggtcgcgcggagcagcaaaaccggtcgctctcgcgcgcgctgcagcgggctcgatcgcgtagtatagtcgtcggcgcgcgcccgcctactcccccgatacgacgcgagcatttaagcgcgcgctctccgtccgagtcgcgcgacgacgacgcgatcgatcgagcctgcttccagcttcctgcttctccttcccgacctcattgatgagggtgatgtgcgggggacggcgacgggagttaatgacgagagcagagggcgcatgcagaaagaagaagctctcaacgcgagccatggcaataaatgggcgccggtgaccgtccgtcgggcgcgcgaaccatgcacgtcgctgtcgggtttaggtgccaacgcccgccactcgtggcttcggtctgccggccgtctcctcaatcctccacacaggcacagcgagtggccgctgtacggagcacgtgaataacaacaaaacaaaacaaacaggtttggggtggattggatgggacaagcaggacgatcagcagatagtatagcctgaaatccacgccggcgggcgtggagcccatgcacatgcaccgcgccggaatcggtcgtttgccctgccgtgcggccggggcggatgcctcgaggcatcagcaggggccggcaacatttcacatcatgcagcaatgcagctgcagctgcagcctgcaggtattcttttcttcgagttggagggacagtaccgagaagcggcacgtgaagaaagggcaagcgcacagcaatcacgcgttgcgtgtgcttgttggactgccatccacttactgatgggcctcgtcaagtatggggatggacaatacttgggctgggccgaaggcaatcccacaatagtctacagcaccacctctcgctcccaaaaaaaaaacagagagtaaacattggcgtgggtatggcccatgtggtctctgcctccacttctgatcatgctgtggtcttctggttttgcatatatggtgctaacaccgtct

SEQ ID NO: 2664 - DNA, 1792 bp, Zea mays
  misc_feature (1)..(100): optimal_loci_53976_G1, chr2:11651259..11653050, Cluster 15
tagattgggttgagtttttttgtctttaggtcggattttttcaggttagtttggttttggatcaaaagtcatggcacgtatccgacccatgaattattagaggtcaaattgcgtgcggttcgtatccgtccattacattggtcgaatgaaggtatgaaaccaggtttttttagacagatcaggtcggattggtcgtgtcagttagcccatgatcaggtctactcggctgctgtttggcggcgcggactgctgttatgaatcacattatcaataatgaaagagtcgtctgtcttttgctctctggttcacatcagtactctattctaagcacgtacactattctaatgatgtggaactaacacgaatcatgagcccatgacccaaacgagcacactggctctgcggcacgccggaggctctgcagcccagcaccattatcgtcctgagttccatgcaagtaatgatcacttgacgtccggtccggagaagacgggtgtgcttctgcttctgcatgcacatgcggtaatgcgccgcctaataattcagagagcacagactcgcacgcgtacagtgcgacgtgacagcggcccccgcgcccaggaaattccacgggcattgaaggcgcggcgctcacacacacatatacaccaccccgcctcaccaccacggccggcggcaacgcggctccgccgagcgcgacacgtcgcgagccgcgcgcgggggcgccgatcgacggcgacgtcgtactggcgacacgacagcgccgcaggctggcgcgtcccatcgcgtggccaccagcaccacgcctcgcgcgctttgctttttctgccgttcacacccacggcccgttcccggatgagagtagcgcgctcatgcatgcaccaacaaagcaaaaacacgtccgtccaagctaatccggcccgtgcttttcttaccacaagaagaaccaagagagagagaatagaagccccgtacgcgcgcgttggtggttccgccgcgtaatgatcgcgcgaaccagagggacggagaggagctggtggccggccgtcgtgtgctgcgtgtgagtgctgcggcgcgcgcggtcgtcgtcggtcgttttcggccccttcccgcggatgcgcggctctcttcagacgtcaaggatattcgagaggtggcaatggcagctctgaatgatccgcgcgcgggagaggcgcatccaacagggacgacgatggatggtgatgtgaccgagtcgtgctgcgtgcgcgcgggttcgctgccgtgtgtggagtggatcggagggtttaggtttgcggtcgcgtcacccggcctactacccgcgtggatcggcctgtgcgctgcgacccacgtacggactagccctgtggcctcttaagcaatcccggccgacagccggccgtcaccgtaccaactaccgtaaggaacaatttgttcctccctccgggtcacatgcatgcatgcaagtattattcaaccgaacggggagcatgcatgtccttggcatgatcccgcgccacatgcatccgctgcatatatacggtggacggaataggtcgaaagggctcgcaatcgaccgcaactccgcttttgcagacgtacgtacctgcacggcagcgtgtgccggccgggtcaacttctggctggccacgaggcggcggcggcttgacctgcgccgtgggccgtggctgctgaccatgtctagctacgcatttgtaaacgcctcgtacgtaatagcaggacgaacttgctggcgacacttttgactttaatttgtattacaagcggtgca

SEQ ID NO: 2665 - DNA, 1620 bp, Zea mays
  misc_feature (1)..(100): optimal_loci_54490_G1, chr2:14674194..14675813, Cluster 15
atatgccaacttagcaaactctaggaagtaggatttgtacgcaacgtgaccacctctgcctggataaaacttttggacagaagtgtcacgttcattttttataatggaaataaaaaattcccagccctttatattttcctacatacgggcttgcaatttaaaaattaacaaaacacgtcattaaaaaagaacatttttaaaaagaacttttctttgaatcaaacgtcctttaacctggtattagacctccatctatattttacaaaaatctctattgtcaccctctctaagaattaacataccacaaaaatctcttgatgagttttttatttctgaaataatctccagagtctaagccaatacgtcttcctaaaaagaatctataaaaactgatgatatttatttaaaattaaaagccacggtactgggaggaaactccgtaccacacgcacatggtatagaatggaacttggaaactaccacatgcacatgaacatgatgagtacatctgcactgcacatgagctacgagccgtagctgtgctgtgcaaggtatgtacaggacacatacaggagaaagcgtccaaaaacctccatcccgcggccacggccacggcccacgggccaccaaccctgtatggctgtattgtaattgtaactaaccgtacacgagcggccgcgctcgagtaggaagcaacagggaacagggaacagtagcagactgccatccatcagtcgcgggtgtctgaggttcgattcaactgatgagtgggatgcgagcacttgcggcttcgggagtcctccatcccacggattcacgcctgattgcctgtgcggcggcgaataatcagctgccgcggcagatggatggcaggagccgccgggccggcgaaccatggttgtcgcacactaccgcggggagcgctgacttctctagcccattgcctgcctgtcaaggactggcagaaccaaaaccaataaaacccagacgacatcaatcacctcagccagaaacgaactcgcaacagcctctcatcgagtacatgtactattaaaaccattgtacctagccaatataatatcgaaataatttctagaaaaatctcagagacacgttttctgaagaggcatatgacgacatttagacgagtgtgataatatttagtcccactttgctgattaaagcggaggaaacataaactaaataattgtccgctcttcgtagtctcgcacgtgttgagcaataggtacaaggtagaacacactcgcctcgtcctcgccgggtgaagagagcggacacacgacatatatgtgaacggctgatcgaaattagagtccaagccttgcgcgctcagttctttttttggttctgttttatcgtttattctataatccttatcaacgagagatcgtcagcattctttatccggtgtgtatccttatctgatgcagatcattgaattcttatcgcgtacgtattttttggaaaaaacattataaagttatggtgactacatcgtttaccaaacatgtcgtgcttaacaatgtggactccagtatctatcaccagaacaagacatatctgccgctacagcaaaacatgctcgacactgttgtatga

SEQ ID NO: 2666 - DNA, 1466 bp, Zea mays
  misc_feature (1)..(100): optimal_loci_54629_G1, chr2:15280875..15282340, Cluster 15
atcgctggcaacattaaaccagggctaaatgtctcaaaagaaacactaggaagtacgtaggaacctagcgaacgaaacagcccaggttttttttttctcggataccataataccaggcgcgttagaaaaagaaaagaaaaaacgagcaggaaccttggaaccattgccgagcacgggacggccgatcgggaattgtccgtccatgcgtttgtcctgtctttcgaataggaaatgcttttgccgcccggaataaaactacatatatcttttgacgctgtttcagacggagctcagctcatgtagctagcgtgctggaatgaggcacaccgcacatgtaactggtgagtggatctcttgttgagactcactcttgtggacatttttgttgttgttccggcctatacgaacacttgcgcagctcgttgcagagggtactgctccggccggctgtcaaatagatccgagttaggccggagcagcagtgtggctcctcctccatccatcattggctatgcaatgcaagagactttctggaagccgaaacgcggctcaaaccatgtcttaaaacgcacagaacaggaatcttgacaggctcctcgctcccgtcggtccatcctgcgctgctctgcactccacgtctccaccccacctcgcaaattagttgggggccgaaaggagcgcggggccgcgggataaagggtaacatacaatacaatacaatacaacaacaattcggcgaggtttactggcgcggaaagcgagagcgatatggtcctactacgcccctgtcctgccgggaagatcttttgctatcgcgttcactgagactgaagactgaggaggcgcgcgggtggcaatggcttggctggtcacgcaaattctccagcgacttttttgtgcccgccgctaccactactgatgatggtacttaacctgaatgccgatctaccctcagttacgcccgccatccgtgcagctccctcttgttaccgccgtaccctcctagtaccatcgtggtcaaattttttaattgctccaaccaccatatagatccttctcccctgcattgcttcgccctggatagtggatacagcgtagagattcaccgtccagcgtgtaaaaaaagaggcgttcgttcagtgtcgagaggcagagagagagagagagagagagcggcgggtgggaatgcgcagagaaaagctgccagagaagtcacggagatacgttacgtacgtactagaacgtgaggaggggtgtgttgtgtggggagcacgcgcgcaagttgcatgcatgcgactctttcttcccaaagcatatcggccgccccccagacccagagatatattaagaattcgacccgctccctacttgtacgatttggtggtgctgggttaggtagacgccgtcgacggagctaatatttagggctgatttggtgatcggggatccccaagggaagaaatcct

SEQ ID NO: 2667 - DNA, 1704 bp, Zea mays
  misc_feature (1)..(100): optimal_loci_54662_G1, chr2:15470772..15472475, Cluster 15
gggaaaacacccgatcttggcgtgcttactagactaagccgcggggttgggatgctcccatgagaccaggccctataccctggccaagggacgaaacaaagcccaatacattatcgcatcctacctctgggggagagcaagctaccaaatagatctatgacctctctaagtaccctactatgttaggtatccgatggcacaacaaacacgtctgatgcctagtgactcctagccgctagaatcaatggttcgactattggatcccctccctcttcccttaactgtaaaaggtgagcacaatagcatttagcaagtcaattctaagttgttaagtttatcctacatagaggcagaaataaagggtggatgattgagaccattatgctagaacccttaccagaatcaagaggtgagagagagttgggtggacttgatgcatgttgtgtttgagcgtcttcatttttatattcatcaattaatgggtagtaagaggatgtaatgtattatacatactgtggcttgtccctcttttaaccgccctcacattcaaaagaataaatgtggcatttgatgattggacctcgcaatatctactactagaagctgatgcgacgacgttgaggtgacatgttccaatccaaatcaagtgttgagttttgttaagacataggcagagaatttaagtcatattcacttaataaagtggcaatacttgtagcgagcgaagtcgacgtacaagtattgtctggaacggcattcatcagtgggcaaaacagaatgattattctttaatatccagtgactgtgaagatatttatttactcatgcaattgtacataacccatggtgcatcgcagaagtcggtaccgcttgacgaatgcacgttagagtacatctttttttttttgtatatataagaaggctcttccatgattcgtactggttaatttgagatcaatggggcatgtaacacgacacgccacctgtaaggttgtaagcaatcattcagcacatccgtttgatgctgtaatcattcgtgaacgtcgcattgcattgcagcaataaacacgtggagagaatgccaagctccagcttcggttcggtcccttgttggaactgcatgcatttccatggacgtagcagtgcatgcatcctcgtgcccggagtgcacgattccgggtcgagaccgccgcaagtatcgtggcgcgcgagttgccgagttctagcagatgtgtttattatctataatggcgggcagacggacttgcagggcaaattaagcgtcagcacacatcttgacttggcatccttcaggctcgaaccccgtctcgcccagcttttggttggtccctctcatcggctaacgtcctggccattgccctctgctacttgtgccgtaaccttccagaaaacgtccaagtgtcaactactgtactgtacccgaggtagggtcacatcctttgtgccccccccacacacacacacacacatacatatggccgatgcattctgaaatctgaagtagtagcagccactaggaaagcgttcggagtggggacagaacagagccagtctcaccagcagcagcattctgttggggacaggacagcgaaaacttgcgaaacaaaacccaagcgagcaggagcagctagcgaggtaccgtactactactactgcccgtcacctccattgatccgctcctgg

SEQ ID NO: 2668 - DNA, 2038 bp, Zea mays
  misc_feature (1)..(100): optimal_loci_54663_G1, chr2:15472509..15474546, Cluster 15
ccgagccgttctggcccggccgcccgtgctcggtcgccttcacgaaagccaccggggcaggcaggagccaacaaactgcaccgaatctctctcgtcatctcactcacacccccaactgaatagatacataccctgaccgcgcctgactgaccggcgcagcgtcgatccgtagcgggcgacgcagtaaaaaaaaaaaactcattgctcaaggaacacgcaccagcggccggccgggccgggaccccccccccccccccgtttctctgcgttttcactgtcaaggccaagtacgcgtgcagtgaatcgatcccctattgctaacgtgatgacgtgtttgtcgaacactcctgactctatgagccactcccgtcggttcttaaatccgatccacccgcgccgcgccctattgatctctggaatccggcgcatatgaaacgtgtactgctggtgcgtggaaacgcaagttgtcaccgtgcatgaacaagacatgtctggtatctaggtgaggcgatccgaggccagcgccacgaccacaggcaaattttcactatttttttttaattgacagacaagtcacgggccaaattaaaggaatgtcccagctcgttccacgttacggcctgccggttttcacgcgcgggcgcccacgttatcgcttcatcccggccccctcgtaccgtgcgccacgggattaggagcgcgacgacacgggacaggagggaaccagagagggggagagcgagacgccgcgcgccaagtcgggtcgacgccgagtggagccctcgcggtcgcagagagagaggagaggggagcgcgcgcgccgtggccgtggtcgtcttgaaggcgaggcagggtaagctagcaggttgcaattgcatgcaatcaatgagatgatggtggcgtggttaaccacgtcgccgcgcgaggcaataataaaacgctggtgtgggcgtgtggcagcggcagcctttcacttcgctccggccaagcgacgtcacggtggaaggcccaacagttgttctcccggccgcctgaccgtctgaccttggcgctgagtctagctaccccggtggccggtgcagagtagcagtatcattgaccgcatgactcgtcgtaactactttctgttgcgcagaaaacaaaaaagcactgcgcagtcgtcttctagtagtatgttggagggataaacaagacatgaaaaagatattaaaataaaacaagtccttcaacagcgttaagacaaagcccacacattctccaattgtccatcatgagactggcccgatgtaggttacatggcccaagcgacggtttatgatacatgtacatggtactacatggtagcatggtacccagcggaataatttggcccgaaaagacggctattgggccttctttatttagacaccgaaggcccaactagacatggaatacacaaggtcagaacgaacgaacttctggtttatgatttttatgaagagcgtcccatggtgcatcccctgtccactgacaggtgacttctgcaacgttgcggagtcggaaagcgtatggaaccagaaccttcttctcctgatgattatgtcagcttatcattagctatgtggaggtaaaccaaagtgcgcactgtcacgacactggataagtgctgacaagcatgcatgccagctccacatgcatgcatgtatgcgctactcctattccttggtaactgggcaactggcaagctcttgtccgcacggcaacccaactgttgttcggcagccatggccccccatggctgaatggctcatggctggtgtctcgacagagtgcgcgtcaatccggaaccgacagctagctttctccgaataggggtgcattcatgtgttcatgcatcgtgatctatccgcgtactggtagtatacagttctaagtaccggccgtactacactgaggactggtcatgtgcgaggacacgacgcacacggcacaatgtcaggcgtcagggctgtcggtacgtaactgctagtattaggctcgtcatgcggccatgggacaa

SEQ ID NO: 2669 - DNA, 2219 bp, Zea mays
  misc_feature (1)..(100): optimal_loci_55502_G1, chr2:20017381..20019599, Cluster 15
ttcggtgctcactgctcaacatttactcgacgctgcagtggtatgaattgagcacggcacggtagggggcatagcggccacgcaccacgtcgagccctcgatcggtgagaacatggcgatcgatttcgggcggcagcacagcgcaggggctagctaggctataggggatccggcgagacgagcagcaggaagcccaggaacctaggtagccgatggcgaacaagagataaggccaccatcagcaataacgaatggcgtttctcacagaacgaaagcactcgcggctggcaatagcagtaataagcgtgtccaggcagtcatgcacatacaacagcgccacttgcgcacagtctgctactgatcggacaccggagtagcgtagccaacaaacccagctgccctgccctgccctctctacgacggccatgcatggagtggaccggccccaatcatgctgcacctacggcggcgctgtggccgtaccatatgattgccgagttcacaaactgttaagcgctagcggcgactactataagtaccagtgcaggtacgggtgctagtgacgagaacgcaacacgatgataatgcgatcattcagagccgcgtgatgcctcctgcgctcggccagcactgctgccgtccccgttccgtgatggggattaaacccggcctgtgttctgtactgtagctgtgcatcgtgcttctgtgaatgtagctgcaagctactgaccacgccgaatttaatgatcttcggtcggtcttctgtaccggcctaatatacagttcttcaataccatcctaatttgtcgcgtgcccaataaagtttgcctagtagtgcaattatttgctcccagctaggatccttgcaagcaacattgcttgaatcgcccaaatgatcaaggagaccgtacctgtgcgcgcttcagtgttctagcttaattactgacagtttgatctgtttggtgcttgaggtaacacagatatataggatgctgcttgcgagaggcagcatttttattaggacaaacagtgatgacgacgaacaaatggcctgtttggaactttagttcgttctagtgcatccaaacaagatggctactagtatatagactcatccaacagaccgtaagactgcatggtacgatggaggaagcaggaagctctagctaattgacttgttttatctcgtggcctttttctctaccttggactaacaattggcttatatggtgctgttttcaatcgcaattgtttgttctgtagctaattggctcaaaagaatgaaaaaaaatcttttgaatggatactgacgcggcaactactgcccatgcatatataaacctttcaattacaaggtaagtgtgttcccatgatttgctaattttgctcttgacgacgactatactcgctgtcacttttccttggacaacaagtcaacaagcttgtgaacattgaagacacttacccgttaattactccatgcctgaaaggcacttgccccactacgtacacgccccccccccaacttgcacgcttttaatagctaactactactacaggtcttcaattcgtcctggttgatctgaaccacaaattacggttacaagttctgaatttatacgttgaaacagtacactaatatatatcagagcatgttttcaatagagccgaacacatgctttggtttgttttctcaagtgtggtcggttgacatgtcccatcagatcaataatagatcatcacaatctgtaaaaaatggggttgcaaggtcagtttcgcccaagtaatctaccgaattaagatgtaagcacagcaataagcaagtcgagccaatgatatacgcccacatgacgcagcacagaagacgccactgccatggcgtatgcgctctacaggccggtcagtacaagacggcacttcgattgacaggctcatgaacactaaacaacagttccaaccctcacctagcaagtagcaaagcatgcatatgagcgatgggccccaggcttgttgcaggcacgcattagaaaacttgatcctccctccgggagctcacatgcatgctcccggactattgcacaagacgccattggccatgtcatgctcatgccgagccgttcattctttaatcgacgtaaccgcattagaccgaaattaacaaacccgaaatgcatgcgctagcttttggacacgacttaacacgcattctttaatctata

SEQ ID NO: 2670 - DNA, 1895 bp, Zea mays
  misc_feature (1)..(100): optimal_loci_55529_G1, chr2:20108543..20110437, Cluster 15
cacgtacgcggacactcccatcgcatccatcatgcatggacgcgacgcgagcgtggagcctgggtctggcagctgcagcccgcgcgcgtacccgagtcctgcaaccctaaagcgagcgatatgatcgatgcagtcgcgggtcgtcggatcctgcctgccgtacctgcggcttgtccgacgcatgcatggatggatgctccgatccgatccatccggcgtctacgtatcgcacagctcgctcgcagtagtacgtgcacgccgctagtcgtcgtccgacggttacgctggtagatgggatggccactcgcctacttgcaagtaacaattcgccgtcaaagttggcccgtgcgtgcatccaatccaatccaaacccaacccaaccaacgcctccgtaccatcagcccaagcttcgagtcagagatctagagcattagtagcagttaataaatagttggactagctagcttgcaactaatgtacaatgtacggaattgcacttagctagctagcttgtggggtatatattcgcagcatcactacaattctatagctagcacagcacaatttaaaaggtagtggtacgtgtacgtacgtgtattatacactccttctctacgtgtcttcctcccgagtgcaagtaatagttggcgggtgcgtctacccgattccaaccaatttccgtaccgtacgtaccagagctagatcaggcccgtgctcgatccggcttcaaacttaacgtactgttggcgaatttgagctagtttttagctcaaccagtaactagctctaacctatccaaacagtcctaataagtatatatatacggtgtattatactgcaggtatggtactactacttgtattaattggttaaacacactctgacgacgccggaacatgtgtagtatatagtctttccagtctactacaatataactgcggtgcgggctctcagcctctcagggacagagtgtcgactgtcgagagagcaaataaatatacaatcccagctagctcgcactgttaccgacgacatgagttaatactcgcggttacggcgagctaaccataaagatcactcagctcgcaacaagtgcccagatgccgacggcagggctaccgatgcaaatttgctaacagcagagcaaagcgaaacacacggtaacatactaaaccactgtgctgcagtgcagagggagtcaaacgcgctggacaacagcagccggctcccgagatgccactctgctttattactcgatcctacctccgatagtccgatcgatgatgtaagctgcaagtctgggacgggatcagtgcactgtcaacgcaacaggctgtaattcggctctagtttaaggggccgatgcgatggccgatgccgtcatcggtcatccttctttatcgctagctgccggcaagcataggggggaaaacgcagagcttgacatgagcaatgaagccttcaaaccccaaccagcttcttccctattgaaattaggaacactaactaataacttctggcgccccagctacagtagtagtttgtccacacgcaacaacagcaagagatttccgttcagctcttgatgcgctatcagtccggcgcgcagtcttcagtccagcaactgatgcgtacgtggctggcgctgttcttgcttgcatgcttctccctccaacaaatcggctcagaccccatccccaatggccaatgatacgtaacgtaacacggccacataccgtagctaccgcacgaaacctgctagattggcagtcaaatctggggaggttttcaagaaaacgtgcctagcaacaacgtggcatggcatggcatggcaagagaggagtaaatggtgacggaagccaacggcggacctccgttgggggagatgcacagac

SEQ ID NO: 2671 - DNA, 2081 bp, Zea mays
  misc_feature (1)..(100): optimal_loci_56839_G1, chr2:27557144..27559224, Cluster 15
gtgtttgctctcgtctcgtgcatacccgcgcctgctgtcatgtgcacatgcatggccggccctacgccggccgtcgcgctgcttgcggcatggcccgtcggttcaaggtatagatacctacggatacgaaagccaagtgcttttgtagcttgcgcgcgctagggatcggattgtcgcgacatggcccaagccccaaggacgctagggatggaaacggccggcgcaacgctgctgctagctgctctgcggcattgtctgtggtcggcagacgatcgagaggcgcacaaaattcgcatgtgactgattagtacagctcagatcaaggcgcgtggctacaaggagacgcacgtaccccatggcgtccaggatcgcggaggctggcggagcagagacgctggccgtcgttgcttggctccatgcgggggcgcgcgctagcgtctgaatcccacaagatcccggtgattgtaccttctcctgcgcgaaaaaggcattgtgctccaacgacagactgtgcggcctgtctgtgacagatatttgacggggagctttgaccgtttatttacgccatgctcaactgctcatccttcccaaacacaagccaagaagcaactggagtagcatttaattcgaattttctatactctatttcattgccgtgatcgtcgtggaacatacagtatggttagctagcaacccctcgaaggatgtttgccaatgctcagtgcaccatgcatactgctgcatttccacagtcctcatctcgttcgttatagttgtgcattgcattgctcacgtggataaatggatccgtccaattcataagagctgtgccatcactcttatgttttgacatggaggcgacaacaagaggagtcatcgaggtaactttgatggcctaatcgtatattcgacaagaaggcgacctcaagggcttagatgaggtgaaagaatctcaccgttgatggttggagacgagcaacaacgacgactgacatatttgttctctaactagggtaggcacacggagatagagactgaatcaaatgatatagtggagagagctcacagagagcactatatttatatatggtagtcggtaggcggatacagggtcaagcctacgggggctatataccaagtcgagctacgatcgagcccccgcatgtcgaccgttgctttggttcgagtcggcatgtgccatgttgtgcctaagttgggctatcagacctcatacctttcggcaactatattttgagtagatattgcacgtttatagctagatatccaagtagaagacaaaattagttggaggtagaacccaatggcatatacaccgcccatagtggctacctcatactttcatgggatacaaacaattgagggtaaatccgatttggagtgcaagcaggccaagcctaaacctcgattattattattttgcatggatatacatttctacatagaaagatcctaattatggacaagttactaaacggcagtcactcatctgctcaaacattgtcctttcaggttgcaaagcgtgtaaaaataaatttcgttgtggggaaacatgcacggtgtcctttcgaaattctagatcagatggttccatcttccatctacagattggggagaagaagtagagcaaaagctgataaacatttcataagggattttaatgagataacaatttactccttatgaaacatatggaacaagaagactttcttgaaaatttcaagagatttatccgatattgctgtcttaaccgaaggggcagtggatcaacatcatttagccaagtcacactatactcaaaatgcgtaacttgtttttttggggtcttatttcccccttctcttgtgggtccaggttgatcggctagatgtaagtagtctgttgttgccgtcattattcctttttctactattaaaaataaaaaaactcttgtcgtactttttaaatatagctcatggtatctaactactaactagccattgatacaaaattttagccatggtatggtcctgtattccctaagttgtagtttataattagctataatgagttcgctggtccta

SEQ ID NO: 2672 - DNA, 1570 bp, Zea mays
  misc_feature (1)..(100): optimal_loci_59167_G1, chr2:41231186..41232755, Cluster 15
accttttgttgttcttttttttatatatatactcgtactacctacagctattggatttcaacgctatagtctgattgcaagaatcatagcgcaccctactggatcccaagcttgattagactggaccggctgggcgctctcgtctcacaaaatactcctacatggcatacgttagaaaagtgtaggcaagtgttctctgttatactcagaggtcagagcccacacaaccaatttttttttatgaagaccgcacttgtatacgcggaacccttgcttgtacaacaagcaaaacaaacgtagttgagcacacacgcagtcacgtccgtccagtcacacgtctgaggggtactgtacgcgcgtacagccgagctgctgacgcccaaaccgcgtgttcggttggcgctggcggtggcatcagcggaaccttctgcttggcgtcaaaaaaaaaaaaaaaaacgaggccgttggcttaggttggagagggccccgccagcgccaaccgaacacgcaaaaagtcagtgtattcgggaatcgggaccaaagtccacgaaggcgtagcgttgccgggggtctattttaaagtcccctccccgggctccccctcctcgctggcatgcactccgcactctctccggatgctctgcgatcctgcaccgctcatggcgtgctgtgcacaccgcatacgcgtcgaggacgggccagcccggcagcagagacagagagggctactgctgccgcttcagctgaaagtgggacggcgtcgggcacggcaagtttccacttgaactgtgcggtcgtcgtctctttccgctccagattttcaattcgcctgttgcgttgtgcgtgcctaggctacgcttcagctcgcttctgaactccgataggcgatagcaaggacccgacctacgcaagatgacactcgacgtcgagtcgtcgacgacagtgccacacaaacggtgcgggcatgcagagtgcaggaggctagtgatgaaaagggaagccggctgcccctgggcgctaccgcgttccgtcagtggctgactgcctgactgcactgcacggcacggcttagcagaatgagaggcggttttacgttagcttgagagagagcgcaccactgcatatatctatggtgacagcgattactgcctgagaagcttaaccgatgattacgccatcatgacatttactggtcagcactcagcactcaccagtcaccaacgcggacggttacgccttccagagacactccttgtcgcgccgtggcgataagaactctgtatgtgcacctcgccgcaatgcacgtccgtgtatcaagcgagctggatcacgaccgttgcagtaaacataacaacatacccaacactgcctaaacaagtaaacataacaacatttgttgatcaataatacgattgcagtctagattgacatttgtttcctcgttcagcacagctccatttttctggcgacctcccttacatgacctacttctctacaattgcgtatgttatctttcacatttccccccttattcatcgggtcttcttcttcctcacgagtctcaatctat

SEQ ID NO: 2673 - DNA, 2058 bp, Zea mays
  misc_feature (1)..(100): optimal_loci_61743_G1, chr2:55800051..55802108, Cluster 15
gtcaggcggtgacgttgacgcgtcatgccatgcgtggattggatgaacgcacgcacgtcgatctcgccatctcggacgtctctgaagaagtgtaaacggagacccggccgagagcgagaggtccatgcctgacgctgacgggcaatcacagacacagggtttggttgtttggttggttgggcaatgtgacaaaatttgaaacgccccatatatagtccatagaaaaatctctcccttggcctcttcccacagtggccgtcgccatgcctgcagctgtctcgaggcgagcttaagacagacctccacacgcgcgagcgtgtcgtcgttctcaagggcgaggaaaaaaggccgcgctcgatcgcttaactattattattattattatgcgtagtagtccgccattgctgcttttcaggaggaggggaaaaaaaagaagctttgtgtcactgtcgtggttaaaaggtacactactgtttgccactagtgttcttttcaagtcggtgtcgagtgggagttgtgcttgtgcacgtacgtacgtgtcacacagagcgaggccgcagccagccacctagccagtcggggccgtcggatcaaccgaaccgacggtgcaccggagatgtattgtctccctgcgaggctttaatttcccggttcctggagcacacaaggacaggcttcattaggttgggacggaatatacaaacaaccggccacttgcacgtactggattggtttggttccacagggaaaagctgcagcatgatggctctttccaaccagggcctaatataacggcctgcagttcccttggcgagagagaatgacaaggagggttttagaggagcttagctagcgctccatgtttttttggccgtgtttggcgttgccaccttcttgtttgttctcttgtagtggtgttcttccttgccgaaagctttgttgttgttcagagaagctaaattatatgtgggtggagcaaaagccggccggccggggtgtctgttgttgccggcgtttaaaaatgagatgaaacgaaggagctactaggagagaatttgaagcaggcaagtgatgtacagtgtggtattttttgagccgccgtgtatagcagatgtttagtgtgctgcagcgagctgatatatgtggatccagctagcctgctcagcttctgtcgtatgctaaaatcctcctgtgagaaatcctgggccgaagatcagtgagtgcgcgaacactatgatgtatatacagcagatcttcatagagaacagcttccacttgcagaccagaaagttaatgacgggggacggaatcagcaacgctacacgtacgtacgtacgtgcagcaaggaattcacaaggtcaatgatgctccgtcatctggaatcgacatgcaaagttgactagctagagtcccttgtctctagcacatcaagctggtaataatactatacaagtagctagcaaccacgctgtcgcccgccccctgggactcccaccgatcaccagcttcgacgcacgctggaactgagagcctgctgccggccaggccatgtccatccatggcacgcacgcacggtcgaaacgagcagcaccaagcgtgctcattatagtttttccactatatatcggtgcttggcgagtcgaagtggcaatggaagtggtgaaaatggcaaaatgcacatgatcctttgagccgacaagagtggcctaaaaaaatcagaggttgctgctggtagtagtagttgttgttgttgtaggccaggtaggcctgttttgttttgttgtggcatgccaattatagggagctagcatgtaggctgtgttttctactgtatctatgtctcgtcggaccagcaagattcactggcatggcattggtcgtttgcctaacgttatagcttatcctccccagattccacgatcgtttcgtttgtttataaccatgcgattcctttttttctctctccattgttttgtttatccctaggtaatttcttctcgtgtctggtggaggaacgtaacgcaccgagaatcatacagaccccctccctcgctccct

SEQ ID NO: 2674 - DNA, 1454 bp, Zea mays
  misc_feature (1)..(100): optimal_loci_6211_G1, chr1:31773683..31775136, Cluster 15
tacgcggcaacgtggcccgcccaaccccatcatcatgtcctgcgactaatcatggcatggcgcctcctcctcctcctctttcactgcctgcgctgcactgcaatctgtgttactgtgcgcgctccacagtgcgaccgtttcccatcagttttgtacctgtacttgtgtttctaaccaatagatcatagtgcatatatggactgtggaaatggagtggtcaacatttgatatgccttattatatacgttggcactcacatgcaataatgttaacacgtaatggtgtgtatgaaatgttttgagccagaacaaaacttctaggacttaaagagcttgtttgagagcaaacgtaatggaggagattgactatttaattttaattagtgaggtattctaagtcctcaattcccttcattccacttgtttattatacggctgccaaagaattaatggaactactatacgcctcgcggtatgtacatcgctgaaggacctacagtcgaagggatgttgttcgtctctcccgaagcgctggaatgcccctagtcctgtgagagaccagaggcaaggacttcaccaccctggcttgctccgcaatccccacaaccatcggacccagcagggcaggtacccataccatcgccatagcgagggcagctctttttccaggggttggtgagacagcaggctccaaggccccactccgtggaggaagagggggcaactgaagagttttgggggcaactctggctcctcccgtcttcagccgaaccacccccaagatactaagatactctagggttcgtcggggcgaatcggactctgctaccctggtatggattcgtcgagatctttgggcttctaaggagtttggtatagaggattgcttcccggttggtgccaatgatcgctggtctgatccacctcataaactcaagtggtgaagagcgtgaaactttctctcaagtggtgaaggagatggcgtctcgtggtagaggaaatagggggttcaggcctcgtccttcatatggagattggagtagctggggttcgtggaatcactaccaattccaaacgccacaaaatttgtttcatcatcctcccccacctcctcctccatatggattttaccctcaacctcttccaaatatttttcacccaagaccacatcaacagcagtatccaagagacttcagatctgatctgcgacctcgtgagcagaactctgggagttcgagggggtaaagattcattctactcagaatacttaagggcatgtttgagagtaagggtaatggaagagatcgaggtgatattcaattttaaatagtaagagattatagccttctcagtcttctttattcgacttgtttccaaacaagctctaattgtatttgcggttggaagaagaaatcgataacaaaattatatatgttggtttattatacatcgtag

SEQ ID NO: 2675 - DNA, 2038 bp, Zea mays
  misc_feature (1)..(100): optimal_loci_638_G1, chr1:3398052..3400089, Cluster 15
agctagctcatcgagggcatccatgcatcatgctattttgcatgcgcgcggcatgcatgcatgcattggctataggtacaaggtactacacgacgacggcacagttagcgcacgcgcggctcctagctagctagctaggtaaactgatgcacgccagccgcgtgcttgctacccgggttttcaggccctggttgcagcgagacagccaggcatatagagatgagcgagctagccagtaggagtaggaggattcgggagatccatcttgatctgtgtgtgcgacgccccgccccctgtgctgtactgctgtgcacaagcatgcaatgcaagccctatcaaatcgttcttcccttcatttctcgttcaccttttttttttggacatagacatcacataattttaccattattcggtacgtattttatcttgataaaaaaaattcaagattctgaaatataacatctctctattattcccttcatctctatttggctcggagtagctaggctccatcgtctttcagtttcaagcttcctgcgagagttccatcgatcggtcggcgcctatacacagacctacaaaacaatcactataactactaaactgttagatacaatatttattctgtagggtgaatgaaaaatatcgattcatgaggagatggtttttttttttttttgaagaaacgtgaagaggagatgtctggtctgaaggagccctaaagactgggtttagcttggttcgagttcaacctcttgaatctcgcccagagcctgccgagctgtaaggcccggaacaagaacacgtgtgggccttactgaccgagggcaagtaacctgggccggacgggctctcgtttcgacctcctgcacgcaccgacgcacggtgcatcgcgatggccgatggcgtcacgttcacgtcgcgcccccgctcacagtcacagcacaatccccagcgaccgaccgctaactgcctctgcccctagggtattttttaccgcacgcgggccattcgcgttcgcttccgagttccgacccgtcggcgtcgctggaggttggtgctcatcgccctttcaaacccgacgccttcccggtgctctccatacgtccccagtggagttattagtcctctcgagtctcgaccgatcgattacccgggggggagggcgcccccattgtttttttcgcagcgctagcgtcgccttgctccgaggggacaacaaggtttttttttttgttgggacgggcggggggaggttcaaagttctgccgcggaggaggcagcggagagacggataccatgaggccggtcttctgcggcaacttcgaccacgtcacccaccagtatagcccccatcagtcggatcgacatgaagttaggtactcgcctggcgcttacactaattctgcatgtcctgagtctaatccaaaatgcagtatctggtggagtctggagcgatagtttgtaatgtatttgtgttttcattgcgccatggatatttgtaccagaccatcagtgcaaatgcttatttaataatgaaatgctagttctgtttgtcctgaatctaatcctaaatgtggaacctagagtcaggagcactggcttgtatttgtgttaatgagtgtgccatgaacattcctatgcttatagaatcaatccccccagcagtcttaacggatcttgcgctagatcttgcttgtcctgtatctaatcataagtgcagaacctggagtcaggagcactggtttgtatctgtgtaaatgagtgtgcggtcaacattcgtatcctagtggaacccccaaccagtctcaaccgatcttgcgctagaccttgtatggtatatgttcatagtgcacttatctccttggtccttgctatgtcgcaagttcgctacacctaatcgtccagcacatatgttttcatgggacatgtgcatgtttgcaaatttgttgtgtttttactttttgcgttgtattatatactagtcaatgttttcaagtcggatgacttgttggtcgttctggctgactgacttgga

SEQ ID NO: 2676 - DNA, 1589 bp, Zea mays
  misc_feature (1)..(100): optimal_loci_6388_G1, chr1:32764132..32765720, Cluster 15
acacgatcgacttgccagtataaataaaacacgaaggtggtttggcactagctagctaacttgaacgtgtgtgtgtgtgtgtgagctacgataaatatcgcccggccatggcgtggtcgcattcagcccgtcacagctcttggtccggcacagacggcggcgggccatccagagccataagttggattttttttctgccgtacgtgacctgcaccggcaccgcgtcagctaccatttggtttggtggctccggagaaagctgtggaattgtcgggtggttttctgcgtggacggggccttttcgctcgccgccatcggccatccatctgggcctgggccctggggtgagcgagcgaggaaaggaaccgcatgtgactgatcgccatgccgtgctgctgctccaggtttctaggcgtgcgaacgtgcgagatgtgatatcattggcattggcggcaaaatgtacaggccacggtcgtctggccaggcctcctgtccatgtaattaaaaaaaaaaatctcatggttgtagcacgcacgcacgcactgtatcgtccgtgctttgacttgtggaaggcccacgcacgcccatcagcatgtgcaccaccagaacgcttatactggattactggctactcgctcgctccttcggtggttctccttccaatacgcgcgcatccagctctttgcagccgtagaacttgcacgtgaaatttctttaatcagtactcctattgcagtcaacaatggaacgcaatcgtgacctctgaatttcaacctagtttagtcagaagtcggcggacctctcccgtctccggctaaaaaagcgtatgcgcgtcagctaacttgcatttttgacatttcgtgtcgccaatagtataccacacaggcgtttacttcagagatactagttggatgggccttctgctgagcctgatgagcgccgaccattgcatcacgtccacagcatcttggccaagttgcgcgatgagctacgtaacaaacagctcgcgccggttcatagatcacaagccaaaaaggacctcgcgggccgtggcggcagcttttttttatgccgcccccgctgccccaccgtcccggtccggcctttgacggtggcgctgtgtggctgctcctcctctgctcgtgccgcgccgtccgacgaaatactggcgctgccctgtgcccctcgtcggacgcggtcggcaggttttaattagcagtcggccggcgccgggggatcgttcacttcttaatggaaaatgcagttggttaagttcggcccaagggaaatgaatatatactttcaccgataaacttgctgccgctcactgcttcctgccaagatggacgcgccaacgacggcacgaacgcgggcgatgctcgcgccaaccagcacgttccgtcggcccaccaacattaaaagacaataaatctttttcatatgtgccattacatgaatttgtaattatttataatctattaaatatgtcgagtggctgtagatggtattttttatgaattattttgacatttatcccacttcccgtaattatttataatctattaaatttgtaattatttataatctgg

SEQ ID NO: 2677 - DNA, 1497 bp, Zea mays
  misc_feature (1)..(100): optimal_loci_6775_G1, chr1:34809925..34811421, Cluster 15
agggttccaaacatggtcttatttaattttaactgaattaaaacaagttgttacgtccatttaaagtccaaccgctaccagcaactaaacgacggcttgtctcttggagattgattctctatttttggttgcatcgtgcgaatgaacctgtggcgagatagtagaagtgaacgattttgcgttgcatcgtgccattgaacctggctagatagttagcagtgcacggaacttgcggtcgtgttcgcgtgcactcacggcgaaaatcacgagccacacacgccgcgcgcagcagcagaggaacaccctaccaaaaacgaggctgacaatgtgcgcgtaccacgagcaggagcagcggaggacacccgagcggagcgtgctccacgccgccgacacggaattatggcgagtggtcctccagcaccatgctgcgccagcgccggggatctcgtgtcttcctggaccaggagtaaaacaacaaccatacctgctcgagcattccgctgcccgcagatcagctttttagatgtaaagaaagatcaaaaaaggacccaagtccccaacccggccacccgggcggcgccagccattgcaagaacgaacgaattggtggaagggagaaagcagaagaaaaaaaaatagagagaaagaactgacacgtgggagttagttggtagtgagagtgagagtgagagtgagagaggtggagttataccaaacactatatgacaaatttatggatctactctatgattagttcaaataaatcctagattcagattcatttttctacgctgacaaagagctagcgaacggacctccctgtttctcatctgtggcgtgctgccgttactgtcacccacctaataaatgcactgctgctgctacctaatccggtgattatctatttatctttccggttgatgcgtcattcaccgatccgatttcttcgtaaattatacttttccacgaagcttcatcaatggtttcggacctactactagtacacaaacttaattaattgttttgtagcgcaactgtgctgtgccagtggtacccccactgcaggacctgcatcgattactttgcaactttattgcaaccgatccaactgtatgggaaggaagccaacttttttttttctcacgctcgcatcagaactggctgtaatattttctatttttctttttctgaatggcgaagttaactccgaaagcctgtcaaaggtatgaagcgtgccaagttctcaatcaagtacacaggcagaatatgaattatgaagtgctttcagttattcagaagttgaaagcaatctctatcagctacacgtatacgtaaaatcatctgccttgctctacagggtagtaaacacctgtgggagcctggagccttgtcatcttcctgtacctgcggtggtcgcaaccacgcacaaataacaaattcacggcagctccacacgctgttaaataaaaaaaaaggacgacgaatctctagaatcgt

SEQ ID NO: 2678 - DNA, 1417 bp, Zea mays
  misc_feature (1)..(100): optimal_loci_73221_G1, chr2:131336210..131337626, Cluster 15
accttaccacttctattgttgatccttttctttttaagatcgtagtattagcacaatctatatatgctagtgctttggaaggtatcacaatcgccaaagacgactcgtgggtttgagataggaagcagccagagctgctcgtgcttgagttttacaacgataaactataactatagctataccggtcacatgtttctcttgttaattgctgctggccgtgatgcgatgacgacaagaatttgactttttttggcacctgctggcctgcctcattctagaaggggtcattgcactcactcgttataaccatctttcagttgccgaaacggtgatgtgtgttaggtgaagctgtcctgcaggcctgccatcatgaccgcatgcatgcgtccacattttatttgttcccattcgttcctttctttcttttattatgttttgttttatggggggtccttgtcatagccatatatgcagaacatttcagtacacgcctaactcatcgtaagtatatagtatgattggcgcgcaaaacatcttcgcttctctttatttttcctttggaaatcacagcatatatatttatccaaaggcatcatgcatgtgtgacttcccatttccatcagtgatcacatgtagtcgtgctgccacgcgtgtcggaaaagattgagtgagaagcgatttggcatgcagtgaagccagccgcgcgttgcattttgacatgtagaagaaaacaaccctgctgctgcgtgcacatgcatgtgctcaatgtgctctgccttctcttggtttatctacatgctctactgcttttggccgcagaactagctcgttgaagctaccttctgtcgcgcgactatgtcaacacacaaatggaggtcgcttgaaccgttggaaaatgatgctcggaaagggacggttgaggtcggaagatgagacggtgggagcaattggcaaccgagggtgcacgcagcagagccctttgccttggaaaccgtggcgctccggccctctccctgtccggtccatccatcgccacaaagccatctctgaccaagttggcgcctggtgctggctcgggccctttttttttatctcttttgcaagtgagctgattgtgatcattctgagtggtggacaaggcaggtcgatgcaaattcagaaggatcgtctcatctagtgcataagggcattgtataaccctattaattgatgtgtttcttgagatgtctctaaggtgttacgtgcaaaaaaatcaagatacgagctcttcatgaaaaattcgtcttttcacgactttctatacatattgttacttaattacattaatgttctaatgggcttagagttgtatgacgtattttcttagctgtcccatctcttctactttggaaaaccgagcaaggtgctttaggttgta

SEQ ID NO: 2679 - DNA, 1587 bp, Zea mays
  misc_feature (1)..(100): optimal_loci_7783_G1, chr1:40560830..40562416, Cluster 15
aaatatcattggattgatattgtcgtgcactttttatgatatactatataaatatcaagaatagtttctgttgtgggatgagtttgtatctgatatggagagattttttttttccttttcccaagggacggaatactacataggagtatagtctagtacagtacgagtaaacagcaggcacaattgggagtacagtacaggcggcaagtattccttgccggcttgtgcttggacacaagacggcagcagtgaggtgactctgctcccatcacgtcaattcaaacgttgcacgtctgttcagttcaggtctccttctctgctggtcacgttatctacagtaccgtggtatcccgtacacgcctctctgcacgccgtgtctcctggatgttctcccaggatttgtagctcaagtgaagtgacagatcaatctattcatctgccagtgccaccgcggcaaatccttgtggcggttgcaagtaaccactctgcaaacagcctcgcaggtcacggccagcagggacagccgctgcaaattattgtgatagttggtctcatcacttgtagcactatcagggaagaacgcgcgcgataatctttctgatgatttcttttttagcttaccatttggctccctttctatgtgccgtgctgacactgacaggacagagagagctggtgacgaaatagtacactagtttggtgcatagcgcagcagctgctctttccatgtcgattatacatcaatccctttgtccgttgcatatcatggtgtccaccgcgaggcgcattacatctcctttgctgcctgcctgcatgctcatctaagacgatggcagtaacaaacaaacagcaggtatttgctgccagtttttatattgctgtagaaaagaaaaccctgccgttttctttcgatgcgtcgtccgttgctttgctccggtctggcgtctgcccatggtgcagcaggtatttgctgatggatgtgtcggtccatcttgcaacagctccgagcagtacgtcggtcgaactgagctctctggtgccagccagtagcagagtagcggcctgcttggtatgctaccgcctagcggcaatgccagtgccgcgcgcgcttgcacgccctaccatacgggtttggacctcatcttctgtactgtacgtgatccgccatgtccgactccttgcgcaattcctcaataatccttcaccctggatggatgcatatgcatatgcatcatcggttattcggttcatgcctgtgtacacggtccagccagcctcgcgttcagaacatcctcgcgaaatgagagaatctgtcgtctgtgtacacgatcagccagccttactttctgcagcgcctttctttcctttctacggacaccagctccggctggcaagggctagcattcatggccaagtgatgtcacgtcggctctcctagttttctgggaaaggtcgtctcgcccactgtcagcgtcagcgcatggactccgtcctaacagctacgtacaggtttgtttacccactttttcttccggatgctcttctgatacaggttcagcactcagtacgcctctccaaatgtttcgt

SEQ ID NO: 2680 - DNA, 1964 bp, Zea mays
  misc_feature (1)..(100): optimal_loci_80591_G1, chr2:174601684..174603647, Cluster 15
tagccacctattgccccaacgaaaatgggtagggagagatgggatttgtgggggcaacaaatacagtggtagtttggtaagcgtcagtttgggagaaaaaaaagaattgggggagactgagggagctaaaacccttttcctgaactagtacaattgtctccattcaagaagagaaaagaaatagaataattataatgctcagcactcaacgaagtctcgagaatgactgttgcagattagcacttgatcagatagtgacaacgactcgttctgtgtttatcttcatttcatgagtaaagaaactaaagtttttccagcagcaacgattatctgtgttcgggaaaataaattaaataaaaagaatggcactgtagtgtggtcgaatcttcatggaatgaacaatgaagtgtagcggcaggtgggcctcagcagcagcttgcaaggcaaaacgttcccatcgcagagatgtgtatatatgcttgcttaggcttttgaagaaactaataaagcgccgacttaacagaactgatgtagcacccgccatcccaaccttgccgtgtcagtgcaaaagggttgggcacctgaaaaatcaaaaaaaaaatctacatatgtgatacctgaatttgtagtcgatgaatgtaattaaacagcagcgtaataacctattcgggagtagtatatttgtttcgttcttgggggtttagggttgagcaaagcttttgtcatggctacaagaaaacagaaacctagcttttgggcatcgatctactgtattttcgctttatcgatgcacctctcgtcgcagtcgtacgtgttcaatcacaaagctatatatcatcgtatcgctttcaattccgacgcggaataacactctcctcgctttcttttctttctctttctctctcgtacgtcccttccattgtgtttgtggcgcatcgcattcgatcatgttgcttgtgccaacgattgttttgtttttgttggcggatatagtatgcacacacagttctgttcaaactgtacttccatgtgtttctgttttccaggcgtgcactctgcacagcttctgcagatggccatgcatgtttgccagcccaaacgttaatttcatgctttcagcgaatatagcttgctaacgtccgcgtcttgaagaggtcgtagatacttcgccaccggacgccgatgatgatgctctgacagtgcacgccgaacagacggccggccgtatatggtcaattcatggtcacaaggcgatcggaatcgcgcgcgcagccaaaccgactgcaccgtcgacgattctcccagctctcgtagcccaatctttgcgaagcccaaagatctggttgcgtcaccttttcaatcaaccattagcaaagcgcacacgaaacgaaactgacacagccaacttggcaaacaagatcgggatgtatcggagaccagaaaaagagagagagaggaagaaggaaagcaggacctacaaggctcctacagcgccaattcagctgcagaatgaccccaagcaataatccaccagttcatcaataagatgtaatctcgactcctggtggtggggcgtgcgcctgatgccagctagatgcagaggtcggtagccatggcagcgggtgctagctagagctggtgacggctacaactacaatgcatgtgcggcagtgttaggtgtgcggtatggttggcgccccggtcgaaagagtttgagggcgacgcaacaaggtttatggactctccaaggcttctgtggagcggcaagacagcgacgacgacaatggtgcttggtaaggggttcggtatcatggctcgacgttgtgctggggagacgtagacacccagggtgaaagccacatgcgacggtgacatctatatggactatgcactggatgtctctttgcatgtgggtgacatctatggacggttgacgcaacaaggtttatggacgcaacaaggtt

SEQ ID NO: 2681 - DNA, 1479 bp, Zea mays
  misc_feature (1)..(100): optimal_loci_82477_G1, chr2:184400449..184401927, Cluster 15
taaatagggttcccaattttatgcattaccaggcatgaaaaaaataaaacaagacctcaggcactaccacctcccccaaaaaatactaaaagattgtcctgattattctcggataataaaattcaagtgccaaacgagcccatgaaacatcttcttgaacattcatcaagcctcttgtttgtttatacaccttaatgcagcattagaaacctagagccacatgatgaaataaattgtgcttgttgtatggatctcatattatgtatacccttggttgggcttgggtcgaattgataacgatcatttgggtcagatcatcaaatgaagatattcaaattagactattttaataataataatagtcgttgctcgtgaggcatagatttaccaatatgagttactactcataatattgctataaattatgataggaatatggtgaaacctagggtggaagctgatttctcgttgaactaccaaaatctgttgattatttagaatatgttctacaggaatgacaaaatacagtggagctgaacaaactggaacatttttttttcaaggagagagccagaacttttttagggccaaaatagagaattctctcagatttcaatgcgttctcgaggagcgcgcttcatcctgcgctgcaggcaggactcgcagggctgctgccagccaccggccaccctgtgtgctgcagtgtggagaagggcggcgtgcgtgacgcggcgcagtatagctgcggttgcagctgcacacctgcggcgccccgcttgaatgctcgtcacgcgccgggatcagctgcccctggttcgtgcggtgtgaggcactgaggccatgggaatggaacggtgcacacgaccgtgcaagaaccgagagcttgccgtgttcagtgtgctcggttggttggataatcttttcctttggagaaggggggagaaaatgacataccagtggcgttttgtcaagacccgacccaacggctcgcacagcattacaaacaggctctctgcacactggtcctgcctgctgcacgccgtaacgttgcctctggctgtttaggccgaccgacagcgaccccactcgcagcgctgtggccatggggacgccgacggcgacgtggacaggagcgtgcgggcgcagcggggcccggctcgcacgcccatccacggccgagaacggctcgctgacgtgcggcgctcaggctggcagcaggagcaggcagccagcagctgcgcccgcgctgcttgcaggatccgcggcagcgctttgtcccccctcacgcacggtatccgccgcggatacacagatgggatcggagctgcaagcctgcaaccttctcgcggcgccaatggtgaacggcgaatggctactgtgctactagtgcagagtgtgggctaggagtagcatatacgaagtcaaaaccactgagcctgtttggtacggccaacacggaggtggctagagctgtacaaa

SEQ ID NO: 2682 - DNA, 1530 bp, Zea mays
  misc_feature (1)..(100): optimal_loci_82591_G1, chr2:185010324..185011853, Cluster 15
cgtttgatgtgacccgagctaagctttagtccacagaaccaaacaccccctaaatagtaccgtctcctcgagatctgcgctgtgctaagtaataaacaggcagcgatccagcggcggcatgcttcattccttccttcctttacagtaaaaatgtcaatgtcaagtacccagctttggctggtcattactcattagtaccacaccaccggtggtggcagcgctagaacccgtgtgcattgcgatgccacgcaggaatctttctgtcagatcgatgacgctgtttcccagtgacgagtgagtgaaagagtctaggactgtgtcttcgtggtgattggcggtcctgcagatttcgctcggtcgctaggagcagcagctctgagaagaaataattcacagcttgggtagatttgttccccccacgcagcggttgggcctcattattgatttgttcattcaatgtgcacgtatacgatgatgtctcagggccggctgagggaccgcaggagggagggaggcagagctcgatcgggcggaactacaacctgggtaattaaaaaaacgaagtgcaacattgcatggtacacaacacagaactagctacaagtagatagcgtatgcatgcagtggagttgaactcgctcgctcagtggcggggctgggcttgttggttgtactagctagctaggctgctgaactgatgatcaggcagaggcaggcattcatcgtcgtaggacgtactactccgcatcgtagtaacacgtccctgcatgctcccgggccccggccgactatggactgcactgcactgaccccgtgggcacagtataccctatatactctcgtacgcttcctcctgtgtcccgaaataagtgttcgtcggtactgattttttttcaaacttaattaaatttgtaaagagtattagtaatatttatattatatctctcaataagtatataaggctctatctaactatattaattatatgctataatttataaatattgtatatatatagttaaagttaaaagtacttcagtttcttgagaaacaagaacatactcggtttcgatacggagggacaagtacaggtacagatacggcccatacggatccagtggatgtataagaatatactcctatgtagtagtagtacgtactaacgcactcgtggtgtgcttttgtacctccccctttcgtgcttttacttccggatccattcttgggaattgtgagcaagggtgggggctgcacatgatgtggacaagggaggcaacttttcaagaatcggaagatgcagctgggaacgcaagcacgtacaaaggaattaacatcccttactaccgagcgtaagtgtaattttagcttcctcaccatctagctctgcactctaagtattgacctcaattcaattcatatgtatttaggtacattaaggtatattaaattagtttaatttacacttcaatccacctcaatacatgtgtattaagatcaataatagagcatccaaactatgtctaactggaa

SEQ ID NO: 2683 - DNA, 2368 bp, Zea mays
  misc_feature (1)..(100): optimal_loci_827_G1, chr1:4451642..4454009, Cluster 15
cagttgagacaaagaaaagacataataggtgaaggttgctcctggactggttaatcggatgatcacctgccaaggaaaaggaaggtagtggagcaatggtagaaccatcctgcaatttgtgatgggagcaagcaagtattctctgtgtggtaaagaccgaacaacaatcctgctgcaggttttttttagttctcgggatagtgataaagctactactttcttgatagaagttttctcccacgtcctcctcctaatattctctgctctgctccgtgcgtgagccgtgagccgtgagcttcccgaaagaaagaacatggaaaaaatgctttactttcccagtaagtaaactctatcaaatggctgaagcaaaccacgggcactctgaagtctgaagccggagctagcaaggagtgcaaccgggcagcgcatcgcaggaatcagatctgaacgggaggccaggcttcggagatggaaaaagctagctgatgatgcctttggaggaacacgagtgtttggtcgtgtcgtgtgccagggctcatccggccgaagcactggaactccggaaggaagagctgtaatacatccgggaataaagtcggcattattgtatcgtgaaggctgagaaagaatggctgggaatatcggaaagcaggaaatactctgcctctgcttgcatgcttgctgctgaagttgcttgccccctcgcgaaacagctgcggtctgcagtctgcgaaagacaggggggtgaatcaagaggagctgccactgcctctgccagagtctgtatctgtctcttaaacaagcggtcgtcatatttcttccttgccatgtcccatgtattttggcgaggtagaaatgtagaattccgatctcagaagagcacggcatgttcttcagtgtctgcgtttcgttctgtgccgaaccgatgcacttgcattttcagagaccagagttttcaagtggatgatgtttcagactttcagttgccacctgcccaagccccgaactggcattctgcctgttgccagtattagggcacaatatatgccattttttccccttcctttcttcaggcgatgcggtgtgcaaatatatgctgcgaatattattacttcttttgctagaattccttgtgctgggactgggaatattagcaaggtgtatggtaataatgctcattcttatatcttgagacgtcgtggaaaccatgcatgcatgaggactggctaacacttgcacgaccagctgattcgacgtaataataaaccggataagaagatgcagagcagagcagacagacagtagacagatcaccaccaccgcaccgcatcgcatcgcacccgatctcaagttgctcgaatcgtctgtggcaacaaggcgtacgatcgggaggtggcggacgatcaagtttccactagtaaagcaagcgttgcagatgcagcgcggcatggcgtcacgtccatgacccatgcacgcgcatctgtgctgcaatgcaacatggtcgtcccccctatggcggagctagcttggtaggcgagtaggtagctaggcgagaacggaatccattccttatccagaacgccgcctcgttcttcacacggccgggtcgatggccgccacggcggatcgtctagcagtcggcgtgccgggctgccgatgcagccagaggccggctgtccgtcgatcgatggatcggagcagcagcctgcctgcaccgcaacgtacgtaacttgtgtcgtctcgtccggatagcttcgaatttatctctcgtattttacaggatgccggcagcggcaggcatgggggcggcgggcgtgggattcgcggcgcactgggcgcggccgcgacgcgagcgaacctccacgcagcagcgcacgcaggacccggcatttttgtttttttatgcccgtacgtctcagtccgcgggtgcgattccttggctactcgctcgcggtcgcggccgccggaggggaggaagcgggttcggtggtcgaggaattggttcagagagatcgcggaggtggactggacggggcgagtgatgtgatgtggccatgtgggcaagcaaaagctacaaggaagaagaagacgatcctttgtgcccgcccacgtcatctccattctcatctacggtgcccgtccgtcgctctcagcggccgtagcaactcgtttgtcaacaaataagaatcagatacaaattaagttagattttccctaaagtagataaatggtaatattaaaatttagatagttcaaaagttagatttaaactttgagactagaatttgagttaaaagggaaaatataagataaaacagaaagatcctcacttgtttaattgatggattatgtgtttaaaaaacattct

SEQ ID NO: 2684 - DNA, 1461 bp, Zea mays
  misc_feature (1)..(100): optimal_loci_82708_G1, chr2:185698902..185700362, Cluster 15
caccgcaagcgaccaataccgtcaaacccgccttatattacaacaccatgcaccccttctctgtcgatctccgtagctccaagcagatgctggacagtatttactcgagtgactgcacgtacggtcgatagatgcatgcattctcgttgaacacgcaacgcagacgcagccactactactgtgccaaatcgcgtggcgcgcagacagtttgcaagctgtcagtacgtcgtacatgtacatgcacgggaatatatatactcgactcgtggttctgaatacgtgcagttgctagaatcgaagatcgtaaatagtttcatttatatatcactgctttgtcgagacacacgtacgtacacgtagatgcatgcatgctctgcttgtacacgtcgagcgatcagcgcggacgccgggcaaataggagagcagccgtcgcgttgcgttgcgtatgcacttgatgatgagacaaccgctgtgggtctcacgtcacatgcctgtttgcaagcatgcaaccgagccaggagtagctagtgctgcgcgcggcttgcttgcaccagcacgacgccacgcactcctgcagtgcgttagctaccgggcctcttgcttgcagacaagcaatgtacagcatatacgctcggatgcatggcagcgtgcacgcagtccgtgtacatgcatgctagcttcatcagttcaggccgacgcaattaggccttcaataaagccagccgagctgcatgtcccttttttctcccatcacacacgtacgcatatatcatacatatatctaatgtaaaaaagaattagagtgctaataactcctctattagaatattttctaaagaaaaccatacgtttgtgcagaataatgcgtcaatgatggtgggattcacctagccatagatggtaaattcggtggacaggatttaatgttaacaacctaatcctttttactctatgtaaaagcaagtagcgtacgtgcatgcatgtgtgcgaatcatgggcagtttgattatttgcgatcgccgtcgccgagacgccgaagcaaacctgacgcccacatcgtcgtgacagatagatctccttttttttagtacgaaaaggggcggcggcagcagcagtggaccgactgatggatgcatggacgaaaggagaaggatatatgcacaaacacacaaaaaagcagcgtcgtttcctactagcactgttccatgtagacacagcgagaagctttggccggccggacctgtcaccaatcaccatgtagtagagaacgtgccttcagttttagatttcagtgccggttagtctatgactccgtccagggatgaatattacttgttctatatttattttcatattttttctattcggattcagattagatatgtatattcactacatcataaccagactattagtgacgacttttaagttaattagtgatacgtgtaaaacccatttcag

SEQ ID NO: 2685 - DNA, 1477 bp, Zea mays
  misc_feature (1)..(100): optimal_loci_82773_G1, chr2:185869253..185870729, Cluster 15
agagagtagttgttatgctggttggctggctgcccacagccagcctgcactacacctgatatgaatctttctgttggctagatgggtgagaggggatctggtaggccctaaagcgttggaatgaaattgtcagaggaatctagtttcaccatattgtgtttttctaaatctcttataatcggcttctatatatgtatgctaccgtgagagattgttccttatctagctagcaaggtaacacgtatagacccagagtttaatgagtatctgccaacctagtctccctgtaaccattcagcctctccaatcccctagctatcaacaaggtacgagtggcatgtgtacatgtggtacttgtgcagggaacagagtctcaacctagctagagaaaatttagcacggagccatcgcaccatgcacatatacatataccatgccaaagactttcacacggagcaaaaaggaagaaattttcagctcggcaccaataatcggtgcccaggaaaaggcacgagagacaagacaagaccctgctcggtcccggccccgctcggcgctcgtcgccgcctccttctgcctggtggctgggtgctggccggcggccggcctgcctgcagcttctcccggctggtgtgagtggctcatgccacgaaatttcatacacatgctgacatgcactatcttagagtacaattcttttgtcgcctcaactttctgtcgtctcaccgctcacgtgccgtgaacttgagaagaaacatactcgtgcttgtgcaagcatggggagactagactactagaagaaaacacgggcaggcagtaccgtataaataaagggacgcgcaatcaagcctccacgcacgtaaacaacatgagctatatacgacctgatggctacctcgatctgtcgcagactcgcagcacgtactatacttttccatttctccttcttcttctgtgccctagttcctctggacctttttgcacttttctttttgggtttcacttgacttgtttttttttcgccgttcaaatggaacgttctgatggaaaatgtgctctccatgaccatgcatgcatccggccagcatgatcgtcatgcgaatggaatagacacggcccatcatacggccatacactgaaagatgaaaacgactcaaacctaataatggcacacaagcgcgcgtgtgcaaatttctacgaatgaaccagtaatcatgtgtgtgactgcccattcgttgcaggcgcttaacatagaattaggatgacctgattggaagttggtttgctacgttgaattgctgaattaaaaaaaactcgtgtagcacacagtccgtgaaaattgctgaagctgtagtattctctgacgtccatgcaagcactgcttacagattttctaataataacatcactccaaatcgtgcagattttaggccgtgtccaacaatttacctatagaattatacaaaacaatattttg

SEQ ID NO: 2686 - DNA, 2437 bp, Zea mays
  misc_feature (1)..(100): optimal_loci_87345_G1, chr2:212412367..212414803, Cluster 15
  modified_base (862)..(862): a, c, g, or t
  misc_feature (862)..(961): n is a, c, g, or t
  modified_base (863)..(863): a, c, g, or t
  modified_base (864)..(864): a, c, g, or t
  modified_base (865)..(865): a, c, g, or t
  modified_base (866)..(866): a, c, g, or t
  modified_base (867)..(867): a, c, g, or t
  modified_base (868)..(868): a, c, g, or t
  modified_base (869)..(869): a, c, g, or t
  modified_base (870)..(870): a, c, g, or t
  modified_base (871)..(871): a, c, g, or t
  modified_base (872)..(872): a, c, g, or t
  modified_base (873)..(873): a, c, g, or t
  modified_base (874)..(874): a, c, g, or t
  modified_base (875)..(875): a, c, g, or t
  modified_base (876)..(876): a, c, g, or t
  modified_base (877)..(877): a, c, g, or t
  modified_base (878)..(878): a, c, g, or t
  modified_base (879)..(879): a, c, g, or t
  modified_base (880)..(880): a, c, g, or t
  modified_base (881)..(881): a, c, g, or t
  modified_base (882)..(882): a, c, g, or t
  modified_base (883)..(883): a, c, g, or t
  modified_base (884)..(884): a, c, g, or t
  modified_base (885)..(885): a, c, g, or t
  modified_base (886)..(886): a, c, g, or t
  modified_base (887)..(887): a, c, g, or t
  modified_base (888)..(888): a, c, g, or t
  modified_base (889)..(889): a, c, g, or t
  modified_base (890)..(890): a, c, g, or t
  modified_base (891)..(891): a, c, g, or t
  modified_base (892)..(892): a, c, g, or t
  modified_base (893)..(893): a, c, g, or t
  modified_base (894)..(894): a, c, g, or t
  modified_base (895)..(895): a, c, g, or t
  modified_base (896)..(896): a, c, g, or t
  modified_base (897)..(897): a, c, g, or t
  modified_base (898)..(898): a, c, g, or t
  modified_base (899)..(899): a, c, g, or t
  modified_base (900)..(900): a, c, g, or t
  modified_base (901)..(901): a, c, g, or t
  modified_base (902)..(902): a, c, g, or t
  modified_base (903)..(903): a, c, g, or t
  modified_base (904)..(904): a, c, g, or t
  modified_base (905)..(905): a, c, g, or t
  modified_base (906)..(906): a, c, g, or t
  modified_base (907)..(907): a, c, g, or t
  modified_base (908)..(908): a, c, g, or t
  modified_base (909)..(909): a, c, g, or t
  modified_base (910)..(910): a, c, g, or t
  modified_base (911)..(911): a, c, g, or t
  modified_base (912)..(912): a, c, g, or t
  modified_base (913)..(913): a, c, g, or t
  modified_base (914)..(914): a, c, g, or t
  modified_base (915)..(915): a, c, g, or t
  modified_base (916)..(916): a, c, g, or t
  modified_base (917)..(917): a, c, g, or t
  modified_base (918)..(918): a, c, g, or t
  modified_base (919)..(919): a, c, g, or t
  modified_base (920)..(920): a, c, g, or t
  modified_base (921)..(921): a, c, g, or t
  modified_base (922)..(922): a, c, g, or t
  modified_base (923)..(923): a, c, g, or t
  modified_base (924)..(924): a, c, g, or t
  modified_base (925)..(925): a, c, g, or t
  modified_base (926)..(926): a, c, g, or t
  modified_base (927)..(927): a, c, g, or t
  modified_base (928)..(928): a, c, g, or t
  modified_base (929)..(929): a, c, g, or t
  modified_base (930)..(930): a, c, g, or t
  modified_base (931)..(931): a, c, g, or t
  modified_base (932)..(932): a, c, g, or t
  modified_base (933)..(933): a, c, g, or t
  modified_base (934)..(934): a, c, g, or t
  modified_base (935)..(935): a, c, g, or t
  modified_base (936)..(936): a, c, g, or t
  modified_base (937)..(937): a, c, g, or t
  modified_base (938)..(938): a, c, g, or t
  modified_base (939)..(939): a, c, g, or t
  modified_base (940)..(940): a, c, g, or t
  modified_base (941)..(941): a, c, g, or t
  modified_base (942)..(942): a, c, g, or t
  modified_base (943)..(943): a, c, g, or t
  modified_base (944)..(944): a, c, g, or t
  modified_base (945)..(945): a, c, g, or t
  modified_base (946)..(946): a, c, g, or t
  modified_base (947)..(947): a, c, g, or t
  modified_base (948)..(948): a, c, g, or t
  modified_base (949)..(949): a, c, g, or t
  modified_base (950)..(950): a, c, g, or t
  modified_base (951)..(951): a, c, g, or t
  modified_base (952)..(952): a, c, g, or t
  modified_base (953)..(953): a, c, g, or t
  modified_base (954)..(954): a, c, g, or t
  modified_base (955)..(955): a, c, g, or t
  modified_base (956)..(956): a, c, g, or t
  modified_base (957)..(957): a, c, g, or t
  modified_base (958)..(958): a, c, g, or t
  modified_base (959)..(959): a, c, g, or t
  modified_base (960)..(960): a, c, g, or t
  modified_base (961)..(961): a, c, g, or t
ccatttttaacccgtttgaactgtgcatgaacagtatgtgctagcttttttaggtgaacgaaagcggatggagggggcccctaccttacgataaatgcacgtagaagcatattatatatatatagtataactcatgagttatactatatatcatgagttattctatgcgtgtgcgtgttgctttgacttcacgtagaagcattattgctagcttgctgcttgcgttgtggcgtggccgcatgggcatggcacagtatggggataatgggagtacgtgtgtgtgtgtgcgtgtgctgttacaatcctccacattgcatgcacgtcactgtctgtctgtctctcgagcaagacatgattacctttgttgaatcttttctcgcgcgtacgtactaacgttgttggattggatcgacctcttttgttcgtcgtttccaaagctaggcttgaaagatagagatctatacttatatataataagtatgtgtatatgatataaaatgttatccaaagacactgcacagagggaagtggctgatcgacactggtacagctgcatattatatacgcctttcttcatttcaccacgtacgtacgcatggaaacaatgctgccgtgttttttgtcgaccgtagatatataatacgtagctgccgtgagacgaaagccgttcgatgcccttctcctccttgatctccagcttagctagcatgcatgcatgggcggccggcaacggcaaggcaagctagctagctagctatagttgatcccttgccgtggaagcagagcagcagcggaaacaagcccaagctcacaagtcacaaggctttgcttggatcccctgcaacgtcgtgtcagtggcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccccccccccgccaccaatggcgacggacgacgtctggcggggcgggcctagaaacgaacgaatgcaggaagcctccagaaaagcgtctcctcccctcgcgggggggctggctcgattccgttgaaaaaaaaggcgcttcacgtgccccgcttttactttccccgctgccccccacgcgccggggcccgggtgatcgacgacggacggacggagatgcatggagccacggccggtggtggtgccgaccacatgggccggcctcgcagtcgcagatcaggctcggggagactccctcgacgtcgccggccgaagtggatacggtgccggtgcctcagccagcagcctccccgcctgtgcaggtgcagctcggtctggaccttggcctcggcttcagaaatcagaatgctgatctgtctgctcagagctttcagctgctcgcgtcgtgtatctcgtcgtatggtcgcgagtgagatacgtggacgtactggaaaaaggaatcgatctggcatctcatgactggtgtcagatattcgttcagggcagcagacgacaggctacgtgcacgtggccacggatactacgcatgaacgtggtcggagttgtcactcactgacacacaaataatgccttgcttgataccgcaccggaaacatatggcgtgcgtaccataccaacaacttggaaacagccgtttcctgctcaaaagtcgtcgtcgtcggcctgccactgccagcctgatcgagcgagagtgccacaacgtgacatggcattattcaaggggaaaaatcatgctcctcttttaaacacatatttcccaacattatcgaaattacagaaaatttaccgacatcaaatatatttttgatggtatatatagcttttcatttacacggatcatgcaggggctgatcgactgtcgttgctcctgctttgcgaattgcgatactactgcctacgtacgcgcagtatgggagcggcaacgaagagacccgtagaggcccaacttcgtattgggcttgctgacgtgaacgcggctaatacaaaacccgttgccctccctttctactccctttctaatacaaaacaaaagttcaggcttcattcaggctaatacaaaactcattgctggacttcattcagtcttgtaactgaaacaaaccacggttcaaacttactagtccctacctgctctataaaagaaaaacaacgtacaagctatgcatgtatgtaaattttataacaaagaagtacacgagtctgagtccaaaaaaagagagagaaaagaatccctcgtagtctttcagaagtcctctaatctaaggtaacaacgaggcttaagtggatgctttttcccatgcatggttttatgtgaaatcaaataaaaaggaaagtgaagtcgtctatattttcgagcaagtggttcctgtaaaacaaagacaactactccctccattccaatctacaattcattt

SEQ ID NO: 2687 - DNA, 3365 bp, Zea mays
  misc_feature (1)..(100): optimal_loci_92568_G1, chr3:2607966..2611330, Cluster 15
cgacaccgctgagctcgcactcgccgtcggctacatgaacctcgtgcgtgtcgacatgtgtcatggcgacgacaattggcacgcggggtcatcttcgtcgtccggaggctcaacgatgagaagggcttcacggtcgccgtgaagatgaacacccagagtagcgagatgcacatggacgaccttggctgcgcgtcctgcacgaagggcgaggtcagcacgcaacagctctatctcaattctcaattgaagtgaagtacttattgttagtaattgaaatgaagtgcttatttttagtgtttgacagcaaaaattgtatcgactcttattcactcccactccctctgtcgtctcactagtccttcaaatttcttcacttccatgtggttccatgtataccataccctctttcagctgcagcaacatcaccaaaattgtataaggattactctcttttttctgaactgagacgatgatgttcacatgttgatatttgatgaacagtcagggttctctgaataaacacctcatattattcaggttctcaacttatgttaccatataagattaatgtgcatttgagcctccttcaaagattgttactctccttcgtcacagcttcatcctcatgtatctccttgtcactattgattcaggtgattactgtatgagttttaagtcaagattattagagttatgtatgaaattaggaaatgcagcgccatgttttttataatctaaaaaaagcgcctttggtagccctcattactgtggcatcctggtgcagcggaatctgctcagactgtcacactggcccgacggatgcagtgtgtgtcatgtggtttcatcacgtatcaggctatctgctcaggtttggtatacagtattcgtttacgaaggcaaccaaacaacatctgggcttttttttcataccataacgtccacataaaatttctggattttcaatgggatttttagttgtcaaaattctttctttctttctcacatcttcaaaaaaatactatagtcatcttccaaaaaaaattagtattagtttcttctcttccatgtgcttctctctttgagctgcagcaacattaccaaaaatttgtcaaaattctggagtttcttctctttttgatctgcagcaacatcaccaaagctgtagaagaattactctctctctttttctgaactgagaccataatattcgcaggttggtgtttgatgaacagacagggttctctgaagaaacacctcgtattattcaggtccccacctgatggtagcatataagattgatgcgcatatgatcctccttcttgaagccttgcatttttctgatcttttacaagtgttgagctgtctaaactctaccgtaccataacatacacagaaaaaatctggattgtgaataggatctttagctgtcaataagtttatttcattctcacatctaccacacgactgaaggctaccattctataaatctacctaacggtacgtaaacttgcctatttccagtttccaaacaagctggtctttaccctgttccaaacaaattagcaaggtcatccgactttcgcgatatcacccacgctgaaacctgttataaacttgggttaataaataaattaaatacagacacatgtagtcaatccataggaattgcttgttaagctcgggtcaattgatattgatccaccttcgtgtgagagctgaagacatttccaagcctctaacctcttgtcgatctgcttgttaccaggaccgctcatcttaactagtttgacatcagtggttggaattcaaaatgtatttcttaggtagatgggctaatatgcgatgcaactggaagcagctggccacttggttgcttccaattccaagtcactcacgcacggtccctgtgaataccctctggcttgttactacagtttgtttgccggcccgacgtctcaaaggagcacgaaaaggccgaaatgacggcccatctagaagcggcctgaggcgaagaatgaggatactatgacgcttcatattttaccacatgctgttactgttactgttactgttagtggatggcagagaaggctgtgtctatcctctgaaacgggaccaattgtagcggagcagcagagcagatcctgcacgtagcagcaaccataccatgccgttcctggccgtggccgccggacatcgctgggtctcgtgctcagctcgggcaccattcacttgccaaaaaaaaactagcattggtggtccggcgctgtgcgtgcgtgcgtgggtgcatggtcatggttgctcgctggggtgggggagggcgaccacggcgtgctggcgccgcgctgctggggtttgtggcttttgcgacatgtagcagtagcactgtggcctgtgggctgtggcaagggccgatgagtcggcggcaaaagcaccgtggtcctgtatgcctgccgctgcccctgctcctgctccggtgtgctttctcaggccagcatgcagcaccggatgagggtggcctggcagtggctgtggcagtggcagggtccaagctccatcatttcgtttcggcgttgagacgccgggccaaaccaatgccgtgcatgcatatagagctgcgcgttgtgttgcaccaccagcgcatatagatacatacatacatattcggagcacgcttttgcaggctgctatctatctatatatataagtaatctggccatgccggccggcgattgatccggccaccagcatcaccagccagagtctcccatcccctggccgccgcgcgcagctcgatcgtgccgtcgctgtcgccacctgctgcatcgatccacgcatgccaacgggaatccggggacacgtaactttttgccttctccttcctgtcgcgcctgccgacgtacaagcaaggatgcaacgcaacggcacacacagcctcattcctggctccccggcgacgccgacgtacgtgacggcggcagcttcctcttccggttccggcacgacgacacagtgctctcgcatgcagcgctgtaaccaaaggaaactgcagcctcggcactgctgatcacttgccctgctctcctgctcgctcgttgttgggttggttcttcgtacccgtgtctgtgccgtacgacttcactgctcagtggcggtagtacgatctcgagctggagctgggtgggctcaaaacaagaacaacagctgctgcatcctgcctgcactgcagtcctactcctttacaacctgtaacaggatattcacagagtggcccaaaagatcttctcatcaacagctagtacgtaccgctagggccgccgaaatctactacagtaaagccgtagtactatgtatgatacgaggag

SEQ ID NO: 2688 - DNA, 1631 bp, Zea mays
  misc_feature (1)..(100): optimal_loci_92850_G1, chr3:3986741..3988371, Cluster 15
cttgcgactggcgaggcaggcaagagaaccgagacgacgtcaaaggtagcacgtactagcagctggggcaggtaccgtaggtttgcactttgcaggtggtccgcgcgacggggatccagcagaccggtttgggcacgtaccgtaccggggctgatgaacggacggacggcaacatctagcaggcgtagcgtacgtcgtcgacgtccatgtcgatggatgggctcagggctgtggattggcctggccgcgcgtccaggttcatggcacgctgtcgctgccaacgatccagccacgcacgcccctctcgttgcctctctcatgaatcacgagcagcaagctctgcaccatcgcacgcgcgcgaccgagagagcatgcagtcgcggtcaggtcagcgagacggagacggcgtacatcggcgagcagtggccagtggaggaggcggccacgcgtcccagccctggcgcctggaccaccatggccggggcgggctcgttgccgtggacccgtaggggtctcctcctgagtcctgaccagtgacagctgaccggtgcagtgcagtgcagtgcagtgggtgggaacagcgccgccgaccgcgcgggccagcctcctccatcggcggcccatcccatcccatgcgcccgtgccgctcgctcgctcgaccggctcgggtgagtgggtgaccacggcggccgctggacgctgagggcacgcggaccgtactacatgcattgatgcatggcagagcacgacggacgacgtccctagctctcgccatggctctcaggagctaccgtacgtaaacgtaacgtgtccgtcgcacccgcttccattccatccatccgtccattttcctctggtcgccgtcgccgtccgatccagcgccaggcaagttgctgccgtgcgtccgtgcatgcatcatgcatgtgcacctggagcaagccgccgatgagctcgcaggctagaatacaacaacaacgacgtcgacaagcggccggacaacgagagcgcaggctaaagtacaagcggctgttcactcaccaagtgtcaactcgtaggcacggccaccactggcctactaccgtgcgttctccctttctaaaagcaaggctacgatgttcataacggttaaacttttcaaaatattttaattagttttacaaacaaaatagtaatgtttatatatctaaatatattttattttaaaacagaattaacaatgctacattaatattctatgaacaattgaacagtcatgcgttggcacatgaaaaaagcgaaccaccactcccgcgggctgccttgtatcattgtatggtcctggtttttaagcacacgagggagggagggagaaaaggaaaccgtcgtcccttagatgaacatgaccattcatgcatgcattcatcatctcaggtgtcccatgcatgtcacatagccagtcctgtaggctacagtacgacctcagaccatctccaaacaggaatcatataggagagaatctcttaaagaatacgataaaaaatagatacgggggatgaattgaatatacaagatattgttagagacagtcttatcatactcagctactgcaatctttgcaggctacattgctgctggttcggtcaggtaggtga

SEQ ID NO: 2689 - DNA, 1553 bp, Zea mays
  misc_feature (1)..(100): optimal_loci_93279_G1, chr3:5878975..5880527, Cluster 15
cgataaattggtggtgatcctcggcactgcttcttttttgcgctacacaaagcgaagtgatataacactgacagacattgtgccgagtgtatctgattctgtgtctctaggtggtatagttttgttgcttactgttcaataagtttttttatagcaaactgatcttgtatgccagtattttctatatactcatcatcatgctatatatatgtgaagtcataaatgtgttgttttctttttctagattaaattgatgtgcccaaatatctactaacatgagagagtatcatttctacaattaaggacgtacctttgttaaagtctaatataaattaatccaaaaaaaatacaaaaactcgcgctcgtgaacagaatttagacaccgcaataaatctaaccagctgagatgcgctcaattcatgatccgtgctgttttttggtgcatgcatgtgtttgcacctgcacctcccatgtattttagaattttataattcgagctacaaaaccaagaagacgtcgtatgtccgtatcactgcaggggagctgtaattaaggcaaccataaaactgaacggcagtatactgtcaaagcttttatttcgtgtgtgatcctcactgaaccacgactaaaagaagtgatccaacaaccaagaaataacgctgctgattgatgctcgtgggcgctatgcatgtatcgaggcgaccagtagtgcaaagcgcagccagtcaacgctgatccgacacacgggcggtacaaaaccaccattgggcattgggaaaaagaagaagaacaaggagaagcaagctgggaggactccaacagggcaacactgtcaacgatcgacaaaggcagcccctcaacgatcgaccagcgtgtgcatgcacatgtgcactgcttttcattcaccccggcccggcccggccgcccccggaaagctcgaagcatccgagagacgatgacagcggaatggcgcgcgcgcgggtcgtcgacctagctagcagctagcagagacggctcgagctcccatgcatgcatgtatatgcatgtcaacggctacaaaagtttgggctttctatgcgtcgtccttggccttgaccggcctgccccgctcgaccgatctccatcgacgctctagctgcctctagctggactacttagttatgagagagacgatcgatggatgtccggtgtgcgtgctgtagctacagacgctagagactagcgaccgagggtgaacagctagcgtgcgtggcatggcatagcatggcatgcggccatgcccattccacagtgtgcgggcgtgggccggggacgctagatggagagcacagctaggcaaaagggggtgtcgtcgcagccgcgtagtggataggagcccccacggaaacaagcagagagagagagagagagagcttgcattgcatgcctcgcggatggacgtacgccaccaccagaccagagcaaagctagctttttgcttgccgcgtccactgcaaagaagagagagcgtgcgaggggaaagcagccgagggttattaggctttcgtccgaaa

SEQ ID NO: 2690 - DNA, 1759 bp, Zea mays
  misc_feature (1)..(100): optimal_loci_94184_G1, chr3:10462255..10464013, Cluster 15
tctctggggaagtgtatctccccgctatgtctctcggaccaaatgtcatcttgccttggtcaatatacagatacatggtatacccgatcttccgcatgtattagccttgatcgatctaagcctagcctctaccatcgtcattcttagtccattggtacgtcatgtatttttcttaaccatcttaattggtggtcgtcaaccgtctctatactccacatgtatgtacttacacaaccaaaacacatgctatttacgcactcgcatttaaatcagcctcaaattaaactggacaaaaatataattgtatcacgacaattgatcactcatctcatcgtacgtaagtcaacgagtccgtcaaaaaaaaacaagaggatggagctacagcgagcgagtgaatggatgacgagccaagttttactagtaggacgtagtactacgctacagcgccggccgggtaagtaaatggggagcaattaattcatcatcatcacctggactgctggagggacgcgggtacagaattggccctgtcattctctcaattcctcctcgctgtcagcgtcagctgcagacgagtagccattcaacacagcacaggtggtggcgtaaaggcctttgcagggccagacggcagaggacaggcagtaagcaacctgctagtgctagctaggactaggagtggtagtatttgtttgcatggatcgcgcgcatgcagtctccgtctggccggcgaatagattcttcgtccccgatcgatcaagctcaattccatgcgtgcatagccgcttgcgttgttgcctctgagtctctgactgactggtatacccaatcctcttcatcccgtggaatgcgcgcaagggaaaaaaaatggatcgtcggagctggaagccctggactcactggagttgctataggagcgatcgaggcgagcgtcggacgctgtaggagctgataaggatgggcgctggcggcggcccctcccctgtctggcgcctgccgggcggtggcgacccaccgcaccgcagcagcagcagcagcgcgccggcacggtggggccgccaggcgcccgccacttcccccggtgcccgctgcccccgttgcgacggacgacgcgatcgacaggcgcggcacaagcgcgaccaagaatggaccggatccgtcgtcgtgctcgtgcctcccggttcggcgctcgatcggcggcaggagcaggacgtgtggaacggggagcgccagccccgcgcgagaatcctgctagcgctagcgattgccgtccgcaattacgccaccgcgaaaaggccggggaaaaaaaggtcccggtcgcggtctcgtccgatctgaacccgatctccgaccggtggttatccggatgcctgcctgcctgcctgcctgagcgtgtggctttcgcctccgacaccgcgcaacatgaaggaaagcgacgccgtccggccgacctgcgtgtgcgcagccgctgccgctaatctctatatatcccgtggcctaataacgggatgcctggcaagggggggcaccgtgccgtgccgtcgccgtcgtgggccgtgtggctgtcgcggcgccggtgccacctgtacggtgcagtgccgcgggcgggcaggggcaggcagcctggtggtggattcatttcgtttcatttaacctttctgcccgcaaatacgcgtccccccccccctccccactgccggtacccgctgtgttcgtccggacacaagttactgctgccaggcgggcgagcagagcagca

SEQ ID NO: 2691 - DNA, 2024 bp, Zea mays
  misc_feature (1)..(100): optimal_loci_94189_G1, chr3:10465320..10467343, Cluster 15
cacaagttggcgccggccggccaccaatcatttcctcccagatgacaatcacagaggaggctactttactttactttacgaccactactgctacacatgaatgactggatggatgctgaattatgcatactcctacattactattattgctagacccagcctggtccagtccagctagccagccttgtggagattctccaagatggcagagagagagagagagatgtgatgaaaagatttggtcacgttcgcctagggaacagcactgcagcagctcagctgtacgcgctccattccacggtgctggccctggcgtgctgcggcgcggccagggccaccagctcgagcgagctgagctcgaacggatcacagagacacagagaacagaggcagaggggccaccaggcagccagccacgccacgtacgcgtacggacgggatcaagtgctcgcgtcgcgcgcgccccctccgtccgtccctccgtccccatccctgtcccctgcaatgatccggcgcggcggctagcccagcaggtaggggcagcccgcagccgccgcgagaaacgagagccagagccagccaaacaacgtgggagctctgccaccttttcacccccccggcccggcgcgcgtggtcgtggatggatcggtcggtcgagcgccaatgtagtagccgcttcgtcctgtcccgaccggcgccgcggcgcggactgacagcaggcatggcggctgcctgactgagtgcctggctgggaagtgggagcgggcggctgtcgtctcgtctaggcatgcatgcagatgcagatcggatcgagctttgcggttgctcgtgtccggattctgatgtcaacagcgccaacagtgggaagtggttagcgagcgaggggaaattgtcgatctgacgtcgttgggacatcgaacatgcgtgccgcatggcgggaaagcaggggagaaaagtcggcggtcactccttgacactgcgctgctctctgtgtctgtctctgctctggtggtgagctcctttaaggaaaacagcagatgcagctgttctgctgcagcgcccagctgagtgtttatccagttggagacgagactctagctactgaattgttcgcctcgcctcaggaatcctgttccctttgcatttcctgttccctttgcattttccattaccatttcagcaaccaaaagccaccttcgagtctcggcctatcactggtttcatttggtatggtttgaaaatcagcataatgaatgtgctctacatataaaaacgtaaaaaaggaacagtctagataacactcaggaatctaagatctaactaactatcgctattctctgactgttataccatgatccaatattctactctctctctctccccgtttacaataaatctacttctaatgttcaagatttttatcccacagtaagtgcacttatggttcttgtcccagacataaccagtagaggtttagttatttttttagttttaaaagtacatacactacatgtcatgacaccttttgtaggggcacatgcgccatttttttctatcactaatttgtgcaaagacgctcatagaatatattacgcttatttttaggacggatgaagtagttttctctgttatatgtctagtaaatattttcttgattgtttttcaaaacgaaaaaaaatactacaccatatttgtccatgtacatcctccatgagggagtataatgcaatcttataatcatcaattttgtgcgcttccgctttctcctaattaactggtcgtgcccctgctgtatatcgccaccatcgccctttcccctgccgatgcatatcccacttccatattgtctttgtttccttcctcttgaacccttgttcgttagcaagaggattgtagaagattaaagtcctttctatttaatttttaacagaaagatatttaatcctttgagtctacttctaactaaacaagtcttgattgtttttactatttagggttggttgaaaaggagcgcaacaagtaag

SEQ ID NO: 2692 - DNA, 2442 bp, Zea mays
  misc_feature (1)..(100): optimal_loci_96446_G1, chr3:23018790..23021231, Cluster 15
gacaagtctggtttccctggaaaatgtctcggtttcttttggccaacgccgcgtcctctctgatgtgtcgctggaacttaaacctggaaaaattttgactttacttgggccaaatggcgcaggtaagtcgacactggtacgggtagtgctcgggctggtaacacccgatgaaggggttatcaagcgcaacggaaaactgcgcatcggctatgtaccgcagaagctgtatctcgacaccacgttgccactgaccgtaaaccgttttttacgcttacgccctggtacacataaagaagatattttgcctgcactgaaacgtgtccaggccgggcacctgattaacgcaccgatgcaaaagctctctggtggcgaaacgcagcgtgtactattagcgcgagcattgttaaatcgcccgcaattattagtgctggatgaacccactcaaggcgtggatgtaaatggccaggtggcgttatatgaccttattgaccaactgcgtcgtgaactggattgtggcgttttaatggtttctcacgatctgcatctggtgatggcaaaaaccgatgaagtgctgtgcctgaatcaccacatttgttgttccggcacaccggaagttgtttccctgcatccggagtttatttcaatgtttggtcctcgtggtgctgaacaactgggtatctatcgccatcatcataaccatcgtcacgatttacagggacgaattgttttgcgtcggggaaatgatcgctcatgattgaattattatttcccggttggttagccgggatcatgctcgcctgtgccgcgggtccgctgggttcgtttgtagtctggcgtcgtatgtcttatttcggtgatacgctggctcatgcctcattacttggcgtcgcgtttggtttgttgctggacgtgaatccattctatgcggtgattgccgttacgctgctgctggcgggcggtctggtatggctggagaagcgtccacagctggcgatcgacacgttattagggattatggcgcacagtgccctgtcgctgggcctggtggtcgtgagtctgatgtctaatattcgtgttgatttgatggcttacctgttcggtgatttgctggcagtgacgccagaagatctcatctctattgcgattggcgtggtcatcgtggtggctattttgttctggcaatggcgcaatttgctgtcaatgacgataagcccggatctggcgtttgttgatggtgtgaaattacagcgagtgaaattgttgttgatgctggtgacggcattgacgattggtgtagcgatgaaatttgtcggtgcgttgattattacttcgttgctgattattcctgctgctactgcgcgtcgctttgcccgcacgccggaacagatggctggtgtcgctgttttggtggggatggtggcagtgactggcggtttaaccttttccgcggtttacgatacgccggcgggtccgtcggtggtgctatgtgcggcactgttatttattctcagtatgatgaaaaagcaggccagctaatctatcgctgaacacatttgtcggatgcggcgcgagcgccttatccgacctacggttcggtatctctggtagtcctggtaagacgcgaacagcgtcgcatcaggcatattgccagtgccggatgcggcgcgagcgaccaatccgacttacggcatttctggcggcgttatgccaaagtgattccacgcccgcgtcgtcgccatacgcccacgcggtgtacgctgcaaaaagccttgctgaatcaaataaggttccagcacatcctcaatggtttcacgttcttcgccaatggctgccgccaggttatccagacctacaggtccaccaaagaacttatcgattaccgccagcaacaatttgcggtccatataatcgaaaccttcagcatcgacattcaacatatccagcgcctgagcagcgatatctgccgagatggtgccatcgtgcttcacttcggcgaaatcacgcactcgacgcagcagacggttggcaatgcgcggcgtaccgcgagcgcgacgagcaacttccagcgcgccgtcatcactcatctcaagccccataaagcgtgcgctgcgactgacgatatattgcagatccggcacctgataaaactccagacgttgcacaataccaaaacggtcgcgcaacggtgatgtcagcgaacctgcgcgcgtggttgcaccaatcagggtaaacggcggcaaatcaattttaatggagcgtgccgccggaccttcaccaatcatgatatccagttggtagtcttccattgccgggtacagcacttcttcaacaactggcgatagacggtggatctcatcaataaacagcacgtcatgcggttcaaggttagtgagcatcgcagccaaatcgcccgccttttccagcaccggaccagaagtcgtg

SEQ ID NO: 2693 - DNA, 1689 bp, Zea mays
  misc_feature (1)..(100): optimal_loci_337001_G1, chr10:77188319..77190007, Cluster 16
atagtatatggctgtgctgccaacgctctgcgcttcactaactggctactactcgtacctgatttgtatttgtatttcctcctgcttaattgcccggttgccagtagcttgtgtgcattattgaggcgcggatcttctagctaggtagctagggcatctgtccggtgcactgcatagagctagagagttggtagctggccgtggggagtcatcctgatgtgcggtggctgtcatgtagtagtagcactaacattactagctagcatcaccggccgcgccggtagtgataccaatatcaacaagcaacaaagcgagtatagcagaatgatcgatgcggaatgaatataatgcctctcgctcatcactagctactagctacagctgctcttctgcctactgctgcccagctaattacgaagaagaagaagagctcggcatcggagatgtgttttttcaatcaaggccggccggctggctagagcgaccttgttcgtcacgaagaagagctgcgagactcgatcgtgagaaaaaataaagcttttgagtgccatggcatatgcagcgcgcgtgaagggaggagggcccgcggtcaccggcggtggatgggatgcttgggttgattcgatgccatgccatgttccgcacatgcgcggcgcatgtcgtggcgtcgggcgagagcgagatgccatgcttggaagcttcccttgtccatcctggcagcagagtggctggcggcacccaacccaacaccagacaaagcaacaacccggccgacccgagaggcgcaccatcgcgcgcaccgcgccgaatccatcccggcccattccgtgcgcacaccagacctgcagaaggcagcagcggcacgagcacgacggaccgtcaccgccaccgccaacggtaatcggttagctcggccgtcgcgccagccagccgcaccgacaccgcgacacgctcccgcggccttcgagaagggagacgcgcgagccgatcgtgcgggcgggtcgggtcaggggcggcgctttccgttagtggttggcaacgtgttatcaagagtatgtaggcctgccacctttctctctctttctctctctctctcactgtgtgtttatttttggcgcgagagggcagccgggcagcagaggtggactgctcgtccgtgatcttcctcgtccaagctactcctacataccactgccctgctggccacaatgtggtaaccgtgtgtgtgtgctgtggcctattgcaatccacccacagcagcagcaagctaggtgataaggtgaaacacatcgcatcgcgtcgtggtcgtgggtaggctaagctaacgggcaacatgtacttggcaacggtcggtgtggatgcctgatctcgacggaggtgacgtgttggcggctgtatgtactcgtgccgcacacagttcgttttgggagagagagagagagggtgcatcgtctagagctactgcgcagcacaccgtcttcttcttcgtctcttttgagcatgacgagtcatacataataagcttaattatagcccggaccctcccccccccccccccccccctctctctgctcctagctagaagccacgtgtgattggacagatagattgcacgaggtgacgcacaaacggtggttactgtgtcctccatggtcgtgtcgtgtgtgtctagctgcagggtcgttgcag

SEQ ID NO: 2694 - DNA, 1704 bp, Zea mays
  misc_feature (1)..(100): optimal_loci_1125_G1, chr1:5652779..5654482, Cluster 16
cacaatctattatagttcaacagagattgtttgtccgtcaccggccccgcgatctctctttaatttggagccttttctttggcaatctcgaactgaactgacagcacaaaggttatgtgtgcgttgcaagtcgttttcgtttggtggaggaaaggcggcgcacggcgagagagatcgatcctgcagcatcctacattcctactagcttggcgtaagcggcaaaaaggaagctgccttatgtagctagctaggcgaccaacagtgaagcctagctagcagctttcgtctctctatgtatatccatatatctcgaaagagtacacgtgagcgtgtgtgtgtgttacagtaattaacagtacatgtgcatgtgtaactagctagatagcttaccggcagcggcagcactgtcatcagctccccttgaaggaaaaggctgttttgcctttccttgtaaaagctaccgcccaagtgtgtagcttgagctatagcgacgccgcgtgagtgcttatggttgttatatatgacagtacttgtgagttgtgacatgctcaaaaaataaatgtcacacgcagtggctgccgggggcaccagtgtggtgaatttggcttggcggcaggctagctagcttaaaacgaactagctacactccgctagtgtgatgtcatgtgcttgtatataagagccagaaatgcatgcatgcatgcatgactgcctgattatctctactagctttggctagctagctagtggatggaggggtgaacggcaagggatggaaatgaaatggcgaatatgcatggatgcaagttaactatcccaaagtaataaacaagccgtcagtgagccgcgatcatagtattgttttgtctggtcgtcctacgtggcggaataaggccggcgcggcgatggcgtttggtgaagcgaaagggaccgcccgctggcagcctggctactggtcaccccaaaaaaaaaaggagcgccaaaaaagggtaggtgatgtatataggatagggaagagatagataggtagagatacttgtggcacactcttaccacttttgatagtacacatgtgatgtgagtgagctgtgagcatcaagcttcttgtgtcgcgcgcgttccatctcttcttccttcactcctcccctctctcatgcacactcctgcctgctcctcctcgcgctgtacatgcatgcatgcatggcctctcgatgattccaggccatcattcattgcccgatcacctccgcgcacttcactcctcccaccctgccgttccagggcatggagcgccatggtgctgtgtgcgtggctgcatgcatgcatgcctcacctcgaacggggaagatcgatcgatcgagcatggcaatcagttgctagacgaccattgtgccgccatgccaatgcttcattcatgcacgcacgcatgcgcgggtagctgactagctggtcacatcgacgactgcagaaatatttattgtaaaaaatgaaaagttgctgcagtgctgctggatatatattgtaaaaaagggaaaataaaaaacagaaggtagtgcgtgatattaatcttcttcatcttcgtcggcggcggcggcagctttagagaaacaagcttcgctgctttggggctttagtttcgtatagaagtggcatccgggtttaatgtccctttagttttaggtctaacgtctaacactgctgact

SEQ ID NO: 2695 - DNA, 1461 bp, Zea mays
  misc_feature (1)..(100): optimal_loci_118782_G1, chr3:165863059..165864519, Cluster 16
aaggacggaacgttcggcgacacgagcctggcgagagacacgacaccagctggttggttcgcacctctttccctgctgcgcatgcgcatcattgagccacgctgcctttggtttggaactccatgcacgcccggtggcatgcatcgtcctattattcggacgaacgaaaaatctttgaagtaactttgttgtttaaacagttacattacatataaccacaaccaccacgtgcgcgcgcgtatatatgcatggtcactggttagcttctttatcattttccaatttccagtccatcatgacctaaagatatatatacttgcgtgccgggcttccggcgcacgcacgtctcgatgcctctgatgggcaaccggccgccaaggggaatttccacgcggctgggcggtgcagaaaaagggcatctaattaaaaacagcagaagcagcagtgcactgcataaaacattcagattccctcactctagacttccgactgacgcgtcgtgtggaggccgcaggaaattctggccatcggaatctgcatgcctgcatctagagagagatagagggagagggagagttgggaagagcctgccaggaaacaggcaggtggcttcatgcatgcaggttctcgcacgagcttgtagtgcacaataatcggacgatctattcctggtcctgtacactctaggctctagctgcttccttgttgcagcggatggcttgacaaattttcctgccctgtccgctggatgaacaagaacagctccggccctccaaccttccatgactccatgttgaccagacatgcatgtctcacgctcggttaatgttccacggcccaggagaataaataaagcatgtctcagcacagggtatataatatactaccagtgtttgtcccggaaaggaataaaggcgcaattcccatcagcccatgtaggaacaaagcttggccccatcgagcaacatcgaccgggtgcatgtgtgcaatggatcaaacgaggaatagaaagaatgaaacacggcattatattgcatgcctcacaagtcacaacgacgtcgcagccctatgccactgtggtagtaataaaaagtatacagtataaaaatgtcgttacaggccctggacactgtccagcactgccgacatgattgcaggcagatctttaattagggcgcgtgtgaaattaagcacaactcgtcccgtttggaagcttaagcgcgaagtatattcccaactttgagtacaaagtggacagtgtctttgttgtatggttgagaacggagagggactcgatgcgatgagcacgtacgacgatagatagggcatccccacagccgcctctcgagccaccactactactccatatcttatttttaccgtcagttcacaatcgccgtacttgacggccgccgacgcttgagctcgatagctgagcgctcacgctattactcacttcta

SEQ ID NO: 2696 - DNA, 3455 bp, Zea mays
  misc_feature (1)..(100): optimal_loci_119309_G1, chr3:169213181..169216635, Cluster 16
tttgcacctatttatatgccctgagagctattcatatgaactattaaatctactaaggacactgttgtcttttcctttcgtagtcttgttgaccaagtcatgaggatttccccttgctcttgctaacttcgtcgtcatgcatcaactccaatgaaactaagtttatagcttcgtctttacaattgtgaaggctacacaccatttcgaaacgaaggtgttcttaggtaattaccttattatacctgaaacagacttaggaataaccggtaagttagtgttttaatgactttggccaaagaggaccccaataggggcgacgaggcacgctgcagtgtgtgtggcctacacatccggccatggacggtcgtgaccgagtgggacggtggtcgccaaacccaacaagaaagatggagggcggagtcaccgaggggaaatgagaggaatccggtagaccaaaggatccggaaaataagagtcgtactttacgagtacacacacgatcgccgaatggtttttaccctaacgtgccacttattgtgtagggctggccaagagacacggccggcgtgccaggccatgtggcatgatgggccaaaagttggagaacgacctagcctgccaaacgctctcgtgcttttttgtttcggaccgtgctcagcttggcccctacggcacgacccaaacttacagtaccgtcccctccctgcatcacgattgtcttcgtccggtcctgccgtcccatggcaaccgatactactcccgaggagtgacgatcgatcagcacgactgctgacggttgatgtggaactaggcaggttaaaaaaatgccaggacgaggaaacacgcaatgatccaacgacaggacagtggacaggaagcatggtacagtagactagtacatgtcctgccccggacacacgcgctcccatcatctccctcccattcagctccaagattagcaaacggccgggttgatgtggatagcaacctggctgtgtgtgtacgagatttgtttccttactactgctgctgatgataacaacagtaccatgattagcgcgagcgatggcgcacccagcggcagcctctccacgaccacgacggcgacggcgaccgaccggccccgcgggacaccggagttgtctctttgcaggtacccgtacccagtagcggtactcatcacgctcctatctgatgtttttaacccccccaggttttcacttcaccgctcgaaagcgttgggtacttcctatttctttctttctttcttctatcaccgctccacgccacagggtaagtactgctcacagcgccagcagggtggcaggtgtgtgcagtccatcctcgctgacactagcattgatctttgttttggaacggagagagagagagagtcgtgggtgatcccctgaccgatccgcagccggccgcacgtttgtgagtgcctgacgagacgcgtcgacggtgggtatggggtacacccttttgcgtaggcattggtagccgtagcccggtagtgtcccttggacggagcgccgcaggcattagccgatcccatccatggtccatggagagacaatggatgatccgtcaccgaggtgtgtgtacagtggtcggtcgccagccgacgaccgcaaagacaacgggtgaagcgacgggcgagcgtgcgtggcaacagtggcacgaagcgagtgaaactccggtgggttggagtttggacgacggcacggcacgaggggcggcaaaagggatgttggcgccgcgcggtgggtgcgtgcgtggccgtgggtcagctctgctctgctcagcaggcagcagctagcagaaagctgatggatggagcagcccagccggggcccggcggccggctgcgcgagcgagcgagcgagacgtgtgagggcggccgcgcgcaggcacaggcacaggcacaggcgcgtggccagaccaggcctcgtgggcgacgccgcgcgcggcaggagcagaggcaggcaggccggccaaagcattcgcatttaacgcgcgaccaccaccgggcacagggccgtcgtcgaccgcccgccgatgctcggtaccttctcccctcctctgtcgctgtgcctgcaccctgaccctgaccctgaccctgcagctgcttgtatacgtacgtacgcccgcactgtgctgcgcgctggtcgctgccaccgtcgatcgatcgtcatcattgccgccggccggccggccgatcgcgagccatcattgcgcccgtctcggcgcgtccccctcaccctccctggtgctggtgcttctcgcagcaacaacaacaatctgcctgctgttccgtccattccgtctctctgcccgcgcccgcgcgcgtcgatccatcccaattgaattcaactgaatgaatgcgagtaggaagcggagagggaggaggagtacttgtacagccacggccccagcccctagctagccaacagtgcgcttccctgtgcccctcgggctctgcatcattcccgtgtgtgcttgtctctgtccgtgcgagagaaaaaaaacatgccagcgtacgtctccatctgaccatctcccgcctgcctctctctcatcacgccacttcaacttattattagtagcatctctaggaggagtactatttaatacacaagcactgtcgaaaatatcgctgtgctggtttctcttacgcattatataaggagaatggatttggcaaatgtttattgcagtatcagccaagaagcaaaaccagagagagagagagacaggagggagagagacagaggggcagggcttgtgcactgcgcgcgcgtctgctactgcgactggactgcgagagagagagagagagagagagtagggggctgggctgggctggctagacaatgcgcctgcgcagcgcgactgtgctggggcattgcccgtatgctgctgtgctatgaatgcagggatgtatgtgcattgaatcccccctgcaggacacgacaattttgggcggtatgctgcccctgcctgccccggccttctcacattcactggatgatgggtggcgttgccattgccagtagctggcgtctcgcctcccatgttcccctttgctgtcgttgtgtcatggcacagtgtcactgcctggaaaatgccttgtgccttgtcaaacagctccccggtgggtcagccgaccttggtcaacgacagaatgcgcgtacagagggagagagagagagagagagagacgcccggccggccggaaactaaccagtggttccgcacagcaacagctagctaccccgctgccgtgatacatgtgccgtgccatgcctcgatcgatgctatctctatacctcgtgcaacgcatcatcgcgcctgaactaggcaactggaatattatatatatatatattcgtgcatcgagcaagcaagcgggggggcgcgcatgcttgcttggctacaattataagctagta

SEQ ID NO: 2697 - DNA, 1926 bp, Zea mays
  misc_feature (1)..(100): optimal_loci_119632_G1, chr3:171029040..171030965, Cluster 16
gtaaatatacatgctcaatcatatctcacaccgaaaactctcgagatatgcatcgcccaagaccaagaatagtgctcatgactttagcgtggtctaaaattgggtcgctaaattttgcgagaacaacacagatgttgtcgtagaattgacttttctcttaaccatggataccacccggacctcaatttctaggtttgacctctctctcttttttttcctcgtctgagtcatcccccatctatcgtattcgtatctctctagctccacccaaactagtggaggggtcatactgctgacttatcacctactagctagcagtagcaggtgctgacaactatggtagtgctatttgaatgggcaaattaggcggcggatccacacgtatattttctttcccgataagaggacgatgtatcctactagtagtactaggggccggtactatggagtggacgtagcagccaatccacgactgggagttgatggcaatcgcatgagccgaatcaattactaaatcgggagatcgtgggcaggaggcggcgtatgacttttccaagaactttttttttcctgatttctgatgatccaagacatgattaaaggttgcttgtactacatcccatcggtgtgcagagggcaaatagacagagagggagagaggaaagcggacgagtgatggttgtcactgtctgtgtctataggcaacaacaaaacaacaaggacgaaactgagctgccgctcgctcagtcagaatggtgcgagtgcaagtggaaggcagccccgtctctgttgcaacttgggtcatggtggtgggggcctgggctgcggcccagccgagtccatttctgtttgtccttgttgcgcaccacgacacgtgccttcacgtgggcttaaagtggaggctgggctctgtgacagtgacggccgaaggagttagtagccctcaactactgcttagtgtttgtttctcaccactctctctctatctcttccaaagtacaacgccacacgtactgttgacagattagaagggctgcaatcgcaggtcaatcatgtctgcttaggccaggcaccatcttttaatttcacgtctgacgaaggacggggtcccttgcactgctgttcatggtctgtccttggatcccaaaacacatttgacgcccggaatttcgggtgaccatctcaatttaactcctgttgttcgcctgtaggacatacccagcgcaccaaacggtggctggctaggctagctacctaggtgactgttgaaggcttctgcaccagattgcctcatgacaacccctgcttactttactaatgggtaagatcagcgagtgtgtgtggcattagcagtctttgtcgtcgtgcaggtgcagttgatgcttattttggtttggcctgtgagccatcatgcttcgacggggaagagtgccgcgccggtgtctccgcttgctaatgatgttgcaaacgatattcgttgatgattcgttgagtaattcttagagcagctgcagtccatgttgaggacgctcgctcagcaaaactcggtcaacgggtcaaaccttttggcttttctaaaatctcccagattatataacagtataacactagttcaaaattttctagattatataatccgaacatattataatcctaaacaaacaccctacatatgtatacccataatacattatatatttgaacattaagcagagtaatgatctatcctttttatagacttctcaatgaagtataaaagatttctttatctactctgaaccagttcattaagaagaccaaagaagcagaaactaatataccattaagaccttggcgacgactagttatgtgtattcacagatgaatgatggaaaattgtatgctgttagatccttacactaaccattttatcgtcattcagattgt

SEQ ID NO: 2698 - DNA, 2480 bp, Zea mays
  misc_feature (1)..(100): optimal_loci_119847_G1, chr3:172380449..172382928, Cluster 16
gagcaaaaaaaaaaaaaatcccagccgacgatattcgagtcaaagatccgctgatccagcagcccccgtgacagagtggccccctattccaatgtcctcttcgacgcagcaaacgaacaaaccgaaagctgccggacccagcagcaggcccaagcgcccaccatggaacgaaacttgtcttgtctcgctcgcccacgtgacgtgagcactccgcgcgctgcagaacgatgatttgatgatgatcctgtctgatcacataagctcttcttcctcttttgtacacggccagagaatgctgatctgtgcctgcatgtctgattggattggatcggatcgcgacgtgatgaagtggtagtaggagcggccgctagagggttccattcgcaggaccagccgaccaggctatgaacaaatgcttcagccaccctgctgccttggaatgcaagtgcattgcactgctgcgctattattctgttaaacaacaaggatcactcattacatcagctcacgccgtgcacagtgcgacgacacatacaaagtgcctcatctgtcgtcctttcagagttgatcaaacagaacctaaaataatattgtggtccggccgtgcgtcaaatgactaggcacagaatgattgtcaagtggtcgggctggctgttgatgattagtatagcagctttgcagagggatctgtccatccatctcaacagtaacactgaccagaaaaacaaaaatttccctctaattctgcgaaacctatatattattacggcactgctccatgcatgattattgcactagtgtcgtcgtgactcgcgagaacttttggctcgtgctggagctcgacatgaactgacgcctgacggccgggggggaatctaatagtgtattatgtagcctcaccgcaccgtgtctgggctatcatcacctgtcgctgcagccgctagaatcgtgtggagcccaagggctaggaggctaggacaacgatggtgtccgctcagaaatctgctcggtttcttcttttcttttagaacaccggcaagcgctgcaagacgaggtgcgcgcgcgcgcgcgtgtggacaccgatcgagtgcaggcgtggtcggatggcgagcgtacagtgtgcgctccagaaatctgcaggctcggagaaataaatgtgcctcgcccagtagacggtctttatcatttgccgtgcagtcggcgtctcagcatctaaccggaatatcgatcggatcattcgttagttgtggccatccttagaagtcccacaagaggagttgagttgcccaacgggctccgcagctccgcttcgattcagcgcttcttttagttactaaattatcaaatacaaaaactttatatttaataatttaaagactaaaataaacctactaaaatatagtgcctacaaaccgaacatcgtctaacactacggttggctcgtcgggcaccatgcatgtcgaagatgtgggctataggtagcttagctacaacatcaactttttttttcgatcaaagatacgtctagcttgactgtgacttgcatttctttgacagtatacatatgagtatatgaccgagtgtttttgtcactgcacggcagatcgtaggaatactcctaactttttttacatacgaacaaaaggagagtctgcactctgcagaaggggagccaaacggacaaaacgagcgtctttgggcggcaagcgacaatgaattgtttagaataaaaaaaaaccagatgtgagaattcgtgattgaaacaagttaacggccggtctccatgtccatgatggccactccttaaaattattgctcctggtccgtgcatgcattattgtcgtggacggtcgatgagtcacattcagattccagtaatgacacattattttgacgtcaatgatttggtctctgccatgccatgcactctcacccaatgcaaagtggcgtcgggtcgatggattggcgatacacttcctgccgtgtgtaggacgatatatagccggatccctcacaagtcacaaagcaaaaagtgcgctagccccacgtggccaacgggcaatggcgtcagatactcagatgagactgcacacctgcagcgcagacagggaaatgaatgaggaagggaggaccaggactcaagaggccacgagagcacacgacggcccgcggaagaaagcatcggcgcttggtcctccactagaccactagactagagcactaccagcagacatgtgctttgaagtctcgatcagcggccgccttcctccccttgccgttgtttgcccttgcgcggcggcgatccacttctcgtggctattgatgccctttttttcacggggcaaggtgtcgatctctcggccgacgctcttcttccggtgcaggtggtatcctcctccgtatcattggcggaagacgagctgtatccgatgagtcgacgtcatcaatcagtgtgcaatgtactatctcctgcaccacat

SEQ ID NO: 2699 - DNA, 1571 bp, Zea mays
  misc_feature (1)..(100): optimal_loci_120459_G1, chr3:176326049..176327619, Cluster 16
ggcttcgtcgggccagggagccatatggaaagaagcgaaagggtgacctcaatgtgcgcagcgggcggacgctgcaatgcaatttttcatcaggcaacaatgcgagattgcagattcgcacttgcaagcctagccggggtaggcagtcagagccaggcaggaaggcaaaggcgtggtagctagagcctgcggttaattccaatgcaggggcacaggccgcaggcacataattcccctcgaagcgcacacgcgcgagacgtgcacttcatcaataatgtcgtagatcgtgtcgcagatccatctcctccttcctttcgcttacattacatttatgcatgcatggccgtgcctcccctaacctgacgtcgatcgacaatactcccacatgcatgaaacatacaggttcggtgttctcctgccggggcacttgatggcattcggttgagcactgttccagctttctctggagatacgcccacgaacaggtcagtgagggacgggggaaagcgagagcgagcggacgagacacgcagaaagctagctacagaagccaccacggacagacagggcaggtactatagttagcagcgcgccgatggcttcatggcgccgaggggcaagggcccgtggccgtgactgcaggtgcacttcttccaccacgtacggtcctgtgatggcgtacgtcttggtgccggactgccggccggcggatcaaacgcgtggctcgtctgcccggaaatgacgtatcagccggcccggccggacctgggaggatcttggacgcagttcgtttgctcctccctcgtttcattcgtctatgttcctctgcactatctctggtcttttttttgctatggtacatttactggtcgtaccgcatatctatggaaatctacctgataaatactgttagaatctacagtacctccagcttggttttgtctgcttgtgtgctaaaacaaaaaaaaacgaactgcatataataacatatcactagactagctagtgcactactttcattcaaaaagaaaaaagtagactagtgcactacctgttattagtataatcatcatggaccgcttctcaaagccatttttcgttcatctggtacatccatataagaacgtactacaagaactattaagaaatctacttactgcctataaacactgcacatagctacatgcaattagcgagtagcagccagtcgcctcaacagagaagctatgcacgagctggatcagctcttgtcctcacatgaccagttagtcaactccaacagctagccctgcagacgatcctgccgtgtgtgcccagaatttactgcgcacgtacgtaaggtttaaccactgtccagtcacaccagccatatatgcaaatgcttacatctgttgcccctctctgacatgatcctccacaggatccaatctggacgtgctgcacacatcatcacaatacacatgtagaggtactgtatctctctgcactctctctctctctctagtcctttttacgctgtgtgtgtatctatctcagcctcagctcgttttaccagcatgctgcgtgcacgc

SEQ ID NO: 2700 - DNA, 2865 bp, Zea mays
  misc_feature (1)..(100): optimal_loci_120463_G1, chr3:176358281..176361145, Cluster 16
taaagctattttcagcaatttatccatttttatattcatatttaaactttactctatatatagtatattgtatagtataaacagtgttttaaatgatcatacgagtttttttgataagcacatcgtaagcatccgcagaatccttacctacttttttcccgctactagtgtcgaccttttcttaaaaaaaaaggaagatagcctgttagcgttagataacgatggctacgtaattgcgtcgtcagcattattgatggtccagcaggtcgtaggggcggtagggctcgtaggatgcacggacgagagctaataggggaacatgtatgtatcaaggatttaagacaagttcgtttgtcttgtttccttgtggaggacgctcaggcggagcaatcagatcgggctcgggcgcgaccgcggtgaaagctacaactcgtctctcttccgtagtactacttcagtttgtgcaagaaatgctgcttgaaaactgtttccggaaagttgttgggctaacagtaaaaactcggtaaaacgagcttatgcaagcgtggctgttgctcgatcagggacgaagaaaggagacgttttttttttaccgacagagcacagggcacaaaaaaaggcagcagcggcatcacagacgcccaaatctaccgaaaagattggcacacagtccatatgaaagctagccttgtcttgctcactagcagtagtagcagagtcggccagggacggcaacccgccaagctttcttgtaccttcgttgcacctccccagcctattcgccatcattgcttcttgcatggtttgcgagcagtgcctgctgtgctgtgctggtagcccccacgccatcagagcaccactgtccatgacagtgggagaccacagtggacggagcaaagcaactgtttgaatttttctctcttgattccaaatattatctatgcatgccaagagatttaccgaagaaagcgacgtatgggggtatctcggggggggggggggggggggtgcagagtagcaaggtctactcgtaccaagctttgctccttggctccttgcagagggtgtcgagatcaatccgtatccatgtcgtaattttcaaaaaaaaaaaggtctgctccctgcaccccttattactatataaaacgatatgatagtagcactatattagttttttttcaatggaataagaccatccctctcgctctattacaaaaatagggattacatgactggggtgtcgaacatccaatcagtcaaaaatatattatttatcttattgttgtttgtcatgttttcctatcaaaatttgatggtgttttacgtacaaccttcacatgctctttctctcgatagttcttaacaggtattattcagaaggtctatatacgatgaagaataatgtcagcttcgattcaaacggtctgtagctagctaggtaagcttcgttggtccgctaatgtttttgctgttttagcctttgtcattcaaatccccttgcagtgtcaatacgaacggagggagtatactataccgggccaaaagaaaataacccggaagtgtggcagtgattactgctgcagctcgagatatacagcatactcgatcgtacagtagtaggcactagcactagacagagtgcagaagagttccatgtgaaccagagtgctgtggccactgggccagctagcccacttgtactgttcggcttgcacggtgcgagcacagtagatatatacatatatacctgcgcgctgtgccgctccggcgctgcacccgccgcctgagacctcagcggctgatgagccgagcgcgcagtctagagtagggacggcacggctcatgatgacggtgcccttggcttggctccaggctccgcttccccccgccgagtcgtcgaccctttgccgagcggactgcggcaggccgtgagcctcgcaggctctcgcccgccccgccccgcccagccatgcctttttcgacgcttcggccatctgtacctgcgtgcctggtcctgatccgggcagaccactgcggcggtgcatggatgtggatgcccgctcgatctctattcttggttttgggagcagatcatgatcaaaacgaaaggtcagtctttctttttttttccccttttgcctcggggcaagtgtggaggtacgtcttaaatttcaggtggcggagaggtaatggcggccggtatagtgcagtgtaaaaagccatgcacgagtgacaggttgtagtagtgtggggactggggatgaggatgcagaatagtttcagcatttcaggtgatgatgatggactcaggactggcgactgcagcagcctgcagggagttcaaggaccgatatgggctgggtggtggactggtggtggtggtccgtgggctacgagctcggtccaagttggcccatccatggtcgtctcctctaggctggcggttcgctatgctgtagcctgtagtatgggcatggatggaggaaggaaggtttcaggtgatccatgacagccacacggcgactccatagtccagtccagacaggcagggcgcacgagccgaagcggaccggagcgcacacggccagtagtataagcgtactacgctacaaaggcctttcgatttttcgtatatacattgcatggtacaaacaggcccaacccacggtcgcttcgatctgccctctattccagagccttgccgtttgtcgatctcttctcatcttctgccgtagcacatcagcttcttggtcagctcgccactcgtggtcctctagcctgttgctctattcattcgcttcaatcggcggctagcggtttggaagatccaacttgtaaaagccactctttccaacaggctaaaaa

SEQ ID NO: 2701 - DNA, 1700 bp, Zea mays
  misc_feature (1)..(100): optimal_loci_120464_G1, chr3:176361222..176362921, Cluster 16
taaatcacacacacacacacacagaggaacgaactacgggcatttgtgcactttcagccgatatactgtgtgtgctacgtagtcccattctgtttcctagtcctagaactaggacaatcatctgttcgatttcatttttcagatagatacagtcggcgagtgtgacacacgaggcgaccagagtggcggtggtggactagcaggcgacctaatgtggagtacgcgcgcaccgtaccggcggcagcgtgcacctccgtcaccatacgacgacattgactgccgggggtgaggtgaccggccgagcccgagaacaccaccagacctggaacagctcaccgccgtattcatatgggcctgcgacgccatggcaacaaccgccattcatggacacttaaaactcgatttctctctaggcactatacggcattgaagcccttcctttaatcaccaggcgctcagcagctggaattttaggaggcggatttaaaggacgagccgagtagtggttgtggttggttggcgctccgtccggtccgtcgtcgctggactgcacttcacttcgcttcacgcgcctgcctagctaaatgcttcaaccatgaccatgcacgcagtagtactactacgcggggctgagctgagcttggactggatcactggatccatccatccacgctactcctagctcgctgcagctgcacggagtacagagcctggccatggcccatggacgacaaagcggcgggagcgagtggtcgcctgctcgtcgggtcattttcagacgggcgggggagtgagccgataccactggaccgctcgctctctgaaatcaaacactacgtactagtagttaggaaggagtgccatgaatcccaatgcgacaattcgtgctgctgctacggtcgtccagctgtgccgtgtctttggacgcaagtgatttcgacgggtctcggccatcccatgggtgatgggccggcaggagcccggagagtgtctctgtgtcggtaagtacagcgggtacgttccagtgccaaattgtttggcgaaggacggccggccttaatatttccgcgtggtgtggtgcaggtgcaggcgctggacatggccattagagggagaagccagcggaagctgatctgccgagcagaggagaggagagccaagcggggcggagggagagcagctgtgctgtgcctgtgcgttggcgcgctcggaattgcaacagcagggggggggcattgaagcgaagatttaaatcgcccggctgacaccgcccccgccccatccccctcgcggcagcaaaactgtctccaattactcgggcatttatacggattaaaagccaattaatcggcaataggcctccctttcaatgaccctaaccacccagcatctccccttctcggcacttgtgattcgagggcttcgttctcgctgtcgcagacgaatcactttccggggcacaagggagccagctggacagctgcacccgggggctgctgctttgtaaaaaaactgttttgataatagttatgatgatattttttagactatttaaaccgcgatctaacataacttttttggtttataattagtgttttgcatttgtatactaaataatatagtttaagatactttgtctccaaacaaaatattgcttggagtgatttaaaaaaattatgcttatgccatgatatttttaa

SEQ ID NO: 2702 - DNA, 2609 bp, Zea mays
  misc_feature (1)..(100): optimal_loci_120714_G1, chr3:178044816..178047424, Cluster 16
cgcgcgaccaaccgaggtccagcttccatctttctggatggcgtgcgatgcgatgcgaataatgcgatgcaaactgcgcaaggaaatcaaacgagcgcgcctccttgatgaagagtgagctggtacagtggtgtacttactattcgacagtggccaagcgcgtgtggacaaacattcgtgtggcgccgacgccgacgccgacccctcgcgccattcacgtgcgggcgccgccgctcgagcgcgtgcagcagcgacgcgacggggccggcgcgccatgatgattgggcaacatggacgcgcgccgatccgcccgggcgagcccatccggttccccgccacgataccggaagtgctatcgcgcgcggattcggtgcccgatggtcatggatgcgtgaggtggacggatagactcgcgtcgcggcccgcccgcccgcgctggtcccgatcgggcgaaacagagacgctctgcctggccaccggcccaccgcatgggctccgtctccgtctccgtgcggtgatcccgccgtgtagccccccgcccgctcctgcgacgcgtgcggtgccagccaccctgccgactactatcgcaggtcgcagcccactggtggtactggtaccagtagcatggacacggaaccttggacccataccactgttgctcgcgaaagcgagcgtacgggcgaggtgagccagccaagcggcccataataatcatgtcatgtggcgctgataattagggcagggggggggggatcgagttcggccatgcatgatggccatggattctgccgctcagccatcccattctcgatgggttgcttgcttgcttgcccgatctccttcttcttcttcttcaagctgggtggggttgggtcgagaacaaaaaaaaatatatgctttttgattgagttttcaccgtgcttttcggttggaaaagagagcgcgcgagggaggaggatatcatcatcttttgccaaaagcagcggcgttaaggttttttttgcaaacatggaatggaaaagtggggtgtgggggttcaaaagcacgcgcttgtccttttggagaaagcaagcgcccatgagtccgctttgttgaagttttcgattgcatgtagttccttccttcggtttgctttcctcagtgagtagtagtactctactcgctccgttcacgtcagaatgtagttagggttacgtggggttgaagtctagtggcacagtggaaggtgtactagctctacctggacatgatcagggtaacagtgccccgtcatttccaattggaggcgccgtaccacgttgagcccgactaggcgggcatcgaatgaagagggatctgagctgtgaagagtgatcacgacggcgatgctgatcatgatggttggcctcggccaatccgactccaaccccggggaggtgcgtgcgtggtggctggcggtggggcctcgttggaacttgcgatgctgcgtcctgacgtggaccagcgcagcatcggttccctcgcgtccacgccaaacacagtgttcccgtctcgcgatggatggatgatggtcttccttcctagctatagcgactaccggatccagaaaacacatcccgttatctaccttgcacaaagaaaatttagacaaaagagatagcttcaatagatatagttttctaattcttagttaagaaaaaaaatcaattcatccctcaattccataaacaaatggaagagcaactcatccccgctcgtgtagctagcagcggagctagcaaagcaaccataccatatccatatggtaggtgctgggaggggtccaatgatgtgagcataggcactgtatgtaatctcagtgttgtcgagcgccgagaaacagggtgaaagataaaaaggccatatgctcgtttaatcattattacatatcttaaaagattataatgttatatttataattaaatgattatgtaatcaattcttcacatataagaggttgtatttattttttctaatcgtttactgattcgtatggatattgtctgtccgtattcaaatttgatctgcctaataggggtaagatgtgatctatatctaagttcgggtacttaatgttcgattcatatccgtattcttaaagttgtatatttaagatatcgatttctattatattcaaattttatccaatgcaacttgataatatctgtatcggatcaaatccaaagagaaaacgtgaaaacaaataatattcaattcgattacacccctactgactcgccgtcagaccaacaccccacaaaagatatcatgtcaatctcatcttttagaccatctacaaccattttctccatatttctctctctatctatactttctattatattttactacatcttaaaagatactcctccacatacaaggcgtctccaaccattttacctatctagttctttctatatacattatagctcaatcatctaacaattttcacctgtttttgaaagttacggaactttaaaaagttaatatcacaaagaaataaattaattgaagaatgaggtgattaaagccccaatgcattagggaaggtgcctctctcatctaaaatagggagcatcatggagagaacc

SEQ ID NO: 2703 - DNA, 1757 bp, Zea mays
  misc_feature (1)..(100): optimal_loci_120789_G1, chr3:178317381..178319137, Cluster 16
  modified_base (1138)..(1138): a, c, g, or t
  misc_feature (1138)..(1237): n is a, c, g, or t
  modified_base (1139)..(1139): a, c, g, or t
  modified_base (1140)..(1140): a, c, g, or t
  modified_base (1141)..(1141): a, c, g, or t
  modified_base (1142)..(1142): a, c, g, or t
  modified_base (1143)..(1143): a, c, g, or t
  modified_base (1144)..(1144): a, c, g, or t
  modified_base (1145)..(1145): a, c, g, or t
  modified_base (1146)..(1146): a, c, g, or t
  modified_base (1147)..(1147): a, c, g, or t
  modified_base (1148)..(1148): a, c, g, or t
  modified_base (1149)..(1149): a, c, g, or t
  modified_base (1150)..(1150): a, c, g, or t
  modified_base (1151)..(1151): a, c, g, or t
  modified_base (1152)..(1152): a, c, g, or t
  modified_base (1153)..(1153): a, c, g, or t
  modified_base (1154)..(1154): a, c, g, or t
  modified_base (1155)..(1155): a, c, g, or t
  modified_base (1156)..(1156): a, c, g, or t
  modified_base (1157)..(1157): a, c, g, or t
  modified_base (1158)..(1158): a, c, g, or t
  modified_base (1159)..(1159): a, c, g, or t
  modified_base (1160)..(1160): a, c, g, or t
  modified_base (1161)..(1161): a, c, g, or t
  modified_base (1162)..(1162): a, c, g, or t
  modified_base (1163)..(1163): a, c, g, or t
  modified_base (1164)..(1164): a, c, g, or t
  modified_base (1165)..(1165): a, c, g, or t
  modified_base (1166)..(1166): a, c, g, or t
  modified_base (1167)..(1167): a, c, g, or t
  modified_base (1168)..(1168): a, c, g, or t
  modified_base (1169)..(1169): a, c, g, or t
  modified_base (1170)..(1170): a, c, g, or t
  modified_base (1171)..(1171): a, c, g, or t
  modified_base (1172)..(1172): a, c, g, or t
  modified_base (1173)..(1173): a, c, g, or t
  modified_base (1174)..(1174): a, c, g, or t
  modified_base (1175)..(1175): a, c, g, or t
  modified_base (1176)..(1176): a, c, g, or t
  modified_base (1177)..(1177): a, c, g, or t
  modified_base (1178)..(1178): a, c, g, or t
  modified_base (1179)..(1179): a, c, g, or t
  modified_base (1180)..(1180): a, c, g, or t
  modified_base (1181)..(1181): a, c, g, or t
  modified_base (1182)..(1182): a, c, g, or t
  modified_base (1183)..(1183): a, c, g, or t
  modified_base (1184)..(1184): a, c, g, or t
  modified_base (1185)..(1185): a, c, g, or t
  modified_base (1186)..(1186): a, c, g, or t
  modified_base (1187)..(1187): a, c, g, or t
  modified_base (1188)..(1188): a, c, g, or t
  modified_base (1189)..(1189): a, c, g, or t
  modified_base (1190)..(1190): a, c, g, or t
  modified_base (1191)..(1191): a, c, g, or t
  modified_base (1192)..(1192): a, c, g, or t
  modified_base (1193)..(1193): a, c, g, or t
  modified_base (1194)..(1194): a, c, g, or t
  modified_base (1195)..(1195): a, c, g, or t
  modified_base (1196)..(1196): a, c, g, or t
  modified_base (1197)..(1197): a, c, g, or t
  modified_base (1198)..(1198): a, c, g, or t
  modified_base (1199)..(1199): a, c, g, or t
  modified_base (1200)..(1200): a, c, g, or t
  modified_base (1201)..(1201): a, c, g, or t
  modified_base (1202)..(1202): a, c, g, or t
  modified_base (1203)..(1203): a, c, g, or t
  modified_base (1204)..(1204): a, c, g, or t
  modified_base (1205)..(1205): a, c, g, or t
  modified_base (1206)..(1206): a, c, g, or t
  modified_base (1207)..(1207): a, c, g, or t
  modified_base (1208)..(1208): a, c, g, or t
  modified_base (1209)..(1209): a, c, g, or t
  modified_base (1210)..(1210): a, c, g, or t
  modified_base (1211)..(1211): a, c, g, or t
  modified_base (1212)..(1212): a, c, g, or t
  modified_base (1213)..(1213): a, c, g, or t
  modified_base (1214)..(1214): a, c, g, or t
  modified_base (1215)..(1215): a, c, g, or t
  modified_base (1216)..(1216): a, c, g, or t
  modified_base (1217)..(1217): a, c, g, or t
  modified_base (1218)..(1218): a, c, g, or t
  modified_base (1219)..(1219): a, c, g, or t
  modified_base (1220)..(1220): a, c, g, or t
  modified_base (1221)..(1221): a, c, g, or t
  modified_base (1222)..(1222): a, c, g, or t
  modified_base (1223)..(1223): a, c, g, or t
  modified_base (1224)..(1224): a, c, g, or t
  modified_base (1225)..(1225): a, c, g, or t
  modified_base (1226)..(1226): a, c, g, or t
  modified_base (1227)..(1227): a, c, g, or t
  modified_base (1228)..(1228): a, c, g, or t
  modified_base (1229)..(1229): a, c, g, or t
  modified_base (1230)..(1230): a, c, g, or t
  modified_base (1231)..(1231): a, c, g, or t
  modified_base (1232)..(1232): a, c, g, or t
  modified_base (1233)..(1233): a, c, g, or t
  modified_base (1234)..(1234): a, c, g, or t
  modified_base (1235)..(1235): a, c, g, or t
  modified_base (1236)..(1236): a, c, g, or t
  modified_base (1237)..(1237): a, c, g, or t
gaaatgacatagtagcttattagttgggagcggcgccgagcatatcgctatccgtctggccaccctgcattgggaattaccggcgctcacggtcagagagaacagtccataccagccgtgccaagccatattctgaagtcaaagggcgtcgccgtatcggtcgtcgaactgcatcgccgtgccgcccaactagctatagctcctgatttattggtcagccaaacccaaatcgttggtcactggagctcagaaaattagggcgtccagttgatcgatcggagctgggcgcgcgtgcagagtatagatggcccggtggcgtggtgcgtccatcacttcgtcgtgatcgagaatcgttggtgggttttgtggaggacaagggagaacggacatggggacgcagtgcaagacctctctcagaatgcttagaccagatcccaggttgttgtgcgcgcggggataaaagaatcgcgagtgatcgaagtgaggaggccgaatctgtttttggacgaacacgtcgggacaacaggccttccgccatgcgcattgtctaggccactacttgttgtttactactcattttcatttgcattgaccatattcatctgactgtattgactgtacatatttttttgaaagatttgactgtacatattgacccagaactgattgtcctgaccaggttaacgcaggcgtacgtatatattccaggacttccttacgcttgcgaaatctactggggctgtggggcaggaattgagaagtaattattattgccaccggatgcatgcatggatcttattattatgatctctcagggtatatatatcccacccacatgaggcagccataatgatccatacttactactataagcccgtgcatttaagctccacaaattccaatctgctttactttttgatgatgccctgtcggagacaaagtagtcgtagctaatcaagcaactaacacacatctgtctcgggcactctctcctgtgttgaaaatggtacacacataaagttccgtcgtcgtcataaaacatagtatatttcatcgatgaagctttttatattatctgtctttactgatacttatatcacaccagcttaataaaacgaatcaagctgattcatcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgtataaactgatatttatttcacaccagcttaatttacgatcataaaatttgtatggaaagtgaaattaaactagcctgacaaatcattcaaaaccatggccatgatagttgtttatcccccccccccccccccccccccccaaattaaaacagctttacccggatgagccggttcgtcatgcccgcatgcacgggcacgagccttgaacacacgcacacctgtgcatgataaaaagggtctctccatgcatgcacgtcaatcacttttgccacgaaaagacgcacacgtaaacgattcggcgagcccgatccagaccggaggagaaaccaatcatggcccccgtcgcgtccacacccaatcgaaatccgttcgtcacgcgagacaggattgcgcgcgatcgagttagtatgtaatataatcctcggctcgccggcacattagcaacaatcacgacgacgacgacgtctttggagctggaccacacgctgaggcctgaggccggccggggcgatcga

SEQ ID NO: 2704 - DNA, 3426 bp, Zea mays
  misc_feature (1)..(100): optimal_loci_123895_G1, chr3:194467933..194471358, Cluster 16
tatatatactacgtacgtgcagtggtattttattagctggacacctgctgattcaacggcggcgtgcttagtagatgagtagatggctaccattgattaggttatcccgtctgatcagaccctaatgcacgcgtagcttgacttggtggggagggctgtcggcgacattcattcttcccttgtggggcgcgcggatcggtcgagtacgtctggttttgaccctgatcgagcattattttcagcgacatgcagtgagagttgatttcggggcagttgagcgagacgggcgctgcaaatagtaaataaataaataaatgctcatgcatgcatgtgtgtgtgagtgatttcgatgagctcgaagcccgggaacgaagtcgccgtagaatcgtagtagtacgtacgtactgtagttgacagggtgtattactatcttgtttttggtagcagatccaagggcttgcttcatctctttctctacgacgacgacgacgacgacgactgatcagctagctggcgttgcttctattaagctgtactcaattaaccaggtcgattaccatgcattatactatatatgtatgatgctagctgcctagtttttcaccacaaaggtcatggctgggtccgacacagccctagtgggattagttattggagccagtgttacatgaaacagcgacatgcatgatggtaatgttgtcaggcgtgactctgcatatgttatgtatatgtacgcttttgtttgcacagacaaggaaagaccccatagtatgtatgttttacttgtcgacaggggaggatcaattcaaaacgcgtatataatcgtctcttttggaacttagtggtgggttgtttctaagaggtagcagacagatcgagctagctctgcttggttagttgctggactttcagtaaactggagcagcgcacggctagctccatttgattatatttgtagcatagcacgcaccatctcagcttatagagagagatgccggtggactattatgccccccggtcgacactactcctgattctcgagcgggagagcgcatgcatgcatgtgtagcctagcctcctctctagtaaagtagatgaagtccgcgcgacgcgacgcaacccgacccgtagacgggcatagctacttgctacttgtgtaggccatgttggggctgcatgcggaccgaacccaacaggcccacgagaaaggaggccgaccgaacgaccgaacccgcgtcgctcactccatcccatgcatgcccggccggcctctgctccgccgagctgtatatgtaggtaggtagccacgcgcgacgcgacgatgcccggccgcgcgctacactacacggctacgctagctagctcgtcgatccagcacaccgaccgaccggttcatcgatcacggcgtcacccgttgttgttcatatccacccgtgcatccccccaccccccccccccccccggccgtgcgcaacgtaccgacggatcgatggccgcgcgtggacgcatggcgtgggtcgccggcatccccggcctggagagcgacgccgacgcggtcgaccagccgcttccttgggcacacgcttttcggcgcgcggccggcgagatctcgacacgcacgcgaggctccaacggaacacggtcgtgtacgtgttaggtgtaacagtgggttggtgaccgtgatccttccttcctgctgcccgattgaccgcgcactcgagatctcatctaatgcgccgtcaaatcctgagacttttcgagctccggctgatgaagctacggcggcctactacgagccgaaaagcctgagacggagcgtggagcgggaggggacagcacggctctgtgtccatccgacccgatcgaccgagggacaccagctgccagcgggatggcacgcgaacgaccatctcgtcctgtaccagtaccactccgcttctagttgtatgcctacttattggctctgtgctccgcgtgtcatctgacgacaagattggtccaacacgagtcaatggactgttcccaggagtcgaagctgtcctggtgtgggtggtgacaatgacttggccctgactcccgagcgagcgagcgagtgatcggccacacgacaccgccggctgcatcggtcggtgtcatctcggttgttttcgccatcacacgagagacacatgctccggtagagaaacctaatcaaaagttatatccaccaggaaatcgcacacgacgacgtacatgcatatctttctttcgtctgctattcataaaacctttttttcttcctttttttttaacgacaggacttcacgaggtcgtctcacatgccctgagacgcgacggtctccagcttcattcaggtcaggtccgggccatcgtttctgttcgcacaaactccgttctcgtactgccagccgatcagggaaccgtgccttgaccatccgggattgactcgaaactctgctccaatttgcgccctggacacgcgacatcgaagcccggaaacaccaatcagcacgaacgatctgtcgacgactcggagatggacggcctatctgttcgccggaacaaaatatatactagtagtaaacagacggctctttcatttggtccaaaaccgccggctgctcttcgattccgtgagccggcggccggcttcttcgtgtgggaaggcaaagctgcgtttcttgccttccgttcattgattcattccatgctgaatcctgattgtctgcgagctctgctgcatcggccgacttcttcggcttcaagctgtacctccagcgcagcgtggcgtggcctacctccaatctactgatgggacgtcatcatgtgctcctgacctgcccttccttggtcgccaattctcttccgctcaaagccacggcgaggcgtgcccgtcagctgtgttgacttcgcacggaggaggaacggcagccagttggcattggcatcttttatcgctacccggcgaggcgatgccgtgctgcgctcaccactgtttctggcctcacaaccaagagttgcgtgctgtgtgctctgctcaccactgtttctgcgctgctggttgctgtgattgtgttttgccatcacaaacttcccctcctcttcctctcaaacgggaagcctggcaactgcagttagctatcttcacaggattctctccgtcacgtaatttcctcacgcgctacctctcgtggaacacaggtaccagaacgggcgccagaacagcaatgcgcatccgttacggtgcatggcccagagagatgagtcctaacacggagcaaccgttccgaactgaccaagccacctcaggtcagctgttaacaacacgacgagcataccaggacatgcatacgcgaccacaaagggcgagcccggtcttgccgagagaggagctacataatactaggctctgttcgtttagtccag

SEQ ID NO: 2705 - DNA, 2348 bp, Zea mays
  misc_feature (1)..(100): optimal_loci_123995_G1, chr3:194889859..194892206, Cluster 16
tcctgcaaagagaggccgcagaaaccttccaaacaattgccccccctgtcgccatggacaagacagtcaggcacacagcacatctggtctctgcaaagaacaaagcaagcgcgcgcgtatacgcatgctggagagagccaagctgcaagcccggccggccaccacatggaggaggacagagcgcttggactgctggtggatgtggaccactgcctcgaaattaaccacggccagcacccagcagggccagccaaacaggagatatggatggacggagatccgaggctcccgtcccgtggctggacgaccgacgacggacgtgtggggccggctgacgatgagtagtagtagaccagctcgaccggtcgggccggacggcggcggtggaggtggggcgcctgggctggcgggaagcctttatttgcccttgcccggtgaaaattaaaagcgaccccatatgcatatgcatagccctgtagctagctagctagctagggtttgcatgcatgcgacggatcggtcggtcttatgtacccgcccatatctttcgctcgctttggtatggaccaatatatactacccttgttcacatgatcaaaaatggtccccccctgcacacgcatacacatacactgagaactagagaagggggagagagaagatatatagatgctacgctagctaacttgctgctgctgctgcataccctgccccgtcaatcaagctatatatttggtccgtgcatcaccatcattccgtgcgtgatcgtccctttaattacttttggttaagttaacagctcttggagtttggagtagtagaggctactactagctgctagtgctagcgagagtagtagcaagcaacaagttgccatcaggcaggccccgcgcggccggcgaccccttgctagcttgcccgtgctgcaaaaagctgggcctagctaagccatgctgattgctgcgtgagatcgcgctatatatgctttgatcagctgttgcatgcagagccgagcagctcgataattgcagtgcatgctgctcctacggtcctactactatatagatggttttagtatacgacgatgaggcattgttgtcagctatagtaccatctactaggagcctaggctgtttacgacgctgcaggtcgtacacagtcgatggaacagtgtgtcgtcgtttggcagtgtcgtctttgagcggctagtagcctgtccacatgctatcttatttcaaactggatttgttttgagaggggatcagtgtagggaagtggcctaccctcctgcaggtgcatagttaggtggcttgcacagttgtcagttgcactgcactgtttcggcatggaataggttttttctttagcttcttcgcatcgctgaaatcattccttctacatttaatttcgtgtgcccctaatagtactagtgtgtaggagtagtataccgtacgtacatgacaacttctagctaggcggctgtctgtatatgtacgctagctcgggccaatcgcctaccgacgactgtacgcagtacagtagtagaaaactagaaatagtggccctgggatggcaaaagcatgaaggtaagcggcagggtagctactactggcctactggcgacgtgctatgcaacgtcattctgcacgcacgcacattcgcttcgccgaaacgccggaagccgttggcggccgttttcgccccgactaccgtgctcttgtctccatgtatacatacatatgcacgtcgcacgtcacaacgtcaggtcgctctctaactttgtgctactctctctctctctctctctctgcatgcgagacaaagactggtcctcatcatcgtgtgagctgacctttgcactgtaacgtcacgtgcctatatatacaaacccggcaaacatggcagtcaaaactccaaacgtctgcaaccaccagaagccacgtttgttacgcacgttgcacggtcagcgcggtactatccccaccaacgcacgatatacccgtgagcatccaccttggatctataccatatgttcggtgcatacggactcggtctggtgcaccagaccgccaaagagcctcggtttgggaatttcacaaacatgtttcggtgtgccagtagaccgatccagtgatgccagagaggtccaagttagactcttttgagcttaactccttccatatgattttggcatttctggtaattaagcttccctacgactcaaaacaaacatagttagtactggattaactaagtctgggaaacttacatctttcacatattttcagtatagttcatgttttggcccaaaccaagtctagaaaacacttttttctacaaaaggagtt

SEQ ID NO: 2706 - DNA, 1858 bp, Zea mays
  misc_feature (1)..(100): optimal_loci_125375_G1, chr3:202559415..202561272, Cluster 16
gtttccgcgtgctgatcacaaggactatagcaataaatatacattcagcattcggttcttaacccgtgctgatcacagcaaacctgtacgcccagcgtttggccatcccggcgcgcgccacacattccaatcccaccaccacgttacagcagcagcatggtggcaggcaggtgactgcagtgcaccagcatcatctgcagtgctaggtcagctgcctgtggtcacgaagagcagtgcactgcatacaccgaatggagcctaggtaggtagctcctgtaggacagagtgaggaggctagcaccaccgacgacggacaagaaaaaaaaaaaacagaacaaaactactgcccctccctactaaatgcaatctgactgaacaactcacatgtcgcgcgcatacccttgcttgctttcccatgcaacagcccagtcaggtaacgcctggacctggactgggcgttagaaaccggcccgtccacgccgtcacatgacctgtctccatcggcgacctcagatgtccgcagaccgcaggtcgctcaagctgcactgcatgcgccccaggtccagctgtgttcgtgcgctggcattgacttcgatctgccaagtattggggcaagtagtataccaaggatctatgagaactgaaaagaaaatactaggcaaaagaattctcaaatgacatcctaacaagatgatgacagagtgtcgtccagaatctggaagcccaccggtcggcacagtcctgtacacgcgcacgtaatcatcgagctacagctaccgtatagcgtggaaagaaacgtctctttggtcgctgagactaattataaagtgaagttaaaaataagagttgtgatagaaaatgagatgagagagctcttaataaaaacagcccaacgacgcgccacgtgcgcaagggtagtagtactgcgtagtactccgtgatgcccatccgtcgcgtacccgttcccatccattagtccaacgacccacggtcgggccgaaagagatgcgtcgaacgactcggcacgctacgcatcgatgcccttcagacttttctccacgcaaataaataccgagcacgtgtcgagactcctcgcatgaggcggttgtccatgtcgactttttacgacgcgcaagtgcaattgaaacggccacccgcgtattccttttcctgacgtgcaggtgcaggtaccagccactagcttgaagaaatgcagcactgtactgtacaccagctggtcaccagcgccctcctccgcgagaaatcgagggcaacgagtattaagggcctgttggtttagggtgattaaactttaataatggttaaactatagtttacttttagttcctaaaaatacaaaccgggtaactgaaaaccccaactaaagtctactcctccactcaccaaggactatagtagcgtttttttgctgcatttggtatcatgttttcccccgtgcgccctattaaatagggggtcgtgcggtcttgatgcatggtaaataatgttatttagtcagatttagttactgaaactaaatagagtaatttagtgactaaattttaatcaataaagtttaatcaggtgactgaaaaaattaaacagggccttaattcgaccgcgctgtgccgctaatagcagcataagaagtagatctatccattgataatggtcttaggacatatttgattcctttagtccaaaaactaaagtttagtctctatccggtttgatttcaggactacaaatattcagaatgtattaaatgactcataacaagggccaaaatattaattagcattctcataccattaatgcaactgaaataaatgaagatcaaaagttggaattaatataa

SEQ ID NO: 2707 - DNA, 2212 bp, Zea mays
  misc_feature (1)..(100): optimal_loci_126368_G1, chr3:207245509..207247720, Cluster 16
tcgaaaatgtgaacccccccccgtgttcgatgtttacaaccacgggccacgaagaaaccgcgccacaccctcgcgcgtgccttctgctgccctggccgggcacccaccagtaccaccgaccaatattgccatgctccccaggtcgcatcgttctggaacccgggctccctcgacgtctcgtggttaaccgctcgtgtggtctattcactggccttgcaaggtagtaagaatacagggatggatgtggacgtgattttggtcggcacgcagagtaactgtcggcgtggctatagttagctcgcagcaatgtgagaccgcacgggagaaatgtagcgatgctcattggccattattggcgccgctaacgacggcaccgtcaccagcagggagtgggatttagctagatctagcgcggccgtaacgggggaggagagaatcagctggagttcgaatccgtccaggcagagcgacggggaaccagaacgagctgggctggctttggcaagtgggtagggccactgtttcgttttgagagagagcaactgagcaacactagctaggcgtaggacgattagcgcctgtagtagtagcagtagtaacggctgctctggatgtgccactggggcctagagaccagaccagcaaccgcaacaactgccaaggccgccctggatgcaacggctgctgctgcgcgccggcggcatgcccatcaccccctcgggttccccgtacatgccctgcatccttttgcgtgcctcccggttcgacaaccgtgcgtgcgtgcattcgcgcgctgcgttgaagactagcctaggagggtgttctggtccgtgcaggtcataccgtcgtctcggccccccaacaggaagcttcttttcagaagccttgttgtttggaacgccatttggatagtctagtaataggctacaagagcatagcactcctactctcctagccactagagttgcggcctctttccgagtcccagtctcccagatgacgggggggagaccacgacgcacgaccaggccaccagggagcatagcgagaccaatgagcaatgctcgctgcccggcgtgccgtgtctgcacgccgaggactggagcagggtatagctcagtaggcatctgaggtggcatcctatcctggccatatattttacaagctattacacgcacagtgttagttgctgcattagtttaaaatactatatgagataggcacagcttggctctgctccgctccagggaatatagttctggacgaatatggtggcacatccaaatcaagcagcgcaggcggcgacatcatcaggcaagagcacatgaccgaagaacgcaactacagtctacagctcacaaaccgcccgctcggaccttgtttggtaaagagataaaatcccaccatgcatataatgaatgtatttaatgagtcttgattagatgaatctatatctcacactcaatcctatagtgagataaaatccataccttttttttaaaaaaaatccaaacccttagattataatctatgataacaaaaatatttgagtaggcttgaattattttgagacatgagttgtgcatggatttaattccaatttattagagttggattggtgtaaaccaacaaggtctcgttgacgcagccactgaaggattaaccgaataacccatggtgatgcaacagaaaagaataagatgtttgaaaaccctatcgttttattgcaagtggtggagccatgtgacagacatcgatctatgctatgaatgatgtcggcgagcgcgaggctcccttcctactacctctgttgtaccacctgacgtatgtagggtttctacggttaaatttaatatggctttgacccatgatttatttaattataaatcaaataaatatcgccatattaaatactataatacattacagttttaatcccgtataggaatttaatttcttattaattttacttaaatagatgggctgtgcgtgccatattaaatactataatacattaagttagtaagtggctggttgatggaggtgtacagaacaaacctataacgtacgtggtaatatgaatttattatggcgattactccatcttccagaaacacccactgttacctccttgtccttcgaaggcgcctcaccgatgaaaagaaactctcttctctgttgagttgcatatccgttgagttgcatatgagtc

SEQ ID NO: 2708 - DNA, 1801 bp, Zea mays
  misc_feature (1)..(100): optimal_loci_127259_G1, chr3:211753229..211755029, Cluster 16
gaagtattttcaacaaattttatgcgttcagaacaaattgcggggtgatatggagtttgaagtatccacaaaggaaagtcaagatctaacatcgtcgtcatctcagacttcggattcgttttgtttatgattataatctgttcagattatataatctaacttattttgaattaagtgttagtttaaaataaattagattatataattcagtcagatctaaacatacacccatggtttatgcctaatttatagctctgcatctgtatatggttcggctcggttacacaaaccggcacagcccgtgaaaccagtccacggaccaaccgttttgaaggcatcaccaccagcaaaagcctcgtatatgcggttgcctccacggcaaatcaggacaaggaaacattatccctagttagctatacacattataacatcgctatatcccaacatcataaacttaaaataatccaccgaccgtgtatactctagacacagatgtggcgtgacaggtctgctcccccgcatcttccgatgcaaaccttgcacaggtccgccgcgtataaaaaaagtcccgagcaaacagagccgtgctcgctcgcctcgcctgccagcacagcagagcgcgcagacgcataccggcggaccggccggccgtgccgctcgcgttgccgaagcccggcctcggacgacgacgccgcgctccgtgtctcgggcacaagaccttcgcctgtgactccgagtaagctctctcgtctcgtcacccccacctttcagatatgcatgcttgtgcttttgagcagagaaaagaaacttgcttcgcatgggggccgtagacctttttcccgcgcccgcgcttactttcgctcgctccgcaaaacgccaaagctggcccggcagcacagcagccagcagccagcaggcatcctccgctcggcggtcgctgatgatgaaactgcaaaactgttgcttttttttttgcattgatgatggacgacgtgaaatcaggttcggctaggccgcagttggcgcgttgctagacgacaaaaaatgtcacgtactactcagtcacaggtagtactagtagtgaacgatagagagcagaaatacagcacgagtattgtgtgctggcctggcagtagtacatacagcactcacaggactgactgtaagtaggagctcgcagctgcagctgcagtttcacttttttcagaaaggaaggcggccctctccaaacactacgctacgcacgctagacgcgccaccgatttctgtgtacaccagtggaaggagacggcctcggcaagcgtggcgtccctactaggagatctagccgctgcctgcagtctgcagcgagacccgcgccgcaacgctggcaggtgccgtccctgccgccgaggattcctcaagcaagaaggtctttagccgcattgctgattcactctctgttcgttcaggtcgagcgcaacgaaccgacaagatgtgtgcagctgcaacctctccctttttcttcagccatcgaacagctcatcacgtagtactagtgctccgttgcgggggcagggcagtggacctctacgtacgctagcttcgttattacaaatacgaataatggggcctgctttgcttaaccgccggacgcgcgcacttgcacatcgagggagcgtgcggctttggtcgccatctatagcccgcagtcgccatcatcgtgtcttccccccgaggttgttgtggtcatctaaacctgctgcaatgatttggggacggagacggcacggcaggttcaggttggcgcttgagcagtact

SEQ ID NO: 2709 - DNA, 2149 bp, Zea mays
  misc_feature (1)..(100): optimal_loci_127268_G1, chr3:211767898..211770046, Cluster 16
tatagtcgttctgatagaaggttagatctagaaaagcggtctgaccgactttacagtttatactataaaattggcgtggtcggatctaaagggcagcttgccgatcttgctaggttaatgtgtcagcctggcttactccaggctgggtgtcaagcttctcgtctctttcaattttacatgtcaacattaatagaacttgctagatagtcatcaactaagcggttcccttagtttcaaattataagatattctaaccttttttaaagttaaagcatctaaaatttaatcaaaatatgaaaaaaccatcaaacggttatagtacaaaatataattaataaagaatctaatgacacctaaatttagttaaacttgagatgctttgactctttgataaagttacactcacaatagtttacaacagagaaagtataacctagctactagcgtctgcaatgcacattatcatgtttgcgttctagctagatcgcacaagtgccgcctccagtggggacagtagccagcgcacgccggcgcgcgtctagtgcggtgggctcatgtgcgcgtcgcctgctagcaacgggtgccgagtgatctccatcggtcgctcggggagggggacaaagggggcgcgcgcgtcccactcggtgttcctcgccaccgcctggcaccgcgcgcgacgccgacgcgcgcgctgtgcggcgcgcacggtggcacagcacagcacagcacaggacacgggtggttttaggtggttggagcgagcgccagtggtcaccagtgcgcggggcgtcgacagacgataggcggagtgggctccgcgctggcggtgccatgccgtgcgcgcgcgggcaaacgcggccgcggccgtgccaccacttggttcggcggatcgtgacggcggaaggtgtcgggccagctttcggtcccggccggccgccgaaccgaatgctggatttcgatgtcaaatagtactggggacgttcaccgtgtgagagactgaaattggcgcaggaaatctcatccatttgtactgcagagagctgaaactgatcgcggttccaaaatccaaaggtgctctaagcttccgcttacagttcgtactccatccgtagccatcgcgcgcgtgcctcgagccttcgaagccatcatgctttgctcctgttctatccccttccaaaacagatagatggcgcacggttcaaccgacaggtggtcctggatgatcgtgattcagttccttctgtctgctgtgtgttttttctctctctccgcctttcggccatttttatcatttaggcttcgtttggctccaaggaaggacaaaccaaccaagaaacaaactgatttacgaaacatgattgacaaagccaagatcacaaagttctaaaggccgcaattaaaagaattgtttgaataacaacaacatcacaagtaatgtggatctgaataaagcactgatgctaaaatgactgctccatatattgacgcatttttgtagatgcacgtctaacctttcaactcatcttggtctaagagtaccatgcaggagcctacactttctgtaaggacaaaatactcatatgagatggcacaaagaagagataaatgaaactgacaagctagaatgcgctcgattgtagcagtaaattggtcttagtactgatttgcataacaaggctgcacatggataaagaaaatgatattgatcttctcaccaagttaatattaccatccgattttactttcccaggctcattgttgcatggctgggagaactattagtttgtctacattcagattccctgtccaatgaatttgcctttcccaggctcattattgaattggaccgaaccaaactctcacaacttgcacaggcaaccaaaataaaatgctagtgatgagtcagggatagaggccgccgtgtgggtctagttccatgggtagcagggatcggactctgtctccgtcggcccctctctatccaaacgcatgtaccgggttcttgtcgacaccacttttgcaagacagaaccatctctcctgcatctttgccaacatctactagttccttgctgtgcaattcaccttctcttcttccctttatggctagtttgcatccatgatttctaatgacgaatggaggagagtga

SEQ ID NO: 2710 - DNA, 3282 bp, Zea mays
  misc_feature (1)..(100): optimal_loci_127930_G1, chr3:214833350..214836631, Cluster 16
taactctaataagttgacacaatgacacgtgggcctgaagagctatgatcattggcttggtcccatgtaatccagacaaggttgcacacgttcagcaaccattatttcagcgatttaccgggactcgggtcggggctgtctcgagcacatgctactacgctagctagaccctgatacaatgatgaactgtgttcctgtgagtagttttgctagctacgtgctcgctgacgggcaagaggcaatgatttgtggaggtacatctaggcacctagccattccgctgtgcctatcatatactagcttgaaggcgtgcacgtcctcaaattcagtagcatgttgaaaaacacgttaaaagtaggggccacacacacaccatgcatgccacacccagctgcatgtgacatcgatcggcatgcagtgcggcatgcacgttggcacgatcttgcttgccatgtgttcccttgcccctctctctctctgtctgtctttgaccggaaacagtgtggcaaaagaacccgcggatcagagaatcagatttaagtaccgcgtgcacattgaacagtagtacttacgagagtgtgctgcaaacgcaaaaaggatatatatgcacctccttttgccaacatttcctcttccatagtatgtggtctatgggtagagtgtagacaacgttaaaaggtcctggaagagacatccggcaaggttcatttccttccctttttcgttcaaaaaggctacccatgcgagtatacacctggataataccatgcggcggcatgctttccatcctcaccagcaggcgtccccccacgacccgtccagccgtcagcagggtctttcagagagagagagagagagagagagagagaccggcggtcatgccggacgcccggaccgaactccttaattgtcgacaggatgggagaggagagacgatggtccgtacgtgaccggttacatccatccatgcatgggatgggaggatgatgtgtaggtaggagactaggagtactcctctcctcctacaccggccgtttgcgagagagagagtcgtccggccggcgggggcattcactcgagtgggggcaagcgcacgcatatgcatgcagacgcggtggtggtgcaccggctcgtcgccgcatgcctcagggccagcagctggcagaagcagcagtgagtgtgagggtagcacttcatgaaagcaaacaggcagcacggaagcgaggtcgccaccacaccagcactggcgggcgcggcatacacatgcagggtgcatgcaaaggaagaggagaagcacgcaggccgcgcatgcaggacggtaattgcagagagagcagcgagcagagcaaagcaagccgagatgatggtacgtacggtacgggaaccgtgggctggggggggcacgtacagaaaccgcaaacagacagcgggtagcgcgacaacacatgcagcagcatggactgacggacggggcgttgcttcgctgcacctgcacctgcctgtgcgcccgcagcattgcgttgcgtcgctgcaggcggcggagcgcgacagcgcctgaccggtcggtggagtcgtcgtgagagccgaccacggccagaggcacctgcactactacttgtgcatgctagcgtcattggtagccgcctttccgctccaatatttgccgcgtgcaaggcggtgccgcgcgcgtgggatgcaatccaaaccctgcaggcgcgcgcgggagggtcactagctcgtcacctgatagtagcgctaagaacattgcccatgcactgatgagtgatgagtgctgctcgctgccgggtgccggccggctatacaatgccctactatttacgtgcgtcgtaccatgtccttccttttcgagggcaggagtctacgagagtccaacttttacgaatttttcgggacatttgcattgggcccgtaagattcttcttctctgcatcctgaacgcaatgctgatatatatgtatggtcatggacagaatgctgtcttccaggaaatacacaaatacggctgtctctgaaagatggcatatgtctcgtacgtcaaagttttgtagggagagttgagttgcacgctgctgcatgtctaacagtctaagacgatgcgctcagctcctactgctacaaacacatacagcgacaagctagcaaacaatggcgctagctatttggcaaatggccgccgcccattattgactgcagtagataaatcattgccatatgcgtgattcgtgtatggctccatcatttctctagctgggacgactagttctttcaaaaatttcagctgggactagtagttagctatatatatatatagcttgctcttgtcaagtttttagtaagtacttgaggtactcgcgcaccactgtttaaagatgcttaaagaagctataagctgcagatgcaaacagagacagaatcttagactgcgcgcgcatgcaaaagccttgctcctttctaggggatcagacggctggacacgatgtggattctgagccaccgctcccggcccagcagctgcaggctagcctagcccgggggcaacgaaaaaaaagggccccggccggccgcgcggtgtgcagtgcatggccaccaccacaccagggggagggggagccgggaggggccagccagagccaggggcaggggcagcagcaaaagaagacaagcgacatgattcgctgcgtacgccagccgcgacaaagcgcgcctctcatctgtcccctccgtccgccgctgccggctgccccggcgcgcgcgtgacgatcgtgaactccaccacgcccgcgcgcgctccctcgctcgggtcgtccgtccagtccagcccagcgcgcaggggcagggtacgtgcctgtactcatctctagcctctctctctctctctcctctccacacggcatactcctcctttccgtaaactttacactgtgctgcgcctgcgcttattatgcacgccacacaagagagagacgagctagagctagagagcgccataccagtaccactaccaccacatgacacggcagaacagaaccgcgggggaatgccgggatgggatgatgatgcgacgacggatagacagacccgaccaccgcccacggtgtgatgtgatgctaatggtaatggacgatggcgcggggcaggcagcagctagcgcctagcggaagatctcacggcccggggaatccgctcgctcgctgttgagttgagtggctcgcaccgctatcatttcttgcagggtcctccggttcgtacgtacttgacgca

SEQ ID NO: 2711 - DNA, 1863 bp, Zea mays
  misc_feature (1)..(100): optimal_loci_155217_G1, chr4:147910023..147911885, Cluster 16
gcaaacgtgctccaaatgaacaacaaaactatgctttgccaattgcgcacagggagtgagccgctgtatgcgtttagccgcgaacacaggaaagagctcccatgcaaggaacccatgacagctagttctcgagttccattaataagaatatatatcatcgggaaagcagtaaagtttcttgcatgcatgagctagaaaacctggcagcgcttctggttctcctggaccagagagaaggaaattaccactactgcattatccacgcaggctacagagcctgcacacgtacgtacaagcaccccgtacaaagcagtagctagggctaccaccgtacgtatacgtactgtatgcgtccaccaggtaaactggtaaagtttagccgctaggaaatccagacggttctaaacttcgattgaatgccaaaaaatatatatacatttttaggtgtgtttcagcttagctgaaatcagctggaacatgttctagaatctaaatatatagttccgctaaacttttaggttttgttggtttgtgccggattggtgagtaaagttcagttaaaaagtggattcaaaccgggccatggtactagtgccttacagtaataagagtatatatattaggagaaaaagaaagcgagggcaggagcggagcggtcctgctgtctgctgaggccccgatcgatgtccggccgggctccggctgtatcatcatgatgatggcgatgccccctcgccacgctgcgactgcgactgccactgcagctagcaggcagcaacaacagcggccgcagcgagacaggaactcctctctgaacttggcatttacttcctgccccttgctcaaaatccgagctacactcagtaggccaggctgccaggctgctcattgaaggcccctccgtccgtgcccttcatcatctccctcctcgtcgcactccctcagcctcggcggcgccgtcgatcagtgctgccggccggtacccccagctcaattcatcactgttcctgcggcgatcatatgctattcctattcctatgccaactcagggtccacattgtttttattagtttatgtttatgtataataagtcaaacgagagggcttctagttgacttccttgagttacaccctttgttgagttgacactcaaaagtgtcttgtcgaccaggccaggcgtataaagctagccaacgttaagaggtccgacatgactactactttgcctagattccaaaccgttctatttttcaaattggcttctgacatgagaaacattaagttgttttctactaagagaccactctctttagatacgtattcaacatccaatcgaacaaaaatctatgtactgtctacgtctcaaccgcacattgctattgcatgctgttcaattggctttaacccgaaaagatttctactgtttttatgtttttatagtgttttgtctcaataaattgcatctacaacagtacgaacaattaactttaatctgaagtaaacaacctatttatcacttgatctaatgaccaagaaagatactctaggcttccggacctacgacctcgagaaacctaacaatatccttgccccggcgggggtcccttccgtgcgagagtttcgacggttaatttgcaagaaactaatcgttctaaagtgactagttatcctttgatagtttggtcatgaacctttatattcttcaccatataagtgtgatatactcactacgctctcctgtttagggtagctggacgatctagctctagatgtcgtgtgctccaatacaacgtacgtcatcctaaagattttggacttttacgttgaattaatcttctcgagttggttgtgtaggcaaaatat

SEQ ID NO: 2712 - DNA, 1507 bp, Zea mays
  misc_feature (1)..(100): optimal_loci_156188_G1, chr4:153264833..153266339, Cluster 16
ataaaaataataacaaatatacaaataggcgaatgaacgctccttggcaactctgcacatggagtgttctgtttagatgacatgaaacacggtgtacattgttcgtcaacccatatttaagggtggtacactataaaatttaatgatcgaaacggattaggatcgagctataatatttctactcattttttttaaactaataaaattaattaaggaccataacttactgtgaagaaacattttggtcgcggtctattgccacctctaccgacgcattcccttaattaactaacaatacaaaagagtcaggtcaactcagaacaacacaagctaataacgacaaagctcgagcggagtagctttcaactacgggccaaccatcgcgatcgagcggctttggcacccgaatttaattgtgggtgggtggctggtgcaccaaacggcagggcagcaacaaacaaaaaccagagacgggcgagcgacggagcgacggagcgagtgcctgtcttcgtcccccgctcgctctcgctcccactgtagctgcactgctcgttgcctttttttttttgctgctgccatccgctctgccccgcatttctttcccaggtcaaacttgaaagcagtagccgatggccggctgggtttcgtctactcgtacgtacgaacgcccatccatcagtaaagtataaaacatcgatcggtggcagccggcagcccccggctagcttcttctcatcgtcctccggcagaaagacgactcgtgtgtttcggcctctccagttcgttctcagccgaatctccattcaccaccccattagagagggggaaaaatgagagacagtgatggagaatttcgggaactgtcacgtttggaataatgtgctacatctacatgtacactcctttttctaaaagcgcagaccgtgtacgcgatcgatacagcaggcgggaatatattcttcgtttccttcggtacgaagcctactgcttctacgtcgtcgttacttgggtatagtacactgcattgctgtagcgaacttgctttctccttttttttttcttccctgtcaaagagagagagagagaggaaaactgtcacccttctcttggatgtttcgaaattaaaaaaaaaaaaacaggagaaccaaccgtagtaaacacactgtgggaaatccgtctagttccggagaattttgtccgtccatttcggcccatctaccgttccacaagcgaggacggcctgcaagcctagcagctccaactcccttttctccatgggccgtctgacgggcctggatcttgcgtccagatccgagttttttgtttgtttgtttgtttataaaatccgtgcacttttaaaaaattttacccggcaggaagaatttgccgccggttcagttagcggaattacctttctatgtttaaatttatcttagaaaaataataaattctacaaatttaagaaagttgtagtgacagatctataactctgtagttcatagccttt

SEQ ID NO: 2713 - DNA, 2853 bp, Zea mays
  misc_feature (1)..(100): optimal_loci_159795_G1, chr4:173795104..173797956, Cluster 16
tgcacttcacaaaaggtacatatggacaaaatagcttagaactgtgagagtactacgtagctgtggtagtaggagacagatattcaccactcaccaggcatcctaccattgggtcgtcaagctaagatcaggattttaattaacttttggtgcacgattccattcccatcgatcggtttgttggcgccagccctttctgccaatttggcagttaaataacaaccgtcatggcatagatcctccgtgctacaaaggctccaagtcgtagccgcaattcccggggccgtccaagtccagatctctctgtctcgccagcatacggctacgcaacaaccaaagccggtcacgcacggctcgacactaaacaacaagaaggaaacagaaacgtccctctcaagcacagccccagacatctctctctctccgacccaatccagcccccaaagagagcaagcaaaccgcgtcgtggagactggagactgaagacccccggccggatgagctagatgcatgcatcaggcaggcacagagaaagctgcacctgatgatgcagggtgccaggatcctacgggacatggtcggcatcctacacacgaacgtcgccgtcacggacatgcagcttattatcccgtggccgccacatgggggttccggacgctgtcccgcgcgcgcgctctcgccggtcgtcgtcgccgccggaagtccagccgttcggacaccacagagccgctggacgatgccgacgacgaccaccaccaccaccaggcgggatggagctcctccgttgatgaaccgaccgggattcggcgaatacgtaccgacatgcatgccacacatgcgtacgtggcagcagcgctagcggcttcgtcgtccgctgagcatttcgcaggagtgatccccatgattgacatctcgttcgcgcgcgttctaattaagctgcatgcatcatgcatgctgcccggccagtgcccagatacactacacatgagataacaggtcgcgatcgatcacccgatcacggccacatgggcgttctacgtgctgtctgccatgatccatggcgcctagctgccacctgccatgcttgctttgcactttaatttcatctcatctcatctcgtcagcaagctagccgtcggcgctggataaggcaaggcaagccgcaaggcatatgcatgcaggtttcatcgcgaattaattgcaccaggatctagatatagggcccccctgtgatcttcatggctgattgtttgcctgtacatgttaacaatagcaaagactctattagcacatactagcaaggtcaattaactgatggacaaatgatttgctaactctcttgttaacaattagctaatttattagtcacctcgtttgcaacctaatatatgctaaagccggcaaattatttaccggatggacggtagcagtttctcttgcattggttgggtgcgccgatcagctgggatgagcttcttcagctcgctcgttaagtcgcctctggaatggaatacagcgggaaaaaagcaccaccgcggaagaaaacaaaagcaacaatatacggcagggagggtttgactggcatatcattttttctctcctgaaaatataaatccaagtgctggccacgtacagtacggggttgctgtcgagttgaacgagctcatggcatcctaagacgatcttgtcccaatcattgcgtgtcaccctgtgtcaaaatacgatcccacgaaatgcggatcgcgggcgagggctaatgactgcgtttggccggccgcgcaaaaaaacatcgcaaatccggctcctgcaaactactagtacgtgctagtacttagcaacaactgctaggcaatgatgtgcaaaactatcttgaaaaccgtccttgtaccgagctcacgcttggacaaacattgcatgagagctagtttgatggcatggaaatggagggtatctttgaaaagaattctcttgctattaaaaattgaatagtaagaggttattacctcattatctctttcacctatatgatcatcaaatcagctctaaaggcttgtttgaaagcaagggtaatagaggagattgagagggctcaaatcatttactattcaatttcgaataataagtgatttagacatctcaatcccttacattacccttggtcccaaacgaggggtaacgagacaaaaatcccatcaagaatggtctcatcacaccgttttcaatgctgcagcttcaacaagagtaaaataaaattaaggacctgtttaggaacatagtatttccttagttccaaggcaatactgtgttatttgaattttgagcataccattgtattttagaccaaaaagtgtttgagagcgcacctaaaaaattgtatttttaaatcatgattttaccaataccatagtatttttggggtcaattttttttggtgtggacaaagtttttttattcttgcacacaactaatgtcttttcttctcgtacaccgcaactaaaataataagatattgtgtcttcaaacaggtgttgaattgaattgatgtaaaatataccataattatgtcatgacatacaataaagtatggtattataaatcgtggttttgagaaacatagctcccaaacaagggcttgtttggatctcatgagctaaaaccaaaaaaatgactcaagtttagttatttggcagaaagagctaaaagcgacaaaatagcaaaaaaagtaataatttagtcactttcagttgttcttgtttggatctttatctcctaaatgatagaacttcattcacttttgctttagtaactagaatttaaacaggccctttattttagtcctgtggtctaaatagt

SEQ ID NO: 2714 - DNA, 1436 bp, Zea mays
  misc_feature (1)..(100): optimal_loci_160011_G1, chr4:175274411..175275846, Cluster 16
acatgaggaacattgccacgaagtaacctccttggtcattcggttttagtcatcacgattcacgggagaggagggggcatgtggacgtatgggaatggcgtgacgcgtgacgtgagccacacattccagcactgccaggtgggtccaggaggcattgtctgactggtgcggcggctgcgcctgcctatggaggccctggcccgccggggatagtgtatgaatagcatgaacagcgcgtgcttcttttgctcgcagtgaatgcagacacacagagagagagagaagacacacacacaccccctcctcgtgccgtgtcctcgcgtgacgtgtgcgccggccgacatgcggcgcgatgatgtgtgctgcgccagggctcgacagtttccattgcaggagtgcaggacggagagatgcctctgcggcttcgcttcagcccgttcgctgaactttttattcacacttgtttctactacttgtaaaatgtagcagtccgtccgctggctggtaaatgcgtggcgcggttctccgatacgaatctcgaatccaagcaatggtgccacaaacacaaacggttggatctactgccagtagatagctgctgtggtgtggtctgatccgcgccgtgcgctgccgtcgcgtcactggatggattttttgtactgccagaggtggcgcgagaaaagtccacaacaagtccgtgaaaggtggcgctggcgcgtacatacgctacgcctagtgtatccagatccatatctgcaggccggatccagcatggtctttttttgccgttccgttccatggttacgccgccgccgcgcacgccggccacacgggctgcctcgccgctgaatggagggaccgagggagggagagagaagggggaccggaggaagaaaggaaacggggcaactcgaagcagcggcggcgcagcgcagcaaaaggtgcctcctctcacatggcccggtggcagcgcatccatcatgtccaaggagcagaaggcctagcctgcctgtcgcgctgccctgccactgtttggaagtttcgccccggcgacgcatcgtccgtgtcagcgtatctacagtgagcccccattggtgcgtgttggctgcgtcatgggaatcgcgaattggcgcggggcccagacacagccgcaggaggggcgcaggcatgattccttctgtgctgcagtatggccaggaccgaatagggatggggcgagccggcacttttgcagggctagtagtatatagcatcttcaaaagctctttactaaaaaaaacagtactaatcgttaaacaaaggatcacgctaaacgagggaaaacaatgcaaactctctctcttttttacattttatatcaactatatcatatagtccaaatatttatgttttttatcatcatttttttaaaatgcggagttagctttgatctgagc

SEQ ID NO: 2715 - DNA, 2881 bp, Zea mays
  misc_feature (1)..(100): optimal_loci_160371_G1, chr4:177322858..177325738, Cluster 16
gcctggtagactaattggtgcaaccgagcaaccaagacacgtgaataaaggtgcaattagtctggttacatagatacgttctcaacaaggataacaagagatagagagtgaaactttattggtgtgtacaataagtacatgcatgatatatgtacaaacgcaagttaggtgcaatttgaatacaagctatgaatacatgacgctcgatcgatctgcaagaatgtagctacctctggtactgccagaaaaacaaaggagccaggaaccggcgggagggcccatgtccttgcccgtttgctcctttaatttgtgtgtgtctcctgccatgcatagtgtggttagcggcgacatccactgatccacatcatgtgcatctgccgccgtacgtgccgtgccgtgccgacgctcctccgtacgcgtccacggcccagccagcgcgcgcggtagctcgacgtcgacgggattatttaccgccagagcgtggcatgtaccgctgcttgctatgcgtacgtacgtgctacatatatacgaactcgccctggcctcgcccggcgcccacggcgcgcgtgagtacgtacgccgtaccacgcgctggagccgccagcagcaggcgtcgtcatggcgctgtgctcgcggcggccggcacggaggaccgtgcgctctgacatgcatcgcctggatattttgtccatcgggccgggggcgggcgagagcgcgaccgaacggatggttggtgcaggtgcagcggtgccgacatgacacgaccgccatgggcacggcaacggcagtgcgcgcgcgtgccgccggacggcgaggcgcgcacgttctagctcactactcagtactcactagtcgcggcgccgacaggtcgggcgggagatggagcggtcgacagattggccgggaaccgtgggcgtacgagacgtacggccgcaggggcgcagggatgtacatgtactgctcggaaggtggaatttacgaggccgtgaccatgcatgcatgggcatctctgtcaccgtttccgtgcgtgctgctgcggcccgggatgggcagaagaggcacggaccttggtggagagtactggaggaggtcgagtgaagtcggaacagagcatgttcagaaggacggtccgtgcacctgtttctgcaccggccacagagggtaatttacttgtgtctcagctcattcatcttctctctctttttttttcttaagagacagagagagggactatggcaggcggtccctgctctgaaccttttataccccgtctctctttttcgtcaaaacatttgaaattttaactgcgaacaaaggacagaatgagtctttgatgaatgtgtgcaaggatactgggcacagcaaaagtgaatcgaaggaaagagagaggggagagatgcactcagcccaattattatagacatacaagatattctatactaaattcccggtaggcgcggtagccaatgtttggccagttttgtgcttgtccatttcgtctaattctgggcaagcctgccggcctgaatcccggaataattgggcatagcaattcccatccacgggcaggcaaaaacacaacacccctcgatcgctgaaggcaaccttgtactactactacccccccacagcaaccgtgtctcgtatggctcttccgttccgggccaatcaatcgacgcacacaggctcgccaataaaatatctccaactcttcgctccaccggatcatgtgagcacacaccaccacccaccatgcacggtccggtccctttcttgaatccctgcttgtcttgatgagcagagcagggcggggccggctcagctgcgcctgaagctgaagaggattcgaggtgcggtggctggctggctggtggctggcgagctcgaccaggacagagcgaggcgctagcgccagtggcccagcgctgaggtggtcctaggtttagatagcagcagggttggagtggagatctcccgcccgacaacaagatcagacccgtatttatgctttgagaggaacaccaccgaaaagcctaccccctccatccctatctgcattaacatcttcacaccggccgcccctcccttcgttcagttgtcagcatgcaaacctcagctcctcctcctccgcccggacccctctctcagtctcagcaagtgcagtggccggtgttgtgtgttttccagcagacgatggaataatccctcgctcggcagcacctgtcgtctgtcagtcgcgatggtgtgtgtttatcatctgaggaaactagtttgtattattgagagagggtgttctgagcgatagtgtcgtacatcccacgacacgtctctctcatggttttctactacgacagtctcttttctccatgcatatatatctactaccagctaaaagttagtgctatagccatatgagaaacaagttctagtctgggttggggaagggatttcgtcctggttttctcaccagctagcaggactatggatctgagactagtagagagcatagtcctttggtcccggttggcttaatttgggattaaaaggtatgctaggctaaaaaaaaataattagcacaaatcaatcacgcccccagagctagtcttttgtatatggatggatcgaaagggattaaaagaaattttgacttgctatagatttaaagccactccatccccttcaattcatatgcatggtttgagatgaaaatgcttaattgtttgtctgatggtgtgtgctgcatgcatgctaacgtcgatgactcacggcagtacgtacgtacctgtggaaattggggcacacagaagaagaagaagaaataaaaaaggaaggacgcggacaagttctggtcgcagagtccaaggatgaactggccggccgc

SEQ ID NO: 2716 - DNA, 1510 bp, Zea mays
  misc_feature (1)..(100): optimal_loci_160563_G1, chr4:178382775..178384284, Cluster 16
taattataaaaggaactcctgcaggcatgccctacctacaccctgtaccaacagaacaccaggcaccagccggcccaatgaatgcgttgcacataaacatcgccgccgcaaggtaccggattctcttggttcacttgtcaccgctcaataaacaagctcgctctgagcatgtcatggtcatggcgcaaccatgcatatattatgcatattgtttcagtaagcagtgcagaggtagcttccttagaccaatcacatgacataggcacaacggagaccagctaatagctaagaaagagattttttttctgtgtgctctgtggctgctgtgtgcattcagttcaacggcggcaggcagcagcatgcacggccgcatgggcatggcagccggagtcggatcaaacagggacgcgcgcatggcatgcgcggtgtgtacggagggagggaaggggaaggggaagggccgaggccatggagaggacgaggacgcccccaagtcaagatcgtgcacgcggtggggttggggatcgggagggcggcaacggcatgcagctggccaggaactggaactgggcggctgctgctgcagcgtgctttgccggggcggggggcggcgggcccggagttggactaaccgaccaattaaccacgcttttcgatctggactagatgacccatttgtttatgcttaccgtacgggttacttactgtaggaccactgactaaatgcctgctggctggcaccgcgtgtgtggtgtggtgtggaatggaacgatgcaggctaagatgaccatttgttcatgtgcctacattggtaatctggggcgtcgtccgggcctagcagttagctagagacatctgattgcgatgcagcagctgatgatatggccacggactggatcactcgaccgctgatctgcagctgaggttcattcagtacgcggctgcgagctcattcattgtctgttgcgttgcatcggtacgtacgtacgtacgtacgtacgtgaagtgtgaatcgcaccgcgaaagctaggcgtctgtgttcatctatcaacagccggaggccaaggtaaacgaacctgcgtgtttgaatcctgaaccaacaaggaagcttgacgacggcaaagacacacgccgcactcactgcacgcccaccgtcggctcgctctcggctgtgtacgaaccgttattgctatatgcagcggcacattcttgtccttcattccgtggatgcagtgcatgagtgttgtccccatggtacggaaaaaacatgtgcttcagtctcgctccgtacaggtcgtcgatcccacggctgccagaggccgtgccagtgccagccgatcacgtagtactggacgatgccatgcatgcccccccacaggcccagacgatggtccgtgtccgtcctacgcagagcaacgtcagcgagaaccaaagcatggaagcgtcgtcgctatcctggaatcccaccagccgcagcaggccaccacaccgccgcatggggctggctagc

SEQ ID NO: 2717 - DNA, 1849 bp, Zea mays
  misc_feature (1)..(100): optimal_loci_162532_G1, chr4:189899798..189901646, Cluster 16
atttgatttggcaacacggccgatatctatatcgtaccttttagcgaataagggatacggagaattcgaaattcctgacatgcatagcgcgctagccctatacatttcatttaccaccggccgtctatggacacgcgagtgctcaaaaagatggagcagggaaacatgcaatgatccatcgcacacactgcacgcgctcttccggacagtcagcgtgcaagaggagtactctcctaggtagtagtagtagtagtgctcacttgcagatgtgatgactgatgagtgtgcaaggctggcgtcagccgtcaggggaggggaggggtaacgtgccgcaggtgcctgcagtgccagccctgcggcggtgcggaacgctgatacgcacgcacgctgcgcgccgtgccaattatcagctactagcatgcatccacacacgtacacgtagtacaggtacaggagctgcacctacatgcatggtccacagtcagtacgtgtaagttagtagtatgtactagcctagtaataggtcggtcccttcccttcctcctggccggctcgcccactcaggccaccgggacgggacgggacgcgacgcgacgggaccccaaccgtacgcctgggcgcccagggcgtacgtggctggtagccgccgctgcccgctgctgctgctgctgcatgcatgatgccattgttaggcgccgcgccgttgttcggccggggaccgtcggtggaacgtacgcacgcacacagctctcccctgtctcgatccccccccccccctcctctcctctcctgcgtcgtcgtcctcccctccggcatgcatctcgtcctgtgctgcgtgatgcagcaccagcatgcatgcatgcctcagcttgggcgcgggtacagcgtactacgacagcagtagaggtactagcgtgcatgcatgtgtgactgactggccccggagcgtgtgacgcgcggaggaaggaggaaggagcgagggcctggcgtggcgtctggcggacgcgactgttggtggccgacgacgacgcgactagctagtactgtagctattggctctgctgctagtctgctgtgcccctgctcctgctcctgctggccagctgctcctggtcctggtgggccgcaggcagaggcagacggtgtgtggcacatgcgaggccgagccgctcatgcacatgcatcatgcatgagcatgaatgatctccccggcccacttgcttgtgtatggcatggctgtggctccaactaaccgaagcaatcaggtgtgactgtgaggtggctgcaccacgcgcggtaccgtacccgccggccctgacctgaacgaaccaaaccacaagtgaacgcagcagatgacatagacatcgtcgtcagccatgcatgcccaaataaatggtggtgccgtggtggtaggtgggtgggtggcaacgcggtgacaagtgacgtcgccgccgtcgtcgtccctcaaacttgtctcttatatatatactatcgaaatctcaaaaatgtattttcagatatcggaacttaccttcgagtgccgccatatacatagctaggtaggtccagatcgctcaataaatttgcccatagcgcgtcgtgcaggtccagcagcgtattgtttttatacagttgcggagatatataaacgcgaggatttgcatggacaactggcctggatcgacatgcatgatggacgcatgcagtgcaattgggcgcacgaaaagtagggggcattcttcaaactgctattctggtagtggtagatccagaatccgctagttattgtgctgccgcgccaacccacccctccctcttgtcagtcagtcgggcagaaaagcagcatatg

SEQ ID NO: 2718 - DNA, 1482 bp, Zea mays
  misc_feature (1)..(100): optimal_loci_164809_G1, chr4:201127039..201128520, Cluster 16
cgttgctgagtagaagaaggcgtggcgaggtggaagcaaaacaagtcggtggcgaggtgccataggagaagactctcatcgaatggcctgtttaggctccagccaagggcgtcgagcaaaccctcacggtcgagagtccactggccccggctgtcgttgaacctgtggtaggaggcgatgccatgtatctgccaccacccagccgtgacgtggttggccacgagttgggtgatgccactggacgacttgtacggctccatacaccagagctggtcgatcaagtccttgacgaacgtaggcagcttcctcaggatccagtgcttcctattgcgggccatggcggcaaccagaaaacaaacttagcggctctgaatgtattggtcgaaggaacttatttcgccgctctctactgaaccagaagagcccgcaagactactgaagctaaccttcttcaagtcccatggcttcagtaagcatttgccagatccaaaatggaacagcgaaatcgctgcttgcaatatgaagccatctccggaccaggatttgcaaaacacatacacagcaacagtgacctgccaataccagcgaagaggaagacattttgtggattcaacaaaagacaggtagctagttgagttgagacaggtgcagcaccaacctgagagactgctgttaggacgacatgccttgtccacagctcattgtcttcgatgttgtaggctgtgatgccgtcttggccaccaagatgttgtagcacctgcaggctgtagctgctgcgatgcgtggatacccactcctgacggttctggcgattgaagagcacggccaacgcgtatatcgccacagcgtcgctgcctagataggccagccagattgtcaacctgaaccaggcagggatactgcgtttacgcaagccggctgcgaaaaagaggaagatctggatgaagagacagcacaaggacgcgcagctgccactcctcccaccattgcactgccgctgtgaaacccatgctctcagtctcagctaccacccatgctatatctacgtacccaggccttcctgcgcttaaatactacgagcctctcagctactactatagttaactgcttgctttgctcaggtacgtacgcactttctctactcgatcgtgatgtgttcatacgttgataattgacaagcctttgttgcattaccacagactatatatacggatcagtaattcactattattatatatacatccatctgccggccggattgcatcaggcaccttcatcgcatattcctttaattgtcgcatcgaagctgttggccgctaagtccctacgttgttgctttaggccgacgttactgaaatgcccaggaaaatgcaacatgattacttggaccagtaacaagcttctcagatgtgattctcagtcgtctagctagattctagattctagggtagcaacgaaagtggtgcaaattaaatccagaac

SEQ ID NO: 2719 - DNA, 1579 bp, Zea mays
  misc_feature (1)..(100): optimal_loci_174363_G1, chr5:11877391..11878969, Cluster 16
cattggcaactgcagcgtcgatttccatgcagttaaggcatgtaagtggacggaggggcccactgcttttcacaagtaggcggcagtggaatttggcgtcgatgcgaggtgttgggccagtatatatgttagctccccccgccgatggccggtgcttaacgtgagccatgcaatgtcgtgagggcgcaatattagttttatgtccccgctgaaacaaataaataaaagggcgaagccggagaaagatgaaaggggggaatatgtttgctgcggcggattgtggagataagatcgcatctctcatgcggtcatcgaacatccgccgccctgcaactgcaagctaggacgacgacgatgcgttaattgtgacatcagttgagcgtatattcttatatatggttaattaatggatgctaacaaaaaaaaatatatagtctatcttgggagagggacagcattttcttttcatcgcagactgcaggttaattaattcgttttctgaacgttgttcggaccggactgaatatataatgcctggtttatttctctatagtttcaggtggccattgttaggttacacatacgtgagcttctttttttcagattccggtgtccggtcggcattgattagtttgtcgacttgcgactatgagccgacgcaacgagtacatatatagagtaatggtagacaaagcctaaagtgactttagctaaggagaggaaaagtgtattaggttattcttttccacgtcgtggtgcactatactccgcgcggccatatattgtcgtagtagcgttgagatgggttttagtcttggtttattattggagattaaagagttttactctcgattttttaaccgggactggatctgaaactgaaccctaaacgcgaggacgaggggagtcagagacaatggcgaatgccgcgcaccagagatgaccgtgggccggcctgtttggtattgccacgatcggagccatggctggctggctgtcacgggcacctctcatccacgggctctcctgttcctactgccggcaaggattacctcgagcccttcatccgccacgccaccatctcgttgtcaggtggcaacgtagacacaaagagggagctttccatccatgcgttactaaaataattataatggtatgcatcaatcaacccaatttgttactgctatatatactgctgctgtgtgatacagttggctgaccctttccatgcgttactaaaatttcatactactacgttgcttcaaaaaaaaaaaaaaggtattgattcgtgcgtactactaatggggtcgactcttggtccccttgaagaaccctacgccaggcacccgtataaaacatctatactttccaatgtgggcaggtcaacatgacaacatcatcacgaacccacaacccagcatatatatgtacactgttttaggacatgtacagtccacgaacaactgatgtctataggtatatattgatattaaaaaacatgtgcaaacaatataaataataagttatatggtgattgtctatttacaatgcctacaaaattttaccgtctcttggcctt

SEQ ID NO: 2720 - DNA, 2947 bp, Zea mays
  misc_feature (1)..(100): optimal_loci_174389_G1, chr5:11920522..11923468, Cluster 16
ggctacgacctcgatcgacaccggcgatgacggcgcccatgactccgccctcaacaccaattaagccctgcagctgaggatgctccctagtccctcccctaccatatccggcgacgtacgcccgccccgccatcgacaacccatgcatcagcacatgatcgagcccaaacaggctgttattagcagtcatacgtagctcaaatcatttttactgcagtgctcctcagacctgaccggctgtccaggcacatcagccacatgatcgagctcggatcggcctggctgggggctggctggctttagctagccgcctgcatgggccaaagttactgctgctagctagttaacaacaacctaaaccagcaatctattgcgttgcgcgtcgagcagtcgtggcatccgaccctttgctcttttttgaccagcgagaatagaatctgcggcacgccccttgttgcttggacacaacacaacacaacgcaacgcaaggcgcctgcttcgaccgatccacccacctcgagacgtgacgcgcaggggggggctccaaataaaggccgccctgaggctggtatagtattagtgtggtagctttgcaggcgtgtacgcacgtctttggttttttatctctgcccgcctggtttgtggtttctttttggacggtggatggagcctttatccgtgcctagcttttttaaaaaaaaacgtacacagtacgtattccgttctctggctgtttgcatgcatacgcctagtctactagtctagtgcgtgcaggaccgcagccagctagctgctgctgtaccactactagtctactacagtctacaacagtgttgctactagcctgcgcccgactgtggtcgagctcgactgctcgagcaacgagcatagttgttgtacaggctgtgtcacatacgtgtgctcgcttctacgtactcgtacggtcgtacgtatacgaggaggaggctgctgcggtgggcaagtccgtccgtccgtccgtccctacacgccacacgtacaacggtctgcgtcagtgacgtgtctggcgcccgaagctctgcagggccgggactgcaacttttgtctccggccaagacatggactctgcttcgaacactatacagctggtagtagtagagccgtacgtataggtgtgatgttattttacaggtcccgaacggatcggaggttgattgatattcctggagtgcgaggagggaccacgtacgcctttacgtcggacctcgcccctcctttgttccccccccccccccctcctcgcactcttttctcgcctctagcgcctcagacattcctttaggttacgtagccgttagcctaatgcaatgcgatggaacgcaacgcaacgcaaaacgcagcgacgtatcttgggatgggagacagtgccccatttgacgaaagggacgtatcttcggagctttaaaagagtgtctgcgaggccacagctccaagaggacgggcgggtccgcacggtcctgatgcgtgcccaccgtcagtacagctccctcctaagggcaggactgcaggaggccgacggcacgatcacaagtccgggaccagggcagggcaggcacacgccacttccttcgtccgttcccgtgctgacggacgacgcgcgccacgtacaggcgcctgctactgctactgtgtctgtgcgcgcatgcatcaccgcacgagctttggccgcctcacgtcgcgcaggccgtgcgttcatcttcgttagcgctaacagtgggtcgtcatgaaccgaggcgcgcaggcatcatgcgcccacgtttctgcgcgcacacgcgcagcgcagcgcagggtgccatcattactgcggccggaggtacgtactacgtgggtgggcggcggtggcccggccggtggtggcatggcatgccgctgtgtccgtgtgctaagcttcctccctcccttggacgattcgattccgcagggccaccaacgtctctgatgagtgtctactacatactcctaaactctgcaaaacgtccccgtcctggcggtccaaatatttccattcccgccgctgcattgcccgctgcctgtctggcgtctgaggcaacaggggatgacacgcatggatcgcaggtcgcggccgcagtcgatcgaccgacggatcgactcagcaaaccagaaacaggtcaggcaaggcagctacgcgcgcacggcgagggcggaaggctggcaacaggcagcagcccggtccaagaaacaaagccctttcacatcggcgtgcacgccgccgatccactgttggagcgccctgcatctatccgtctcaggacgcaggcgtcgcggccggctgctttctcgctctcgggttgccttgcctcccagtcccacctgccttgcccttccccgttgccttgcgcctgcagtgcagaacttgcactgtttgggtttgccggtgcgtttctccattcctgagagccgttccggttcaccttctccagcgcatgcatgtgcatgcaaaccaagcaagcagaggcagcaggttccattgccaggtagctacagaagcttcctgttccttggcggtgcaggtgctgtctgaaccgaaccgccttctctctctctctctctcttggacacctaaacaaacattagcttcttctcaatttttttcagagtggaacggaaataagctccgtttgagcatctctagcagctttgtaaacaaaaaaaaaagctccgtaaaaacagatgtagggagttgttacatgataatagatagtaaaaaatttgtaaacggcccatgggctctcttcgccgaacactacagtacacaggctcccgccgagacgtacggtacgtgcgtgttgtcgctgcgcggtcacgtacagccagcacgtgcatcctcacctgtcctgtctactaccacggccaagccgtacggcgtacctccagagggaatgaatca

SEQ ID NO: 2721 - DNA, 2292 bp, Zea mays
  misc_feature (1)..(100): optimal_loci_181147_G1, chr5:49156276..49158567, Cluster 16
gtatctacggttttgtacctcgaaatagtgctgtcacatagccggctgggcttgatgatgaccttgtcatgcattcgcgtacgacactacgactgcttggtattttgtcaggccgtataattccagagtagcaggcaacaggcgtatattggcagtctaggacacggctgcccgatggatacccagtcctacgtacagtagtaccagggtactcctagtcctcgctctgtcatgcgcgcaggctttacgaaatcaaggctcggatcccccagaagatctcgctgctggtgctgggggcgcgcgcagaattaattgcagggagaatattttactgcgtgcagaattacacaatcggccagacccgtcaagacagaaagtagcagcagtactaccgtctaccagtaccagacacacacagcagctgaccagctgtttaagatagataccctatatattattgactctctctcaaaaaaagggaaaaaaatagaacatgcaattgtcaaattgaagggacaggcttcatggctatatacaatattgggatgtatttggttcactgactaaagtttactttcgtgtcacataaaataaaatggctagcctagtacatgtcgcatagctaatgtcatcctgtcctcttcatgcgtgtgctacctcaggctagcttgattgtcttgtctgtagtctgtctgtctgtaccgccacgagaaggaaaagctgtgacgcatactacgctgaatacatggatccgtgtggccggacggtccatgtacctgcgtgggtgtgcgcgcactcgtatagtagctggacgaagaagaagatgtgtgagcgtgtgtatagtggctggatggatgaagagcacaaaggcactgtagtctggttgagcgtcgcgtttccagctagggccgcatgcactgcctgcgtccttgcgaacgcatgtgagttaagtgtcccgccgctttacgatcatcctgctgtttcaattcagaagcgcgtactatgtgccgtgactaccacgcgcgcgtgggcggagccggcggcggcggcacgctgtgccctgccctgtgactgggacgcgagtgcatctgcatccgcacggggacgccgcgcttgccggtctcaacggcaatcctcgcctcgggatccaacccaaacagaattcagcaaaattaaaggtctccctgtctccagaggggaactgctacgtccacgcaaccaacaaggcccaacttggggatcgatgccattgattaataattatgccgaaatcggctagcggccgagaacagcagtttaagctagctagctacagatcttgtcgaaaatacgagggaaaaaaaggcagatcagaaaacagattattattctgatgcagtgatgctcgagctagctacactaacatacgcgttcttcgcagcatgcagtcacgatatctgtttggtgtttagtacctgtactactactaggattgtcgtgttgattgatgataatctgtccggactccgtcgatccggaggaggagccggccggtgaacgaagaagcccggcctctctcgctcacgccgatccatgtataatcgcgcgcgcgcgcgtctagggatcggcgcgtcagcagggggccatcatcgtcggtgcgtggacgcgtgaaacaaggccggccggcttctcgtgtcgtctcgtgtcagcagtgggcttttgactagctagtgctactagaaacgaagaacctgcatggctggcgcgtgaggccggccggcagaaacgtaggagaccgcggccgttgttcctgggtctggagtaacgtagtacgttggaacgaagcgaaacgcgagggacgcctgctccatcagcggtgacgacgacggtcggtcatcagtccggccatgtggacgtggtgccccgacgacaggccggcactcactcaaatcgcgtccatcagtcacgcgctcacgccgagctccggacaccatgggccgggcccggtcccttgtgtcttttccagcgggccacaataagcgcgcggtttacgacatggttgcgtgctacgtgggtgggccgaatcgtttcgtcattgaaaaaaaaggccccgttttgcctctctaaacgaccaagttcagagtactttacgatttattagtttggtggttttcatgttaaactcaatgcggttttcatatggcttgaaataattttcgtcttagattttcatgtttaactcaatgatgtggtggtgccccgacgacgacagacactcaaactgcgtccgtcgctcacgccgagctccggaca

SEQ ID NO: 2722 - DNA, 1576 bp, Zea mays
  misc_feature (1)..(100): optimal_loci_197574_G1, chr5:160075645..160077220, Cluster 16
ttgactttgggataactgtcgaggtaattgatttcggaggacaaaaaaagtatttggacttggatgtcgtgtggcctcttttgaaatcgatctggtgctgactacggtagctagctagctatatgaaaaaggcatgaccattcataattgtctgatagaggttacaaccaaagccggccagccagacgtttgtatattataataaaagctatgggaacatgtcatgatattgacggccgggggagagatcatatcacaggacacagtagcatgctaggctggcgtgcgagcgtgatcgcgtgtccggccggcgtgcgtttacgttacgagcgcgggagccggaaatgatggagacaggaaccgagggacgagggggcgtgcaccacgagtgctgtgcgcccgccaccggcggacaagcgcgagcgcgacgacatgatgggattgggggcaggcttcacctcctgaaatgcatctgcccccatgacaagaaagaagttttgcgcttttttatcagtccataaataaataattatatatatatatatggcctcatcgataagaaaaacacacacagaacaaaaaaaaccaagtcatccacgtgcggaaacgtggtaccgtgactcagatccatcggcagctggctcgtctagtcagccaggtgtgatgtgatcaccccggggggcaccctgcagatcgatctcatccaccaccgacgagacgtacgtctcagctcttccggtcaataataagaccgtgttcagtaggctccatacactgatctacattctttttttctcggacaaagatagtactataattttagacttccctatttcacgttagttttttttaaaacctacgagcaaataaatgccactgctgcaccccgcctcctcctcttcctcctgagattccaacttctcctttctcggccacaaacaaatctggtgtgtttatgtatttcccaaccatatctttatcccttatctcctttcatcgtgccaggcatggctagacgatatgagtgaactataaacaaaaaatataaatacatatgatgtaaataagtatgattaggtttaccattacatgtatttttataatatatttaatttgatgttataaatattagtatttatttttatccacatatttgaagaaactcaagacacaacactaaaaaaatttgctcctagtagaattgtattcttcggtggactaatatagtacagttttggacttccctagtctaagttaaattttttttgggacccagtagtagcaaataaatatcactcgaccgcctcctctcttccgcatggcggaccggtgagtcggtgactcctattgcatattggcatattgcagtaccgaatggaggagccagagggctcgccggagcagctgacgacgcgcagcgagcaccacccggctttcttgctccctgcaaggtgacttccacgtacgtgaggaggcgcctggtgggcaacctcaaggtaggataggaggtgcagtgagtggacgatcgatagggtaggccttcgcgcgcggtgaagcgcccgcactgtagaaatcg

SEQ ID NO: 2723 - DNA, 1507 bp, Zea mays
  misc_feature (1)..(100): optimal_loci_198569_G1, chr5:165651919..165653425, Cluster 16
ccttggtagcgcgtagaagactttggactatggagtttggacgtaccaagtatcggatatcagaagtcgaatcctaagcgtgaagagttaatttgtaaccatcgatcggaattacacaattgggtggttaaaaaaataacgacgtggtgaaccgaagacggaggccacgcacggtggggcggccgtcgcagcttttggagacgaaggcactttttttttgttgcttcggcaccacctctcaacgtgctttctttgtggctgagaaaaccggcgcttggacttcgctggaagcctctcgggttgttgtggcgttgcaagggtcttttttatgcagaggcagaggcactttcgatggtcaagaaggctcatgcatgaccaacagatctgtatcctatggttgagaataatacgactgacctggccatcgtctctctctctcagcgctgcaaacggaatgtgcgtgtgacggacggacaggcagaggcagtacgtacgacgaaacataggacatataataacagcttgcatggaagggacgtaacgtaacgtaacctaacctaagcttgtttgtctcatgagagacgtccttctgtgagtttgcgatggagactggctggccggggaagaaacgggcctctcatacatgcccatgcccttctcagtccctcggcccggccttgccactgccgtcacagatcatgtgtgggcccagagcatgcagtggtggcccccacaaacttttggagagtgctccgccactagctagctagggccggcgtacatgctgttgcctgttggtggcctggttggagagagccagagctcacgcaggctacagggaggaaggaacagtgcttctgcgcctgcatgcatgcatgagcagttgcataggaactgtacttaagcgcaggcaatgacgaccaagggaagtttattatgtatgtattgtatatagcttaagtagagcagtagtttgtactccaataatgagcctaaaagttacctaagcacaaaatctgcaacttgtctgttcttgttgcgtcgagcattcagcggtagaagctagctaaagagagaggaacacagtcaatcaaccggctagtagtagtactcagcatgcatgcaaggctgtaataatgatagaatcacgtggccgggggattagttgcggccgcgggcagctttcaacaagctaggggccgggcgcgcgcgagattggggatatatgcatgatggccttatgattcgcgagcccccttcatcactgtttgcccatcttctctcactgtcctgtcttttgtctctcgcaactactgtaggaaggaatccatagctctcgttgtgtcgtgcattgcatgcatggaccatgcatcatgcatggcatggcccagagagtgcgcatctgccagctcctatgcatgagctctacctctcctttctttctctctctcacacacacacactagaaggccctgttttgacccgagatttgtagcgtcagttggac

SEQ ID NO: 2724 - DNA, 2072 bp, Zea mays
  misc_feature (1)..(100): optimal_loci_200536_G1, chr5:176987754..176989825, Cluster 16
caccggcatcgtgttgggtgggtcttagcttagctctggtggtactactacttaattaagccaaagtacgtggcggtggtacctaggacgacgtacagtacgtgctactacgtctcatgcccaaggtttattatagcgacgcgcgatcaacttaacgatcgagtaggccgctaggctagcaaatgctgcacgctcatgaatgcacgcccggtccggtccgatccgatccaatccatctcgagtcgacatgtactacgagacaccccgcatcgacggctataactacgggttgtcccggccggcggcgatcggaaccgtaccggcgtttgtcacggcgtaatcacgctggcgggcggtaccgccatccgatctaacctgcctgccggctggctagcggctaaacacgaccccgcccgtccaatcgcgcgccgcgacacggtagctcgcccaacctagctactccgtagctatagccgcgcgacgcgctcccggcccgggcggcgccttcattgcacacgcgacgcgggccggagcaaccagcccgggccgggggcgggcggtggccgccggcgccgggcgagccagccgcgccgcgcgaggatcagggtcaggaccaggatcaggatcgcacgctggcggctgcggacacggcacgggcgggctttttcagggaataatcctaatccgcgtcccctattgaaggaaccacgtgtccctgtcgccgcccggtggttgcgccgtctattcggcccgttcgcgcgccctaacgacggcgaggcgaccaacagctgcctgatctgcatgcgtcggcccacccatacatgcggcctggaacctctgcgttccggaattgggtgcagcggaaaatcgctttcatcgtgcagtttcactgcttcatggttcgacccagccttagttagagctgccgggcaacccaagcttcgtcaggttgagctgctgtgtcctcacgttctgttgttgtggcagatggctgccctagaaacaggatttttcgcaaacgaggccagtcacccagcgtgttgttgtggcagatggctgccctagaaacaggatttttcgcaaacgaggccagtcacccaactgacaccacgacagactgtgcgttgcgcttcgatctggtgacgacacgctcattattgcagtaaaaggagtaactaagaggggttctgagacttgagcagatctctttgctgatgcaacgggactgaccataagctacaacaagagcgctagctatggtggcggccatcgacatggaggaaaacatgatttcagcaacgacgcgtcgaaatcttaggctgcaggcataagaagaagggcgttcctgcgatcctgaggctatggcctctgcaaaaacgttcagttgcatggcagaatgtctgcaccaaaagggacctgaggacacgcgcggcgcgccccacgctttcttgctcgctagctctttacagccactgcactctcatcagaaagaagcccacggttcgtcagactctctcagcaaatcatttcatgaaaaaaccgctggcaacccctattatgtgcaaccgattgtgtggtcgaggaagaaaccccggagcagaagaactctcatctctcataaggcttcctataatgcaatagtaataataataataaagccactgatgagcgatgcaggattttttcaagcctccgatccgtcgatcaaatggcttagtccaatgcatcgtttctatcgaagtaactatatatatctggtcgatatatatgcagctaacctaagccgccaagccaaagacatttcagttaatgagttcatgctcatttctttaccagagcagcagcacggccgtgcatgtgccgtgctcatgtcttaccagacccacaaaaatgctctgcttcttctcccatgtactacacagtacacggtacaacacaaccacagtagcgccattccagttcgatctttacgggccataaattcactcgtgtcggtccacgctgctcctacgagcgagcattgaccgtgccagtggcagtgggtcactaataaccaccagtcaccactcacc

SEQ ID NO: 2725 - DNA, 2216 bp, Zea mays
  misc_feature (1)..(100): optimal_loci_201784_G1, chr5:184281910..184284125, Cluster 16
gatctgatggctatggacatttagttgcaataattggtgatgttgtctgagactaaaagtcaacttcttttttgggttagagccacacaccaacaacgattaaagacgccgcaccatttagttctggtttatgactccaaccaagactaaatgcccttcctacaaaagtctgtcgtgtggcgctagctgttggactgaagatttcagtcttgcttggtggttctaatcaggagtaataatgctttcattagtttcaggtacggtataatttcggcagctgggactgaagggaaaaaacccccccgaagatctgacctagtgttgatgaaattgatatatatgtggaaagcatgtttggcgcaggtgttgcgtgtagatgtagacactgctcatgcatgaggcttgcggaaaataaaaagagtgtactagttgatctgtacgcacgtttaacgacggcaaattgcatgcagaatgcatactctcaggcagtctggcacaaattgatgggcatatctgtcgatgatggctggaataggcgatcttattataataataggttacaagcagcaggtcatctatcatgcatgatacatccactacatgcatgcatacatgtacatgtgctcgcgtttgtttcaccctagttaactcaaaggcttgtagcgcgcggatgttcaattcagtactaatatttaccctagcaagctgcttatctagctaataccagccgacctccactgaactgactagtatccggcctatagcagtaggcagtagctaggcgacctgctacctaatcgccttgccaatgaattaatatttcttcttgtatcctgtctggtcctggaatactgcacatgcatgggccggccgtgagggatctgcaggatcggaggggacggtcctgagcgaggcattaggcatgttcgcgcgcggagacgtttagggcactcctccggcgcgtgcagcagcagtacgatccctccccggcggccctagtgtgcccggaagacaagggtgtgtgtcctcgtagagggcacagctagcttgcaaccccagctcccctactttattcggagtcgagtcaccgtgacctttctttagggttaacctttctcgctctttggggctggatgggcgcttctcgatacatttgataggagagagagagagaggactcccgggtcccggctgatgcggggaacaccgtgcatgggtcgtctggatcatttgattgtggtaccaaggaatgatcaagaaaagataactgtagaacgtacgctttataattaatatctgtgaccagcgagagagctagcttcacacactgtatatactgacacttcttgcagcttcagtcctgcgttttagtttcagagtatagcaactagtagctagctagctagctaggtaggtgatttatattgacgtatctactacactggctcaattcataaaaaaaacccgacgaaatctgtctctctatctatatcactgagctcagctgtttatatataataatttcttgcagaacaactctctggaactggacggcctccgtccacttctcaagaacatgaaccttagcagcagaccctacaacgaaccagtccctcacacaggtcatgattcatgaaactgcaggccgagaacattcacctacactggcgccattggctggctccaggcacgcccgctgctaaaactaaaaccagcaggagctagctgatgcatgccgagatgtggggttaacggatcagtttcggtcagtccaagcaggaggtcataccataccagtccaatccagcgcgattcacctcgaaagcacggccccgccgaatattgtagagcgggcagtcctaggctgctgcccgcgtagccgtgtgccctattagtggcggggagggttggaactcggaggcgcgcgcacgcgcgggccggccgccgggcgggcgggcgggcgcgcatgccgcggctcgcgtcgccacgacatgtcagagatcgatcggctactactagcttccgccttccacaggtgtgcgtgcgcgcggccagggcgggccggggcgggggtttgaccgcgccgcggcgagcgccagcccttccctctcctttttcttttttacgggaatctttcgctggattcgccgtcgttggacgggacgaaccgtccgcacagtagccgccccgcgcgcacaggtgtgcatgcacttgta

SEQ ID NO: 2726 - DNA, 1807 bp, Zea mays
  misc_feature (1)..(100): optimal_loci_201819_G1, chr5:184470152..184471958, Cluster 16
cgattcacacgttgaagaccatccatcgagtcaattttagtagctccgagtaaaagagatatgagtcaatgagtgtacttgtctttatgcttataacaaaataacagtgtacgtttgataccatgaaacgtcgatgttatcacttatttttagctaaagggctccattattcattgctagtcatgaaccaaatcatgaaacataggcataccctccttcctcattgagacgaaggtgacgcggcggagctaacatccagtctgcaaaaagtggtgggacggggacgcaacggcactgggttcgcatttttacatttttagttggctgtaaaatcagagtgtaccaaaaaagatggaaggaagatgaaacgaggcgggtccactggttgagcagtacgaactgcacggtggtggagtgggatcgatccgcccgtagccgtaggccaggtggtaccccgcactcccatctccgtctgcccagctgccagctcgctacaccgaccgggtccatccacccgctggcagttgtgagagagagagagagagacgccactgtttcgtgcgcagcgcagacgcctccggcccgcgcgccccgacgcgcggcccgcgggcggtcccgccgtcccagcagaccagtaacgacggtggcgcgcggcaggcgggcacggcaattcgacaggcacaagcgagtgcagtagcgcacacagcagcgcctgcgacccaccggccccgccctgacccgtcgccaggtccggcaccggcaggcggcacgcgagtgccacagttttacgccccgcgctacgcgacgtgctgcactccgcccgcccgccggtcggcccccggtgcgtgcctgcctgccgctttgccggcccgatcgaccgggtcagtcaggccagtcacatgctgatgcgctgttgcaccgtacgcgtctctgtgttgctcgccgagcggcaacagcagagggcagagtccggccggccggcacgactgggcgcctttcgggattaaatgacgagcggtcaaatcgtgtggtttcttttggccgctgtcgttgcggcttgcgtgacaagagatgcgtgcatgcagccaagacgtgtgcagctgcagccgtgaggaccgtgatgagtgagggactgaggaggaggatgggctccgggctcgcgtgtcttgttcatacttcactgtcgctttgacggtcgttggaccagtctactggtctctacgcacgagtacgtttgttccgtccgtcttgagaggaggagggacccacatgaacgtactcgtccttttttttttctctcttctctcctaacgtgtggaaatagccgtcctcttgagctggtggctggtgctcgccgcagtcgcagccttgcaggaatctggatcattacaagaagagatgagcagcagtgcatcacggagttcaagagcatggaattttgtctctaggtttcttgaaggagcacgggcggtccgcccgagatccctcctaggcctagcacggaaaaactcgagcgcatcttctcgggcgcggacgacacagctgttttatttcattacatattcctccatcaccatgacacgacacgttcctcgttctcgacaagaaagaaaaaaaaaaggcgtcatggttccatccacctccacgattgacagatttctctcatatattttacgacgacttgctgtgcttttcacctgtcatgatgattatgcagatgatcaccggctcactgtcagtcaccctgccgtggattttggaatatctctgccataccagagctagctgcatgggcgaattgaggatc

SEQ ID NO: 2727 - DNA, 1879 bp, Zea mays
  misc_feature (1)..(100): optimal_loci_202017_G1, chr5:185648585..185650463, Cluster 16
agctctaagtttcaaacggccttcagctaatagttagcccgttaataattagctgacctattttagttaataatcagctaattcgacggttagattatgatctaactgatcagaagttacatttgcatgcttacacacgtaaggactgatgcatggtagagtaattgttgccattaactattagctttagtggttccaaacatgtcctaattttatttgtcccgcatggaatcatgtgaaatgcttacaagcaatttggtaatcaatttcatcggtatgcatatagtagggttcgcattattcgtgatgaaatccgcgaggatatatgcgaccgtacggaagagcatctgcatggcgagatctttggccggtagctagccgtgtttttagcttctagtgctagctaggtaggtggttgagctcggaattaatgggcagatgccgtccgacgtgcgtgcactagcgctgcccctggcctctcggcctcggggtgaccagtgactagctctgcactttggttctgagtggcagtgggcagttaccagtggcggaccggccggtggtgctggatagagtggagcagcttccctgcctttgatttggccggtccggtcgccttgcattgcattgcatggctggactggaagggaaggtggtggtcctgtcctgtgcactcactcactcactcacacatgtgcaaccgctcggcgactcgatccggccaccgaaagtgccgctgctccggctgcctatatgtcgtcttgtttgtcgccgtgtgtgtcctttgactgaacgagctgcatagtatgagcacatcgacgacggctaccatacataccagttctgcacgcagctgtcaacgaagcacccacaggtgacaggccacagtgttcgggagcagattcgagagcttttgcaaggattttgccatgcatatgatgccagctcgagtttttttttatggtctcgctagttttaaagccttagaaacaagtgttctgttgtactatgtggagttccctcgtgtactccaaacggatccgcctaaattccgttagggccggccacccagaccagtggccgaccaaaattctcctgcatttacagtccaacaactacacacaccgctcccgcgctccgagcagctgctctgctgcagcgagcgataactgcatgtcgaggtgcggcgtttccgggctactagctcgctgcagccaggccaggccaggcatccatcctgttacggctcgttgcttgtactactacgcaagcaggcgtgcttcggctcgcctggcgacctccgtagctcgtcgtgactcgtgagcgaagtttctcgatcagaactcagaacagaagacgaaagcgttgggggccggatgactccattccctttcctgaaattcttcacggcgtcatcgagcttggcaaacttgcagaatgccccagcaacacaactgtggccaaacagcttgatggggccgtcgtccttgcatagcctgtcgagcatggccactgggcgcgacgtttgggatcaacccaacttgttctcactcaggctgccgccgctcatcaaagctagctgctctagccgcgcctccctgacatccttctatacgcttcgctcggcctgctgctgctgcccagcgtcggcgtcgcagaggaacggtcaggcccggcctgccccggccaggcctacccaacacgtcagaccgtgtgctttgccgcgtcgcggcccaatacgcgctcggccctcccacggacggcccacgtgctcgctcccgcagtccccgcgttcggaaatcggaaccgaacacaggtccgtggcgccgccacgccattatgccaggctataaagccagagttgctgagcgacgacgtc

SEQ ID NO: 2728 - DNA, 1417 bp, Zea mays
  misc_feature (1)..(100): optimal_loci_203328_G1, chr5:192861391..192862807, Cluster 16
atgcagtccccggaggctctcatttttttctctattagttagaattatttgaatcttaaacgaggttctaaacctttttaaactgcctaaatatgagatgaaggagataccgataaatccttggtgatggcagtgttgggaacgtgcacgtacgacgacgtggtggcgggtggccatgttccaccaaactgacagtcgttgaggacacgacccatgcatccatcgttcaatacccccagcaacagcaaggactggtcgcatatatattgtcaaatccgtttcaaccagtgtgatgacgaccgacgcgcactgtgcagtgcgcaaccggtttttcttcaccaatcagtagcgtaaaacacaatagagggaggtataaataagcattagcaatgggtaataacacggatgtagatggtcttgagactcgtgcaggaggcgatgcccttgatcatgaagctgacagctccgtttgttatgttattttaaaaaccccgacccggccagcccctatcaacctgtacccctatggctatcctctcctcgccgcgttgcatgcatgcacacgccgcgcgccagccagctgccaccaagagaaccgaccttttgataatccaaggctagctagctagcgagacgacgacgtcgatccattccattcttttcaagcaagtgtactttatatgcatcgccgtctggtctggtacgctaggcttagcttctggtctggtggtgtgtccgtctggtctggtaccgtaggcacgcagtggatttaagtgggtgcaacgtccgcacagatgcgaacgctgtacctaacgtattggcatgcatatgcatgatgattggcgatgacagcaacattacatgctatcccggaccggagccggaggcgtagaaaaacctcagagcacccaggaggtgcggtggactccaggtccaggacacggcctcgtacgtgatgcgtggccgtcgattggaccgagggctgaggtcatcgtcgggccacttgcaaggcgaaagggtcgtgccgtgggggtccatgtccatacaacaccatacagtactccagggcccagaccggacccctgcctccatcgcagacagaggctggcatccggtccacaaccaccaataagcgcccatccagccccacgtacggcgcagtctcactgccactgcggagtccaatcgattgatgcacacgtacgttatacagagtgacacggacggaccgcaaggaccacgcccacattacctatggccaggcagtccggcacgatgtgatctctccctcacgcccggactccggccttgtcctccaccgctgtaaaagtaaaacagttgaacggtcgcgagcgaggggtccggtggttcctccacgcgtcccggtcttccggaccaggcaacagagccgaatttg

SEQ ID NO: 2729 - DNA, 2621 bp, Zea mays
  misc_feature (1)..(100): optimal_loci_204061_G1, chr5:196756610..196759230, Cluster 16
gctgaccagcgatccttgtatcccgcatgaactgttgtcgttcggctactctggtgtctggtctatatcgaagtcatagatcggatctcgaacttgtgctttaggtagtcttcgtcaacacggccggccaggggcgggggcgggtctggcgacggcggcgggggcatgggcggcgcaacaaggaaggagcggcgcggcgagaaaagagaaaagagattagcgccggcgtggcgagaagaaagactgcctctgtttaaatcctaaatccgtttattttcgactgctagagtcattggcggacatcaaccaccgaaaataaagactttatttttggctgtcgtcgtgaccaccaaaaataatcctagtcatagaaaatcgtccgcagtgctgttctgtacacgccaataacttcactagtttcctaattctacggccctcggagattaattgttggtgcatacatgtaggatgaaagcgtgcatccaaccagaacccaacaagtgcattaaggcacgcccagtgcaactcctgcggcgaggcggtagtggcggccggggttctctctgtcactgagacacaaagggagattcatatggccttggctttgtatagcattacaacaggcgggagagaaagagggagaagcataaagcaaacgaatcgaatcattcaatctggcgccggcaaggggctccgttcctcccgctctgccggccggcccgctcgtattattgcatgagacgcgtgggatggcatggaagcgagaggagctagcagggccggagagcagaggcagaacaaattcctccgcgcctccgatcgatcccctacttcgccgctagctgcacggccggcctcggcctgatgccgagatcttgaactcccctcgtcgtcacgtcgctttccaggcctgccatctctgtcgcggcagccacctcgacgcatgtgctaccgtgggtgggcggcgtgcgctggcgcggcggaggatatatccccgtccatgataacgacactccctaatcttctcaccagacagatgatccatggccctcgcccggccacctcttgccgtggaagcatattatccacatacatactgccggttccgcacgcgcgggtagaaggtgcagtacgtatcgtctggagacggccgggagtatctccctttggcggcggcggcgacgtatataaataggcatgatgggagcatgcttgcttgttcgatcttgtgcgcttctgtcccgcccctcctagcccctcctccttcttcttttcgttttggcaatcttcagattatgcatgacatgcatgcaccatggactgtttggtggtattgccagacgacgacttctgttttcgttgcgcaatgtttgtttgtattgtaccgtgatgcgaacgactgagaaggattttggatattgcgttgtgatattattgtacgtcatgcatatgatggtgctctttagtttctgcctgtgtgctaggactttctgacgtttgtggttgacgatccctacagctagcagtgtgcttgggatgactctcagctacatgcatgtgtcagaaattgtgatagaactagcatggaatgcacccaataactccaagtttaagcgattccgagtccactaataacgacgatatatctgctgctgtccctttgccatacactaaattagtacccactttacctcaaatcataagcatgcagttttgattttttttagagataaaacatgttaagtttggtaaattttaaataataaaacaataacacttatgattctaattagagtatcgttaaattctttattaattctattttatagtgtatctatttgatgccacaaatgtttacaattttatctatagttttagttaaatttaagatgttttaactctaagaattttacattgttgctgatttcgaatgtaaaggactgtttgtcatattaccccgctctctggtcctgtttgctgcaacgcaatagttcgccgagttatgaagcctatgccctgggcgggcccagcaatatttgtcatatgcgcacggcaattaatccaattgtagagcgcagctgtctacgtgtgactggatctgctggagtcctgtaaaccgagcagttgtgcttgcttcgagttcatgcaccgaatattgtcgcggttggtagcacgttacgatgggctgttgtgttgaacagacatggtccagatattatggcacaagtagatactgggccgaatataggctcaactatctagaaataaaatgtaacgcatgccataggcctcttctgccgctggcaattggcatggttagttcgtcaaatctccatcggacagatttttggcccaccgtggtcctacccgagaagcctcagcgactcagttcgtagtttcgtttttagttcgatgccgctacaggcataggtaggattgcatgagtctcgtatgtgtaaaagatataaataaatcacattaatcataaataattaagactaaaacacgtaattcaacttgattcctttgaaatcaaagaaagcacaaattcagaaacaaaagcgaacaaaggttaaatatttacctttctatctcaaagcagataacttattattcatgag

SEQ ID NO: 2730 - DNA, 2119 bp, Zea mays
  misc_feature (1)..(100): optimal_loci_204293_G1, chr5:198203100..198205218, Cluster 16
ccaaccaattggacaaggaagacaactatggaactatgaagcataatcggcaccaaatgttcaaacctaactaataagcgagtaagcgaccaatcacatgtgcattaattgtggcctagtctaccacatcttctacgtgctaggacccgtgaggaacatgtctaccaaccagattcaagctgatgggtatgtgctaggacctctgaagaacatgtctaccaaccattttttggtaattaatttttttcatgatcataaagtttggagattttggtggaagttgagaaaaccatgatcttagagatagttttttttatctatagagttgctttgatatttggagttagttttaaataactttaggaacatattcataaaatttgaactcaaccagactccgtttcagtggatttcactttttcgtagttcagtttcaaggtgtagattctaccaaagtaggctaggttagatttgcatcttggctaggtcggtttgcatcacggatgggcaggcttatgttttgaggtctaggtgtcagttattcgattcgtctctttggtaggatttttgagttgcccatgaagatagcaaagtgtcaagtcatcggtgggttaagtgttttggcttcaagctcttgcttcaattaggttgaagttgagagcctcgctttaaggtttttgtgtgttttggtcatactcttggtttttcacttttgtgggtgtccctgctatgttctctaggtatactgaaggacatccggccacttgttgactcgagtacatcttacttgtgagttttaatattctaggagggttatttaggacaattaatggtcattttagaaaagagttttaaagtacttctcatctgtctccttgtcttcttggatccttcacttaaactattttctcccgatgaaattcagaaaaaggccattttatggcgccgctgaagttactgtaactagagaaaaatatctatatgtactgtatctccttaatttactttcaatacatgtgtcgatttcacgaaagtaactgcagtgcagacatcactagtgaccctgcaacagaaaagagcaaggaggacgacgcttttgccactgcccaatggtgggaaacgacatttgcttttaagggacacacctctgacgaactgcacattctggacttctcatccggacatacgattgtagcacgttggcaaaaaaacagacagcgtgactattgggaagcctaaaggacagcgtgagtgtacatcaagcaaatgagattactgggcgaacacgaacactctctcagtgtcatcctttattaccacctttaacgcattttggaaccaaatctgcagatcatccaatgcagacgtaccctagtactgccttctcacacatgcaagcgcgccggtgcatattggcgatgatgatgaaacaccaactgagccaaacatttgtgccttttcagcgacggtgtcctgtcctgctgttaggcgaaaagcaacagacgcatccccaatcccgtcgtcgtccagtccatctctgcacgccgagacgccatgcacaggagcgccgtggcgaacgccggcggcccacgtcggcacccgaatcccccccgcgatttccccctgccggctgccggagcttgcggccggacaggggcgtttttgcccaaccccccctctttttcaccggtgctacgcgcgcgtataagtggaggggaatatcaggacgtacgcgcgcgccctgtggttggcttatcgtttggcacgcgtgcccgccatccgccccgtcaggctccacttccgcgcgcgcgcgcgcggccctgcaggctgcagccgggcggggcggccccatcgacggcgaccgttccgaccacgacatcggggtcgagtcgaccacccgatcgacgtctcgactcgaccggtcatgccaagagaccatccccagtccccaccactcggccgcaaattcgcggacgggacgcgcgcgggcgagcagtcaatcagcgtgcacgctgcatgcaaacagctgctggttagctgggctgggcaactgctggcgacccgcgccgtgcgctcgggcgcggctgtgagtgaggaccggttaggctatccgcaacca

SEQ ID NO: 2731 - DNA, 3213 bp, Zea mays
  misc_feature (1)..(100): optimal_loci_204637_G1, chr5:200298202..200301414, Cluster 16
ggaaacgagagtgggataaacaagcgtaaaaaatgaacgggaacgagagtattaagcggaaacttataatttaatacaaaacacacgtgatattgatggcgagctagcagtacaacaacatggaacaaacagatacagagagacaattaatactacattgttatttgcttgtttgtggtgtatatatatagctacgaccagcgttgtttaagtctttaggacatttgtcattaaggggaggcaattaatactacattgttatttgcttgtttgtggtgtacatatagctaggtagaataaccttttatgctataatttgcatatataatgctttagctaatgcattaatgcatcttgggccgatcccgggtttctaaaatatataataaataccggttcaacctggctaaaaacgagtgggatagaccctatcatgttttagaattttttcacaaatacaaaaacagacggatcaaatatagaaaaatgatattggtcgggacgtcctctttcaaccttacatgcgggtcggtcgtcgagccaattttcagctttgcgggtgaagtaaaagaagcgaagccaagtagcaagcacgcatgggcatggccgcatgggccgtgcgggcgtgcatggcacatggcagcgcgcagcacatcgatggatcctcggctccagccggcgtcaggcgacacagatgtcttccgtgcaaacggccgctgaaagagacgagacgaccgcgttcttgtggaagaaaagaagcgagatcgaggctcggcggggcgcccccttgggcagcaggcaaggcatcggtacggatccaattccatgcgtgggaatctcccggagctaggccggagggaagggagcctggggagagccgaaggggaaacagtgcggtcggcagcggtccgcggtaggaagggtgatgacaggagcgggagtaaatgcctgtagcccgtaggggcacggtcgtctcccgtcaaccggctggccgccgcgcccgcctcggtcgccatgccacctgcagcagcagcagcatcgagcccctgcatgcattgcatgccatgcatgcagcagcagcagcaggccaggtcaggccaggtagcgtagcgcccgtagcgcgggctccgtccgtccatgtccctgtccctggccgcagctactaggagtactatagtgtgtagtactgctcagcagccgtgcagtgcggtgcgcggcggaggggcgggcgagctggcaaagtggcaactggcttggctaggctagctttccgttggcgtggttgggctttgcaggacagctggtgcacgtgacggggcgggagggggcatgcttccctatatcagccacagctaccgccgtactagccccccgcacctagctttagctagggccagccggccgcccgtctcccggctgcgttgtggttgtggtggagtggatgggagatgagatggatgatgccattgtcacatcacgcacctgccgctgccgcgcgcgcaaggcgcacttgcctgccctgggccctcctcccaccgggggtctcgtctggcaccgtcacttcatggggaggggaagcatgggcatggctgcatggtgcgtgcaccacgcttcattcgtatatacagctgttagccgggatggatcggctgatgctctcaactgaagtgatcgataaaaagcggtgcgttggtattagctggcctcgtgccgtccggcgggacgcgttggaagctttttcgactccggggagactttttttttagacttgcaatccactctcactgatccactgcttttctgctcgtgtgctaaactgctaactcggcaatatagcatcactcatttgcggtgcaactgcagtgcgcagcctacagatccaaagctacgtactgtactctaaattccttgctgtagtacgtgaaacgtcatgcgtatccggccggctcccgcgagacaggaagagacagcgactcgcagacttgcagctgcccagcaggcagtagcttgccctttttaatcgcagcacttggggttgacagtcacacacacactggtcgcggcgcggcagatgaggcgccacaaatctgaaccagcatacagttagggcccatgatttcccccctttctctatggtttttatatataaaaaaactgatttatatgaaacttttgtatgattcctcctaaattcctgcatttcaaataagacatcgagctagtgtaagcgtaggcctgcaaagctgcagctgcctgttccctgtactacttggcactaatctcaccggctacgtgccttcgcatacggagtagtttattcgcggtgggacacttgatagaaaggctacggtagcgtacttctaagactatggtcatttaaaacactattttatactatagtctatactgttactacactagagttaaaatataaagatgaatatagataaattactgaagatagtctaaacatcttttccattttttaagaggacacgcctaaacagttgtgaatacatacatacacaccgatacacagatgctaaagcactaaagcccctaaaaagttggtgatacatgaaccaacacgaaatcgatcacctttgaacccgccagtcctactaccactctccttcgtttgacctagctggctggttaagaaaaaaagttcgttttccgtaaaagcgatccaagtgacaacgacgagacgtgattttccgtacctgactgatgttgataccagccactactccgagctagtagtaaaagatttttacagccaggggagagacggcgttcgtctgctagtggctagaccgcgcgtgttgcgcgacgccgggccggggcgcgcggtcggccacggactggcagccggtgcgaggcacgccgcgtggtccagctagatcgccgaccgggcacggcagacgacggccggtccagcggctggacacgggcacacgagagtacgagactgcgcgcgtttaggttggtaccactaccaccatgcatgtcgcgactcgctcgtccgattatggagcaaaaacacctgtcgtcatgcgaatcattgtacggcatagcgataagaaaaaaaaacttaccgcttctagcatgcccgtcgtatgcgacgacgaagttgagaaatcatgcccaagcaagcttcccgcatgctgagttttcgctgaccctgttggcctgatatgtcgctgaccctga

SEQ ID NO: 2732 - DNA, 1907 bp, Zea mays
  misc_feature (1)..(100): optimal_loci_205744_G1, chr5:206481032..206482938, Cluster 16
tcagccagtgcaggattacctcaccggaattgcgtcacgtgcatcgccgtctggcaccgcgctgccgtgtcttccatccttggcctgatgagcgcgaactgtgccgtgtgattaacagccgtcgccgctgatgacgctgcgcgcatacgaaatgtctcgcatgctgtcgtgtcgcgtcgactcgacccgttcgctggcgtgctggcgtgctgcgctgttttatcaccccaccggcgtgctctcaagctgcttccgaagcggtggaagcgattgagcccggcccggtgaaaggcattcgcgccaccggtgccaacaagctcgaagagatcctctacggcgtgctgccacaggtgatgccactgctgatctcctactccctctatcgcttcgaatccaacgtccgctcggcgaccgtcgtcggcatggtcggcgcaggcgggatcggcgtcaccctgtgggaagcgattcgcggtttccagttccaacaaacctgcgccctgatggtgcttatcatcgtcacggtcagcctgctggatttcctctctcaacggttgcgtaagcactttatctgataagcgaggcattgatatctatgcacttgtctacacatccgaccagctacccaacacgctatcaagagatagccgcaaaacttgagcaggagcttcgtcaacactacccgctgcgggcgactatcttcccgccgagcagcaactggcagcgcgctttgaggtgaatcgccacaccctgcgccgcgccatcgaccaactggtggaaaaaggctgggtacagcgccgtcagggcgtcggcgtgctggtgctgatgcgcccgttcgattacccgctcaacgcccaggcgcgttttagccagaatctgctggatcagggcagccatcccaccagcgaaaaactgctttcggtattgcgccccgcgtccggccacgtcgctgacgcactggggattaccgagggggagaacgtcatccacctgcgcaccctgcgtcgtgtcaacggcgtcgcgctctgtttaatcgaccactacttcgcggacctcaccctctggccgacgctgcaacgcttcgacagcggctcgctgcacgattttctgcgcgagcaaaccggaattgcgctgcgccgcagccagacgcggatcagcgcccgccgcgcccaggccaaagagtgccagcgtcttgaaatcccgaatatgtcgccgctgctgtgcgtgcgcacccttaaccaccgtgacggtgaaagcagcccggcggagtactccgtcagcctgacgcgcgccgacatgattgaattcactatggagcactgaatgcacgcagataccgcgacccgccagcactggatgtccgtgctggcgcacagccaaccggctgaactggcagcacgcctgaacgcgctaaacatcaccgccgactatgaggtgatccgcgccgctgaaactggcctggtacagattcaggcgcggatgggcggcaccggcgaacgtttttttgccggcgacgccacgctgacccgcgccgccgtgcgcctgactgacggcacgctcggctacagctgggtgcaggggcgtgataaacagcacgccgaacgctgcgcgctgattgacgcgctgatgcagcaatctcgccactttcaaaacttatcagaaacccttattgccccgctggacgctgaccgtatggcacgcattgccgcacgccaggccgaagtgaacgccagccgggtcgacttctttacgatggttcgcggagacaacgcatgaccctggaaaccgcttttatgcttcccgtgcaggatgcccagcacagttttcgtcgcctgttaaaggccatgagcgagccgggcgtgattgtcgccctgcatcagctcaaacgcggctggcaaccgctgaatatc

SEQ ID NO: 2733 - DNA, 2087 bp, Zea mays
  misc_feature (1)..(100): optimal_loci_206062_G1, chr5:208097190..208099276, Cluster 16
ctattggttaattaggcccggactgacgactgtcgatttgggggcaaaaccacaaacaccaccttcggttccactgcatacatgcgccgggctattttgacgccacgacttgtggtcgtggcaactagacttggtcacattttctaccctacagatgtctgaaaaataaagattttgatcgcatcgcgcgcgtacggcaaaatggttctttttttctggaccagttgacccgtggctcacttttttggcgtgccagaatttaccactggaaaactgcactggtatactcgcatcccatgttcatcagcgcaccgtccgagcgagtcctcgctcaccaactatttttgtgaagttcctggtgacctgttatgagacacgacgagcgcacagctgtttttcactgtacgattgtactgtgcatatggattatggatacttacaaatttagacactttggcgagagccgcctgacaggtaaaaagggaccgggacggactctaacctctacgtctgtctggtccaccgtccgctagcggcaccggcatgcatgcatgcagatggcgcagtgcgctagtcgatcggtccaccgtccgcgccgcgcggtctattattcgtggatctagaaactgtgcgtccacaacgcgctccgagaatgaggacagcgtccaactaggcaaaactagcagcagcacatgcatgcgtgcttgcattgcatgcacgcgccactgccgatcgatcgccatgcacgcacgcgcactcgacgcccggccgtccgtcgcccatgatcgctcgcgctgtcgtccctcggcgtgcacatcgttttcgtgtgtctacttatatatacggtcttcaaaactcaaagcggcattaatgtagcgttttgttccagagccatttaagatggaacggctccgtccgtcagttctatatagaatcaatctaaataatcgcaaattaggagtggagttgctccgcctagcttatgcaacattgaataaatgaaagatactaaataaatgctctagccaatgctctataaaaacattttgttctttgatctatagataaccagagagaccctttttcttaaaaaaaaagagatcagggccaaagggtttggtgaggatgttggggggcagtgtccccaaaccaattccacgagaaagcaataatcgcgcacacatggacgatggtgtagccctgcccgggtcgatcacttaaaatagtttttgtgccattctttctcccgatgctagctctcacaacatgatactcgcggggggggggggggggggggggaggcagatctctcctgctacttttactacgcactatctccgaaagaacatgttgcttgttgacctggcaaataacactagctactcttgcattgcttctggacatcaattatgccaagctagatcatcattggcacttgagatagactgatagaggcatatatagcgtgcgcagcatgggcacacagcactcagtctcagtctcagagacacctcttgtgggcttcagcttcactgatatgcagccgcaagtgcgggttgggcatgatagagatttgctaatccggtctcgatctgggcccattaattcgtgctgcattggcatggataacttgacatgaacgccaccaaggaccactagctgcaagatgtcaatgcgccacatcgcaaaaggggagagaagaaggatatgctccatttcggcagtggtcgggagaattgtatgatcattcattcaatgagttgtttagttaggctacacgcgtaaggtaaaatcttctccgcacggtttgcttgatgcagatatgaagtgtttatggggtgcttggacgtttgaggtggatagtgagaaattcctcaaaattagtgaaatacctgtagatacagatgtcgtaaaaatcatttcattgataaaagggagaagtgataagatggtagactagcgagtaccatatccctcgaactaataaacaacccattagcaatgcccaaacataccagaaataaaatggttgctcagtgttcaccgatcgaagtggcccagatgaacagtagcacgacatggccgcc

SEQ ID NO: 2734 - DNA, 1761 bp, Zea mays
  misc_feature (1)..(100): optimal_loci_206130_G1, chr5:208431530..208433290, Cluster 16
ctttgttcggctcattcttacgtctcctggatctgctaatcttcgatgtgtgaacctgtgtatctttgggaaaatggaactggccactggcgagtgcttttgtagcagctaagagatttagggcatgtttgataaccatggatgaggtttggttcactgtcaaagagagaatatctcctcttatctctactctatatgttggatgaacggacttttttttttgaaaaaaaaagaccggataggctcgtccagcttttctgaatcccgtgcgtttggcccaaaattagcaatcgattgcacgctgtactaaccactatggaattattgggcgggtggtgcgatcttggccgcatcccacaccacacggataatatggagtggccatgtaccaacctgcagtattgagtatgacatcgacgaggaccgtgtcaaaattcctagctgatttattttgtctcgccggcgggtcccgtccggcgctcgtcgtcgctccgctttccgatccgtgaccactcgccgccgcggctctcgatctcaaaccgcgtctcgacccaaaaatgaagcggagatctgtaagtacaggcagtacaatgggggtactaccgttgtgcatgcattcgctacttcatgcgcaaatacattttgtacctgtcatgtggtatgcctgctcctcgacggcgaattggccgggaaacggacgtttccgcaccattggctactttttgtgtgtgtgtgtgttttgttttagaaagggaggagtcgatcgccattgaccgcgtcgagctttactggcatggagccatagagaagtataaaacaagcaccgaaatgcacaggacgatagatggacatcatcggtggtataggcactgtgtaggcagccagccagagaagatttatggctggctgtaccggcgaaaagggtcgaactgtgcatgtagagctggcaattgtcgcgaccgacacttgatggtccagcattggcatatggcctacaggctacacagcacatcccctcgccgttgcatgtccagatcgccccggttgacggtcccaccatcggaggcattctgtaaccagttttttcacccgaaatatctcattctgtaataagtagtagtaataatagaagaaaaagtctcctcttggacagcaagcatgcacgcgtggtagtggtggctgcttggcgcatccaaccaaatcaccaacgtgctagcccacctcgcattcatgcagtgacggacgacctaacagtctctggtgatctggctacccatggcctcacagtgctcactcacacactcagacgtgggttcatcactggcgaggttagtttaggcagcagatggcgacggcagcacaagttggggggcaactaacaccgtggcctagctttattatggaagcatcactgacccactttcacagagccgcacgacgtctaatcacgcggccaaccaaatctgccagtggcagtgaatgctagtgatgagtagtgaccagcgagtgcagcagttcatgagtagcagtggttggtaatgtccgccgctgtatagcgtgtctcgatgaggccatgccacttttttcaccgggagaagagcatcccaacgtgaattttattgaatctgacaatgagaagtcatgccacaatacaatgaccttttttttaaaggaaaacgagccaaaacccctacataacgtcgtggaagaccacatattacaaacagctgctagaacaatgcagtggacttcatcaataca

SEQ ID NO: 2735 - DNA, 1904 bp, Zea mays
  misc_feature (1)..(100): optimal_loci_206231_G1, chr5:208989878..208991781, Cluster 16
ctgtccgctcctttcaaaagcttgttggtaccgttaactagcgtggtatgtagctaggctctggttggtggcactggcaccgttactctactccatctgtggtcgtgatcgaatagcatatagcacgtattgatatacgaatgtgtgtgttttattcagagagagctgcatgctaaatgacagacgcacaattttttgctttattttcaggcttcattcatctatgaatccaaacttacttatgactgaacatatttttctttattactagttcgtcttcagactatagtagaaaatgtgaacaataatctgccagattcacaatccacatgggcggtagacttgtaacatgctggttgccagcagagcgaggggcagctgccttttggaaaggcaagttagtcatcactggccggcgcgcgcgagccggcagttggacgcgtcgaaacgccgcgaccctgcgtccacgagtcggcgagtggaggccgcggggatccggcggcggcgaccgagcgaccgccgaatccgggcgcgatctttggacgtgcccggcgcacgtacgcggccgctggttcgtgtgccggtttttcacacgcccttctttattttctgcctgcttgaccctcccccgtggatcgtcgctcagatcttctttgggtccgtccatgatacgcgcctcttgacaatcgatgatggcaaaggacggatacgggtcacgacaaaatctgcctgcactgcgtagcggaatcgttcctgtgtggcgccgacgaggggggcgcatgcagtggcgtcctcgtgatagatatatatcggaggcgagattgtgagcatccgaatcacagcgacatggacggcgcagggattcgagccaaggaaaactgggctgggtgggcgaaggacaaccccccagggcgccgaggagacggttctgtggtcgcgctgcgctaaaccttggaggcctggacgactacgaccccgaaccaacttgtgttcatggatgctacgctatagcgcgaaacgaaatattcttcggtttcttttgggtggtggccacgagtgaaacgtcacactcgcttcactggagaccgctagatatctatatatatcctgtgcaagaagcacaaccaagttgccagggaaaagccacacgggcctgatagtccttttctttcttgaaggcgatttgatagcccatatcagatgagcacatggccgcatatcgtacggttagacctgttcaaactcaaactcgggttaagccgttaaggccttaagggtattacccgtgtgttgggtcaggtcaagttggtctataccattttattcgatatgttgggttagaatttttttagattggatcgagtatttttagggttagataaagttttagataaaaaaaatcatggttcatacatattccatgggttgtagaggctaaaagacaatagtatatatctttctgttgcatgggtcagattgggccggctttttttagagggggacgggtcaggctatagagaaaggattttgtgataccataatcgggaatattgttttaaaactattcaacaaataaatttataacccaattatagatgatctaatggtaataaaaaatttattacagctcaagaatgtaatggtacgtctgtcatatttttttactacaattgaaccataaaactacaactttgaattaatgcttatggatacgtccgcagctccagatgtggctataatgaatatattcacacgttgcatacaatgttcagagggacacctatggtctcagatttagcaatagtgatatcttttattgtaatgttgtccctcataataaacacgataagcgcgagtattacctgaattggctagtgttacgtgccaacttggtttgagaagca

SEQ ID NO: 2736 - DNA, 1837 bp, Zea mays
  misc_feature (1)..(100): optimal_loci_206718_G1, chr5:211552820..211554656, Cluster 16
ctgcccctgacacgagttcgcgtgcgcgcggctccttcctgtagctgatggtacggctatactacgtaaatctccaactccagccagctgtgtacatgtacagcgcgggcgtcgacgacgacggcgagcgaccggccggacggctccgtgtcgtccctcccttgcaggcggccggcggcggcgggtgcagtgcgtgccgctgtcgcgcgcgcgggcgacgacgtcgcggccgcgctgccactcgatggatgatggatcgatgcatcgatctcagctccccctttgccggccccacgcccgagatcttgcaggcgacgtcaaatattctggaccgggacggaggctcgctccatatatatgtgtttgtgttttgttctagtgattagggttctcgcgagatccaaagatctatcaatatgatatcttcctcttgctactcattgccacggcgaccgagttcacttggcgccagcaggggccgatgagagcagcgagacaccgccgtccgtcgaggttaaagttaaaacggtgacacgccagagagcaggccactggtgggtgcaaggcgcgggcagcgcgaccgcacgatcgttagcggccgtaccgaactgcgtgtgatgcagagagtagggtgctggagccggtagatcgctcgctagttctctgctccatgttgaccatcccgatccatccaccatgtcgtccgggttgcaattattccgtgcggcgtggatgactggtccgaaaacctaccacccgtctcttttgttcttgtgttgtgtgtggggtgggttacttgtgcagtggcagcattgactcagtaatggccataattcccggggacaaagacttgacgcgcatgttgttttcggtagcaacgcgaaaaccgaccgacgcgatgacgccgcttcaattcttgctagttactgcattacatgacgacccgctgtagcatagtagctttgtgagaacgcttgctagtagctagctgaatatatatgcatggtcatgcatgtatatacatgtttcatttggttggatttacacgtacgccatgctatatatagctttctaagcacttggctgcttgtcaccgtcacatcacggaaccacttcacatgcccaagtcctccccccaattaaaagcgagcaagagagacagtacgtgctccagagaatagccatccgaaattccagctctattgatggaggcatggagctccccttgtccccctttaatttactatactagctagctttcagatgggaaccttggatgctgcctctgccgcgcgcgtgcttgggaccaacatatgcatgcagctagagccggccaagccaaggcgcaatcgatccttggacactcaggaacttgtccccgtcctcctcttttgttttgcgtgccccaatttgctcttgcattgtacggcggccgtgtgagccgtcaacgtcaacgttagcggctcatcgtcatgcatcggccaagccagcaatgcaactgccaggcaaagcgttttttctcgggagaaattggaaaggtccaatactgacgggcaaactacctggccctggccgagccttattagggcgtacgtcttcaacaacacgagctgtagtgtagcactagttgcttgtaaaagttggtggatatatggagggaaaacggccactttgctgagaggatctgaaggagtaggtcaggaggagggtgcatgttgacaactgaagggggtagctagtgtcaatgcagacagggatggagatggagggtaggcttttgccaaaggcatttttggcggtgttcgtcctctcagtctcagagcgtaaatatggtcct

SEQ ID NO: 2737 - DNA, 1668 bp, Zea mays
  misc_feature (1)..(100): optimal_loci_207281_G1, chr5:214083830..214085497, Cluster 16
accagagcgacacctggagtcagggaactgctgcttggtgaatcagaatccaccaccattatatcagggattggggatcaagaaagctactccttattttataggaaagagagagtaagctactctcctagctaagaacaaaatatcagctacgcacattctagctagtatactagtactatacttccccctcttaaaattgcaagccattttaattttgctgaagagctaaatcatcttaagtttaaccaaatttatattacaaaaaataatatatatgtatatatatggtactaaataaacactattatattctttgtaatttactacacaaagggaatatattacattatatacatatgtgcttttgatctttcttctcactttcccggcgttgatttcatgccgtccctatcctatccgttgccatcaccagcttttggaaggagaggagatgagacgagaaaaagaggagaggacaaaggacgagagcggtgagaggcctttagttgatccggacccacacggcactccgccgcgatctccataggccccagcgtcgtctgcgtaagcgctacgagagagcacccaacaacacccatcaagatcctttgcatccagaaaagaaaaaggaggatgatatatatatgacaccgtatgtcattcagtcagcgatgattagctagtggaagtttcagcagttattggtgattgttgttctagcggtcaggattgaaagaaaggaagaaagaaagaaagaaagaaagaaagaaagaaagaaagaaagaaaggaaatcatagaatgtgtatgcagcatgctgaattaaaccaacactgaatgctggacagcacaaacagtaaggcggcagccgtcggaatttgcttcgtttgctgttgtgtgcagactgactcgcaggtgttatttctctagtcactatataatatgatatttagtctttgttgatggttttaatcgggattaaagcacgaggatttacgaagtactgtatttggtatggccctgctgcaaacgagacccgtactcgaaaattttatatggtataggtcctcaaactctataaagtttgcagttttgttagggtgtttgattgatttgatcaactacccttaaagatttacagcttcaaccgtagttttctttctacgtacactagtatgtgtgtgtgtgactgtagcctatatatcctgggtcagatgtggtgagaatcctgctgcaatcgtcatggtcttttgggaggatcgatcgattacgacgacgccgaatacgtccggtccggcagcaggtgtgaaccgggggcagcttaaagaatctgttgaaaagccgagcgtgcggctccgggcaatgtgatcccacatgcatgcatgcatgcgctttcattcgctggactggaaaggaaacggcctcccctccgctccacttgtgcataggataggaggtagtagatgaggaagttagctatagatgatgcgcatgctagtgcgtggtgcactgctaagatgtcgcgatccggcctagtggtgcccccatttggttctcaaggcaaaaggcaacgatagagagagagacatgaaaagacagactatatatatggatagcaccggccggagtggaccagcggtagtgccttataagaacatgcaaactag

SEQ ID NO: 2738 - DNA, 2167 bp, Zea mays
  misc_feature (1)..(100): optimal_loci_207595_G1, chr5:215518341..215520507, Cluster 16
ggccgcggcggcgacgaggaggagattggtagcaagagcgctcttgtctctctgtcaatctacagagtagctagagagggatggggagaggaggggaacgcattaaattgcctcggctgctctctcgttgggtttggtggtcttgctgctgctgctggcggtgatgcaatggcacgccgatctgctactgccaattcagatcgggggtggagttaatgagcagctaatcaggggttagtgagtggcctccccttccgctccgcttgtgtgggtttcgaatcgagggcggggagggagagtgacgcacgctggcgagctgctttctggcgtcccggacctgcgtagtacgtgtagattgttttggacttggtggctccagagtcaaacaagtgttcccttcttttcctcgacttcgtttcgtttttttttgtggttttcttgctaggttgggttagagagagagagaaccgtgtgacgatatgccaaacgcatgttgttagtgaaagtattcaactacgacaagccatgcatcactcactcatttgtgttctaaagcaagctctcaataacagcaggatttcagtgtttaagccttcatgcacccaggttaagagtaggttagctagatttttaaagctgccagaatgaatgagtgttttcttagaaattgtgagctcacaccgtatactgtaaaatccaaggatttatttctatttaattttctacttttttacactttaaagtttggaggaaaaaggatgaataaagtcgcgccatcatcaaattccaggtccaatcatactccatatgtgctcttgcacggctaactggctaaccagcatcaactgaaaacattctttatttctcactcgattttcttcgatctctagtggatttgagtttctaaaataacttaggttggatcttacctctacgagactacgaccagggacgaatccaaatgatgttttcgttaggcctccgactaccctaaaatttgattaaaaacaaagtatccctcggggttaggtctaaagaaacaaatcttacgacttgcaatctaataattaattagatgtattatgtgacattttggttattttctagccatgatggaactgattgaaactagatatatgtggtaccgaattatacacggtattattacgatgtcttaaaataaaggaacagagaaaatcacgatatatcttataagattctagattttctattatatttaagcttgcatttattgacaacattttttttctctgtagggacagggaaaggatgaggtcgtgtcttattagcaagcgtgtattttgaacatgataaaaattcaatatgacgtagactgccaggtgggcaggtgctagtgcatactagactagtagtgctacagccacagccacaggccacggcgggacggtctgaggagggaaggctgggtggccgccggcgtgtgtgtggctgcccgctgcacggcgcatggctagctgaatcggcgaatggatccccttccttcttcccctgttccctgtatggctgtatgcatgcagtgcagcagcattggacgcgtccgtgacttcgatggcgcctgccatgcagctcgcgtcgcctgtcttccagtgtctccctgcctgccgcctacaggtgtgctgtgcacttgtgccatgctcatcacgtcagtccaatcccgtgaacgaaggagaagtctccatcgaccaagatggcggaggtgggccggaagagcttccaccgaagcgatcgatgggtacgagtgcttctttcctgggccgggccgggccggcgctctgtgctggcagctgcctttgccctgctgtacgtggaccgtttgtgcctgcgtcgccatcagcaacaggacagcggacgcgaggaagaggccgggccacccgtcgtctcgtgccccgtgctgcctgcctctgcccttgttcttcccctacgccccgccgaccctgcaggctgcagcctgcactagtggctgcaactggcatcctgccagtgccagtggccccacctagcacagagatgatttatccgtccacatttctgcgcatgcgattcggcaatgcacggccaaccgagcgagcgtggtctgctgtctgctcgacgacctgacctgcccggccggccggccgacgacgac

SEQ ID NO: 2739 - DNA, 1602 bp, Zea mays
  misc_feature (1)..(100): optimal_loci_207613_G1, chr5:215627794..215629395, Cluster 16
ccaaatggccagttgcaggagaagaagattagtgcagtacgtagtatacgtaacgtaatcgaggagaacaacaccggtatagaaagaaagaggagaagcgggtgcctgcctaccgcggcccattaatggtgcttcacgtgacctgccacgcccccacctccggccccccctaccctactgtgcacggtggctacaccactactactactaggcagccgagctcctcgcctcgctctcgctctcgctcctccaccttccctcccttgggtccgtccgtttgccgtgcgccattgcccattgcccattgcgccctgcgccccctcccttggccaagttgccatttgccttccctttccctccgcatcggcccatcccagtatcctaccctccccctcccactcacggcagctgccattgtcgccctgtctgcccccctccacgctctccctatccaccacagcacagcacagcacagcgccacgcacgatctcgccggtgccaccgtgctcccccaccttcaaatgtcgggcctccttccaccggcgccccgcggcacggagcactgagcgcagtccggtccggcgctgccccactgcgacaaggaggacgggcaagcgccgccagccgcgcggggcctccgctctgctcaccctcgccgcgggggagacacacggggtaggtgcggagaggacgctagatccgcgcgcccgaccgtccccgccgcctcccaccggccaccgcaccgccgccgccggcggttccctcgtcgtcgcgcgccagcgcagctgctgcagtgcaggtccggcaccccatcctatgcttttctatctgcttggtggacggaggtgggtcttgccgtttttgggttgggttgggttggccggttgggtgagctgctcacccggcttcgggtggtgctggtggtgaccgttcgccgtcgctgtctctcccaaaagcggcgcccttttcagccgcacggagctcctccagcccagtcctccttttttttttattaatcacctctctaatccgatctaatcgcagtcacctgctcgcctcccactctatcctgaagacctgaactagtaattaatgcccgggattgtttgttctctcctaacctccgccttgccgcatccatggggaccagcgccaccgccacctttccctccgccacgcccattggcttcgctgccgctgccgttgccattgctgcgccccgcccccgtcctcctcctcctctgtggtggtataacgacggctgcgtcctccccccgattcggctgttgccgttccgttccgccgaccagggaaaatgctctgcgcctctgctcaagtccgcgtcgcccgttctcaatcacgccattcccgccgtccggttcctcgccccctgcatgaaatgtaattttattatttcgcttcaccggctgcgcctcgtctgataaggacaaaatcgggtcggaatctttttctggcgcccggtaccggcccgttggggggggctacaaaagaaaaagggaagggcgggcctcctttccttcgcccgccgcctcttggggcgggttggaaaaatttcgtaatttctgccatagtgaaggaaat

SEQ ID NO: 2740 - DNA, 1421 bp, Zea mays
  misc_feature (1)..(100): optimal_loci_208210_G1, chr6:1532094..1533514, Cluster 16
cagggccctgtggcttggggaattgccttggccctggtccaaaaaaggatacaactcttcgggcaacttaatcttgagatggtccgaagaaatgacatctacaccaacatgtatccttgagaacgaccaagcatctcagggccctcgtgtcctcgaagcactctgagtttaggggcactctcacatttatgggaactactttgtaagaacagtttgagatctagacatctaaaccaacatgtctctttgattagagtagaactcctaacatccttaaatgtggtttaaggatcaatagagtagaactcctaacatggaggatatatgagatcatgatgattagtagtttttttgagcttgtaatgatcttttgcacttttgtgttcatcaactgacaagtgataagagaactcatggtattatgttgtggcctgaacctctctaaattgtccgtgtgctggtttttggtggtgtggtgtctaggttcaacctatcacttacctgctacacctccgatccactctctctaatgagtttatattttatttttgtgtacttgtttacatactccggtgtctaaggataattagcgggaatgtaggtttccaagagcaccgagaaagaaacagcggagtttgaaaggcgggcgggcagtgggcagggagtacgagagatttgtctttggggacagaggccactgggctgggtataccccgtatgcatgtgcatagccataggggggcaaaggcaaggaatgatggcctggaaatgggcatcagtttgaggcatggcgtcgacgcttggttggctgcagcaaccgccttttgaggcggcggcacagtcagaccagagtgacgacccccatgcagcaatcatgcatgcctccctcccagtcccatagaatagaagatcattattgttgttattacaagtttctatgatatcttgtctaggcgctcagctcgtaccgtacgtggggtttaggaggacgagaggggtgattatatatcttagtaggatttgcattgattggggacatgagcggcacggtcttccatcgacgatgatgcacgcgtcgttggaacagctatagtagtaatactcgtgtgcgtggccgtacgtggttgaccggtggtggggtccacgctactcatcctgtgctgtgcccggaccccggtggttttatatgcaatgaattccattgcattgcattgcagtgatctcgtctagctcatcaccaacagtcgccgtcgtatgcgttagctgttccatcgatctggaacagcttgggggcattgattattcgtgcagtggaatatatatgatgctgtcacacggcggtttgttccgtcttctcccaacattttggccgcggcgtggcttccatgtctctccatcgacgatatctctctctctctgct

SEQ ID NO: 2741 - DNA, 1623 bp, Zea mays
  misc_feature (1)..(100): optimal_loci_208582_G1, chr6:4310288..4311910, Cluster 16
cctatgtctattaacttcatgtggttacaattgatcaattctctacttctagtgtttgagaaaaaacgtgtcatttcttcttcaagtagactaacttggtaatcgaggtttttgtaatatggaaatcatgctaatctttcatgagccatttttatataattaaaccaaaaaaattgtatccaatttaatttaacagtttgttgtaccattgtgaatccatagtggctagtttgcaccttctgatggtggcactatcatatttgaccccccctccatcccatttgtgtgggaaaataattaaataaacttatgtgaatcctttttgtgccaacttgggttactctctagtctctacttcaaccatggtttgcattgtctggcatgttggtctaatcacttctacaaaatttattttaggagacatctagttttattagcagatattggtgggtcgatatcatccggctcggtcaagaaaccaaatcagacaccggcctctcgtgccctaaccaggagcgcaacaatcttttggttgtggcctcatttcatactacatatataaacaaaagaatagggtcgacacatgaacttgtcaacccctctttcccaaacacacatatacacacacacacataagatcgtattgtcacagtaccctcttcttgaacacacacatatgagatcgtatctatctctatgcgataagtgaaggaaatgccgatgtcgtcatcatcaccatcctaatggccttgtcctagaacccaaaaggtataccgattctaacttcttcagcatagctattggttaaggagttttttatccgaaatttgatccaagccaaaaatatcccgaaccaaagccaaaaaacctaacccgaactgacacgtcttatagggaggcatgcatggacaaacccgatccgattttatagtagtcacgtacgggtcagatgcataacccggtccaattcacaacactagcaatgaccagcaaaagtaacagatactagcagtagctagagtggactcaggtagtcaggtagccgtagtaccaaactatataccaatgtaaaaaagcacaacgtgtatgggtgtctctctctatcggtcttaagctgagctcggccctcatcgggagtctgggaccatgactacactttgtcgtgtgcgtaacataattgtgcctgactgtgtggaccccggcggccggccgatgagggcgacccttctatatgcatatgcatgcatgcatgcatggctgctgatgcagccctgcagcacacagtggccggccagtcgcttttggccgtggggatgcatgtgtgcgcgtgttgcgtgcgccgtgccggccgggggctcccctgggctggcctccgtctccgtcccgtccatctcagacgacccacccagccacaaaggtaggcgcgcgcgcgggtgcggctccgatcgatcggccggcccacatccatgcatgcatccgccggcgcccggcctgccggacgacggacaccaccaccacaggccggaagaagtcggggacccagccagcacccccctgctggcctccagcctgcggctagctaccgatgtacatgcgcatcactcctgtgtctgtaccctccac

SEQ ID NO: 2742 - DNA, 2008 bp, Zea mays
  misc_feature (1)..(100): optimal_loci_220414_G1, chr6:82767125..82769132, Cluster 16
ttaagtggtgcaatcttaggtccatgatgtcagttgcatgtgtgttccatgctaacatggaattactaacttggtatgtcttttatatttaacccctcaactttatttgtgtcccatgaataggaccttgcttccatcttctctcttgctaaagctagcctgttggataccgcgattcccttcaattcgctattgcttatgtttgtcacatagttccttttctctactcctataaagcaccagtttccattgtttccaccattgtgtgtgtcacgcgtgcgaaatgtgtgcaacccgtcaatctcgctggaactgtggctatgatcccatccggttgatttgttggctcgatgaggcgcatctctgcttggcccgcctcggggactgcttccacgccatctacggtgcccctccctatgtcaattcgtctccatccctggcctgcgcgtgtgcgtttgagctaagactgaggctgactgtagtgatgcgcaggctggttgttgctgcagggagggtgaatctgatcagggagcacatcgactatgagggctactcggtgctgcccatggccatcggccaagacatgatcatcgccatccggagggccaatgaccgctatgtgtgggccaccgacgtcgacgacaagtacctcctctgcatctaccccgctgactcgaacaaggtgctccatgctctacccctatccatatacatagattggtattacaacatggtctaccacgacacgctcttcaaatatggctgcaccgttgccatcaagtgcttcggtcgcttcgcctgtccaaactcacgccagttcctggtccgtttaccttgctccatgtgatggatggatcgtttcttatgtttgtgttgcctctgcggcatctggttgaacggttgtgtgtccatgggtgcacgatgagtcgagggttgttcggtagctctactacgagagcggcgagcttctcctcgccgcagagttcatgtcgcacgagaccttggcaaagcatctcttccactgtatgggtgtgttcggatgcaagtccaggaatgttaggccaaatattggccttgccaagccaatttgcagtgtttggttggaggccaaattttggccatgcccatgaaatttcgtccatgctagtgccaatacttggtaaaaccagggcacccaaatcagctgcccaaatttggctgggccacattgcattttggtctcaaaccaaacactaaaatttgagcctaattttggtttagcctagctttggtcacttacctaattttggtcaggcttttttggtccacaaccaaacaggccctatgtttggtttctccttccttactcttctcttacattagctgcaactagcacacctgagtttgttagagttgatttcgatttttggtagcaaccatacaactcttcgtctaaatagattgtcagagtaacccataaaatataattatgtgtcgtcgcaacacacggacattgtactagtactatctaatggctgacagcctcgatggatccacatgcatacgttgacatgcatgcatgttgttgcaagtgtgatcgcaacctatggtgtggtgatcttgagggtcatttttagggacgaacacattaggagatcgactcctaattatggatcttttgagtcatttttcaagaatgagtcaatcacataaaagtgtgattagagtagggggaggttccttcgaggcttggcactaggcggtagcagagtcgtgtaggtgattctatctccctacctttgagggagggaccctagctctacctaagccaagtcatccagatatttctaacaatgggggccaacatatagtacccttaaagtgatgaccgaattcgacagagttaaggttcttagccatattttatccttcaagaaattattagtaatcgatagaaagtctatgaaatatagcgaaatgaaatggcagaaggcacaatacagacacttagatgtgtaaagaatcttgt

SEQ ID NO: 2743 - DNA, 1511 bp, Zea mays
  misc_feature (1)..(100): optimal_loci_225058_G1, chr6:108966731..108968241, Cluster 16
atcagctacatgcgtgcgcccataccctgccctccgccgaaaccgaggcggacggtctgaaccagtcgggagctcgagagaggaagcacgcgcggcgcggcgcgactgatcgattccccattcccgcacgtatttccatgcgcgggcgggcatccccttgcttgcttcacgtacggacgcaacgcgcactgtgtgtccagctccagcatgcagctagcggccgtgggcgcggcgcgatggcggccggccggccctcctctcgccgtatcccgcccggcccggcagggaagaagctagcagatcgtgcagtgtgctggccgatcaaccggccggcgctctaatctccaggccacctgctccatccgccagctagagcgatgcaatgcaagtactgacgaccaagttacactgcttgcttgctagcacgttcttgctggcgagcatgcctgcaggcaatgcagcagcctctcactactcgatagtcaggatgactacgtactgtcgcagaaagacgggaaacagaggagtaggttggaaatataagtctgcacttcaccggtgccagcttgaccaccatgcatcacctagctagtagaagctggtataaacccatactacactactacacctctagaggtcaccgaggtaattggcgcgcgcgcgctggtacaccaccgtagaccgtagtacgtgctgatcgatgacgacgctgccgcagggccaaatcaagacgttcgtccggatgctgctggctgccgccgtacgtgctgatcgatgacgacgcttgaaagtccacagcaggcaggatgtttcagtactaccactgcttcaaaggccgggaaaaaaaatcattggaggaccctttaagcgagcatgcatgcagcaaaaggcgaaagagacaagacaattccattccagcaatgcaatgcaatgcaaagcaagcatgcatcgatgatcgatcgaccgacgacgaaagtttgcatgcaacgacacacatacgtagagatcccacaaaaagcttcccgtcccatcgatcgaagacagcaccaagaatgatcaaataccggaacaaagggaactatcaagcaacagagttcagatgccgtcagaggctcagagcaatgtaaaggcgcgcggcgcgggaccttcaattcaacagtagccatgcacgcatgatgcatgcatcctgctaccaagagataaatcattgaatcatgggacaagcaagctgctgcaatactatatagcatgcagcaggcaagctagcagacaatgaagcacacgtccccgccaccggccgaccccatgcatgcatggcaagagaggaccacctggttatggtagtgtagccagtcagtcagactcagacagtgtctctcacatcacacacataccgttccctgaaaaccatgcatgcatgccaggtttcctatactgcctccttcaagaacccagaaacagtgacatacatatgcagagagacatactggcccgcctaagaaataccccgc

SEQ ID NO: 2744 - DNA, 3784 bp, Zea mays
  misc_feature (1)..(100): optimal_loci_233121_G1, chr6:148782326..148786109, Cluster 16
tcagtgccgatagcctgaggtctttagtactagcgctgacctggaatccaggcccatgaatatgatttggtggcgtggggtttggaagatgaacgtgagtgacgaagtgttcttcggctgagcagatcaggttggtgttgccagcgtttggaatcgtaggaaggaggaaggacgggagcattatgactccaagacaagtgacgctgtggttgcgagttgcgcaggagtacttttacagtctgacacaaatcggccagatcgacgatctccttaccaaatgctagatttttttctcttcttttttttgaaacttaatgggacgcagcttgctggtgacgaaaagaatagctcgggggctcccattggagttggaggatgggagctggcgtcgtcgcaacgcaaaaccaggttcagccaccatcgatggctctcgcggcgcccagcaacgcaagagcgggggagcgtgagaagagcaagaccacattggcacaaaggccccgactcggttgttcctataatttgtaccaatccgtttgcatgggaatcaacaacttgttgctcggatctccggctccgggccggccactcgggttcaagttcaatttgaatttcaattcaaaggcgacgcagagtggggtagtagaaagcaaagtaacaccgagtgcaccagcttttaatcacctcctctctctcttttttccccagccatggcaccgcacacacgccgttcgtgccacagaccacacaggtcacagggggtggcagtggtaggtagcctggcgctagcctataggacacgcgcagtcacgcagaacagcagcagtgtacaggtactgctacgcgtacagtacagtgtcagtccaggtccagtaggagtgcagtagtagcttgcaagctagcagagcaacatggcgagcatacaaaccagactccgacagtccgacggtctcgtctcgccgtcttggacgtgcaccaccaccgtggcaccgtccaccaccacaccaccggcgagcagcatgatggagggccatctcccgggggcgcgcatctcgatgcgcccaatattacctttcatgatggcgggttaccacgatcgtgatggctttcacgcgtcgaaccacgcacgcaaagtgccctccctccctctctttgcctcaagttttctttgcctaaatcattgccgagcgccggtccacgacgtacgtacgtatttgtcaacctacggtgtgtgatcatggcggctgataaattgatgggggcgaacgtgaggtagggaggggccagggaggagcatcggatgcctagttcggtagcctgtcgagcgagctgttcgtgcgtgcagagcgcggcatcgagaacgccggaggccaccggccggatgccgggtttggcatgcatgcatgcatgttcagagttctagtactctacactgtgatgagtttgtcaccatccatccatacttgccctttttttccccattgagatttgagagtctgagagctactatcttggtcttggaccacgaaatgatatgctgaacgtcgcttcttgtgcggtgctgaccgcatcgcctcgccaagcgaaggggaactgttgtcaacggttgccttccggtactagcaggtacattacccacaagctagatgactgtgcactttaaagaatataaattgatttctataacaactgctaagcaaattacagatatatatgatatacgacggagaaacaccatattcatgcaaatagactagatctacgtcaaatacgacagaaaatttttaccgtttcttaccaaaccagaaaccccttgctgctaatgagtgtctcagcagcagtgaacatgttgcgaaacggagccgcgcaggcaggagaggatgtcacagctacggcgcagcggagccggagcaggtcagcgcgttcgtgtgccttctcctccgcccgcccgtccgtccgaccaccggcaaactgagaacgtgtgtgcacgtactgccgtgcctttgccttgccacgcgatttcacgggatcggcagggaaacgattttcacagggcttctagtgaggtcaggcccagctaaaaatacacgggacacatgaggacgactcgggcaacggggctgttacatgccatttgcgttggtgggcttgactcgggcaacggggctgttacatgccatttgcattggtgggcttgactcgggaaaactgcacaggcttactgggcgttgtgccgacagggatacgggccttaggcagggacctctctatgtgggctttaacttcgtatacaagtgtgttaaaggggctgctgtttgtactgtctaagcgggccggatgctgatcaagcccaaaacaaaacaccgagaacatcttcacggctcaactgctaccaccaccacaagttcactgacgaaccaatgaacactatcacgtccacacatatacacagcccgtcctgttgtcgccaccggcatcggatgctttgcttgcgccatgcacgcttgcccttcctctcttttcctcaagtagaagacgagggaggatggaagctagcttagctacgccatgcttttgcgccccacaaccgcgtcaactgtcgccgatgccgatgagccaaccaccaccagggctttgtttcttctcgcggggaaaaaaaaaaggagaagcgagacgagccgcttttgcgaagagagagagagaacactgtgggaaaaaagctgcctttttttcaatcaaacggaacagtattgatacccgtcagtttgggaatctttcttccctccccgtccctgtccctgtccccggcttgctttgctcttgcttgtcagcgtttgctgtgcctttttgttcctggcgacggatcggcccatagcgtgcgtccaagattgtcaatttggtgggctttgtgaggtcgtcgtgtgatggaggccaaagccaggacgggaatagtttatttcgtggcatcccttcgttaccccaaagagcaacctcgccgctcttggatccatacccaaaggaggcgagctagggctaggagaaaaaaaggttccaaaactgttcgcaaatcatttgtttatgaatatgtggtgacaaagtggcatcggtaggctctagctggattggaggtactggtgtccccacgccatggggcctcgttcaaactcgaacgaaaacacgcagtacaattgtgtggaacgcagagaatcatgggcgtgcgcttgattagcgagccggccggagcggcgaaggttagccagccctaggaggctgtgattggacgattggggatttggtagcgcgggcggaaccgaacgctgcatggcgctctgccgctctgtgattcggcgcggggctggagggagggccccacgtgacttgctaaccactcgatttgtcgttaacggtttcggtcatgcgatgagtcgtttagctgcgcgggggggcgttgtcattggctggcaacgggagtagtatacatcgagagcttagatttagtccgaaagggaacatcatttcaagcagggatcttctacggcgcggcactaaccatatggacccaatgacgaatccaggaacgaggctgcctgcacccctgatccagcagacccaattagtaccgtatgctaattggatctcaagggtatccatgggaaagaaatcttctttcaattcaattttgaataacgagaggattcctccccaggatcccctcgggatgtctgatcactaaatcagccctcacggttatgagatgcatgcgcacgcataacagcagcaggccgca

SEQ ID NO: 2745 - DNA, 1600 bp, Zea mays
  misc_feature (1)..(100): optimal_loci_233217_G1, chr6:149120036..149121635, Cluster 16
agcatgactactctccttatttcatagttgatataatgtcgtttcgtcgttcgcttgatttttaagcagtttctatgcttctacaatgtattcatctctataaattagagctgcagtaattaaaacagctgtctttattttgaagggaacaaaacccactgtaagtgtggcactggctgacccagccgaagaatggaggttgggcaaacttggactgcaaaatttggacgaaacaacgacaacaagcaccgaacgcagactacacgggctagctatgcggtaaaaccaaatttgctaactgatcaggagccgctggccatgcaggcgccaggtgcagagcggctgaggcaagtgcagcgaggcgagaggccggagatgggagggccggagggggatccggcgagccgtcgacgccgaccaccgccgccgcctgcgtacgtgccaaataccaagtgagtgagtggaggatatccatgtccctgtggtcccttgccgtaaggccatcgcggcccagtcaggagtccccaaaggcccaccactcaacgtctccactctccaccagaaggcagaactagaagctctcgtcaagacgtcttcttcatcaacctcgctcgcgctcagccgctcgccggtccgccgtccgcgctcggcgctccgaggctggagattctgctgcactaggggaggtagggcggccggccgccctcaccttgcgctatggcccgtctactatacctctcgtttgtgcatgtattcttctagttttaaactgtaattaagctgtttttctatgtatatatctccaactttaaatattcaggcagatatggatatgttatcgatatggaatatctgcattcatatatacacagtactatagtatattagttctttgaacggtaagttgggaaatactatcggtattatagacactgccgtatgcagtaacctctagagctagccttgggatatacacgtatattggtaataacatactatcatgagcaaaccaaccgattttttgtaagctttctaaatccagcaaaagacaaccataataatggattggttgagtacttgagtaaaaagtttctatagaggcagacacaaaaatttatatctaaaatagctttcgccaaaatcgtaagcaaaatatatgtgccaggacagtcgaataaatggaacagctagcagtccagtcccgcactgcctgaacagtcacagggtaaggccgggtccatctctttttatatcaagcactaccatgcacgtggtcgcggcacggctccttggtgccccggaccacgtcgcaacggttgagcagtgcgcaacacagcctcgtcccggtctcccgagtccgtgggatggaagagggtcgggtctccatggcgtggctagatccgatccaagccgatccaatccatttctaccaatattatcactgacgcagtgacgtgacgctgatgcagcctagatccacgtcgctctcgctcctgtatacacacgtatgcccgagatatattaggccatgttcgtttacatgggcaagggagtggattgagcaggatttgttctcttccaccataaccgaacaagtttt

SEQ ID NO: 2746 - DNA, 2035 bp, Zea mays
  misc_feature (1)..(100): optimal_loci_233220_G1, chr6:149128179..149130213, Cluster 16
ttatgttttatgtttttactcaagtataagtaaataatatataaattaaaaaaaccttagcagcgtacgtagttgttttagtactgaggcagtacataaaaaaactattaataaaaacgtcgcaccatgctgatgttaacgtaggaacgctctaaaacccaccaccgcggccccacattccttccgttccgtgagtaggcgtaggtaggagtaggtgtaggtaggccgcgactccactaccactaggcagacaaaacgatctcttcagaatccccaaatgaaacgagcagcttatgcatggttggttggacgacagcctgattacgttggacaatacaatactagactagagtgattaaaaatactatgcaattaatttttttatgtaatcaccgtacagctaaaactattgaaaatcacaatatttttatatccaagtgctaatttattttatatttttaaaaagcaacagattctttctttcggtatctcttaacgtaaggtaaattataatataatatactagcggattaaatgattaagtatatctgttatctcttttaagatttgtctatgtcttttggtagtttgattacactgaaagcttgattggaggctattttttttttctccactaaaaagtacggtactttaaaaaaggcaaagcaggtgtcaaatgactcgcgcaagagagacgtcgccatcggcagatcaggcgggcctcgcttccggcccgagcccgaccccgacccctcgtgcacgcctggacccgaaggcatcttgccttcttcctgatgcagtcgctggcgggtagccggggaggataagcgagtcctaacccctcttcctttcttcaattaggtcgccccgctttctctagacgctggagcgtgtcatgtggccccctctacgcctgcctgtagctttcgttgttggcttgtccggtgtcctctcctcctcgtcctccagcgcgatcgcggtggttgcggcgtcctcctcctccctctgctccggtcgccggccggccgggacaacgtcatcgtggggctgcgcggcgacgagagcggcggccgcgccgtcggtcggacgccaacggggcaccaacctgagatggggttcgtacagctttttccggccggctcgaaatcctcgaactggattttcattggaaccggaaggttggcaaagaaaatacatgtacggtggtggttatactgcagaggttttggcctcggcgggaccgggaacatggagaatcaccggcacgccgccactgggttgtgtgacctgcaacagtacttctgacaagaggacaggtcaatgctttgggaggaggccaaccggcaagcgccccagccatgaatgaatcccatgacctggcctcggggctggagctcgccccggaacagcacgagcggccagcacgggagcctcacgtgcccgactgcgtgcctgcgcgcctctttctttctgatgaatttcgccttatccgatcgttggttgcccatgcccggtttgaacatttgctgtacccccacgtcgtctacctgggtcctgggttcattcacagcatgcatgctgctccattgctctggtgcttagagacacccacatgtcagtgatgaagaaaataagcgggcctgtttttgccggatctgacgttgctgaagcagtcgactcgatgtttattttgtgcagttccgtactttcctgttaatcatgacgcacggacggcgcagctcttcagtcaagcctagtgtaccagtcacaccgtcccattctccgcgaatttttactactgctcccaatcccaaaaatcttccacttctacaaatcttccacttctacacgcggttcaagtcaacttatttaaatctacctaatttatcaaaaaagaaatataattttagataggtatatcatgaaaatagatttcacaataaacctaataacatttatttgataccataaatatttatattttttataaaaaactaaacgaaaattgtttcactcttttttttaagggatcaac

SEQ ID NO: 2747 - DNA, 1860 bp, Zea mays
  misc_feature (1)..(100): optimal_loci_233867_G1, chr6:152306796..152308655, Cluster 16
tacaaaacttgtcaatttttagtggggccagctgacccctataaaacttgtcaatttctttacaaatatattgttaatatatttagataatgactaataaagttgaccttaatgactttgttgtctgtggcttcgctcctggtacgtacgtgcgtggtgacggctttgacaatgacaacaaaaggggccggaaaacgttcggtacaactcggtcactactacatgatgagtcgtatctataccatgtactgctcacgtgaaagcagtttgaccacgcccaccatctctttgtggagtactgaacattggggcggggaaaaaaaaaaagagagaactcattcccacccgaggctggctggatacatttttcatatgcatataagagatgaggatctcgagaaagtccgcatcgtttaccatttcatttcctcggtggctcagtgggcgcccggcccccccttttgcgtatgtatgctgtcatggggcaagattttacttaaatttgcaacgctggtgaatattccggccactttcgccgcacggtctcccccactcgtgggtgcaatttctgtaagaacttcctctgagcgaggcgagccgattgaaatggaactggggccacacgaacgaatggaattcccgtgcaggcaggcacaggcaggcccctcgggtgcgcaaagatcgcggttccgtacgcccgatcaggaaccaacaattgtatttgtaattggcgacgggtttatagtgggcgaaatctcgtttttctattctattcgggggtcaaaacgagcatccgggacacagcgccctttttaattcgcccctgccacgtgtccgataccgcgcgaaaaggccgtccggagtccgggccatcatttttgatggaataatgtgtgagcgaaacgcttcattcacatgattccagctttcttctcgctcctccacccgacacaaaagctatcgggtccctccgatcttaaaacgccttgttgaccatgctgttcgctggactactacatgcatcttcctgaaggctgagcttttgaccggggcatgtcacagccagtagttttctgcactaggttcactgacccacaaagcgcgcccgcaaactgctcgcagcgcgaagttgagctacacaaagggagcctgcagctagcagtaccaaacagtagtttgacttgttgtaatcatagtgagattaacaaaagttatcttcgccccggtacctggcattagcggccgacagagaatcaggccgccacactccccccacctccagggggaggtgatccggacggaggcggtcagtgcaagtgctcgtgctccccttcgatcgctctctctctctctcgcgcgcgcgctacaacgcatgcctactagccttttggctaaagctggaaatcccggagacgcagcaaagagaagcgtaacgcaggtttgttcagccctccaaacagacagctagctactagcaacagcaagtcctactttaccagattgaattttagaggatccacatcgcggtgtcttcttcaggtactattcgtgtacaaatgaaatccgctgcgcagcaattgccagactgcagcatgctaataagtactgctctctctgcatcgaattgtggaattcaaccaaatttcttttgggtgatacatatataacacaaagcaggtgtgtaagcactacaaggaatcacttagccagctagtagtgacaataagcaaatgcatagaggactgcaggagaggcaggcggcagaataaggtctcgtttggttgctttagcactctcttgttattagtgtaactgaaataaataataggcaaaaagtagaatttatatggtttagtcctt

SEQ ID NO: 2748 - DNA, 2057 bp, Zea mays
  misc_feature (1)..(100): optimal_loci_234483_G1, chr6:154767067..154769123, Cluster 16
agggcgacactagatgtttggactttggatagctggtcgtcgatggcgcaggggatgtgcgatagcgcgcggtaggcgcaataggccacagggaagggcaggggtacgcttgccgccgggggcagtgcgagcgaggagacgacgctagcccggggggcggcgttgggtggaacgacgcaagagcgcgcaaggtgggtaatgcgggagaaagaaaaaaaaatagaacaaattgttgtattgtttaatcgacactcttgattcaaaataaaatagagcttcaaaaactctatggagttgggttgctcaaaaaaataaagttgaggtgtttcgctgacttcgcttaactccatcctaaaatttggagttggagtggtctcaattatttgaatgagatcctttaggatatgtgtaattttgagaaagagtagtactgaagctgtttactaaatgagaacatgtgaaaccacggtaaaaaaatgtcaacaaaaagtatagattttacttggctagaggcgtggttatatagacggtgagatggttctaaattataaaatgtcttgcgctttgaaacggaacgggggaagcacttactacgtcacttgggcgaccatcgcgagactagacgagcgacactccaattcttcaaccatatccctttgcaggcgcaatccaccgagatcccggcaaaacctgctcagcctccggctggtcgacgaacttctccatccacgccacagcggcaacaggatcggagaaggcgacggcctgacgggacgcggcccaaatggtgcgcgcgactgatttcagctgggctggtcactccgcagccgcagccaccagcttcatcaattcctccggcggcttttgactactccatctccgcgtcacacgtctccttcctccggtcgatcaagacaagaggccgtctcatcagcagctccgcgtacgtagacacgcgacgtgatgcggtggcgtccttagctccagcggacggatgggccaggagccgcgggaggaagaaaaggcctgtacgagtaggaccatatcgccgtcgtctcggcgaaacaccgctgcggctataggtcggtccacctcatcggcagctccatcggtccacctcatgctgatcgagccatttcctttctgctgggcaaaccgtactcgttgacgctgtaagcacatcggcccctcatggtggtccactgcacccttggatgttcctgtcgcctggcgctggatccatcaaccagacgtcacgtcgttgaaaggctatggcttctatacgcaaaagtctctccattaatttgacggcctcctgctactgaaactttgtattgtacccatcggaggaagcttcgttattagcggaaacaattggacggaagatttcactatcggaaaaggctagcttgggttctgttgcttaggctagctagagatgtgatggaattttccatcctcatgttacaacgcagtcacattttcaaaccccgctatccaatcatacaattacacaagtcatcatatatatcttcatgctagagatcatgtccatagcaacaagctacacatcatctactaacattgtcataatctaatatctcttcatgcaagctaaatttccacatcaggataggaacatcacacactaacatatacatttaccttttaatataatctccctccatacactcatatacgaatgagtaatgacctatattatatatataagccaattattatataggccgtccaatttccgttcaggccattgtcatccacagtgcccgcagcaatctggaccatcccttctagttttcatcaaataattgcacgaaaacgcgcacgacagaaacctttgctcaaaggtactgcaggtacaagacatccacatgcactctgcagaagcagagctactgttcagtactagtttatttattgagaaaacaaaaatatgagcggggcattccgactaatgaaaatcaagtgtctgctgtctgctccaccttcagaccatggcatattatcggattcaaattcagtgaagttggcgaagc

SEQ ID NO: 2749 - DNA, 2082 bp, Zea mays
  misc_feature (1)..(100): optimal_loci_236118_G1, chr6:163100571..163102652, Cluster 16
tcctgacgcatgtcgagacgtggacgacaggagcatgcaaggcaccaccagtaagtccggacccccagagcaccgcatgctcgcatggcagtggcacgcacgcgcgcagctgctgaccgctcgttcgtcgcggcgcgtaggcgtagcgtagcgtagagtggtcgacgtacacgccggcggtccacccacgtaccgccgatctagaaaaagctagcgatggagggaggggcggttccgaacgttggcttcacgtttgcgtcgcttttagctatcgcatgcagaagcggccgggatcggacgagagataagctgcctacgtaccagcagctcgctctgcatcagctgagacagcaccggaaaaggcgatggccgaggccgagggcgtggcagacaggtatgatgagcacctttcggtacacagatttcgccgatcatgagttgagcgcaagcgcaaattaaaaaaggtagtcctcaataatctatggacacacaccgctacggcgctacctgccatctcgctcgctggctgcatgccttatctgactgctagacctcggactggaagcaacatgcgttggacagcacatcacagcactagcgcagcaccacttcgcgagcacagtcacacacacatttccagcaccgagcggatcgagaggggggaaaagaggggggctgttggacaaaggaagctagccaagcctttttgttttctctgctgggtggcactggctagtagctgaaaaaccatgcatcttttccttttttttccagccttctcattaggagcagccatgctcatgcatacaaagccgatcgatcacctaccaagaatgacaagaggggagtacaagccaacacgttcccggcctcgatcagtacgtggccagcatcactagcaccagccccttcagagtcgtctgagaagactgtgtgagagagagaatctatcaaacttgaccaccaccagctgaagctgaagcctagctctcttgtttatgcacactgctcgatcgcaatgcaatgcgtgctaaatcttcaactcgatcgcgcgcaaagaggcagcatatatgtgtcgggccggccgggattatcattggacttgtatgttgatttgatctgtggagaaaaaaaaacgtgtagttacgttacgtgcgcggtctgcctagcttttcgtcgtctttaagctagcgatgaacgaatgaaacgtccgtgtttgcttcactttaatttgtcgtgggtcgctgctaaagcatctatcatgcatgcatgcatgcatgctcgattttcctctccacgctgaaagccgaaagggatagcccacgtacagtacaggtacagcacagtcgtgtgtcgtgacacaggcggcctgcttcagtttcctgtgtcttcttctttctgaagcaagcagctgccactgcccactatgagcaccgcgcgccgcgcagcagcgcattgttttcgcgcctctcgaggcctgcaaagaagcccctccgcactagctagctagtacactacgcacaccgatgcaatacatactcccatgcatccatcgtccattgtttgtttgaggcgcgcgtagtacgtctgtcttctcgtcctcccctcggctcgatgcgcacgacgacaatggcgtcccgcgcccccattgcatggaagtcatcaaagctgcccggcctgtaaacaaggcctccctcccttctctcctctcctgcatcatgcatgcatggcgagaatcctattctactactacaccgcaccagccatgcccgccgcttttctggggaaaatcattaacaaatgcatgcaaaaaaggaaggttgcaaagttgcataattaagcaccgggaccgggactgttgttcccctctgacagcgttagcacgcatgttacctctactttgcacgctcggaatgggcaggcaggcagacagtcacagagagggagagaggaatgtgtggactctggctgaagcttccatggaccatgaccgacggacgactaattagcgagctgctgttaagtggcatgcacatggaaactaattaagtgcggttaagggttaacttggtgtctagcctc

SEQ ID NO: 2750 - DNA, 1441 bp, Zea mays
  misc_feature (1)..(100): optimal_loci_236523_G1, chr6:165202685..165204125, Cluster 16
ataatctattgctagatatggagtaagtgaagtggcggttcatggaaaacagatatcttcacttggtcttcgtgtagatctcctgtttgactgaccgcgagatgtcaccccatctaagttacgagtcagacacggagatttcgattttcatacctacacaaaaacaatggaaatagcagcacattttatcgcattttttttctctttacgtacctgtacatggtcagctggggaaagcgggagacagggacgggatgccaaacagaaaccaagtccgttgtctcgtcgggacgcggccggaaaagcaggccggccctgcaaggaaagcgagaaagattctcgaggcagagagacggcggggagcccggcgtccggttccgcgcccagcggcctagtagcccgccggtcagcacagcagctcacccgtgccgtgctggtgttgttctgtcgccgcgaccgcgaggcgtcgggtccagccagagccagcgcaccggggccggggcgcgggtgccgctgccgctgccgctgccgctgccgccgaagtgaccgcgcgcgacgacaagcagaagcagggaggcgcggatgcggacgaacgtgacctacccccgcccgcggcctcggcctcggagtttttttatattattattatttttggcgagcaaagccaaactggactcgccaacctggagagccacgtacgtacggcgggtggcgacaaccggacgaccgcccgctcggaggagaaacgaggcgcgagcctgctcggtcgaccggcggcggcggcggcgcagggcgttccatttctttccggcgtgctgttcgtttgccttgcgtgccggacctttgttaggtttggttcgtcgtccccgcgcgcgcgcgcgcgccgcccccacgtgttcaacgcggctcgccgttggttgactgcctgttttgcgacggcaatcaattatgtatacgtacttcgtttctggtcctggtttttcgaatcttaattacgtttcaactttcaaatatgaaaaggaaaatggaagtttcggagaggcgggcaggaagaacttcggcccggttcatggacctggaggccggtggcacgcaggtggacggatcatggatttggtaggggccgggaccgcgagatccggcaggaaacgccaccgcaaccgctcgtacgggagaaccgcgcgctcgctcgctagatctgccgtcccttccggtgcccggtactccggtcccgaaatacagcaggtcgctgtcagtaactggcaaccggctaatttgattgctaatttttagtcttgtgaatattctttaaaaagaagaagatatggttgttattttacccttagcaaccgggaaccgaaaacatgaccgtgttgctggttccgaaaacgtgaaaacaatctcattctcaccgtgttaaaatctagatttagtaacgtac

SEQ ID NO: 2751 - DNA, 2203 bp, Zea mays
  misc_feature (1)..(100): optimal_loci_236777_G1, chr6:166630956..166633158, Cluster 16
  modified_base (443)..(443): a, c, g, or t
  misc_feature (443)..(542): n is a, c, g, or t
  modified_base (444)..(444): a, c, g, or t
  modified_base (445)..(445): a, c, g, or t
  modified_base (446)..(446): a, c, g, or t
  modified_base (447)..(447): a, c, g, or t
  modified_base (448)..(448): a, c, g, or t
  modified_base (449)..(449): a, c, g, or t
  modified_base (450)..(450): a, c, g, or t
  modified_base (451)..(451): a, c, g, or t
  modified_base (452)..(452): a, c, g, or t
  modified_base (453)..(453): a, c, g, or t
  modified_base (454)..(454): a, c, g, or t
  modified_base (455)..(455): a, c, g, or t
  modified_base (456)..(456): a, c, g, or t
  modified_base (457)..(457): a, c, g, or t
  modified_base (458)..(458): a, c, g, or t
  modified_base (459)..(459): a, c, g, or t
  modified_base (460)..(460): a, c, g, or t
  modified_base (461)..(461): a, c, g, or t
  modified_base (462)..(462): a, c, g, or t
  modified_base (463)..(463): a, c, g, or t
  modified_base (464)..(464): a, c, g, or t
  modified_base (465)..(465): a, c, g, or t
  modified_base (466)..(466): a, c, g, or t
  modified_base (467)..(467): a, c, g, or t
  modified_base (468)..(468): a, c, g, or t
  modified_base (469)..(469): a, c, g, or t
  modified_base (470)..(470): a, c, g, or t
  modified_base (471)..(471): a, c, g, or t
  modified_base (472)..(472): a, c, g, or t
  modified_base (473)..(473): a, c, g, or t
  modified_base (474)..(474): a, c, g, or t
  modified_base (475)..(475): a, c, g, or t
  modified_base (476)..(476): a, c, g, or t
  modified_base (477)..(477): a, c, g, or t
  modified_base (478)..(478): a, c, g, or t
  modified_base (479)..(479): a, c, g, or t
  modified_base (480)..(480): a, c, g, or t
  modified_base (481)..(481): a, c, g, or t
  modified_base (482)..(482): a, c, g, or t
  modified_base (483)..(483): a, c, g, or t
  modified_base (484)..(484): a, c, g, or t
  modified_base (485)..(485): a, c, g, or t
  modified_base (486)..(486): a, c, g, or t
  modified_base (487)..(487): a, c, g, or t
  modified_base (488)..(488): a, c, g, or t
  modified_base (489)..(489): a, c, g, or t
  modified_base (490)..(490): a, c, g, or t
  modified_base (491)..(491): a, c, g, or t
  modified_base (492)..(492): a, c, g, or t
  modified_base (493)..(493): a, c, g, or t
  modified_base (494)..(494): a, c, g, or t
  modified_base (495)..(495): a, c, g, or t
  modified_base (496)..(496): a, c, g, or t
  modified_base (497)..(497): a, c, g, or t
  modified_base (498)..(498): a, c, g, or t
  modified_base (499)..(499): a, c, g, or t
  modified_base (500)..(500): a, c, g, or t
  modified_base (501)..(501): a, c, g, or t
  modified_base (502)..(502): a, c, g, or t
  modified_base (503)..(503): a, c, g, or t
  modified_base (504)..(504): a, c, g, or t
  modified_base (505)..(505): a, c, g, or t
  modified_base (506)..(506): a, c, g, or t
  modified_base (507)..(507): a, c, g, or t
  modified_base (508)..(508): a, c, g, or t
  modified_base (509)..(509): a, c, g, or t
  modified_base (510)..(510): a, c, g, or t
  modified_base (511)..(511): a, c, g, or t
  modified_base (512)..(512): a, c, g, or t
  modified_base (513)..(513): a, c, g, or t
  modified_base (514)..(514): a, c, g, or t
  modified_base (515)..(515): a, c, g, or t
  modified_base (516)..(516): a, c, g, or t
  modified_base (517)..(517): a, c, g, or t
  modified_base (518)..(518): a, c, g, or t
  modified_base (519)..(519): a, c, g, or t
  modified_base (520)..(520): a, c, g, or t
  modified_base (521)..(521): a, c, g, or t
  modified_base (522)..(522): a, c, g, or t
  modified_base (523)..(523): a, c, g, or t
  modified_base (524)..(524): a, c, g, or t
  modified_base (525)..(525): a, c, g, or t
  modified_base (526)..(526): a, c, g, or t
  modified_base (527)..(527): a, c, g, or t
  modified_base (528)..(528): a, c, g, or t
  modified_base (529)..(529): a, c, g, or t
  modified_base (530)..(530): a, c, g, or t
  modified_base (531)..(531): a, c, g, or t
  modified_base (532)..(532): a, c, g, or t
  modified_base (533)..(533): a, c, g, or t
  modified_base (534)..(534): a, c, g, or t
  modified_base (535)..(535): a, c, g, or t
  modified_base (536)..(536): a, c, g, or t
  modified_base (537)..(537): a, c, g, or t
  modified_base (538)..(538): a, c, g, or t
  modified_base (539)..(539): a, c, g, or t
  modified_base (540)..(540): a, c, g, or t
  modified_base (541)..(541): a, c, g, or t
  modified_base (542)..(542): a, c, g, or t
aaaactattgaagtttgattttttttttacgacaggcggcaggtcacatgcgcatgaatagttgaatacgacctccggccgctctctgcagcgcacagggatgaataatcaatcagcaggacggcctactcatgtctatcagtctattgtgaactagctagctagtcgtcctcttctttacccctgcctgctgcttttatgcgcgcgaaatcaaagaaaaaaaatgttcggtgatgatcgatcgcgctttctttctttttctttttttttttggtgtgggtgtgttgtgccgggagaaacggcgggaaaagatgggccttcttttttcctgcgaaatcatgcgggccttttatactcgcgcactcgtttaattccattttttattttgtgcgcaaacggcgctaatgatgcgcatgtgctggggggttggacgggcggcggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaaaacgcccccgcgcgcctctttggggcggcgggggggtatatatctctcgcgcgggcgcccctcatttttatgtttttgaaaagagagatttttttcttctttttccccccccgtgtgttttttgcgggggaaaagggggaaaaattttggtggatagggcccccccctcctttttttctttttttttggggggggtttttcccccggggaaaacccgggggaaaaaagggcccttttttttttccggaaaaaacaggggcctttttttcccggccgccccggggttttcccttttttttttttgcgcccccccccgcccctttttggcccccttttgggggggggggcccgggcgcgtttttggggggggtaaaaattctccccccaaaaggtctcccccccatttggggggcgccccctttttttttttttaaaaaaaaaaaaaaaaaaaagggcccccccccccggggggccccccaaatttttatggggaaaaaaaggggccccccctccccccccccggggtgtggtttttgggggggggggggggaaaaatttccccccccgttttttttttggggggggggccgcccccccccccccccccttctttttgggggggggggggggggaaatataggggcccccccgggggggccccccaggaaaaaaaaaaggaggggagggggctttttttttgttttaaaggggccctctttttcttttttctccaaaaccccccaaggggacccggggggggggggggggggggggggggaggagtgagttgttacgacgcgtcccgtcgaaaggcgcgcgccaaaaccaaaaggcaccgcacgtgtgcacagcagctcctgctccgtcgtcgtgtcccgtactagtactactactactcccgtcccgtcctcggacagggggacgtctccgcacggccgaaagcggcccagcagtagcaaatgctgctgcagctaggctgctgcactgcacgcacacggtactactagtacgtagtcctcctgcacagcaagcaattcgcagatcggccggccctccctccctggtggtggcggggaaaggaaaggaaaggaaaggacggctcacgctcgcggccgtgcacgcacacgcacgtgtcagctgctgcacctgcactgcgctgcgctgcgctgcgcacggttggtttgatttgattgggagaccagaccagaccggaccaccagggacagggaggaagtgaacgacactgaccggacctgccaatctggtttgcatgcatgcatggaaaaaaaaggaggaggaggaacgaacagtggtggttgcactttttcccgcctcgaaacatagcggccgggttcgagacttggggggtccgggttccaaactctgctccgtcgccgtcgccggggtcacgggaattttttttaattttttttacttttattacgacgagttgccgtcgaataaattcggagtaatccactcgcaagaagaaccggggagaaaaaaattgaacggaagattttgcagacgctaccgtacgcgaccgatgttctcaacacccaacacgtgcacgtccacgggcgatttttcggagtatgaacagtacacgactgtacgaagattaaaaaaaaacgaatcaagctgaatctcgggaccc

SEQ ID NO: 2752 - DNA, 1477 bp, Zea mays
  misc_feature (1)..(100): optimal_loci_238024_G1, chr7:4585328..4586804, Cluster 16
ttcgccgagtacttcaacactaggaaaagcagctgtttccggcagtggttacactggcctgatttgttcccaacataataacacaaagaacacatcaacccgttacactggccgcccagctgcagggatcggagggcctatgtcaaattgaagaaactttctttatttcactacgtacaacttgtaaccatatatatagcaggccaccagggcgtatgtaagggcgacacgcacgtaacgtcgttcagctagctatagccagcaagacggctatatctaggtagaggaaactaaatcagattagcgtgcttgctgattcgccggaggctgcagagaagatgagcacaagatgcatatatgtatgagctttgtctaattgatatactttaatatatgccggctggacgaatagaattaagggtcaccatccgatgatcgagacagatatgattcagcgcacagctacttgcgtacggtttgaacaaattaaaggagaaagcgaaaacgtcagcatcgacggatgtttcgagctccagactcctcgtcccggttgtcgctttcatatagccagccagaggttaggtgagcatcctatgtcctgctgcctggctgctgcaagtgtcaatgtctgtgtcagctagcaaagtccagtctcttagacagctagctagtccctgacttgcgtgcagtgcagtcgtccaagcccgggccccgatcatccatggacatacacccagctagctagctcgtgcgtggaactatgatgaatcctgtttgtacagcaaagcacacaatcaacacaaggacatcgccgtcgccgtcgccgtcgaacgaagaatcgtcgatccgatccggccggccggtgggcgctggaccgtcaagtcaagggcttcgatcatctgatccagcagaaaactactctaggcaacaggactactaatagtaattgctggctgtaatgctgccgtctgactacacattgcatgcaatatcccgaggcgacaaaccatgcgttaattctgcacgatggttgatcgatcagtatttcagagagagacggaacgtgcgtgagtgcgatggtttggtcgccgtggattcagtaaaggatatgctcacatgcacgcgtggaaacgaaggtcgttttgggggtagtaggtcccaaaacgatggcggttagcaactctccactactttcttccatggaaatacctcggttgaactctgggctttcccatttaaacggctagctttttcaactgggcttcgtctcctacctactaagctagtcgacttcttgttgcgctcttgaggaccgagcgtgcataacctcggttggcctgcttcccaggtgtccgtgtgtgggtagtgtcttcgtcctcgtgccatttttaaccttattttatatttggacatcctaacataagaaaaatagagagaaaaacttaacgctagagagatggttggttgtgcaaccctt

SEQ ID NO: 2753 - DNA, 1482 bp, Zea mays
  misc_feature (1)..(100): optimal_loci_238100_G1, chr7:4899227..4900708, Cluster 16
ccgccccagccatccaagatccaattatcccaacgttacatctctcggtgtcttgctcacccccacttaggcactactacaggtcgtcttgcactttagtccccacatgctgacatgcacactgctattgcttattatctagctagctagctagccacacgagaggaggaacacaactcctgcttgttcatgtggcgatcgatatatccacctcccaagacctaacagtattatagccacaagagcaactttcattatcttcgttcataatcggttcgattatagagtatacgtcgtagagattttttttttattatcgattgtgatagttcaaagttccaaagcgcgcggtagccaaaagccaaaagaatcagaaatagccaaagtatttggtgggattctcgctttttcccaccaagaatcgcttttttctctgttcaaagatatttgttgacacaccacgaaaacaaccatatgcatatggggtgtctcaaatgggagactgttttacaaattctagtcctctctctagatctctcggatttgaattcaaaatgaaaccctcagatccgatcccatacatataccaaagctataccatagcatatatagaacaacaacagagaatatatcgcatacacaggccacgtgtgtacgtacgcacttgcgtgcgcgcagtgcacgacgagggttagcttagctgtggtggactggacggcgacggcgaccgcgacctgcatgccgaggttgagctgggacggagaagattcggcgtgggcgctacccaacaagccacgcaaagcaaaaaaaacgcagagacgatgctagctgcagaaccaccgctgctgcatgccgattaactgcatgcgtccacgcggagtgggtgatctctcgggctggccggcaccggcaccctagctactagcctactatacgtacgccgcggcggcttgcgcttgtcgtcgtcctccgctcgccttctgccaccgcctgcgacgctgctggccggccggccggtgcgcggtggcgcgtgatagatgaccactgtgtgagctgaactgtatgcacatgcatgcatggggcatggccatggggggccggccggatccatgttgctggccggcgccccgtgctgcccgccggccgcacgcatccatgagaccgtgagcatgatggctgctgcctgacgatgatctgcagcagccagcagcacgagctggatcgatgtacgtggatgatagatggagcatgggcttaaatagttcccgccaggcccggcccgcctcctcctggcgcttttcacttgttgcagcccggcctggcccagcctggccacaaacacaaagcaatagctacatcatacacaactcttctttgtgcgattgtaatcacagactagtatatagcctatgttaacgttgtgatccacagaagggatagaatgggttggcggcggcatgagtgagagaggctgagggcggt

SEQ ID NO: 2754 - DNA, 3203 bp, Zea mays
  misc_feature (1)..(100): optimal_loci_260261_G1, chr7:141522643..141525845, Cluster 16
aacgtcgattacgacctcctcctcatcagtaaaagctcgagaggacggacgtcaatcatggcgctcgtgcagcctagcgcggcgtcgcggtacaggacattcacacatagctagcctcgctggtctggtctccccacacacagcctcctttgcatgctgccccggccggccggtcctgcacgcacgcgcgccaacctagctaccgcgcaacatgacaacactgtagcgctctaatatcttcatgcggaataacgtacgtgagaacgccacaagcaaattttctttattctctctgctgtgacagtagtttgtctgtttttttattattttgcatgctagagctgaaggaacagtggaatagggccaggcgtgggggagaggaacgaatgagaggtcaaatgtgtgtgtgctcatccatcctatcctattatacgaagacaggaggaccagagatccggctgtcgtgcccaggcgcagcagcccacttgaagtgagacagtacaagatagatgcagtcatgcatgcatgcgggcgggcgcgcggctggtctcaactcgcaagcaagctagtgtgcaatgtgcagcatggaatggaaatcgatcgagccagctggtggggagagagcgaaaagacctagtagatcagcagctggctcgatatctacgtcgattgtcgggcccgtgcgtggtcctccaccgtcgcaaccaccgtgcatgacgccaacacggtgccgcatgcatggttgcgcctcgatggctcgcgatggatcggccttagctgcctgtgtgacgcgcttggtggcgctcaggcttctccgcacagctacaactacaagcggtagcacgctgcagatcgagccaatcatgcgtgtgtagatcgatatcgatcagatcggatcggccaaccagcaccttgatttggcacggagaaaaaggagggacgaagcagagagaaaaaaggcttctttttcctcccggttccgggcggccaggccagcagcccaggtgcaggcatgtgggcgcgtcacttcaattcacagtcccgcggcctcggcggctcggcctctcgctcgctcgctctcgtcgtccgtctctgcacctaacgtcaggaatgggcgcaccgcacccagcgcccagagagctggcttgctttcggtcgttgatttgacgacgacgagcaacgcatgcatgatgcgagatgggggcggcgatcggcctcggtcgccggtcggtcggtcaggcacaggttggccgaggcggccggcgcaccatcgtccatccgctgccgcctgccaacatacgaggtgtgtgtgtctgatcgatctcatctgacatacccacccaaccagcacacacggacggaacaacaaccgagtgtggcgcatatataatgatttatttccatttcccgacggataatatttcttctctacacacaaggcacgttagctgctggggggcgccgcgagcactgcaaataagatagtcaaattttgacgtctcatatagtatatataatagtagtatgcgttatccaaacctgacaaataatcatttggaattaaagaatcggatatacatatacacgatctttcattcattcctctgcatggaccgtgccattcgattcggatcttgtccgggcgtgcttgtacttgtacgcacacgcactggctgccgctcagctgccggcgccgcacccggccgatcgaaatgccagctgcactgcactgcatgcgatgcgaggaggtgccacaaggccggcggtgatcgcctccgctccgccggttgttgctgaaggcggaaacttggaggccgctgcgccacgacacaggcgatctttaatttgtccctggccatgcataactgcgcgcggcatgcggcgtgcatgccgccgcagggaattgaatcgccggcaaagctgcaacgtgcctgatacacacatccggatggatcagcgaattcggcgcccgaccacatgctgctgctttcccaggagctgtcgtacacgctattgccttcgtcccatgctgccagtgccatgcatataggagcacaagtacagaacgattgaacgatactactacaatgcaagtctacaacacacacagacgatatatatagctgcgtgtatatataagaccatgaagccacatggatcttcagtactgtctctgtcctaaacgcatgcgattctagctttctaataaggtaaaactagaccagaggagaaatggctaatatattctgcgaatcaaccacaccccgtctcaataatgattgcacctaatatgccagcctttgtaggtctatagttccattcagcattcaggggggtccgagatgaaaacacaacagggatctgccaaagtctgattttcaccgttaagttatgagttgaatcggtggcagactcctgcccgggctctgaagccactgtctccgtagatttctattgtagaataacattgtacaaactacatgctttaattagctcaacgaaattatcccaggctataatcaaacgctgggtccgccactgagttgaatcaagcgtggttgaaaactgtctaaaatcaccggtgatagagaagtccggcatgttgaactctcctcttgcagtggacttgtcaaagacttttgtatcattcacatccacttttggtttaaatgcagatcccttttcattattcctcctctgtctgagtatgtgtactgcaccaccagctagctggatcgtgcatgcgcattcagatcacgtattaattctttttctgacctaataagcgcagtatatatagacgctctcgattgagaaagtcaaggttgatcacatcattcgcaacccaatccgagacgcaagagcgtaactgactttttactgtccaatgcaagtagttccgtaacaatagtatataccacgcacactgcacgccaaccttagcttttctcttcagtttggactgccttgcactcaacaaatatctgacgcacatatatacaaaaaccttgtgaagtctgaacacatacactcatctagcagcatccatgcatcgagctgcacgcaacgcgcgcggtcgagagggcggcacgtccggacaagatacgtacggcccaaacccgatcaagggccggccagcagcggaggggctccatccacacatgcacacactattcatgcacgaaggggtacgtgcgcgcggc

SEQ ID NO: 2755 - DNA, 2675 bp, Zea mays
  misc_feature (1)..(100): optimal_loci_260499_G1, chr7:142906213..142908887, Cluster 16
cagtggtgcccttgcaattgcttgcatgcgtcgaacgacaagcagcgcgcgcattcaaggccgaaccggggagcgcgtactcctctctactgctacgtactgctactactgcgctcctccgtgggccgccgcccggccggacggctccatttattgtgagctctgatggcgatcagatccacctcattctcgatcgatcggggtcagaggggaagaaggcccccccccgtacggcgcgcccccgcccttgtgcagtctgcgactggcgcgactcttctgcggcctccgcgagttaaaaacaaacgcaaagggacaaaggagcccaaccggtttcaggctcctgaagcttgtgcgaggtcagggttttgtctttggcttttgccgtgcgatgctgcttcgcaggctctcagcattgtcgtctccgtctgcccccccggccgcggcgtcttggcgccagccaacaccgcctggctgcggtctcaccggccgtgaagccaagcctgccacgttatgtctctccacatgtcgggtgcattattataaaaaaacgatgatggccgctacgaatgctactataaaatgacttctccaaacaagaaaatcgcatggagcgatttgcgagctttgggggtgccaggtgctgttgatcgatcgatcatcctcctactgctgtactactgctactgctgcggtgaactttcaaggtcaagatgctctgctggttgctggtggcgtgtcactcccatctcctcgatccgtccagcgcagcggcagcatgcacgaccaggatttttactcgggcgcggccgggaccgtctgctcgacaaagctccaccggcaggcacgcagcggtttttactgccacccacaggccacaggtactgcagcgagaaaagggcaagggggttcgggaccgggggcgaggaaaaagttgggaacaggatcccaaggccgccgcgctgcagtgcctgctgtgctgagaaagtccgggccccaataatgaagcgaagccggaagcggccggccctggctggctgctggctgcagcaagcagccccgcgcctcgagccgtgcgccgctgttactcgttgtacccgctcgcccgagttgacccccgcggccgcggcggaagccttcccgtccgcttctcctcctggcttggctccccccttgctttgccctttctttttattttgattttttttaaactgtgcctgccagccacgtccgcccgtgcctcccgcggcccgggccccgcgcgcgcgtggtcccgccgcactcccgtgcgacgcgatgcgatgcgatgggcggctctgcgcatgcgcctgcgcccgccgctccgctgattgcccgcgcgcgcccacgtcccgtccgtccgccgagcggggcacgcggggatgcgcgcgcgcgcgcgcggacacggagggaacagtgcgcagcggcgggggcggggtcgccgggcgctgcgcgctggctgcaggacgaatggacgatgcgatccttttggctcgtccgtgtgtccgttgctgatgatcccaaagcgtaacgaaccggccaagctgcgcaacttgcacgctccgcgtccgcgcgcgaggcgggagacacggccgcgaggcggactgcggaccgcggcgcggcgtgcggctgcgcactgcatctgcatctgcatgccccctcggggcgcgtggctggatctgcggggtaagctgtcgtcgcactgtgactctgtgactggctttgagctgtcctgggttcgcacgcggacagcgccgggcggctgggttcagggaccggacatttctgatctctgacgcagctcacaggcagtctgaagaatagaacgtttcaaacaagtttcattcattttacgtaccgtaacgtatcagcgagtttgttgaacccacaaaaagaagagaaaaaaaccccaatacaactcaacgcaaaaatatatcatgtcaaatttaaacaatgcgccataaaactttttgttaacagtgcccttacactttcaatcgtagttctggcagactgatttcaacgtaccagggaatctaaaacctggttacaaaacagtaataagagtaacgtaaaaaaatgaaattctgagtagttagtatattcagagaagaatggccgacacgaatacgcactcgcactcgccgaagctgctacattaaaaacctgttgcgcactgtacaccaaccaatcgcagtaaaaacctaacgcgctgtaccgcgaacagttcgtctggcctggtacaccttttatgaaagcggcaggaagtacgtatgtactggtacgattgcatatcgggttaatcgtggagcaaggatcctgtatgtttgtctcggagaattgggtacatgtactgttaatcctggagctgctccgctacgtacgtgtccactgtcccgaaagtagcgttcctacaacaaattctcctgttccaccatttccgttctcctatcatggacgaaggcggccctcctgtttccacagaagtggtacgtgtcatcattactctggacacagttaggccctgtttcgttcctttcttaaataattagacattagatcaaatcccaaatataaatcatgactaacaataaataaactagcggactgttcccgaccaggctagtaagcagtacgcagaacacatctataacgacagg

SEQ ID NO: 2756 - DNA, 2164 bp, Zea mays
  misc_feature (1)..(100): optimal_loci_261781_G1, chr7:150014783..150016946, Cluster 16
gtaccctgctaactgctaagttccagaatttctggatcgagtggttcactggtcaaaacttcacctaaaacgtacgtataccctgaccggctgaccctaccctctgcgaatactactacttctgtctggtcagctttcttgcccaccacaccacctgacccaccccccacactctaacaagtgaaataggaaggggtggcatggagagactgctggagccagcgtgtataaatccttacttgtagtagtacggtgctggctacgtactccgacgatccaacgactctacataaatgaatacactccgtacgtgtgtacagttcctctggcacctgccttcaaccaccattctgtactgtacgcacgtagcagtgtgtgaccaccttgtgctggtgtccgtctgtgctgtgcctgtgcatgcatgcctcccgcgcgcccaaacccaagaaagaaggtgcctaagctattggagccaaggaaattccgatttccaaaccgaacaaagagccgcaccgcatcgcatcgcatcgcatcgcgtgcacgtcgtttcaaaatcgattcaaaaatgggcgagcccgaacgtagcaggtttgcatggacgcgcgcgggggccggggccgggcggcgttaataaattcgtttggtgtgcatggcgctcacaacacgaccatatctcgtgacgcaaattaattttgcatcggcttcttgttgctgtatgctttttaatttggatgcttttaattaggtttgcatagcaacgctagtactccgtgtttatgctgtcctactcctaccccgcggacgacatctgctaagagacgaccgatcgacgaccctaccctggcaggagaccgggatccacagaaccgtgcgccgatccagccagcctaccccgcggcgcgcggttgccgatgcatgtgtatacgcatgcaatcttcgtagtagccttttccgcgtacggccaacggggtccgtccgttccgctccgttcgtcccgcaaatagacaggctgcagaggtttccagctgcttgttggcgcttttaatcgggctgtgactattgccgtggcttttacaatattaagctttatagattaagcttgctgaagtgcagctccggccatccccaatccccggcctgtatgcgaactgtgtctgtggcgggcgcggcgccggcgggcttgctgcctaccctagccgattcgatggatcgggcgccggtcagtagccctccagcccagcttggacgcactagcactctagctgcagctagtctcctctgtgctgtgcgtgcttgaaaagacgatggtcgatgggagtagaatctaggactaaatttcctagcctgcttaattagctagctgaacggccaactaatctgtcttttcctcgggcccatattcagcgtgcactttctagtcaagaagattgacaaaaccacaagcaccatgatctcgtcccaatcctgcctgccccatcttttgcgcacagcgttctgtttatttatgtagccctatatctatacggatgtagcgccaaaagggcagatgtttatacatatacctatagtacactgtagtgattctatttaaagtgcaggagcctttcagaactagtattgaaggtacctaataaagagcggcgcgctgtgtatgtgtggccactggccagcctcatcattagcacgtccggcccttaacaaataaaatttgccatcaagctgttttttttctcctccctcaacgatcccgggccgctaaatgtattttagtttgcgtggaatagggagacatgagattaaggatcaacaagcgtatgatatactatgttctgtttttttttctccttctgacagttgaaatttgtcgagcgttgttgtgtaaaatatttaatatttgcagcgcgcgcgcggcccagctagatagccattttcgtttcctttcatctttccgcttcagcagtccgctgacgcgcgtgattttacattatttagtttattacgttgggatagcctcacttcaataatattagatttatttttagttttttctgtccaaacagctccagctccacgagctatatctttaaaaataaactgaaacaaaagaccagtttcgtggaattttttaatctcctcgaagggtgccttaaaaacactattttca

SEQ ID NO: 2757 - DNA, 2232 bp, Zea mays
  misc_feature (1)..(100): optimal_loci_262987_G1, chr7:156671890..156674121, Cluster 16
ggatcttgaaggaacgcacgaaatgggaggctagaaggagatcctttgtacctgcggcaatcaggacacaatgaggacgacggggagaagggcgtcgagagggctgttgccgccgacggagtcgacgacgcggctcctgtctccctttttggaccgacctcctctcccctttgaccaggtgcctcttggatttgcatctgtactagcagatgaaaatgaattagggtttaagggtatagtttgttcctgtgaccacgtcgctgtgtacacgtctgccggcgatacgcatgcggaatggatggcactgcactggcgttgaagaagggctaaaaaagactgatgtgatcgtggagaggacgggtctcaccctgcaccacctcaaccaagggtccaaaagtcggtcaataacccactggtctatcgggtgcggcgcctctgacaattggcaatcgacgaagacgacgaggaggagattgcgccacgccacggtcagccgacgagggaaaaaaaaaagagtgaggatatctttgcattgcatcgggcacgggaactgcacttgttgtcctcgatcgttttgctgtagcgcggcggcagcgcttcgtcgtcgtgggtctcgtcaaaaagaccccgtcgacgcccgacgattctttcgttcgccggccgagcgggtttccgggggcgagggcgagacgccgggccggtgtctctttgttctctccggaatccggaggcagcaggacgctgctcgcccatgcagagcgtgctgtgctgatccgcgctggcgctagtcctcctggaccacggaccggcccggcgagctgtcaggacaggaggagatgtatccgccgctatcgatccatgcgtcgtctactactacaggctagtactaccgatgttgcagtctgaactctgcactgcgcatgccagggtatctctggccgacgggagcgagctgcgtcgatccgttgctacacggtctggctgaaagatctcctcgatcttctgcttcttactgtcttttgctacgtttcattctcttttttttttcctttttttacaaaaaaaaaaacactgtctttactggtacgtttctacatacagatgccaaatacaaatgcgtgtggtaggcttgactgcttgaggcggtagagtggtgaatggtgatgatgggcaaaaggacttgcatgaacaactcacaagagggttcagagctgaaacagcacacttgcgtgcaagcggagtaggacaagagacaaatccgcagcgcacattggcccttgcgctcatgtttttagcatcggccatgcatggcatggaatggaatggatgcatgcatcaataggaataggacatcgacaatctggagacaccagccagccagccttggcaacgcaattctgctcccctctcgtctctctctcccattcactcatccactcccttcccttcttgcatgattgcacactgcgtacgcagagcattccatcatgcaccgtgcatagaccgcgctgtggcaaggagacagatgaatgggcaaaggagtataaattccagcaggagagcaactactgattcggcgcgcacatcacatgggcggctgcggctccatgaaaagccccgccccgccccgacccagccatgatctcgtcggaccggcgcgcgcggtggcgccaaagcgccagcaggcagagaacattccaagccgcctttcgttgccccccttctcttttgattcctcactccagtccccatgtctccatccatggcggccatgtccgtctcgagccccagctgtgcctgtgtgtgagaggtactagactactgtttctctcgaggactgacgaccaaagcgagcacgttcggcgatctttccacgccattagaggacggacggccggtctctggtcgtggtcgagttgcgacggcatggcattggcatggcaggcagaggcgggtgcggggacagaaaggctgcctcatcattcgtactactgtcctgccttggctttgcctttgctcgctcgcttttggcagctaaatttgtgctgggttggattggatattggatatatacatgcagccaacagcaacagcaacggcaacggcaggcagctgactggtccatgggggtgtgtgtgtgtctgtgtgtaaacttacagtactgaccagccacgcatgcgtgatgcatccatctggttgggttccaccacccaccacatgcatgccttgccg

SEQ ID NO: 2758 - DNA, 1643 bp, Zea mays
  misc_feature (1)..(100): optimal_loci_262994_G1, chr7:156711755..156713397, Cluster 16
tgcacaatgttgttgtgtagaacctatcaagccgagtcttaaaccggtcaagccggcttggcctatgtgcaacacgtagaattcattagttatctactctcttggctagctattgttctaaggaacatttctcgactctttagtcaatcactggctcgagagttttgagtctggctcttgcttccgtcgtgatacaagtagagaataccgtttctgggctttctgtgttgtgtcggttttccggtatctgtggtcttattagtaaacatatggccttcaattaattcgagggcatcatggttgcgtgtttggtgcttttactgggtgattttgggacatttgaaaaaaatgaattagctctcattcatctcttctgtagtcactttacttgggtttttatttgcatattaaaaaacaatgaactgaaaacatataatttatagtgcaaacataatgttagtataaacttaggctcaaaatgttgactatgtttgagaatattctggtatatcataatcagctataagacggtctcaggtagtataaaatagggaacgtgaaagtgcagatgaccttgtttaataccttttacatagtgaaatttgaaatataggatgagattgctggagataacaaccattatcgacagctctttatacaaacagtaacctgctgctacgaggcgacaattatattagcttaataccgatggaatggatcgatctgtccgtctgaagatgaagcaaagctagagaagcgacagttagttcttaccgatcgagcttcaagtggccggttggatcgatgttgtacctgtactgtacgtgcgcgcatgatggtgctcactgtgctgtgaacatgatgcggctagtggctgtgagggacgtgaagaaggcgagctcgcgtccatcgatggatcaccgtccgaccggtcgggccgcgtgcacggcacagctgagaggtcaggcgtatgcacagcacagtggtgtgctgtgggtgcggtggtgggcgccgccgcggcctcctttgcgtgctccctcccttgcatctccgcgcggcagcgccttttctccccatgcagacggcacgatcattgggcggtacggtgtcgctgccgcaaaacctttccccggaccgggggggccgactggccgaggcaactccttgggagcctgggaggtcgagatcgtggtgccactgctcggccgctcccttgcgcccccgccgacaccgaaccgatcgccggccggccggcccatggtttgggattcgggaataaaggcctgcgagcctcaaccaaaccattttgttacaggcgcaccgcttggggccttccccaatccccatgatgaccaccattgcagatgcgctgcgtggaacgctaatgggcctgttctgcgagtgcgaataacggatcggcccattgcagcgctaatgggcctgttttacgagtgcgagtagagcggatcgatctaagactcacccaggcctgtccgcacatctgcgatggtccctaggccacaatagagggcccaaaggctgagatactgaagcctgcggacgcccagacaatgacaccgaagacttgttctcttataaaatttagacagtagtgtatccatagtttaactaaaaacactgtt

SEQ ID NO: 2759 - DNA, 1532 bp, Zea mays
  misc_feature (1)..(100): optimal_loci_263621_G1, chr7:159748131..159749662, Cluster 16
cacgcatggcagcacgcctagtactctttttttttttttttgccgcttatcaatgacgagcagcagtcgacaagccgcgccgagggggacgacggccgagcacaacggccaaaccggaccccgggtacggtggcgcgagcaagcacggaagggccgtacggatgggcgaagctgatcccgacccgcatggcccacgccagcgtgtgggcggcccacccatcccacgcgcacccgctgcgctgggatggggtgggacgcagatagagctgccgaatcctccgtgacgagcgggtcccacgtcgacgcggtggcgcacgcgacacgtcgtacgcgacggggaccggacgcctgcctggctgcctgcctttttcctgccttgtggagccgtcctcacgtcggggaggcctgattattttatgcataggctaggcgcgcgggtgccgtcgccgtacaatcttaggggggttccgtacgggacggcgtgtaccgtccgtccagcccacggtcgggtccaccacgctccggggcccgcgggcagcgtagcgtcactggcacggccacgagggggccatgtgtgcgtgcgctgccctgccctgccctgccatgctccgggctaccgcagcgaacaccgcgcgtggcctgtggttttctgccgcctggacggtcgggctcgaatcggtgtgctggcttggcttgtcctctctctctctctctctgtttcaccaggccactggtagagtggtaggttgagctacaactgctggtgtttatcactcacagtcacaggttaccgacgacgagtacatcctcttttgccgtcaattaatctcgaaaaccagtacaagtcacgttccaacagtaatctaccgctaccggtaacaaagaaaaggctgcaggaccctctctctctctctcacttccacagataaaacttggacgagatcgtgtggttaccctccctccctggaagcctgggcgttacgttcgatggcaggaaataaggcttgcagcgactccagtctccaggcgtgctgaaactgcctatcatcattttattttataacaggaaaaaaggcagcaccgtagctgtatttatgtatttatacgtgcacgcgaaagtgttttcaggattgatttattatatacactgtttacaggtttctaaatgatgcagcatgccacgtgaagagggtgcgagggtaggggacaccatgccattgccaagttggctcagtcgtcaaagtgatacgtcagaccagaagaaactactcgccgatttatttttttttctagtatatgtacatggctttttttatgcacttggatctacactagatatatatctagacatataataacatatatttttaaaaaagataaaaataccttataacttaaaatagatagcgtatttgtttttgtacagtctccaatggataacagtttgcactcccaaaataaaagacaaggaggaaaaaaaatctagtaagtgtgtcgtcatgtgttgccatatagcatttttttgtggtggg

SEQ ID NO: 2760 - DNA, 1578 bp, Zea mays
  misc_feature (1)..(100): optimal_loci_263795_G1, chr7:160593568..160595145, Cluster 16
cgccatggcccgacgcggagagctagcagctgctcccgtcccggacggacccagggcggacggggagccttttgtttgttaataatctacgttatccccgggggcgcgccgtcgccgtcgcccatccacccggcccgcgaccgcgacgacggtttccctccccaaacatgtccgtcccggtccgattaatatcttctcgtccactatattatgaccatgtgaaacgaggggggaggggggaggaggagaaagaacacgcgaacgctcgcgtggatcgaggtcgttgtcacgggttccacagaagccatccctgctggagagcgagagtgagtgagggaagcaggtgtaggtgtcgttacctatttgttgtcaccgttacgttccaagaagaagataaaaaaaaggctggcagaacaatcctcctgtctggcgtctctgcccttggggtaaagaaagaaagaaagatcttttccattccatgccgcgagatttttcatccagctgtgtgggtggtgctgttgggcaagttgcgttccgacagaccaaagcgttgcattgttgaaggggtgtggggttgctgatttgtgaggcagagaaaactgactgagtgagtgagtagtagtagtagaccggaaatctggagctgatttgggtgaggatcgatcagagagcgagtgcaggccatgggccattctctggagtctggactctgatcgcctgatctcatccatccgtacccgtgctcctccctgaccgtcgtagctcacaagtgctggagtgcagtgcagtgcagtgcagcgcgcagtacgccagtaccccgtgctgtgctccggttgctctcgtcgtcgtcgtctgcggttagccagttactgtgcggtgggccgggctctcggtcaaatcggttgcccgacctgacgtggagagcctgcctgctgagagcttcagttctcacagctgcaagaatctcgcgtcacccccttcccgctggcgcgcctgctagcctggaaccggaaagaataaaatcgtagcagtccacgaaatccggggcgcagcttgcattgcattactgtgtgtgtgtgacactgacacccacacacatcagcacacacacgcacgcacacatcagtgcatagcttagcttagcttaacgaacagccacggctatcggctttgccagaaaacgaccctccctcctcacgccgccggcctctctcgttcacggtcacgggggcgggcgggcgggcgcacggcgatcgattcccgctgaatcattggagcggcggcgcgtaatgctccaccccttttttgttttgtctcgtcctgcttggacgcaagcatttatccgctcccttttgttgcggagctcagaaaccttttttttttctcttcttctccggcgggcgaatacggtcgattatattactcgcctgttagatcagcagatcggcacggcgaggccggttgctgcggttaacgctgccgtttatgcgattgcttcgatggtgattggtcactctgatggacatgggcggatctaaagggctccagcgcccttacgtgtatgaaactacgatggga

SEQ ID NO: 2761 - DNA, 1809 bp, Zea mays
  misc_feature (1)..(100): optimal_loci_264075_G1, chr7:161906288..161908096, Cluster 16
ctgattaactaacatcatcatcaacgtcaacgacacaattgcggaaaaaaatataaacaaaagcatgcaggaacgagacgtcatggcgtccatattaacagaaacacacggcaatatttacttaggatatgttggctttgaagtggattgagagagggattagaggaaattaaatctaatccgttccaatcccctcaatccatacacttctaaccgattgtttgaatattctagtattcaccaatctacatgtgttgagatggatcgagtaaattagttaaagccttagggggccagggtggatgattggttgcgcatatatgccaagtttcagtccggccttcgaggtttgggggcatatttctgctttctagctagagacccaggtttggtgctgctgatattagtagcatgttttaaagaagcttaagacatgataatataaaataagaactttaagagtgtatttgtataaaactataattacggtcatagcctgtttggctggaacttggaagtctcacaggaacgtacttgtctgacagggcaaggcaactatcgcggggagcaaaccagacgagcccatattattatatgattcagacgataataattaagctcaaactggcctctcggtcagtgctgcggcgcgcggtggtggcctctgacaacatcacagcatgcatgcacctgcgagtttatcgaccccaaccacatgtacggtgcacgcctgccaacagctgagagagatcagtgagatttcatgtgcagcgcgtcatctatgcacagctgcaggggcgaccgcgcgcagaagccgtagctaggaaacgccggcccggccggaccagctagcgcgcaggcgcaagcactagggggcggcagcggcacggggaaaatacgcggggtaggacgagaacggccgacggaacgtcgcgcggcggccgggtcgttatcgcgtgggcgggcgggcgggcgggagaagtggctccggggccggcctggctcgatcgctctcgctcgcggttggggtcggggagcggacgcggggacgggggagggaatctcgcgacgagagggtggcggaatctaacaaaagaaggtgggcttggaccgatccgctggccggccagccgcccggccggctggctagtggacgccctgctgcgcgcggcctacgcacggacgggccccccacgatccatgccccccttttcgcaccgtttctcccgcgacatcattacgcgcgccgacccgatcgacgagacgcctgttcggcgctgttggcttcagattaaaaagcacctccccctccttcctccttcccgcgcgctcccccacgaccagtcgaccacgtacccgtcgttggcatcgtcaatgtctgccgcgagggccgaagggggcgtcgcactcccaggccaggtcctctcccggccggtcccggccgagctagctccgtctccggccggccggagacatccccagttaccccactacaattctcagatggtgatccgcacgtgtgtagagaattcgagatacgttgtataccagcctgctaacacaaccaccaacgacaacagttgcagcattacgtacgtgtttttcactcgataatattagctactattatgagcgtatttggtacagctatggctcttaaaaaaactattgtaggtcatatagcttatggaaaaactacacacgttcaaaaagtagcaaacaactatataaaataactctctattttcatcagttcaaaaggtagcaagacataagccaaaagcaggattcaatatacttttaaaatag

SEQ ID NO: 2762 - DNA, 1614 bp, Zea mays
  misc_feature (1)..(100): optimal_loci_264103_G1, chr7:162031061..162032674, Cluster 16
tcgtacagaaagaagaaaaaaagaaaaaagaaactccgtgacgcagttcggttgtccctgctgctgctgcttgtccctatcctccgtccgtctctctgtcgcgtcgcagttgttgggctgtaggcgccggcctgtagatgacgcgtgcgtcgtgaagacgacgcttggagcgaataatcctgacgggagcgaggtgatcggtgaggaagaagcaggtcttgcattgtgctggcgccaagcgagctcgtcgtcgtcgtcgtcgtcggcagggagctaggtcccgcctcgctcgtccgtccgtccgcccgcccctgggcctggctgcagcctgctgctgcggtgcgtgaaccgtgtgttgtggctgcagccacacagagagcccgtggttttgcttcactgtcagtgactccggatgggaaatgttagtgctggccgcgcgcggccgtcaccgtcccatccgtcaccgtcatgcgagccgccgcgcgtagaatgaacgggaggattgcaaccattttttgacgaagccgtacactctagtagtgtactggtactgttctgcagcccgtctgtcttgtcgtcgtcgcctagctagctccctcgcctttcgatggattttctggttctgtgtcacttgtgccgacttcctacgttttgaggacagatccaactgtagtgtcggctggataattcttggattgcaagcaaaccgtgcggcagtcctgtgttacgaacttactagtagtaaagttgcgtccatccttccgagtcatacggaggtgtgacatgcttgctgcttttatccatgccagaccacactagcctctgttcctccggataattccaactccaccaacggacgttccatgctccagattatatataaatatatatccagtgtcagggtcagggtgggtatggtagcgtaataatgatttaaatttcgcggtgaactttttgaccggcttcggtttggttccttccgaccagtcgagggagggagggagcgatggatggcgcctacctgatgatgaaacttgacgaatctcgcagcacagcatcattcagaacagctggcggtgcgagtcctgggcgtgcgtagcgtagcgtgacctctctcgctcgctttcgagcgcgacgtgcgatcccgcgcccataccctcctgcgcccgtcgtcacggcacggaccaactcgatgcaccatgtctcgtcgatgatcgcggtggcacagggcacggcacagcgggcaggtggtggcaggtcctctggtgtccaggagcagcggcctagagccgccgcgcgcgtcggcgtcgccgctgcgcgcgcgcgagcgcgaagccagcagaaactgcagagattccaaggcggcctctgtgggctgtggcctcagacgtgaaggccttcctgttcctggtccagaatgcagtccagtgaaggcccatgtacgtgacgggccagtaccatttcttctcaggctcggaaagtgaagccacggcctgggctgcattggtctttccgattttcagacaactgtgggcaaactctttctttctttctttttactagcggaatgcggatgtgcagtgcagtccatcactatgacagacaagctcacac

SEQ ID NO: 2763 - DNA, 2072 bp, Zea mays
  misc_feature (1)..(100): optimal_loci_264298_G1, chr7:162961557..162963628, Cluster 16
tcgttcaaatgagaatgagctagagtcatcataaggaaacagggcccccaaaaaaaacaatactagtagtagtgagtagtgaccaactttgcaaaagctgcaatgagtccgtggccatgcatatggatcgcctcatttcacgcactcattttgctgcctgcccttttggacagtgctacctctgcttaggtttctcgtgatgccgtcaccaggaacagcagttgacctctgccttacgcaaggaatcacagtcaccatagcttatccagtttatttccatgtgttgacgaattcgcagggttgcgtgtgcaattggggaaaaacacacacacacatacacagcttcttcctgcaacgtgtggtcatggtggggcatcccacgcgcagcacgacgcggagagcaatgcgagtctggcctccggcgcggccatggctgaccttcggtgcggcggacggcgacgcacgcagcccgcacagcacgcaattggacgcggagctggctgcgagtccaaggctgaacggcggcgggtcgcaggctacgatggtggggcggccgggtgggcgttgaggcgggtttggctagcggcggggcgcagcgcacgttgggttgcggggtgagccgcgaggaaggaaggggtggcgcatgcgagtccacgagaattgaagacagggagagaaacaataaaaatcgaaccggtatgcgatgcgacagtagttggtaattttcaccgattatatgaaagaacagtatttttttgttcagattaccctttgaggtactctataaatctaatagattcgagagctagatccatattttgacggatctagagtggatggagtagaaagtgtttagcagacaaaactgacaatgggactgttttgatggatctaaagttgttgagagtaatttggatttacaattttttgccggggtccctggaccctgatgacaaaccctgttggaatcgtcctgctagtatactagctctaagatgtttttttaaatggtgttagcttttagaagtagctcacaatatgtttagaattacatgacaatctcacataattgaaaatgtatgtataaaactagttcttggttaagagctagtagttttttctttctcttccattaaaatataaaataaaatatttagagctaactcctaaatcattgttgaggccacccttagagtgtactccaataaattatgaatagttatagatagaccccatgattatcaattgcagccatactctatctatgttgctggtgcatgtggcatttaaggtacttctccattggaacatgcagaacactactcctgcttgacttgtttgtacttggtaccatgctcgtactgtcaacagtgtcactaggcttttcaatgaaccagcccaatcagacgggtaccatttccatgtaccacgccggcacatgcgcttgtaacctcacgtccgtgttctctactgctgcctggcatctccccgtgtcctgtactaggtgttgttggcattcggcaagatgccccctagcctgtgtgactttgagtcgagcgactgatgatgggtgtgctgtgaaagtctcaaatccagtttctttaaaaaaaagctgatttctgactttttgtggcgagcaacaagttcttggctagggctagagcctagtagtagattctaatcgctttggggtttggatgatacgagtaattgattgataagagcggcacctcaagtatcaacaggatatgatatccatcccaagaagagaagaatcaacaggatgtcgctggagttagccagcatgcgatctggagtttttgaccttttggtttggcgcagcgcaacgcatgggacgacaacagcacagtggagtggagtggacgagtggtggccttggcccttgggctaggactgagacacaggcgtcagtgttagccgtgctgcacaccatagcttgggcccatggtccatggacacggacaagagaccttctgatgagtctctggcacagcgctgtacgttcatctcctgagctgagaccaccgggctaggcgcgcgcgcggcacttt

SEQ ID NO: 2764 - DNA, 1634 bp, Zea mays
  misc_feature (1)..(100): optimal_loci_264423_G1, chr7:163793625..163795258, Cluster 16
ccttttttaaaagccgcagcgggcccagcgtggggacaaggaggaggtacgtgtgtgcgcaggccgccgcatcgctcgccacgtgcagcgccgcggccagcctcgtgtggccccacgacagctcactgccccagaggccaacttgccgggtcgccgggcaggccctcgcgcgcgacgccgaacccgcgcccggtgcgcatgacgcgtggggcacggacggccgggacccgcaggtgcggctggatggtgtggcgtgcgaactgcgaaggttgctgcggatggatccctcgtctacacgcctagttcgcgttggatgacacgcgggtccagggcaccaccgggcccgcaggccggtggttggcatgtatgaatgacggtgacggctgggtgttggcgcgctgggctgccggagatggagttcacatccacggttgctcctccgcgttgcatgacacgcgggcccgaggcgtgctggccccgcaagtcggtggacggctgcgcggcgcggcgcgtgttggtgattgggtacggtatagtgctagggtctgcaaggggcaagcggtgctgtcgcgacgtctgcggttggaggacgacacgtcactccgggtggggttgacggcgacgtactggcgcgccgtgtccaggtgtcgggctgcggcggcgcggggcagaacggacggcagctatggagcccggctgtcccccgagtgtggaccccgcgcaacaagtggatggcggatagcctatgcctgtggacccacggccgtggagtctcgcatcgcctgcggacatgacgaaacggtttcaactttcaaggtccacgcccattattacccagagacgatggagctataatctccattttctctttgttatatgatgacaggtaaacagcagtaagtttgccgaattttgcacttgcaaatctatcctacacagtactaccttcgtccatatgagtctgcaaccctagattcattcaccatcagactatctagaatctaactaaagttatacaaaaatattctacaaataatctgttgataaatatttggcacgatcgattttaatatatattttttgtgtaaatttggtcgaactaaatatggtttaatccagctcgtgctatagaattgctgttacccggaccaaggggtacttgtgttgtgtgaaaatgttgtttctcaagcactggtcagtttctgccaacgttgagacagagggttagttctcgctttcttcgagggctagactactagagtctaatgcgcataggagaaaaatccaggggtaaaaaggtcgtcttgcaaattgtgcatacatcaacaatacatagtttccatcatacacacattcgctcaaaattttatgtgctgttctaaatttaagtttttcctgaacaatgttgatcagtttttttcggaaatatgtagcatctaaaaaaccaaatatggttacctctgaaatatttgttagtaaaattggttggatgctatgttttagcaaaactcgtttgatgttatttaaggtatagtaaccacacatcggtgttgtctgatctcctgtttagattttaaggtatagtagttagctgttaataattactcgtagtttattatatcgaaacagatttg

SEQ ID NO: 2765 - DNA, 1686 bp, Zea mays
  misc_feature (1)..(100): optimal_loci_264454_G1, chr7:163959564..163961249, Cluster 16
acggtgaataagtttgtatcttccgaatttggagtgacagctcaccattttaacttcttcggtgccttaacaaactttgaaatgaatgaggctgtcggttgatgggagtcgactcagctgagctgagctgctgcgcccccaacgacccacttgtcacatgcatgtgtgcgattttccgcccttaaaagagcttgattgatgcgaatcgccggcggcaaccggaagctagcattttacagtgcaaaagtctcctgatcgattgatccgtccgatccatcgggtgccttttctgcgcacatgattgtgtatggatgctgcacgcacgcttgcagatgcaagtgcagtgcagtgcagtgcagttcatcgatccaagcgtcgcacacacgcatccatgtatggaccaccaactgctctcgttcaggtggctggggacctcgagcttgaggtcgtacttgttttatttggtggggatggggggtcatgtgaagtagacgcacgtctgttgtagggttttcaacctgatcgactcagccagctgctcgtcttgtttgttttactctgaagaagaacgcaaggacagttagaatcagaagcttcgggcaggtataggatcaattactgcctgtgtgtttgcattgcatgcatatgcacaggtgtatatataccgctcccgctggttagcagttcaaccaccacacagtcttcagcgagtttggtttcagtttgacgaagaaccagatgccgcctggctgtggatccgatccgcctgctagctccaaactcatcacacacagtactttgagtcggtgatgaactggcccggccagtcctggtcccaacctgcttatgtgctttacgtataactagcatatctcttaaggttcttctttatggcaagaatcaaccagccgttgctttctgcagccagtttcagacagcttaggtgactcgctctcctgcttcagctttgaacatgtaacggcatcttcatgcatgggcccatggtcacaccacgtacgcgtctttctgacgagccacaggaagccaatgctcgttgaacgtacaatcaagttcgagtaatcttaccattaacacatgatatgctgctatataggagtatttgctgcttgcagctggcttgaggcagctagcagaatctcctggagccgcgtagccagcactccacaagttccactcgatcgccagtcgaagcacgcgccccggcctcacggtgttcagagacgatggtgttctaagattggccttggccatgagggggccgtatccctgcagcttcttttgcgacgaatgaagctagaaaaagggcagggagaaagacatatataagccgcgagcctcatgtgtgattcatgatatttgtgggtggccctgaaatcctgatgccatgggatcggaattgaacaatgatgccccccgcccctcatcacaaggccccgcctgaacaatgatgccattggatcggcttttctttatcctcacgatccaaaaggacggtcccgatgaagaaacttccagttcagctttttggtgggtgacatgcatgtgagcgagagcaagctgctcgagatcgggtgtgaaccgatctgtcccaaaatcagatgagaacccacctttagccctgtttggttacatcacatataacgagtcccacttcctatatgttcg

SEQ ID NO: 2766 - DNA, 1920 bp, Zea mays
  misc_feature (1)..(100): optimal_loci_264775_G1, chr7:165806858..165808777, Cluster 16
cggaaaggcctggccttggactggacctggcgcgcgccgttggacctccctcccacggccgtcgccgtctaatccccccgcgtgatggcgtcgccggcgtcccggctcgcgccggtgcacggttgcaccagatgcaaccagacggggctggtgagccgcgaccaccgaccggcgcgcgcgggctcggcagccgtgtcaaaactcaaaagtccctcggctctgtaccatgcgtaccgtgcgccgtgtggtctagcgtggtcggtacaccactgtactagtactactagcatgccatttggacatatgcgcgttgcgcatagaagtgaagtaagtagtaagccacagtgaaactgtaatactgctacttgtcatctcgggatgacgtggcatgatgcaatcgatcagccctgctttgcctccatagttgagttcgcgtgccactgccattgccagattgtgaggggaaagggaaacgctcccagcgggctccaggaaacgcggaccgtgtgctgtgagcgtgtcgcggggcctccggtctggaaggaatgtgcatgtgcatgagctgcaggcaaaggcaacgagggtggcccggggcctggtggaccaccgtggctggttggccgggccggccggcctgcctgcctgccgtgcctggggaggttcggtatagcggtttgtgctcgactgcatcctgtcccttccggttatgctgagtatgcgttttgggggagaaagcaacagactctccgattccgtgtctgccttcaaaaaaaaaaattagaccatgtaaatattcgtacttagcagccaaaatatataataccacgataacacatgttataatgctaattaacaaagatattataatgtaaactctttctcatgttttctttatacatctcattggcactctaacccatgcgagcccttttacttattccacatgactacaaagagagacgctggacattgggtggccgtcgaaattctaaaaggaacgatgacagaacaacatcatcagattaaggatcattcttctctccaaatgaggggtgaaggggcgaacattggtttcaaattccatggctagtatgttcgatggaactgatgctcgagattccaaggccattagattgatggttagttatgaaggacacaacttttaactcacagaaatgcatgactgcttaagcaatgttgttcgttcattctccccttggaagggactgagtggatggctattatgtctagcatgtccgaagaacatgtaaatcatgcattagggatggcattaaatgctccaacaaaacatcacctaaggcacttgatactagtgaatcggtcttgtaattataataactaggatcatgaacaagatagctctcttgaggagagatgttcaaataagctttgacatcataatatctttggaggctctcttgaggagaagatatgctacgggtgcaagattacaaatgagcctatcccggtcacagttgtacacttgtactagcacgccgatatacatctttataggtaattactagtctatccttgctgttacaccgcaacctttcgtgtttgactccgtgtaagctcatagtagaagtgcatttggtcgtgtttgtttatttttttcaacttgtgtggttctttaatggttcaactagagtatatgaagactatagttgtaaccacagaacaggtttcttctatctcatcccataaaacaggattgttgtactaagcaaatattttctaccgttcaaaacaaaaacaaatcaaatcaatctaaaacatccatcacatcaggtgtcgtgtcgtgtctgtcatttcttcccaataatcagactacgttagtattttattgaatgaactgccactacttcagtgtttgtcgccttgtattattattagttt

SEQ ID NO: 2767 - DNA, 2446 bp, Zea mays
  misc_feature (1)..(100): optimal_loci_264944_G1, chr7:166852833..166855278, Cluster 16
ggcagagccccgacctaaactaccacacatactgcctactggtagaaaattattcatagcatctacctacactacactattgcaaattaaaggactctagaattctacatacagtgtgtggaatgtggaaactgcatgcatgctgtcaagcaaaattaaaccctagagaatagaatagaaatatactcgtactacaaaaaggtgaatggtcaaacaaaataggatcaaatctgggcgtgcagatacgatccccggccgtgtcgtctttaacctagcttaacaagtagcacagcgcgcgcagatcacggctcccaataatccaacaccacgcaccgaaaggaacaatgcagagctagctagcgagatctcagctcgcgtgacgcctacgcgggccgacgccgaccgatattacagaaaaccatacagagtacaaaaccatagtagagtattggtgcaagcaacagaattgaaggaccacagcactgaataatgctgtgactgtgagctctactaggagctaaagaagccacggtattacctttgagagagagagagagagagagagaccatgcatgtgccaggccttgcatgatgccactgcattggccagcctaacgcgctcttttaatttggcacttgttgcatgctttataccaggatctcggccgccaaagctagctttacaatgcgtggcgatcttcttgcttgcgtggggcggccctgactggcgcgcatgtgatctctctccttgtagcctccaagtgtgacaggcttaaaaatatcagggttcatcagccgagagaggtaaattaaagagagagagatattggttgcgaatttgttattgttcaattcgcaagggctggtagtgctagctagctgtgcccggcccccacccgccttgctagctagatcacacgccaatgatttgttattatgtatgaaaacctgcaaaagcggccgtgctttccctgctgcatgcagggtttattcgaggttaagtggttggccgggaagccgtcttttggcatcgtcgacgtcgccggccaattattccaacgccgccgacggccggtagtgtgtcatgtgccggtggcgccggccggtgccagattcttttgcgcacaaagcaacttagcttgcaccaccacctgcatctttccacgcgtgcgccggtaaaaagatggagcaaagccatcggcattattagccaggtccccgccatgcatgtaattaaacgactagtatatataccagtccacatgtgtaatagtacatatatgtagtatgatcatgcaatgcatacatgacccagcagagaatctttagggctgctgcgtgcataaggaattggtaaaaccgcgtacgggtcgatctgctgctacgtggccttgcttggcttttccaagttgagtccggccggtttctatgtatgtggctgctgctgggacactcaagaccgatctcgcttgactaactgtggtcctgtgctattaattgttccttctttaaactacaaaatatatactatagctgtggtgtggcttaacttgcctcgttgtgcgctagctagctagacttgagcacacacactactgatgatgagctttccgggctaagggcatctacgagtacactgcagcaagcatatatatatttctatgctaccagttcgagggccgcatcaaaagtaccttgcgtgcgtgatgttatattagctgtcgcgccgcgatgctcctggtccagaggcacgggtgccagtggttgcccatcccgcccacacacaccgtcattgtcgggcacgccacacgcatatgcatgcatgtgtatgttgagggcgggaaagatatatgcatgcatgtgtttataaccccttggtttcaaaatacgtataataaaaagattgaaaactatttatggtacacgtactgtgtatatatattccatgaaaattttaaaaactactgatggtatctattttgcatagtctgtattatattaattggtacgagtggggtggggtggtcagcagatcgagttaaagagattttattttgagcagcagagatcgttaatgaaccaaataaattttcagaaacgttcttgtagttccatttgcatggagtatatatatatatggacgtgtagccacacacagtcgttgcattcttcgttccgagcgagcgagactactgtgccgaatgggtgatggatgcatgcatggcccacatgttgtgtggtcatcacctccaacggccggcctgcaccgcaccgcagtgagcagcctgtagccagtaagcagcagggttccagcagctccggcggctgatacgccgaatcgctgcacgcagcggcagggaaacgggagaggcccgaccgagcgagggccggcggcagcgcctggtcagagagggcatgtggcctggcgctccctccgtccgcgcgc

SEQ ID NO: 2768 - DNA, 1655 bp, Zea mays
  misc_feature (1)..(100): optimal_loci_265149_G1, chr7:167975559..167977213, Cluster 16
catgacttcgaatcagtcaacaagaatttaggggcgtgtttgctttttttctcatatacttttcttcagacttgtgtcatgtattgatacgaaacttgaatcctattcaacattagttttttattatcttatttgttttcatcacgttgtcttcttggcctcctatgaattttcgtcatgcgtcggtattgattacattctcttgtttgtttgagacctaccttcgatttgagtttaacaagatgcatggcgccgggtttggtagaggtaaacatgctccacactaacgtctacgccatgcatttttgctgttgatcaagcaggcgtttttttttttttttgcgaagacggagagggagggatgggcatagagcgcacatggttctctgcagcgaaccacacggcggtacgtgcaagtactaccatctgtccttgctcctctggactgccagcatgtctcggatctgcatctcgatcgccccctgtcgtctccggcgcgtcagggactcttacgctagctagcttgcatccacacgtggaacgtacagtaggggcatgcatgtactgttcggcatggaattaaacaacaaactgaatgcgaacgagtagatactccgtagccctaggtgcccatctgtttacgcgcttctagaacctgtgtttagcgagctactagtactagtagtcaaagccagtaagccacgcatgcgcccgcgtacaggcaggcaggcaggcaggctggccaacgagaagaaagcatgcaggacagactcgcgcgcgcgtgggcgcacagcgaagacgtacccgtaccggagatccgccgcccgtcctggtcatcctgcgcgcgcacaggcacagctgctccggtcccccgggccccggccgcgcccgtcgtcggcgcacgcatgcagcggccaactgcgacgtgtcctggagcggatctgctgcgtctgcccccacagtcacacacagctagccgtagccagcacggcggccgctgctccgtcgagcgcccaaactctgccacgtactagacgcacggatacgcatgcacacaccgcacacgcaccttctacagcacacgatcgatccatgcatcgactgcacttaatactgatggatcgctttctttttagcatacgtactgtgattaattacgacgatatgatgcatgacccgaccagctaagctgacagtcatcaatcattgctcgatcgatcgggcctagccagctgctccaatccacttccagtgccagtgtgattcattgttcttcaatgctagccctgctgaatgcgtacgtagcacatgcatcgtatatagtagcagtagcaagcattcgcgcgagcatgtctctactctctactacgttcatactgtacagcgcttataaatttgtatatgctttgctatggtccccaaataaaaaaataacatattaaaaaacaaaagaaaagccttatatatatatatatatccatatctctgtggacgaagaagatacgcatgcatgtctcccgatccgatcatttatttgcaagcttatacaaatgccgggtgtgtgcaccgcccggtgcccgctgacatatacacattcctaatgggtgggtactaagagtatagtatagcatatttagatagataaaaaaactcga

SEQ ID NO: 2769 - DNA, 3366 bp, Zea mays
  misc_feature (1)..(100): optimal_loci_265388_G1, chr7:169168295..169171660, Cluster 16
ctatagctaactttctctctctcttgtcctaatcaatcaccctaattatgtccctaactagctagtgtcagttcagtgcacgaatacacatatgttctttaacatacagacaacagtatcacatcaaacagtttgtgcgtacataatatatagacgactatatatataataaaacactgctgcccgcagtatctttctcgcgtgcatgcatgcatgcatgcaatgatatgataaaaaatggattgatatttcagaggaatctcgagatgcgagaaacgttgttgtgatttgcgcggcacgatacatgtctagaaaactggtttttaacggcatctgggcatggtgtgtgtcatctgcagataatgtggcccgatgcctgacgatctagcttcgggggtgagaggccggaagatgacaacattctttgcatgatctctctctctctctctctctctctctctctcttactagccagtagtcgctctcatcacatctatcacaaatatatctaaagcatatatatattgaagcagtatactattcatatatatttatatggatggtctctctttctctagctctctcctcaccacagcagcactcgagcagcaggcagcagtgttcttttgtgcccttattattctatgcatatttccccagtcaaagatagatctagacctggcaacacacagatgcagtactactgggccacatgtgggcatggggataggtcatgtgatgtactcacaatatgtctaccacacaaacatatgattaaagcaaccttgtcatatgtggaacagaatcttccataatattcaaactccacacccaatccacactgcatgcgcgctgaagcaaatagttgtgttgtgtcacacacatgccctgctgcttgcctcagtaatgtactaccattgcatctactactactccatctctgcacccccggccctccagcttgaaattgaactatctgctgccttcttgtcttgctagctagcaggatcgtcggagtagtttcttcgaatgaactcgtccttctggttttcttttgtttatttgtttttgttcatcgtcctttagagaggaggatagtacatgcaatataatagcttttgcacaagcagtaggctgccatatgggcagtgtgtaccaaattgtactgaaatatataggtcatgcagacacagtagctggcggagctgcagcctcctgaattgcatttgatgcatgcttgtggcatgcaactgatgacgagtacttgcatgccaaaaacctagctgcatctattgatcacctgcaggcaggcaggcaggggggtctagctagaatggatctctcatctttcattgggtgtgtgtatctagtttgactctttggttccataacatctgtgcttgcttgaatgttgaatggatatctttcatgttttgaagactttgcaagctagccagcagtacacagggtctctgcttcaaactttgaagtagtaacgactcactcgctttcactctgggcagctggctggctggctaggtagctagctagctagaagtgactgtgcaactctcatcagttcatgatggtatgtgcatgcatgctgtgaccaaagagagaggggaaaaaaggaagagaaactagctttgttttgtttggttcaatgctggttgaaaagttggggggagaggggggggggggtatcaggaatgtttgttttcttgcacattgatacgatgatattaatggaagcagcagccttgcatcaccatcacacacacacacacacatgcatcatgcagatgcagctatagcagggcagcaggcaggcctgcctgggactctgggaggaggctgggctgggaaaggggcaatagaaaaatgcagctgcagctgcattgcattgcatgcactgccctcctcgaaagtggatccctcccctccccctgcctagctagctttgcattgcacttgcacccctctctggagtctggatagatggtcataactctctccatttactactagtatccactgtactactatactgctctctctctctctctctctctctctctcctctctctcgacctgtgagatcgatcgagtgccagagttgggtgtgtgtgagtgaggtctcagcaggtctggtgtgttgctgttccatggaagtcacggggctgccttgaaacttgcaagcaggcagtctcagccggccggcagcagcaggcagcagcacgaaacaaaagtatctctcgttgtgtacaaccatacagaggcagctatagctagagccagcagcccaccagacccggagagagaattaagcatgcgcgtgtgtgcgcactgccgcagcatgcagtgcagcagccgcatgcaggcggtggcgggtagaacaatttggtcactaaataccatgaggatacgggccgtgcggtgcagtgcagtgcagtgcatgctcgcgcgcaattatctagagagctagctagcgcgccaccaccaccagctcctccgatccctctgcgtgcgtggtgtgtaaccgtgcacggacgggacagcgccaccagctcctctgaccatctcttttttttttttcttttctatgcattcctatgccttatatatagatatattatttatttattaaatgatccatcagcaagcccgtgcctgctgccacggacgcatcggaccacgggtcgttgcattgccaagtgttctgctgttccatcacgcacgtcaaatccattcacccatccatcgaccgatcgttatcgtcgtcgacccggccgtccggccggcgacgtactagtactccctcctacgtgacgctgctgcagcggccagagagctgggagagggagggagggtggcagaggcagaggacgcacgacaacgggcgttcacgcacggagactcgcttttggaggcacacacatgcatgttgaacgcccggctccatctagtcctccgaccctgttcaccagtctcgtctcaaaaggacccagcagctacctagctagctatatagcttgcattgcaggcggccggaacttaacggcagccgaacgctacagagcaaacagttgtgtccctctggtcctgttgaaccatatatgttgttactactagctggctagagctagctagatcctagtcatatttatactaatgccatagcagtgcccagttatattaaaggaggggatgatataactgattagttatagcttgttggcaaatcggagcaaattaaagttagcattacggcaaaaaagaggtataaactagttgtattcccttgtctagctaccgagcatgtatatagttacaggtttcttcatgggaaaaatgatatgcatatgt

SEQ ID NO: 2770 - DNA, 2160 bp, Zea mays
  misc_feature (1)..(100): optimal_loci_269371_G1, chr8:13213844..13216003, Cluster 16
tgtcctcaaattgtaaagcaccccaaacaatttcttttgatggttcactagttagttgcttatcttgcgaatcctgcaacgatatttttttctttcttaaacaaagaattaccaacacagaatttctaatgctgttgtattagtcaaaggaattataacctttgatcctccaggttcttcgctgtggcagacaaccggacaagccgagccgtggcacaccggcgtagcagcagtgtcctccatcccgaccatgccggagaactcggcggcggcgatgtcgttctccatcccgaccacgccgaagatctcggcggcggtgatgtcgttctccatcccggcaccgcgggcaggagatatctgcggcggcggtgggagggagtggtgtggccgaggtgctcgaagctctgtacggcggcggcggcggcgggggagatggaggggcggtacaacacgccgacggcggcgtgggggagaggagcacgtaagctctctgcggcgaggcacgccgtttgctgtgaagaacagcaaggctgttaaagggacgcgcgaaaccaaactccatacctttggatgttgttccagcgaaccagtgttgcggttgtgataatcgcaaatatatctcgaaataaaattgcatttgcgaacctggctgaacaggagacaaccagccgtcccgccagaacgaggcggcagctcgtgcgacgccaccgccgcggcgggttatcgccgcctcgcgcgctgtcagactagcgcgcaggcaggttgccgccggtctctcctggcctcctaggatgtggtcgaatggaatcgccctcctctcgacctaggccgtctgcggactgcggttgcggccttgcggggcggggagccgtaggactcggcgctgcggcggcgttaacgccgaaatgaccacggggcgcgggccggagggacgccgtgccccatatctacagttccacgggctactttggtagataaacaccaccgggccaggttgtcgcgcaaaatctagaaaaagcccaatgtaaacttttgggccttttttccaggcgcatccatgaatgccacctccaaccaaacccacctacgacagaattccgtgggagaaattccgtcgggcgctcccacacgcacgcgaaagagggaacaactgccgagatttcgtccgcagattccgctccaaatcacccgggtctaggccgccaacgcggcaacgccgccgctgccacctcgagggcgcggaacctggccgcagcaccagccaccatccggcaaggcagagctcggtggtgcgagtgcgccgcgggatgcctggccgccgccgccccgaccactctggcgagaacgacgccggagcgagcgcaggcaagacccgcgctgggccggccgccgccgcctcgggcgcgcacgctgctacatcacccagtgcacaagtctgggacttggacctcttgcgccattcgccgccccagccccctccactgcctctctcccgctgacgacaacgctcctgcaacgcaacgcaccgcccctgccctcgccgacgctgacgtcctgctgcgccgcccggtccagctctatgcgacggactgcggcgctggcaggcccacggccgccaggaggaggtggtcgtctccagcagtctcggcaggaggaggctcctcctcaacgccagaattgaagcacagtcgtggcgtggcagcagtcgcgggatgttctgctgggagtgcacgaggagatccagagcatgatgcctgcgaaagcaggcttcccttgcggctcagaatcccgcatcagaaccttactatagttgtaaaattttactgatatctaaagatgacttttgcgttttagttatacattcttggctccaggaaatatggttctgtagttggtcaacgttagcatcgcagcctttgtgtgcattatttactggacttggtcgggtcgggtggaccaagtttttgtgtgtgtgtggaatacaatacaatacatcacacgagcatcctcaattacctctgctgaaaatatttgcttcttttagcttgaactactcatttaaatttctgccaactgatctttaaacaggtgttcagaatacaccagattcacagacctaagttgatgaacgccaactgatctgtaaacaagtgatgagaa

SEQ ID NO: 2771 - DNA, 1532 bp, Zea mays
  misc_feature (1)..(100): optimal_loci_269424_G1, chr8:13432092..13433623, Cluster 16
ctgttcgcacagtaattccgtgtttgcgcagatgaccaagcaaatagtctctcttttcaaagctaaataaactacgtgcagacagagagccaaattaaacatacagttgtagtcgtcgtagtaaacaacccaaaccccccgtgccatgcatgcatccaggtcatcagacgacgcaacagttcgctgctgcatgcctgcatttgccgccgagcacgagctgcctgccaggctttctcccccctccctgctgtcgtttgttcggttgttccccgtcaccgggccaatggaaaccccaacccaaacccacccgcccacagaacgccgggggcgagaaaaagaaaatacagtacagacgcaagatccaaggcctgcgactgcgagtcgactggacgcctttcacctcctcctcgggaatctgaaaccgctgggggctcgcagagtgatcggatcagatccgtctgtccatcggtcggtgacgtccaactgtagcgtattgtaccgtccttgtagcagtagtattacaggagtagtagagtgatcaactgatagctgatcagagaagaaggcttgaagcgaagggagggaaccagagtttttttttcaccctttctctctctctctgcagctggttgggggaagccgcaccgccgtgtagtgcagtgcaggccagcttttttattggtttgggctagttgtgcaacagtatttgtactagtactgccgcgggcagaataatgtgccgctagcgaccagaaggcggcgagtcactcttgcgtggcaaaagcgtacggcgatggactatagtcctcggcgatgagacttgagacgggtacgcttcgttattagtttattaggtcttgggttggtagctagagaggaggaagggggatatagtatatatataatatctgtttagttttttatgaacataatatctgtttagttttttatgaactcatcagaatatatatatgttcgctgaacctaaacgttgctaactgctggtgctaagtgattggtcgatcaacttggggtgatgctggacagcagaaacccaggaaaagaaaaagaacaatatcgtctgctggcgtgtcccggccggtacgaccaaaaaaaaaccaatcggaatcatcacctagggtcgaaggcaagaaagaagcggccacgccgggagaacaagcagcgccgccgccgccgccgcgggcacgtacgaacggcgcgcgccgggccgggcaggggagcgccgagcgcgccactccaggccaaagtcgctgcaccggctcatcttatcactccctcgcacgtagtaggcacatacccaaatattgacccatcccgtctccgtgacacaggcgcacgaaaccgacgaggcgaggacgcacgcacggtgtccacccaggaacaggaagtatgtgcctgtgatacgtacatatatcgaactggacctttttatatatatatatatatatatccaggtggaggtgacacgacctttttagtttcctacagcattgttcaatcaccaagctata

SEQ ID NO: 2772 - DNA, 2605 bp, Zea mays
  misc_feature (1)..(100): optimal_loci_270453_G1, chr8:19828438..19831042, Cluster 16
aggagtagagattattagagcgcagtcaaacgaggcgagggctggtgaagctggcggggtgagacggtgagtcggtgactggggcatggaattggccggatgcttcgttggacagttgattggcgccgtggttgagtaacgcaggaggaggatcacgacgccataatgggccacgagtccaggaatgaaaactgggccctaaaatgaatacttacccatatggccaagagaatgaggaaagcccattggccgacacgctcctaccagttcgtcctcacagccgaccccgctcgatctggcgcctgcggcttgcaaaacaaaaaaagagaagagaaaaagaaactcataacctttttcgttccaaggcaatattggccttggtggtactccagtgtctagttgagtctgtttattttgtagaaaacctgcgttcctgtgggcacatgtatgccagtgcacagtgcagtagtgtcactggtgccatcgtcggtccagatcgagctggctgttcatgcttgtacacaacagtgcagtagcaggttcgttcgcgcactactgggtgctgcaaatcaggagagaatttctttccattttatttctgttaggaatgtgtatgactacgacggcattatttggaggctacgttgtggtcgcgcgtacccggcccgtctgaaaatgacttgttgcccctcttgcatctgtatctgtatatgttggacaatgacagcctaatcctatcatctctctaaactcttgtgtccgatacactggcacgggccaccagtccacccccggcgcgcagcctctgcaaccgtattcatacgtacgtgaagggggttcgggggtggtgggggtagggggtagctcaccacatcactgtcaacgactgacacgtgctgactactgctaacggaagcagttaggccaagctaatcccccatgccacctcttagcttagctagctctcgcttcagatcgatgcttcgtatgaaacgagaggctctagactctcgagatgaggacgagatgctatgacaacgtaacggcgtgcaagcacgcacgccaccgatggcagagcagagccgtcggccgacgagcgagctagctagctgccgcgaactcaccgagcggacgcacgagcgagaaacagcgaacagcctctcggcgcggcgccgtctgtgtcgtcgcgtgcgtccgtccggcgatcgagccgtgccggatttgatgtgagccgttgggagatgacagatgatatagaataacctactacgggctacggcctcggcctacggctgatgaggacctcccgacaaaatggtggtagatggccaggcacacgctacctgtccaactgaaactagccagcgcgcgcgcgcgcccctgccgccggggaagcaaacagtccgccccttgtcctgcacgcgcccagcaatctctgccggcgaagcaacggcacgcatgcgacgtgaccgcgacatccgccgggccggcgtgtacaagccgcgcgccgatcgatataggcaccggctggctgagcctgacctcggtccgttgatcgaccagccgtcgtcagggtcaggcccaggcaggccggtcggccgacggcgacgggacgaaggagcccggaaaacggccagctagccggccggccggcagcgtgattggcgccgccagttggcgcgtcgcgtacggccgcagcgcgccgccgcggccgcctagctaggactgggagtctatccgggacgtcgtacgtggcgggctcggtgtcgctgctgcctgcccctgtggcgccgccgccttgagcacgccgccaggataggcctcgcggccacacatatgcaaagctcaaaagctgtccctgttcagcgtgtacttacgagctagttgcgtgcttcgagctcatgtcctcccatctgtgtagtacaacacactagtactagtacacccgatgtatcgtcgtcggtccagcaaggcagcaactgtatatatcgcacgtgccttttttcgtaccttttctcgatctcttttcccagttcctgtgagatgggtcgaaggcacgcactgaccaaaacgagaccaagtgcctgcccccggccacgcactagctttgacgtgctggcgcgtggcgcagagcgggcggcgctggctaacgatgcataatactgtacctcgacggcgacgtcgtcgtcgtcgatctctcacgttttctttgcgccttctgcctcgccggtgcgcggcattcagttcgccatacatggaaaaggtggctacgcaactttgctctctctctctctctagggatcctagaagataccaagtaactaccaagtggacaggtcgatcgatcggaacatgcactgcatccaatgaactcgggtcgccatctcaaggatagttaagattgatcggttcattacaaggtgacgaagatcgatcgatatcatcactgcgagcgcattaaattgctagataaattgccactcaacccgaaagccgacggagacggatgcttttgccaggtgctctgccttcttcagcagcgccactgtcgcggtaattaattaacaccaactatcagtacacaaaaaacaatttggtgctacta

SEQ ID NO: 2773 - DNA, 1413 bp, Zea mays
  misc_feature (1)..(100): optimal_loci_271470_G1, chr8:26351587..26352999, Cluster 16
ctgcttgtggcgtgtcgtcgttgccgggagcagcgtcccggtggatgacgggcgctgcagcaggctctccctcagcgccttcgatcgacgccgggactaggcgtcggcgtgatcgacgcgacatacattagatgtaccacctccaatccgcgcccgtcggttttgttcgtgtcagagatcgtggcaatgcgaatacaagctttcctaaacctgagctcggattacctcgttaattaccagcaaaccgactagaaatcggctggttctctcggactagcaaggagtagagttcttcacgctgatttttgttttctatttgctgatgatagtaatgtttattttttacttacctgatgttgtaattgtgaagcaaagtaaacctgtcttttttataaggagcaaaactatttgttctggggttcggccgaatttaaacgaaatccatgacagctttgtttttactctgttgtaaccagttgaccgtaaaaaagaaaatataggatatatccggcccatctagaacgtgggttgcatgatcggcccatctgtgtgggattcccgggcacctcctctccacaacaacaaattagccaccaccattatctcaagagcagcactgattaatgttaagcacatcggccagcaaggatttccactcgattcaacagggcacagctgctgcgagatccatcaatgatgcaaaaaagagattgatcacaaatcagctagagctagttcaatcggagctagcatcacgtaccgaagaacgcaacgaaaaataccacacattacatggtacaaaacatagaggaatatggataaaccactaaaagatagacatcgtgtttatgtgatggaatacgtctagttttgcgaacaaattagcaaagacattcctcttttctgaaacgcgaaatcgaaatgtctggaatcaaaaatcacctgtgacttttctttaccaccctctgcggcccagcccaactggacctcctttacctccatctgctcgcctcatgggcctattgggaccacatagcagcgagcctacacgccgtgatgttacagatccttaacggggccgtgcgtaggccgtacaaggcctactttgcgagggctgaggaggcccgtactgcttgtgttttcgctgattccgaaagccccaccccacccaactggtggtgctggtccgggccatctccaacagattaacagaacctctcacctcacaaaagaaaattgcatataaaaagctgattccctgccatctgcactctgcagtgcatcctttcatttccattgatcacatcctctgaataaacagactaccaatgccatacctttcataaaaaaacgaaaacaatatcaaaactttcgtatcctattcttactgtgccatacctaatatatatatat

SEQ ID NO: 2774 - DNA, 1446 bp, Zea mays
  misc_feature (1)..(100): optimal_loci_282498_G1, chr8:101769862..101771307, Cluster 16
tagatcatgcaggcttggtcgctcccattacgagaatccagataaaaatgatcccagtgggggtttttttgaatcaaatttcaagatttgaagaagtttatgagttggggtctggaccgtccgaactagagtcatgtccgaattccagatggatcaatgaaaacgggacctctgttcttcgtgtagtagacggccgtggtagcggacacgtcacaaccatggctggcaggaccgcaggagtatacatcatgcatgaatgcgccgcgggcgcgatgagtagtggtcgcgcggacgtagaccacacgtgtcaccagagcagctgcggcatccagggcgtgcgtgtgtgtaaactgtaaacaattcggccgccctgtctcgcaccacgccaccggattgtccggatccaacccatattcacatccacgaaacctccgacgtgaatatccagaaaccttctgcgcgcgcaccagaaaatctggttgcgatggcgcccgccggcaagccttctgcgcgggccggccgacagcaccagaaacctcagctgggccttgatggactgttgttggttcgacgtgacccgtggcccagagcagtggtttattgtgggcgacgaggttgagattggcccagtactctctccctcagttctgaggccccgagtggatggagttgttaatgttagtagtccgccccgcaaagacaaaaaaaaaaaaaaaaaaaaaaacgaagcatgcgcatttggagcagagtctcaagattacggtgagaagaacgatcaaagattcagtctgcaaccgggcatgcagtcaaagtcatacagatatgtgcattcatgtggtctccagcggtccaggcttgtgcctgcaaccagaaatctggttgcacctacctaacccttgctacatcccgccaacgcagctctggtatattcctatcgcagctctgcaccaccgaccgatccggttggccataaataatgcctatcacaaacaaacagcacacacacacaccacgtacgagcgctgctggctgctgtaggtaggtaggtaggaggggctgtggccaaccaaacggcattgaacatcccgtcccgagatatcatgcgtgtttatccagaacagcaacccaaccacctttcccctgaaatccttctaagacgccttcccaacagtttcatggcttaatttgtggcacaaaacaagacgcagaggaggaggaacagaacagcacgtaactctcggctaaaccaccttttttttcctttccagcgaggcaaattctgtgagctgaggcaacgacacacgacctccgcgccgccatcccgtcatcaaccaactcaccatatatatacgacacgatgcacctacctaccagccgttttccaacagcatttcggctcccccgccgctgtggcgccacgccacctcagagaaaagcaggctagcg

SEQ ID NO: 2775 - DNA, 1619 bp, Zea mays
  misc_feature (1)..(100): optimal_loci_288074_G1, chr8:131778419..131780037, Cluster 16
gttcatgtttgctttttctgacgtcgatgattgaacactaatttttttaaaaaaaaaaatctatcctagctagcatgctttaggccggttcatgcagtagttcgtccataccatgtctgtgttcacctggagatttaagaccactaatatgttattttttcttcttctgttcttctggcttgggaggacacattcagcctttgggccatgtctgtcttcacagctcggccgacactactagctaggcccaagaacttgttgggccagaatcactgtttctatcttctaatcttaatacatcacacctgtattggtcttattagcctgcccagctcaccctctgcatccttttcccttccttcttctgtttcttttttttttctttttttcttttttttgtgaaacaactcttcatagtctcgtttcttacggaaagtgaaatgcatccgttttccttgatatacatgtacttatgtagtaggctattgcattgcatacatgtatgtagtacagctagtgagcaccatgaataatggatggaggaatcaagcatgcaggtgcagcacgtcagctcagctagtgctagtgctctgaattattattactgacgcccgcaaacaaagaagcaagcgacgcaatccaatccagaatcaacagatgtcgtgccgtcatgcacaaacgcaccgtatgaacaagaagctagctagcaggaggagcagcagcagcagctgaagaagaagaagaagaagaagagatgattctccaattcatcaatccaatcaaatccagcgcgaggaggagtcaatcgcctaataattcctgtgcaggaacagaccgatcgatcatcaaacatagtgcacctccatctcaagtgctgacacctcctccttttccagagaattcagaggagctatatacccgtgtgtgtgcagatgaattccatcatcagtttccgcgtctgcgccggatcttgcattcatcgtggagttcggtacgctgccactatttttcttcagtagcccagtgaaattaaaggcaggcagcagtccagacaaacatgcatgcatgcacaagcacaatacagaacagtgtcaggagatagatctcagtgtgtagctagtggcattgtgcactacatggaacatgtatgtatcaacggcgcggatagatgaactggtgcagggctgcaggccacaatgcctacttctcctactcgcacgttgcatgcacctaccacacacagacagcagcctccttctccttgtgtttttgctgacatacatgctgagctgcatgacgtacatgtagcttagttcacacataaactagctagctatttcaagtgtacttcgctgtggagagcgagcaagcaagtctttagcgctgtgctgtactggcctgatcaccatacctaattgtcgtcatagctagtagcagctaagcgctccaggttgggctcaactcgggcttcacaaagtgcgctccagcgcctccatatctcgttcgtctgaatttctgaaagcgcgttgcagacatgcatgtactgtgtatgtctgaattttgatcgagagtacgccattgcccgttacggatgtaaggttatccaaaatattgttttg

SEQ ID NO: 2776 - DNA, 2560 bp, Zea mays
  misc_feature (1)..(100): optimal_loci_291818_G1, chr8:151589561..151592120, Cluster 16
ctgcgtgggagagtcatctaccttgataatagtttggggcttctggagtgatttcttagtggttttatctctcttcctcttcttggaagcctctaaagccttgtcctgagtagacggagggggactcgtggaggctctctcatccaattgctctagaaagtggatggatcctgactcttcatagttcttgaggacccactctagttcatgcggaggccaattatacaccaacaactatatcaaaataccacaaattaccgagttgagtaactcaaacattgtctagtggtcgagaggttgtacaaaccaatggaagtgacatagtgagggagtaggcgacaatgtagtatccctcgagatagtcaccgatattaagaaagatttgccaaagatagaccttcgtctttggactcgggatctctgcccccaatggaccgagaagggtcgatcggcccactgttctcgtaggcatagcctgacttctcttagaggagggacttggcaccgaatctagtcggacgccatgtgcatgctcgagagcctcaagttcttcaactcagtaaacgttgtgtagtcacaattaacctactgatcagttgcaaattaatggttcttcacaccgctgaattaagatacatttttgtggcgatgtagtggttcgccgttattaaacgatgtaatagtgatggaaatttgctttctcactgacaacacacgagaattagcgacagaacaaagtgtttgttgtccgtcccgatcaaacccagaacgcccccgacgacacacgctctctctgatacgaactcaaacgcttgggacgcagagaggtgtgggtgcggacagagctttgctggctcgctgaactctccagccctttttctgtgacgaactctccggcagcccctttttctcgttgtactaaactgaatatatagtttttggcagcatatatattttatcgccgatgctaggttttctaggcctgtagtgaaaaaagagagagagagagagagagagagaaacagcaagatatatgtgttgtattgtatgtattatttgtctataatctagtacaacgcattcgtagttgatgagttccgaaacgtactgcatggcagtactatatatatggagtacgtacttatatactatgaacatactcttacaaaagaccaggctggatccaagttgtttactgcctgccaatactgaaaagggcagcacgtactcgcgcatcatttgatctccgtgggagaagaagcatctactagctaggttgtactagtaaagtacgctagctagctagttgctagtggagtagtagtagtagtagttaaccgcatctgctgctgtctgaatgcgtacgcaacacacatggccatgggggaggcaaagctgaattcctgtcgagccgagacggggcgcggggggagcaagacgaggaggagcagcagccagggctgacatgacacacaccaggtgaagcaggcgccagattttaaaactcgtcggctgttcccggttcgtctagctaggtccgtgcatgcatgcacctcaccgcggcgctgcatgcagagctcaagtgggattaaaatctagatcatgcgcccgaggaggggaggcggcatttcggcgctgaataaatacttgccagttggagtggaccttcggccggggggctaaatccaggatgaactattggaatcggagattattcgttttgactttgaccgtgcataaacataacgcaggtacggtgtggtggcggagacagtgccaactgccaactgagttcgaatctagccagagcgacgaacgggggttctgacagaaggagaacgcgctgggctttggcagctggttcgttagtgagggacaagtagacaggtatggctgcgtctagagagagcagcggaacggcgcaggacggttggcggctgtagtagtagtagtatattgttacgctgcctccggcggtccggcccctagtacatgcacgcacggagcggcgggacacgcgcagctggagaagcaccccctcgagcgccaaaaacaagcgaggggggggggggggggggggggggggaagcaggcagcctttgccttggccccctcgaatgatgatggcctttgccgcgggccgcgggcctagagaccagcaaccgcaacaactaccaaggccgggtgcgtgcgggccgtccggctcctcctctcctcagtcctcagcatgagcgcccgccgcccgcagccgccccggggggggaatgggatgcagcgcaacggctgctgcgcctgcacgcgcgccggcaccatgtggccggataaacaatgctgctgcccctgccctgccctgccctgccctgcccatcattgttcatgcttttgcctttcgggttcctctctgaacacgcccgcctcctccccgcttcatccttttgcgtgcctccctcccagttcgccaacctctggtcaaccgtgcgtgcgtgcgttcgcagatgcatgccatgccgtcgtttcgccgcaaaaggaagaagcttctacctttttttttaccaccatt

SEQ ID NO: 2777 - DNA, 1449 bp, Zea mays
  misc_feature (1)..(100): optimal_loci_29395_G1, chr1:179828884..179830332, Cluster 16
atatatcatctggttagatagctatagactagcttttgcgaagaagaaccaatgggaacccggctacatgacccccaccccacacacggtccaattaatataaccaacgaactaaaaaaaaaatcaaagctgcttgcattgttcgttacccaagaatctagctagctagcttgtctgcgattctgtctgcactacagtctttaaaaaagggaattagttggctaattacaagagaggctactactgaattatattcagtatgaatattatacatgcaaagtacactagctagtctaattaatccccagacagtagtagtatatcaatgagtactgtactaggtttaaataagctgctacatactgtatgcaagtgcaggagctgctgctgtgtgtggacagtggacacctggccaggcagtctcgatcatcgatctcgaccggtcagtccatcctcccgcgccctgtctaacctaaacgagttactaaggatcagctggcaggatttcatcagatcagatctcctactagattcccaagcatgcagctcaaaaaaaaactactctactgtacaactgcacgctatctttatcccccaatcgtcctgaggcgcaccatgcatgtggcgatcgagagagctcgcgaatgcatgagctagctagctagctgcaccattcagatacagacacacacggcgacaagctagcaagctgagctctgtgcagctgcctttgcgtttgccttgcctgctaccactagctagctagtctcgactctcgacgagcgccgttcagtttttgtccaaggatcgatcgattgacgacctctctctctctctctcgctcgtgtcgtcgtcgaccgtacgtcgtgctccccactcgctgccggccggagctttattatctcatgcccagcagacagcagatctagccgctgctgctacataaacatactacacctacctaccagcaggcagcaggcagcaggcagtacgtgtgtggcgaacagtggttcgtcgtcggccagtacgtgtcgtgtcggtcgctttggcgcgcggccgggacggacgacgaccgcatgctatatatatacgtagacagcacagcagtgtagaagaagtgtaggctgctagctgacctactgcttgttgttttggttgccgaatgcagcgcaggcatggccgtttccttctccctgaaggctccgttctgctgcatccatattcatatgcagtgcagtgcaaccacacaggctgacaggcccacaaccgaaccaaccagcagctttgctttgtctgcttggccgcctctctatctctctctatatataatagatcattctcttctctctgctgccgtctacgattaaaactaacgcagtaatgctagtaaactaaactaaagctaggtacattagattacttgcaaattgcgactttatatattttatt

SEQ ID NO: 2778 - DNA, 2194 bp, Zea mays
  misc_feature (1)..(100): optimal_loci_293955_G1, chr8:162562476..162564669, Cluster 16
taaccttgagccgcaaactcgagatttccatcattgccttgcacactatgagtaaagaccgaagcgatgattagtggcccacgagacaagacggaggcatgtcatgtttcaggtttagctcatcgatcatcagaggcgagagagggccctgcaaccgcaaccgcaaccgcaaccgaggcgtaggcatgccagcagcactggctcgcagttggcatgatggagatccccctcctaatccgcgccacctcactccgcgcccacacccacaccccgacagaagcaagcgcgcgaggcgggggcgcacaggcacagtcgccctcgccctcgcctctgcgtgcattgcatgccaatggctggtgacccgtcggcgttgtcgcgtatccccatcatcggtagacggcaggtatagaagatagactctcggtgtctctcgtccatcaaagctcgcctcgctgctcttcatcggacccagtccacaccgtcgtacgtaacgtaacgaaacgaatgcggtccagcgtgaccttgtgttagtagcgaagcgtagcgtgtgtgtcttttgagaggggatttgggattccctgtgcaggttctatggtgcaggaggcatgaaggggggagcggtaggtcgacaagtgggtgagggaagatgagatgaggagcaggagtgggccgtacgtcttgcagcctccttcctgtttccaggggcctgcgtgcgttggtatgtgcctatcatatcagaccggctgctctccccgcccgtggacccccacggcagacggcacacagccggccccgcacaagattaagatcttctggatctaaattcagtcctgccccgtagggcttgcgatcatcggtcagccagcacccttcgcgcgtaggctcctcgcgcaccgcttgggttgggttgtgcggcctgctgcctgcggtcccgccggcccccccagcctctagaaatcttcacggccgcgtccggaaacgaaacgggtgcggtggcgatggcgatggactccgcggggtggggtccgttggttcggctcgcgacggggagcgaggaccgacgtgacagggttccggcctccgggacggacacacacgaacgacgcatcagatcggtcggattggcggacgggacagatggatgatgggaggcgtccctgcgcccgtcacgtgctgtgaggctcgacgagtcggccggcgtgcagggccagcactggtctacgtgactctcgctcgcttccggtcctggtgcgggcggggtgagccggctgacgtgcacgtacaggtacagtacaggaccgcgccttgtgttgttgttgttgtagcagctgtactgtgcttgcatagagttcagttcagcatctgggttagcctacaaaggctaggcaggctacacacagctattagctgtcgtttcgggttcggtttcggttcggttcacgtggcctaaactgtaatcgagcatctagccaggtccagtccagaacgagactttattgtgcatagccgagatcgactttattgtgcacaacagtaaataaagcagtcaacattttcgatccattttgatcgtacaagtttaatatgaacaataccaaaacaatcatacgaaccagttaattttaacagggaaatcacgtaggtacggtaaacaaagaagaagaaaaaaaccgcactccaacggggcctaactgttggggaaaaaagagaggcatgcagagacactgcaatcaataaccagctttggcattaatctgaaataaacccaacacaaagtgtacttgcgctacaaaccgtagcgcgttgatggaacgaggcacgcacttcaactataaagacggtcgatagatgcagctaggcatctcatgcgctggtgcacgatctcccattctccctcgtcaaaacggggagaagaaggtgaatcatatatccattaatattctacaaatacttatttacagggtacacgtcgtgtagtattgcacctccgtttctcgcgttatttgggccattgtattttcggcccaaatttatcctcggccaaatgctgccagcccaaacaaacaacggcaaaacaggcccatcaagtaacccagctcgtaagttaccacatcccctccggcctccgtccgaaaacaccaaagtaactttttcttttttatatatatttaaaaatcgaaatttaaattttata

SEQ ID NO: 2779 - DNA, 1583 bp, Zea mays
  misc_feature (1)..(100): optimal_loci_294861_G1, chr8:167189058..167190640, Cluster 16
taaaaacgaaacggaagcggtgtatcctaataataaggacgatgaattccgtcatctttcttaaaccgggagacctagagtgacctcaacggaagggaaaagatcagatcctttctggttggtggtagaaatggcagatgccgcaccggcagcacgtgcctctatatatcgactccaataatccgataggctttgttgattcatttagcaatgcgccaaggagcaaggacacgcacacgccagtacattgtgctagctgctgctagtacctcacaggattcgttgaacgtggacatggcgcagttgggagttgggactcgatcgggagaagctagaccagcccgatttcgatccttgcccatgtcagctgctgtttcagactttcagcgcagcaaattctcggcgctagttcttacttaggaaaaagatacccttcagactctgggattagtgatcataattgcagttgcaggttctgttggaggacatgcaggcagtgcaagcaaaagagagagagagagagaaatcgagagaaggtatcagaatgcccggagctagggtagggtacatgctacctccaatctcgaaattattcatcgtggatttttccttttggaaacgaccgcaaactccggatcctagctcgattaaggaacacgacagagacaggaccacatcgcagcttgatctctacgcgaccaagaacagtttgttcagaataagttcatgcatgcatgcacaaccttacatatcacagatggcgaagccgggccgggcatgtcccgtagcctccaacgccagtgcgcaatgtcgatcagggtaagtgactgaccccgttggtcgcatccatcgcgcgcagagacgcagacacatctcgatcggaaccgtaccaactttcagcactgtttctgatgaggacgactgtaacatgagttcgactgaaggccagacttgtagttttcgtccgaactgggcatggccctgctcggctttggctgctcgcccttggcggattagtcggctggtccgtgtgtccagcatggcgctggctggacaggaagtgaggacgaccatcacgcacgcatcagaagggcaccgagtagacgggacagcacaccagaggttggattcagacttcgaagctgttgctggcgatgatcgtgatacctacgtcgtattgtgcccgtaacacgctgttccccttggaaaaatgtatttgcttcttccatggatcatgcatgattgaaccgtggctactcattactgatgaatgttagcactcaagaacttcgcaaaatttaagtttgttcgtacggggttgatgaagaactgcaatgctactacatatatacaaccgaaagcgagaaagaaacattgctttacaaggcaactgggcatatatttctgatgagagcgcaaacgacttcgcgaagaagtgcacgctgctgtatcggccaccattccattccatgtgcgctgtcaaaccaaggcctgactatagtggcagcagtctgatgcagtcttggctctctccggcctacttgacctctggaaggaacagaacagcacggtgtatctggaag

SEQ ID NO: 2780 - DNA, 3153 bp, Zea mays
  misc_feature (1)..(100): optimal_loci_294872_G1, chr8:167221159..167224311, Cluster 16
atttttttttttgaggggcgttgctgctgtgctgacagtacctaccccccataggatcgtgcttcggccgggcttcgcctggtgtggaaagttctggaaatgaccttgaaatggagtgaaaaaaggagagaaataaacagaaaaaaaggagtagtgtggccccatgcatgtaacaagttaattaccgccggttctctccatgacacacacgtcacggtgttaacttcgtgtcgtcgtcagacgaaaggccatggaataataatggacggcttcagaatcatgccgcacaccatgcatggcataaacatccaacaaatcgtttccgtgaattctgtgccacaatgtctggattctggcccgtaacgccgccgagtctgggatctatgggagtacatagctgcattcgcgtctacatgcatgcattgacgttctcttctgtacatgtacatacaggcttttttgcgcagctggtgttttcaagtaaagccagcaacagcaagcgacttcagccgttagtttttttccggagttttacaggcagcaaacggcggttggaggtgatgaatggaaaaaagaagattgttcgttccaccatgtgtggtcagccgttaacggcgtagatctcagcatctgtgggcgtaaagatttttgatacgccagacaagtgagacacagcatcatcgacgcggtagataccaataccagttaaatctccaacgacgacgtccacatgttgttcagaaccaaactggtcctgcgctcagtggtctcaaactgcaaggcatacctggctagtctctctcgacttgtcagtctctagctagtctagcagctactgcgtcaaaaggttctgaagtttactactgagcctagctgccagtctgccacgctcgatcgctaattagtgctgtactggcttgatggccgccctcaggcatgcatgtactcaagtcgagatcgaacgaagctgctaaacaggtgacaacaccagcgtgtctcagctcctctcgcccgcgcgatgtggacgcgagttccttttcactcatctctcgcagttccctttttccggcacggcatgccgacgcgacgcggtgacagcggcatgaccggctagcgtgagagctcgctctgcgcttgctcccctacaaacctggcggcaccaccacatgacactgacactgacactggcttaattggaactggacacacgcacgcgcgcgcgccggctttatatgtagcagtagcagctgctgttcccatcgcgccccgggccaagaataatcttctccaccggttaaagttacatactttaatcccaaaaaagtatacattaatcttctattaccaaatgaatactgttaaattaataaagttacatacttttaactaatatattcgtagatctatatgtttttttactataaatgtcgtcaagcttaaaattaattaatttctcaggattcgagaaggcactactgacagtttgctgcctcggctcagctcagatattttcggtctgggcctctctcgttctcgagcagggaacggtcactactcaatcaggggtaccgtcccgcctttgtctttgcttgcaatttttttccacgcagcggccccaccgacattcagtcggaacactgtgtctgcttccagctcaaggcaaaccaacgcacaggttgagattgttagctttggtgagcaaatcataaaggcgctgttaacatgacccggaacccgtaatgtaattgaccagaacaccactggacaccgtcgatgccaggatcctctgagtggcgtcagctattcagctggatagctccttggccgacagagacgccgttgatgagcaacagccgacgatccgccgccacccctcagttatctcctcctcgccggatctccgaagctcggatgaccgtacactgttacatccgccacctatccctctctccgttgttcacacaccaatatccgcagaagcttgccttccatgcatgatcaagacgcgcggatgactattgactactggtgagccagcagttctagaaccttcctttctttccgaggaaactattgctctagttgagcaagatggaagtagtgcattacttttgcgctcgttgagcaagatggaagtatgttggcaacctgacgagacacgaatgctgctgagaggcaagcatctgcagacaacctgcaccaacttggcatatataatggcatgtacatgttctataagcgtttgtgtggactgaaccctcgttctccagacccaaagagaccggagaactgccaagcttttctttctatcccaagcatgcagtttcagtagcttcatttgctgatcgatcttctatgtcagcgcaagtctggcaagtggcttggtttccaagcaggtcggggggaaaaaaacattcaagcaatcggacgatctagcttcctgtacgtaaaaatatgtcacctgagtgaggcctgagggctgaggaggatgaaatccaaacgagaggtgcatatttcatatgcccaaggaatatgccgaggaacatgcggatatttggaatagcccatggaaaaggttgctgaacgccaggctgtacaaggatcagggatggcaggtgccaagaaatactacagtgactcagtgagtctgcaggaaatactggggaattgggtgcgagtgcgacacaatacaggtgcagaacgtgcgcgctgcgcgcaagttgccgaatcgctagtgcgatccggggccggatctcacgacccggcagccggatgggccacgcgtggcccactcaccaaccttcctgggctttatttcgatacgcgggtccaggacggtgggcctgctccgggggaaaatgtgtggcgcagatggcggcatggcgcatggtcccgcgagccgtggtaggcgccacctgctgctgtggtgacgtcacgccgcttacatcctcgtgatttgtccggttacccaccttcctatgcactgtgcgctcgtggttgagcttggatgttcttactgaaatttcagtgcatgctttttttttacctctcatggatgtttagtgcacatttatgtgcaagacttctggaagcggccgagcaatagagagcaacttgaaggtggaccgatctttttcactgtactatggggtg

SEQ ID NO: 2781 - DNA, 1415 bp, Zea mays
  misc_feature (1)..(100): optimal_loci_298791_G1, chr9:8428404..8429818, Cluster 16
aatcagctcccgggttgcgttgcgttgcgtggcgtggcggcctggcccatgcacgctcacgcggtttcacagcctagctagcccgcagaaatcaacctcggcagatgcatgctatcatgatgcgatgcgagtcatgagtcatgacatgactgaccaatcataggtactatctctctctctctctctgctcgcgcccggtggtttcgtcaaagacaagcgagccgcgcgcgggaagtcgacggcagcagcagcccgtgaaatcgcgtgcgtgcgggaggggaggggaggcatcgcgccgcggcaggggaggggatgggcaggaggatgcgcggaagcttcgtgccaccagcccacgacacgagctagcgctagcgcaggggcactactctcttcttctccagatttccagaaggacccaaaaaaaaaacagagatagaagtttttgtttttcatttctttcaggattttccctttgacaaattaaagttttccttgcacatgcggtcagggtacaacatgtgtcgttcgtcgtataatataatcccccacttttatcctttttcagcgagggcctttggttctcctccgtacaaaagaagtctcgattaattggccttgcaactgcacgcacgagccttgtctcacctttcaggcgccggagtgtcacgcgctgcgctggtccgacgacgcgctcgtgagtcgtgcgctagccgagaacgagacaagctggcgcggcctccgcgcgccgcggtgtgaatgaacccctgagcacgcaaggaaggaaggaagggacgaatctctgttcatcatcgacgttgagtcagtcagcaggccttttggaccctccgttctgctgctacgcgcgcagtctcatgcaccttgtatagtagtatattaattgcaaacgccgctgcagtgtggaagtggaacgcagccgtcctgaccatctctctctctcttgttcacaagacatggacagtacgagagatacgatctggggcgacagccgacaaggccatataactatgagtcgagttctccatctactgttgccaggcgtacccccctgtaatacgccttctcgacgtcccaagaacactaccccgactcttttcttcaggcgttggcaactgatgttggggatcactctcatgtcaggactcgtgcagggagcagcagcatgggatcgtccaggcccacgacgagcccacggcctcggccgagaatcagccagtgcgtggcccagaccgagttctgtaacaacacatgggcgcggtagtatagtttatcgccagtgtgtaactctgtcccggcgtctcttctcagtctatggatagttttgtcttaacatgtgactccgaaccaaacaaacaaactagaaatcgtcccatcgccacgattacaaccaaacacat

SEQ ID NO: 2782 - DNA, 2197 bp, Zea mays
  misc_feature (1)..(100): optimal_loci_298809_G1, chr9:8456164..8458360, Cluster 16
ggtgattatatgtagatgtatgccagcgtcactatttgtgctatgttttatatatatatatatatatattgataaatgtcgtcccgttttcagctctaactgtgagcgtgtgcaaacctggattcacccttgaaatcactcttttttgcgcacctgtcgccggccgcccattcctattgccaaaaggtgggaaagagggagagtttgcgcaactcttccttcccaaagatggcgaggaatagcccaaggcagaacgcaacccaaaagaagcaatgaatctcgtatgcaaagctgctgattacaatgcaaggaagaagaaaaagtagtaggagaggttgaggggaagatggcctagctgggaagtactagtacgtgtagatgaaaaaggttaagaaatgttaattttgccaactagttctgttcctgtacgacgtactaactgcaagtgtagtagtacaaagttgcattgcattggtcgaaaaggttaaagggacacggggcactagctagctagtagtaacaaagcgtggttttgtttttgtcataactgcggttgcgtgcaaacaaatgccagctggtgtctgaaaaactaagaacattactactatgttgatattattatataaaccgttgcaactgcaactctctgatctatagttaaaggtgcacatgttttgactttaaataaagttgatacactacacacacacacatgtagattcttccggaccagtgcaagaaacatagaacgcgccattgctgtcctcggttgcatccacagattagaataccaattacccctccagagacctttcccggtgttgcaacaaacgcgcatgcaccgcagaggagtccatctgcccaaagcagacgaacgaaaagctagctagctagctagcatatctctccacgtcttcctttcttcttcttctttttttctccttccgatccagctagctagctttaagtaggcatcacatcgaaccaaagagacgagacgagacgggacgggacacgatcgagcagtgttggatcggcggggcaaagacaacctagctttaatctcctggcaagcaagaccaggcgagcaaggcattcattcattcacctaacaattatgcaatcaaccggccggccgggctgcctagtagtgcttgctgatgagtcctctcctctcggcgggggcgtggtgcgctcctgcgaggatttgcaacggtagctggagcctgctcgatcgccttcatgcatgcagtcgtccgtggacctctcccctccctggctagcttcctgcacgcgctgcattttcatggggccggggtctgaaacctagctagctatacgcggtgccgatgcggatctccttattactgtttgacctccggaaagctccggccctgattggcgcgcgcaaagggaggggggggggggggggggggggggggagagctccatccacgacgtgcgtgcgcgtagattggcgatgacgtgccggcaaccacgtacggcgcgccatttgctcacgagaaacagcgtggaaaattgaataatccatgcatgcatggggatccaaataaatcaaaatcagaatcagaatcatgatcaaaatcagagggtgggccagccggggcctactacataccctgtcgaccaccaccctctagatcatccgccactgcttcggtcgtttaacataataaaacataatatgacaatttgctgatcgatgattggtttcagcttggcgacagagcaacagattcagatacaagggtaatgcaatctgtgtcctgacatctgggagctaggtcgtcgtcgtcgtcggtctaactaacctccctgtgtccaatttggtaagtcctaggattccctgatgaaggtttgtgtccttgcttaccaccgatgcaaattggacggtggtaaagccgtgtgggtaaactaaactaaactaatcaccaggccacaagcccatgcactagcttttttaagctagtggcacggtgactagcactagctagtctgtcgtgattattttttcaggaggcatagacgacgacagtgtaaacacgctgtccaatgcgccatgatcttgccgtgcaagctgcaagaccatatggaccggatcgatccacctggctttgcccagcgttctcgcgaaaaagaaatcgtagcagagggggcagccaaagatctcagacag

SEQ ID NO: 2783 - DNA, 1749 bp, Zea mays
  misc_feature (1)..(100): optimal_loci_301273_G1, chr9:20863938..20865686, Cluster 16
  modified_base (488)..(488): a, c, g, or t
  misc_feature (488)..(587): n is a, c, g, or t
  modified_base (489)..(489): a, c, g, or t
  modified_base (490)..(490): a, c, g, or t
  modified_base (491)..(491): a, c, g, or t
  modified_base (492)..(492): a, c, g, or t
  modified_base (493)..(493): a, c, g, or t
  modified_base (494)..(494): a, c, g, or t
  modified_base (495)..(495): a, c, g, or t
  modified_base (496)..(496): a, c, g, or t
  modified_base (497)..(497): a, c, g, or t
  modified_base (498)..(498): a, c, g, or t
  modified_base (499)..(499): a, c, g, or t
  modified_base (500)..(500): a, c, g, or t
  modified_base (501)..(501): a, c, g, or t
  modified_base (502)..(502): a, c, g, or t
  modified_base (503)..(503): a, c, g, or t
  modified_base (504)..(504): a, c, g, or t
  modified_base (505)..(505): a, c, g, or t
  modified_base (506)..(506): a, c, g, or t
  modified_base (507)..(507): a, c, g, or t
  modified_base (508)..(508): a, c, g, or t
  modified_base (509)..(509): a, c, g, or t
  modified_base (510)..(510): a, c, g, or t
  modified_base (511)..(511): a, c, g, or t
  modified_base (512)..(512): a, c, g, or t
  modified_base (513)..(513): a, c, g, or t
  modified_base (514)..(514): a, c, g, or t
  modified_base (515)..(515): a, c, g, or t
  modified_base (516)..(516): a, c, g, or t
  modified_base (517)..(517): a, c, g, or t
  modified_base (518)..(518): a, c, g, or t
  modified_base (519)..(519): a, c, g, or t
  modified_base (520)..(520): a, c, g, or t
  modified_base (521)..(521): a, c, g, or t
  modified_base (522)..(522): a, c, g, or t
  modified_base (523)..(523): a, c, g, or t
  modified_base (524)..(524): a, c, g, or t
  modified_base (525)..(525): a, c, g, or t
  modified_base (526)..(526): a, c, g, or t
  modified_base (527)..(527): a, c, g, or t
  modified_base (528)..(528): a, c, g, or t
  modified_base (529)..(529): a, c, g, or t
  modified_base (530)..(530): a, c, g, or t
  modified_base (531)..(531): a, c, g, or t
  modified_base (532)..(532): a, c, g, or t
  modified_base (533)..(533): a, c, g, or t
  modified_base (534)..(534): a, c, g, or t
  modified_base (535)..(535): a, c, g, or t
  modified_base (536)..(536): a, c, g, or t
  modified_base (537)..(537): a, c, g, or t
  modified_base (538)..(538): a, c, g, or t
  modified_base (539)..(539): a, c, g, or t
  modified_base (540)..(540): a, c, g, or t
  modified_base (541)..(541): a, c, g, or t
  modified_base (542)..(542): a, c, g, or t
  modified_base (543)..(543): a, c, g, or t
  modified_base (544)..(544): a, c, g, or t
  modified_base (545)..(545): a, c, g, or t
  modified_base (546)..(546): a, c, g, or t
  modified_base (547)..(547): a, c, g, or t
  modified_base (548)..(548): a, c, g, or t
  modified_base (549)..(549): a, c, g, or t
  modified_base (550)..(550): a, c, g, or t
  modified_base (551)..(551): a, c, g, or t
  modified_base (552)..(552): a, c, g, or t
  modified_base (553)..(553): a, c, g, or t
  modified_base (554)..(554): a, c, g, or t
  modified_base (555)..(555): a, c, g, or t
  modified_base (556)..(556): a, c, g, or t
  modified_base (557)..(557): a, c, g, or t
  modified_base (558)..(558): a, c, g, or t
  modified_base (559)..(559): a, c, g, or t
  modified_base (560)..(560): a, c, g, or t
  modified_base (561)..(561): a, c, g, or t
  modified_base (562)..(562): a, c, g, or t
  modified_base (563)..(563): a, c, g, or t
  modified_base (564)..(564): a, c, g, or t
  modified_base (565)..(565): a, c, g, or t
  modified_base (566)..(566): a, c, g, or t
  modified_base (567)..(567): a, c, g, or t
  modified_base (568)..(568): a, c, g, or t
  modified_base (569)..(569): a, c, g, or t
  modified_base (570)..(570): a, c, g, or t
  modified_base (571)..(571): a, c, g, or t
  modified_base (572)..(572): a, c, g, or t
  modified_base (573)..(573): a, c, g, or t
  modified_base (574)..(574): a, c, g, or t
  modified_base (575)..(575): a, c, g, or t
  modified_base (576)..(576): a, c, g, or t
  modified_base (577)..(577): a, c, g, or t
  modified_base (578)..(578): a, c, g, or t
  modified_base (579)..(579): a, c, g, or t
  modified_base (580)..(580): a, c, g, or t
  modified_base (581)..(581): a, c, g, or t
  modified_base (582)..(582): a, c, g, or t
  modified_base (583)..(583): a, c, g, or t
  modified_base (584)..(584): a, c, g, or t
  modified_base (585)..(585): a, c, g, or t
  modified_base (586)..(586): a, c, g, or t
  modified_base (587)..(587): a, c, g, or t
attcctccactcattgcaccctctcggggcccccagcgctttctccatgcatgatgcgctcggcgattgcactcgcgtaccagctttgaatttcctcctctgatttaagttcaattccccccccccccctcccaataataaactattggttcgttctcgtctcggtcgcctctagcagctttaatctctcgcggacatttgtttagtctctcgatcagaatatcgtcagggtgcgcaagagaggaaagttagggaatttaatcatggatgaatcaggaatttaattatgaagcagggttagtgtttttttttgcagagtgaaagtgaagttgtgcgagcaggttagctgttttttttttcatttagtggcgcatgatgatggcatatctatcatttgcagagtgatactggtcccgtgttttatgtagtatcttgacatgacagggatgatagataggaacgaatcaaagcctgaaaaccttccaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgaattcaaagaggattcattattattcatatgtaaaattagaaggcaaaaaaaaaactgcacggagaaaaaccagccaggctaactctctaattcggctagacccagcctctaaaactggcttagtcgcccccaaaatctaactacacggccttcccgctgcaaagtcggtcaaaccatcttttgggccttggcatgccggcggctttttatcaccagggtcactgcaagtctgcaatgatcgggcctccccttgaaaccctgcattgccgactttgatgaccagggtttatggccaatggttaacaaaccttatggggtagaagattgcggcattagctgtgggtcatacaagcatatgtctagtctggctcactaatccacataatgtaacagtacagagttaagactggagacctcacacgttctagggcgatcacactaatcccttaggaccctttgcgacataggtcccacataacgggataagccttggggccctcatgttcggagacatctagctagataagccatcgaggcgatgaggtccctaatgagataagtcccgaggacccttgtgtcggggacacctaatggtataagcttccgaggccctcatgccatggggcctaatggaataagccccccaaggcccttatgtcttgatgcacctaaagggatagcccccaaggccctgacacggttctaagcctggcacacgataatcctataactcggcaatacgtgtgcattgtaccagtatatatacaataagccagaaaaaaaaaaacaacaccgatatcatatcgtcggtgtggacaacgtggctatacgacacaaaggttcatgacatgccagttgctagcttggcatgactagacctacgtactaggctactatacatgctcctaactataggtagctagctagtgcgtggccggtggtggtggcactggcatgcctgtatatatgcggactgcggagacgatggcagcagcaggaggggccggcagtaccggcagcgcaacgtgagggccagcttggcgtccgttagctttcggttgccaccatgaatgagtcacgagtcgtgaccgaccggccggtccaggcatatccatccggccatatgcagaattgcagatgcagcagtaacctaacggg

SEQ ID NO: 2784 - DNA, 1458 bp, Zea mays
  misc_feature (1)..(100): optimal_loci_301275_G1, chr9:20866253..20867710, Cluster 16
ataggcgtgatgtgaaaaccactgctgcatgcaatgcagggcatgggcggccgccggccggtgagcgagatcaagttgatgatgatgatgatgggttaataataattgcagagcgtgtaattaggcagctggatcgatggatcggtcggtaacagctgccgctctgaataattgcatgttccaggcggggcacatgcatgcatgcatggccacccccggtggtggtgcctctggcggtaatcatttcgtcgcgctcggtctcggccgtccctgaccccctgatggatcatcatccatcatcgatgatgatgagtgcagtatgtatcatgtatgctggcctggcgtagcgtagcgtatgcaacgcggtggtatatatgcgtatcccgacaataattgtgtacgtgggaggttacatgatgcctgattaatcatttgttccgtctgtgtacgtactgctgctctgcctctcttgcatgttggacccaataatttgcttgctaattaaggtcatgcactagctagctagcaacttggccttaagcatattattacactgtgatcgatggtgatataccaaagcaatgtaattaatgcgtaataatggtgcttgcactagtaatattggagagttttgtgcgtgattcatcagatgtggttaccattagagacgacggcgctgtattattataattcatggcaatgtgcacgtatacgacgctccggccggaccgttccgttcctgccgcgcgcgcgcacgttgccattgccaagcagccactgctgctgcacactactactactccctagctagcaccgtagcagctagagagccacacaacaacaaggcatccgagatctctccgacaggcgcgcgcggcaaatccgccgggtcgtcacacggtgcacgagtcacgaggccaatatggcgcatggcgtatgcgatgctggggtcctatctactcgtacgtgcctcgtcgctacgaaacggaaacaggcacacgccggccgggcgcgggaagcaagctactcctagtcctactctatagtgccgcataggcaagctagccagccagccagctagggcggcctagcggcaaagtatgcgtaggcggccaggccaaggccaatgcatgcatgcatggacgacggaaaacatggccggccgtgatcaaatactaaagccctagctctagtttattctgatctactactagtcattgtagtgttaaactaacacgccaacacgtacgtacggcggcaacgcaatatatatccgtccatggactggaccgtcggacgggccaagagacgacgacgaggagacgagcgagagatcgaggaggagggtggtggcgtaccacgtgggcgttgccgttgcgtcgtggaatcccaaggcgccagccaggcccggcgtacgggcatgtcgcccacacgtgcaagcgccggtcagcggcggca

SEQ ID NO: 2785 - DNA, 1804 bp, Zea mays
  misc_feature (1)..(100): optimal_loci_301466_G1, chr9:21970281..21972084, Cluster 16
gtatagagaattagagaaatgccgaccagagctagctagctagggggccagctgatcctagctactatcctgtgtcgactgctttaatttaatttggtactgagtcacacccggtggtcgtcgatgcgcaacatgcccatgctgccgctctgctccccggcccgtgcgtgcatacggtatgacacatgcatgggcggtcatcagaggactgggacgatgtgatgtgagagtctcaactctatggctggtgagcgcgcaaacggcggtcggcgggcgtggcgtggcctgagcgcaggtgagcgatcgagggtgcggccgagcgaggcggcgggcgacgtacggcgtgggcgcctgccgcctcttgggcgggagctttgggcggcagcgcgcgagtcagattagatgaaggatagattctcagattagatggatcacggcagctatagctagccttcgatctctcttttagctttattaggcaaccaaatatatcatggctaattaaacgatcgacatggcactgtgtgtacacacacgccccctgtcatctgtcaattaaacgatctctgatcatgccagcctcgtgcatcgagaagacctgcatatatgctgcctgctatcgatccggcgagtatactttgcgacagcggccccgtcgtcgtccggccgccggtcccagcgcggcgctctctggaagaagcacgaagcactgtgtgactgtggcgtgcatgcatggctcggactaggtcacagtgagagcctgccctgcccctgcctggtgcctgctcgttcgttgcatcgcgcggcagcatttacctgcatgcatgcggagggatcatggaaggatgctgctgcagagcgacgacgacgacgacgacggatgggtgcgtgcagccgtgcaggtgcgcgcagcagcagtagcagcagtaaaagaagagggcgcgcgcggggggcaaatgattccggtgaccgcatgcatgcattgcatggacgctgcatgggggggcatcaggcatggcatgctctgcgcccgcaggctgcttgctgcctttttactgcagctgcaacgacgggccgggaggagagggagcacccttgccttgagccactcctgcctgcagtagtcctgcactgcagcactcccggcctggttacatgcacttgcagacagtctctctctcactctctcaataaagacacgagagagagagagaggtgcatggatatatgcatggcagtaacctaattctctctcttggccttcttccttgcacagtgcaaagtggtgccctcgctctctttctctctcaatcctaggatgtactgcttgcctactagccagctaggctaggctatcatctcttgcttgctactgtatgtctgtatgtagctgcagccaggcaggccttcttaattcatctttggatttctcctcgtccatcatcggtcgtcagagatcgagtgatgatgaggaagagaacaatcgtcctgctcccaaatattcttaacgctcccccctccaagcgaacttaccgaggggttaatggtaaccatccaatcctatccctgcagctgtcgaccccccggcggcctgtggagtaagaagatgccacagaactacacatgcaatgcagtttacttcacagatctgcacgggtgacacttgcagacaagtgacaaggagctagtacttgagatatatatatagaagagagctgagaggccggccggccggctttgttctttgttcattattcatcagtaacagtctgcaggacaagctagcgcgcgctgttgtttggaa

SEQ ID NO: 2786 - DNA, 1631 bp, Zea mays
  misc_feature (1)..(100): optimal_loci_3051_G1, chr1:15518461..15520091, Cluster 16
gcagcaacagcgaggagtttctcttcctgcacaaaggaaaaccgacccggtccctctgtctgtggggtcccaaggaaccccaggcagtgcgtgccggtctctcaacggtgcgagaagtacgcttgcggtgcacgcaaggtaaggaggaggcccgggccccagcgatgggtccctcctcgcaggcgtgacgcttggggtccccttttcccacggcaaggcctggtcccacccggcagccggggccgtggacggacgagacccgcgggcgcggagtggagtagaggggagcatgacatgcggacccagccccaggccggaggcgggcgggccttctgatcgagcactgtttctccgtcgcttttgcctcactccggctccgcccccctggcccctgctgcttttttttccccgctttcgcgctgaaaagaagaggggggcggggggcggcacgggatggggcccgtcgggataagatgacgaggcaggcaatgacccgtggcacgtgcacccggtccataggcgccgcagatgtcctcatcactcttgaatcctgctgctgccatacttgttggctcaaaactgtccacagatttcttctggcgcgtaaaaaagcatcagatctccgagatgcagatcatgcagctcatcgtccgtcctcgtgacctcgaccacggagcatataatgcaaagggtgtcggcttgccgatggagtgacggtggcctatggaacgggtccagctggtcctcggagcggggcgggagccgagtagccgacagggatagggcgtcggcgttggagggatttgatcagacggcgagggccggccgtgccgtctctgtctgcgttcctgctgcagcggcagtgctgcttgctgccttgtggttctggaaggtacttgcccgtccggcgccaatgcgcatgcaacgcatcaatctttctttcttctgccaggtgggccacttgcgcggcgcgctcgctcgctcgctcgctcgatcagggacgcgacgcgacgacggggctagcatagcaacctggcacactggcaagtggcaaggcagtcggcgactcgggcgtgcatggcaaaaggggagccgtatcaaagcctctcccatcggcgaagcaagggcgcggccgactactcgtgatcgagtaccgtagctttgtcctcaagcgagactgcaggtaggctcgtgagagctacgacgtgatcgagtagcaggccaggaaggaatatatactcctactcggttgcattgcattcccagacagtacactccatagaacccattggtcactagccgatgctgcgccgtgttgcggccactggccgggccggatcacgccatctcccgtgcgccgcgcgtcgcatgtgaatgtgatgcgttctccgttgggcgcgtgtcgtcacgcggccgggaaagcgggcctaactattggagtagtgacgggcgtgcgagaacgtgagcaagtgtggcatgtagtgggttactggcaacatgatactactctactacgtgcccgtttgagagagatcccgatcggttcccgctctttaccggagccctcctaaacaatgcccgaaaaacagctctggatgaagagttggagacgatttggacaagaggagtca

SEQ ID NO: 2787 - DNA, 2466 bp, Zea mays
  misc_feature (1)..(100): optimal_loci_30711_G1, chr1:188902630..188905095, Cluster 16
gttggactaaaatttatcaattttattattagcaatgaatttgatgtttcaaaaacacacacaaaaaaatacttggatagataaatttggtttgaccaacgaaaaatctatattttatattgtatgtatttgaggattaagggcggcaaggcccttgtcggcctccgttggcgtgattgacgctgcccagattggcagcaacacatatcactttaagattagcacatgttaatcttggaatgcatgccatttatcaatttgaggccgtgtagatgagggaactttgttgttgatttgatagtcgcggatgtttcttccctgtggtttctctgtaagtacacctgcctgccaggcccctacagctagctagacgatgtaaataactagtgaacgtttgtaaatgctagaagcatctttgttgaatgtaacaaaccagagaagcttagcttgtgggctagctagcttttgcaatgaatctgaggtacgttaaaacttaacacactgcgactttttattttattttatttttacaggtgttgtttgagttcgacatggcttggaagttggaagaaggccacccgaaaacaagcagtagtcatgttgagcggtgccatgcacgttgcattgcatgcgacagctgaacaatccttggtacggtacggtcccaatgctaccgagtttttgtacagtggacggcgctggtttaccctgtactgtacgtactactactactccatagcatagcatagcataggcatagctaggtgcaggcggcggcgatggagcgacaggtcagtggccggccggggttaatggacaggaccgacagttggtataacaagctgacgtgggcatccaagcctccgccgcagtgccgaactgccgacagcaatttgacaagaaggcgagggatcgccgatcgcgacgcgaccatcgcattcaattcgatcgccatgcatgcatgttccaaacaactgggcctttttcacaggccaagaccagcccaaagttcgaaggaagcgcgggccatttgtgggtttgggttttcaggcttggtcgggttcgccgggctgggctactgcgacaaggctgatactgatggccaggcggctgacacccaccacaacacaagccgcagcaactggtagacttcacttgggtggcaaactggcaaaacgcgcgcggcggacgcagaagaagaagaagaaacaagagatgctgccgctgcttcagaaagcacttgggtacttttctctctcaatcccgggatgcccgattaggggtcacgtcggggccgtcccatcgcctcgcagagcagcgcaccacgtcatgatgcgtctcctgcgcctcgcagcatccccaccggccggatccgctcctacgaaaagctgttgcagcagctggctggcctgcatctgcatgcccggcagcgcggcagcctctccctagtgctagtgcgggtggtaatagaagcagcaagcattattgcaacccgtcaaatcatcctctcctccatggcctgccgccgcctgctgcatgccctggacgctggctcgacgatgtcccggcgtggcgtcctcgtccaacgactagccggccggccccggccacggccatgcacgcagcggcgcgcctgcgtgctctcccccgtcccgtcgtctctcctagtagctcgctcgccctgacggcctgacctgacccaaatcacgtcgtcgtctccattccatccatcactcactcactcatcaccacactcctgctgctctgctgctgctcgtttctaaccttggctttccttcttttctaatacctctttccacgacctgctgccgcatgcatgcatgaaagaacgaatcaatatataatggatttctgcatgcccatactccacagaccgtagcagatgtatacgcagatcgatctgcatgcgagtgccggagcaacagccagtagcgctgctgctgctgcgtgtcaacaccacaccacgcgcgccctgctggccttgagatctcgcgccagcgagaccaaatcctcaccgcactatgccaacagtggctcttggtacatgcactgttcatgtcatatgctgatgagtgtaccgccactgtgctgctgaatgactgaagaaacaagtgcaccaaatacacagtggactatatgggggttttgacgtacgtacacatgcatgggctgggctgggctggctagaggagtcaataaatgtttttgaagcatctgcaatgcacacatgcatgacatgagtgcacatagctagagattgaaagatcgacaacagccgacgagtgcagtctacagtttgtagtaccatacagaacttcccaaattcaccgcctcagccttcgtgcatggacctctcacctctttctttctatctatagatataagcatttcgagagccaaagtcagaacccatgtaagggcttattcgtttcgccgttaatctca

SEQ ID NO: 2788 - DNA, 1551 bp, Zea mays
  misc_feature (1)..(100): optimal_loci_313593_G1, chr9:99033228..99034778, Cluster 16
gtccatctctttctgccgctctgcgaccaactgtgcgccgcgcgtgcgtcatgtcgttgtgttccgtgcgcagccggatggatcggccggtctagacgccctcttgccccggcggcggcgcgtagaataatcggcgcggcggcgagatacgacacgacgtcaagggccggcgtggccatgagttgcaagaaagccttgtcgcctgagcggtgcagaaacgggacgggacgggacggaaaggaccgagcctgttgcccggccctgttctgttcatcgacaggcacgtaccggccgcggggcgggcggagaaagcgatgaacagtcagaagtgtgaagaggccctgaacgacgacgacgacgaagcatcgggagggtgatcggcgacggtgacgcggccccgccttttaatccagagggcactcgcactcgcacttgcacttgcacttgcgcccgtttaactcccggaaagtaacgcgtgtccgccgtgctcggacatgtcgtgagcgccaagttgaatcgctcgatgctttttgccctgatggggcggtggacggaagaaggctggctctggctgggcttcgtgaaagagaccggcagcgacggcgatgggccaggccggtaatgtgctgcggcctgcggcgcaggcccaacggaacggaacggaacgcccccgtcgtcaactgtcgcaggccgcgaaacgcttaatcgagaaagaagcttttgctgctggattttttttttctgctgtcaattcatcatggaaggaagcgtgagcccggcacctcgccctgccctcacagtcacaggtcgtatacatggacacgcatctgcctacccccagccggccggacggcgatagtccaaactgtgatcaagtatcgtgtgctgtctgcaaacaaaatggaaacgcgtgtcaagtcctctcgacgccgttttcatatcatttgtgggttcgttgtgtcgcctgaggagccgtcttagccgaacccggaagggtacggactcacaggacatgctccctacggagaggctatccatggcaccacttcccatactcgcaactcatattatgttgtaacacttccactcacacaatcatgttgtaacactttcactcacaccgagcctcttttttatctctgacatggaatataagagcgaacaataatttttttaaattgtgctaactaggattcgaattcaagacatttgctatctctgatactatattaagttgcataaatcaataaattaaactaaaaagcttgatcagatgaaaagagatgtacaaaactgtcatcactcccgagttggatgctgcagccgcgtgcttcaggtgccaccacgtttctaaacgagatgcagatgagatgaccggcaggcaaccgtgcagctcccgagtcccgggacagttctgacgagctctgcctctctgaaactgaaaagtctgtggactctggtctggagtgctcctggccactcgtacgcaaccgttcaaaggcgtccacactccacaacggctcccgtggatccccccatcccccacggccc

SEQ ID NO: 2789 - DNA, 1944 bp, Zea mays
  misc_feature (1)..(100): optimal_loci_313660_G1, chr9:99361628..99363571, Cluster 16
ccgacaagtatctcgtttgtcaactccatcgcgagctcacaacagcagtgtcgtgtcgtgtcgtgtcgtgctctacggcctccctcgtgtctcacagcaatgacagcatagggagtgacctgcggtccgtgaccgtgagaccgaggcacaccagaataccagatgagcagcgagcaggggagggggcagcacagggccacgggagtacgatggcatggcaggcacctgcacgcaaccgatcctcccgctctagaaagacgaaagaagccatgcaatgcaatgcaagcaaaggaggaaccgaggcaactgtgaggatgggcccacgcgcacagtacatagaactcagcgaaaaccagggatcgataaagctgcagaatcttgcggtcaatctggtgtccctggtgcaccaaatctttgggccgttctttctcctccagacctgcccctgcccctgcctggcaatcttctcgtctctctctgccccagaccccagtgccagtgccccagcggcgcaggcgcaggcgcagcagcggacggagcctgccctccctctccctcccagaccccagtgaaggctggctggctgatggcgagagtggcatggcagcctgacaagaaaacaaattcagacacaccattactgctgccgctgctacctttcgtgtccgacgagcacactccattccctccctctccctgcaccgtaccgtggttcggttcggttcgtttgacccagcgatggcatctttgatttggcatcattttgccctgcccgtcctcatcaaagctccaaactcgagcggaacttttgggctttttcgtgagtggatccatcatcaacagtgacagtaagtagatcgtgctgccgtctttgctctttctttggcacagttcaactactctcccgctgctttgagaccctgtactgtacttcaaagttgcagcagggccaggggcgcagcgtccgaggtaaagagttccggcactgacagcgtgcgtagagctgctggtggtgatcttttctttccctgctgtggtgtgtcaaggacttcagaaggcgaggaaacggatggagtgccttggctaggagcagtgtgcaagcacatacaacatggctcgctttggaagcttcaatggcaggctgtatctgctttacaaaacatcgattccatggtgctttctcaacaccatctactcaggactgttaaggagaaatcatgcgccaattttataaactttaatttaattttatgtatatacatgaaatcaatatttttttcccttgttccaaccagactatacttcgccacagcacatctcgggatgaaagtatgtaagactgttttggatggatcctataaaatagagaagagaacacgtaactacaaagtcaaatttaaaataaagagagtaagataggagataaaataagacagctgatggagtcgagaaatgggtgattgggtggtgtggctatgtgggttgcttgctgtgggtaatactatctaatatggactgggtcgttgtgctgcactcgtgctgttgtttgactgtgtgacaataattgtgaaaggtaggacgaatactctcctagcatatgtctacggcttaagtgaatttatttttttaaaagccgttctaaggttacatactaatacaataatctaaaatcatatgctcaactgaaggacacaaaaaaggatcaactaatttctgtccaagtaagataaactacattgtaggctccgctggggagaaaagacattgtttttttttatgtttgttagccaagactatcagaatatgttcagcagtgacctgaaaaaaaaagattaaaccctttgaatagtagaattgataggatttgaatttttatggcagatctggaataaaagtttggccaaatgaatggcatatagaaagaattctcattgtttgtaattc

SEQ ID NO: 2790 - DNA, 1801 bp, Zea mays
  misc_feature (1)..(100): optimal_loci_315232_G1, chr9:107337261..107339061, Cluster 16
tgaagaagggataaccgaataataaagaggccggatcgtaacaggctaccagccttgaattgatgaattatggcatgtcagaacttaaacgcgggtggcctatacggatacagtatacattacggccggccccgagcaacgcaggatatgtccccggaccaggcaggacgaccccgcccggatcccgtcccggcggccagccgatcgatcgagagatatatgcatggcgatggcagctagctagctagcgtggccaccactcgtgccgtcgcatttgcatgcatgcaggcaggcacgtaggttgctggacgccgtacggaccggccgggcaccaagcatctgctgcgttatcgcggacggcctttccttctctgttctgcaagaaatattaatggcgtagagccgtagatgcatgccacgacgacatgtttggtcgttggcgagacgacgggcggaccatgcatgcatgctgcatgcatagcacgccgcgcgcacgcgcacgtatcgttacggcgagcctttttaaatgcatatatgtgtgaggaatcgtttctgcagccgcaggcacaagcgagcgatctagggctccaggcccggccagacgacgaattacttctaggtttcagtgccgctccagcttcattcacctacctacctaccatgatgcatggcatcattcttccaccgcctgccctgccctacccgcggccccatggtaacttcgacgacgccctcgtcgagagcatcactgagcatgcagtacgtgcaggccccgtttgccgtggtgtaacttcgacgtcatctcgacctctcggatcatcactgaggcctgctccgttgggaaattttctctctactataacagtgtaactattggtgccggcatgcgttatactaacacaaacagcggacgagtttggcacgagtacgtggtcgttagctagctttaactactcttcacgtaattactgcttctgctaacatgcatgcacgatgcatggcggcatgtggaacgggcagcgctggtctgtccccggctggctggctggctccctgtagccaataaaaaacacccggggacaggaaaaggacggcaggaacgacgacagcgcgagtggagggccacatcaatcgccaacagcttcagtgcatgtagatgtaggctccagtgtgccagcacgtacgctgcttcgttgggttcattcacaaagtacgttcttcctccggtcgatctcttgactcgatctgcctttggatccgtcgtcgatcatccatctcttgcctttgttcaagcaacgagaacggcgcgcggtcgatcaatataatgtaggtcgaaatttcacagaaacacttggaatttctacgaccgtatccaatttagattcaacttcaaatctctctctctctctctaaacgaagggaggcggaaaaagcgagcagagaagtttagacacggccgcctgtgcttgactgtacaaccagcttggccaactgtgtgctatgaatgaatggtactgattgcgatgcttcttctgtgggtctagcgagccccctccataaatttctcgtggccatctttgctgggagggaccaaatcaattcgatcgctgccatggacgtacagtacagccgcagcatgctgcagggttcgccaactaatccgtcgacccatgcatcatccatgcgtgaagctgaaggacacccatgcttgcatttcatttaattatcgggacctgcagagcagtggacctagtagtttgttgcatgcaatgcgatcgagactgtctgttgattcagattt

SEQ ID NO: 2791 - DNA, 1834 bp, Zea mays
  misc_feature (1)..(100): optimal_loci_3155_G1, chr1:16061338..16063171, Cluster 16
gctacaggatacatctgttcatcttctttccccccctacgattcgatggattactgctcggggtatatatagacagatagacggtctagctactatacgcgtgtgcagcagctacctgaaaactcgatcagccagcatcacgactgttcccagaaagaaaccaaaccagagtgcacacaaacattctaccttgggtttctatcagtacgtagccaaaccaagtcagtacagtggatttcccatgaacatgaacatgatggaccagcgcacagcatcccccgcggaataattcaccctacatgcattcccgcgtgctttttgtccgcaaaggttgtcgatccacaaagcttcgtcgtggtctagacacgaatccccccccccccgctctgctctgctctgctggcgcgctctaatccggtcgggatgaagctgtgtgtcagcagcagcagcagtacgtatgtagtagaatgaagccacggcagggaaaaagccgttctgctcggattaatctatttgcaccaccaaatggtccctgctggaacaaacacgataggtcatcgaccagacaagacagtatacagttagctgtaaaatgtgaccgcgtgtacgagcttttggtgaacaggcaacgtgaaatggagaatatactgttacgaccgtgccacccacatgcaatgcatggctcctcctccgtggttaacgggtttgcgttgcatgcatgtgacccctctgttgtgtaaatctcgcaagagagagtagaaaaacgcacggcttgtactaggaggtagaggggatagtgaggtcacacagatcaccgccacatttgggcatcgttcgttcctgtcgtcggattctaaatcaagattgtttttcctgtaactacagcagagctgcatcactcgacatcgtcgacagatgctgtcttcaggagcgaccacaaaacatattgtgctactagaaagaaaaaaaactgaaccatggtcaggtgctcaggtgggtgggggaggcagcatggaaaattcgcagctgatccacgcacagttttcagacacagacagggtcgatcctatccgaccgcctctaattttggcgaaaccatgcagcgttttgtcgtcgtccgtccctctctcagtctcaggaagcacgagcagggctggcttcgtcccaactcccaacggcagtcggctgcggatactgattccttccacccatggtgggtcaccaccgccccggccggccacacggttcggtttcgagatcagagaaagcgaaaagactggcaggccatgagcgaggcatgcattgcacagcctaaagaaagagcggggcgtgcacgccggaggcagcggcggaggcgacagaaatgggaacggagagcagcaggtacagccagcggtggagcggatggtgtggccgctgtggatcgggtagggtagggtaggacgcttaggagcaggaccaccggcgccgagggcagcgatcccgagacgaggagaagcaggcgaactcgcatggcgggcgcacacacgagcgagactgcgagagagctcggtcggccatcgatccatcgtctgaaatggatcgaaaaaggggggccgggcgggcacgccagtcgttaccagcgcctcttttgcttctttcggtcgatgcatgcccccgcctccgcctcggcgtccggtgagatccttgctttcttcctcgccgcccttttcctcttttttttttctgctttccgcccttcccgacagactatcctgtgtgtgccatgttctgacgaggttcacaagtccatctgcctccggaacagcacgaggagagacgctgctgcctgctg

SEQ ID NO: 2792 - DNA, 2148 bp, Zea mays
  misc_feature (1)..(100): optimal_loci_315885_G1, chr9:111118401..111120548, Cluster 16
ttccagctataagcgccggacgcggacattcgcttggctttaatccacaaatgtttttatctctttatattgcagtggcagcagtctaatccacaaatgtttttatctctttatattgcaggtgtatcagtctaaatagccagctctaatccgaagcgcgaattactgactgaaaacgatcacaatgaagtgcgaattcctctctaggaatatactctccagccgaaaccagcactgattttttgttttgggggtggctctaaaatactgtctgtccctcgcccgtcgagtttcgctatcaggtcttttctcctttgctccaatggccacgccaaaaaggaagaaacgaataggggagaaaaaaaaggagaggagattatgtgcgcttctaaagctaataataattgccttgccccccatcctctgaaatctacatccgagggtgcaataatgccagcacaaagtggggagttttttttgtggcccggacgcaggcgtcaaacgatcgacggggaaggaagcagcggcatgtgcatcagaaatctctcggccaggccagtgcggctgcctgctgcaactgcgcctcactgtggctgatctcacggggacgacgacggacgggtgcgggcgcgcgcgcgcgctcctgatgcctcgcgctccaatcagagcggccactaatcctggccggcatcaccagcttaccaccacattctaatcgcgttcgtcgtgccagaaggataaccggccgtatctctgcgtgatgtgggggaaagattacgcgcagatatatgatcatcgtacacgcgtaatagtccatatatgcatgtgctggaacgtttgaaagcccctggcgacagtctcgcaactcgcaacggtgacctagctgatgaagtgtcatgttgcatatatgcctgaacgcgtacacccagcgttagtgcatgtataattaagaaggaaatatccagtgtagggtcactggcccacgaaaacaaattgggaggggggcagaaattctctgcgacgacgtacacccagctagcagcgtccacaggccacggcacatgccgtgctgagacgacaccagcgcatttcttcgtccctgtgctctgaccgaaacccagttcagctacgcaagccagcagcccggcgtatcccccagcaggagcttgaatgcagcgtcacatgctgccttttttttccacattattatcagaggaaaacccagctcagagaaaaatgtgcgcgccggcgatgtagaggccccgaacgccacagaaaacgcagcgagatgatggacgcagctggcgggcggcggcgataaggacctgcgtcgctcgcattcgcatgcacgcctggagctcggaggaacttgacttgaagccaagagcgagcgagcgagcgggcgggcagaagcatgtgcggcacgcgtgtcggggtgcccaaacgccggccgggaagcaaaggcgccatgccgtgttgctgtcgtcgctgatcggctgcgcctcctggcagggcacgttgcagccggcgccaccacatggctcgtgacatgtcgacgcgcggtggccgtggccgtggccgtggcgcggcgtctgcctgcactgcactgcacagcagcaggccctggccatgtatggtgccggaactggcgcgggcgggggaggactcgtgtcgtcctgtgctgggcgggcgacaggtgcgaggcgggcactgttgcggcgtgtgtgtggtggatagccttgcatgatccctgaagcgttgagattttgcgggtgggataggatcataggaggatggcagcaggcagtggcagcgacagtggtgaacagttgcgcagcttctccgaggcaggacttttggaggtacagtacggagaggcggaggcccgtacctttctcgctttttcgggactcacggtgctttcttgggcttttgtggcctgtcagcctgtcaccaagcaacaatgcataaacctatgctatgcacgaaatcgtagcccatgggtccgacccatctttccacagcccaaagggcaaacgggccatcaaaacagtgccacaccaccacaacccaaaagcatcaagcacgacgacattgggattttagggttggtgattcctcagcgatctgtcgtcacgggaggatctg

SEQ ID NO: 2793 - DNA, 1432 bp, Zea mays
  misc_feature (1)..(100): optimal_loci_320730_G1, chr9:136794206..136795637, Cluster 16
ttccatcgtggttttgagtgcttatgctaaaaagaaaagaggataatttttaattataaaatcacttctcctgaagaatcaactttcatagggaattagaattaggcagagttctacaaagctggccttacgaaagacgttcatgaattccattgtattggtagcattggaaagctcgactcgtgtatggttgccgacccaaagcgctgggaaaatcacatgtccttttttgttgaactagatatgggtacccctggcatatatttttgacgaaaagaaatggaggaggcaagaatatgtcattcaagaagaaaaaagaaagaacatgcttcttgcgtggagtgggatttccgatgtttcatcaagcgaaagtgaatatgattatcatgaggaaaccaacttcgagagttttcgaaaaagatcgctacgccggctgaaggagtgaagattcggaggacccagcgggcactcgtgcgacgggcggccactctccacgccggctgccgcgaggagcgaggccgaggcacggcggcagtgacgactccatcaaccacgcgcggtgactgcagcgctccagccaaggcgttttacggcggcgaccgcttcgagttcggccagttgtggccgttctacctgaacggcaggtcacggtcgcgttcggcggctcgacggtgggacggcgacggtgcgaggtacatcttgtaggaatgatactggaatttcttctcgtctgaatcagagaatggataaattggggaatcttcctattattgattggattgggggagttggtaacaaggtttcacgtatccaggagcgtggtttttccccaacttataacatggaaaggagtagcatgcatgggtgcgggactgaggtgattaacaagcgagctccacccaagcttgcaaaggaatccatggaggattttctagatgctagtttggtcagggagacgatgatggaagggacaaaggaggaagtctgggagcgggaatccatgagcgggttaccgacgaaaaaaggcatgtcatcggcccaagtgtttgggcactcctggaggcccatcaaccccacgtggtgctgggttccaagaagcggaatccacactaagtcatgctaccctgctcgaccggacgaagtgcgtaggcttcggctctctgccaagtccgtgtctagggttagacatcaatccttggaggctcgttcctatgcccaagtagtgagggaaggcagaatggcttggaggagggatcatggagggagcaattggaaacggcgccaagatgaatggatggaggaagatgaccttctggaaggggatccctgcagagaacaagatctgcgcgctaaacttcagaggggatcaggagattctactgacaggatcccagcagagcaggtacgtgccatgccaaacattagacctgcg

SEQ ID NO: 2794 - DNA, 1429 bp, Zea mays
  misc_feature (1)..(100): optimal_loci_322172_G1, chr9:144523791..144525219, Cluster 16
gctctcaaagccatccacattgattgagtaacttatagcaagaaaaactctttttcgcactccgatttcgttattactgaaagtccgaatattaggtttgtaaaaaaattacaagttgtttatgtttggcacggaaacaatatttccggatggaaaaatatatattaccaaatacaacacttggaacaaataatttctaatactagaacaatataaccatgaatttttaacaagttttgttttttgattttggtgtaattctgacatcgccctgttcagctgttcctctgtcgtgtatcaaactagcaattacgtaatggaaatggaatggagcatcaatcgatcaaattaaaaaagaaaaagaaataaagctagcctgtgcattcttgacagtctgtgtggcctttccgagtccactgaaactgaaatacccaggtcgtagcaccagcaaagacagggacgcaacagaaatcgacgacgaagttgcaggttctctgcgttgtcatttaatctgaaacagacgtcaagaattcacaaacgccaggttttctagagcgagtcctctggggtctagcaacgagacgaatacgcggagtcacggcttaacatctgcgagagcgtcttttccctccttgccggaatgcaatcgtggaatgcgttcttgtggggacgaagatcgagagttgcaatccccctaataaatcaggctctctaaccataacgttaacaacgacggtgccctcacgcagctttcgggccggtgatgattaaggaggcaggcttaaattcgtcgacagtgttctgcctttatcatgattgcgaggactgtactgtatggagtcttagtttttttgcgtttggttgtttacttcctgcagatatctaaatacacagtgcacggtatatgtacgtatgtattggggcattagaatctatgtgcctgtagcaacatttggattaccaaagcaactgtctgaagactgaactagtagagtctgagctctcggtgttgctctgcagggtttaataaacgaaaaaaaaaaaatcaaattgggaactgctaactgaattctgcatcgaccggccagcgcattagcatcgttgccccccatcaacgcgatcgttggtgatctgaccccgaacggcgcgactaattgcgcgattagggagaggtccagtgagcagtcacgtctgagcaaaaggcgcacaggcacagggcgagttcgcaacgctaataaacagcccccggggcgccgccgcccgccggccattaatatatcccagacgccacgcccgcatgcgtcgggcgggccgagtgatggtggacacctgtggcatctattcgtgcgcatgtcgccgacgtacgtgtccctccggcctccggatcggagccgccattattgttgctacatcttggttaggttcacat

SEQ ID NO: 2795 - DNA, 1410 bp, Zea mays
  misc_feature (1)..(100): optimal_loci_32299_G1, chr1:198198031..198199440, Cluster 16
gttggctacgaggagaggagtgtctgtacgtgtagtacgcatatgaaggagtgtacgtgccttgttaagctgttgttgccacgccgaaaagagacgacacctcgtgtattaaaaaaatgagacgaatgtacaggtaaaaccagtgtcagagaagaagcacgccgacgaccgacctaccgaccggccgccgctacggcaggcccctatccgttgcccacgcctcacagttacgcaggccacgggggaaggcatggatgtggtgtgtttacaacgtctccgccctccagcccgcgcgcggtccacggctgctacgtgacgggatcacgcgcggggggcaagggcaacccgcgttaatgcccggcggccggcggcggggtcgccatccgctcgccacgcacgggacctgacgtgtagttcgcccgccgttcaccgatggagtacgggccgaggccccaccgcccgatcgaccccggaccaggctaggaccaccaccacgcgcggcgcctgttgcgacccctgcgcaagcccgtctgtcgccgcgcgcgcgcattgaacgcggcgccaggcggcacgtacgtctccgcgcctgctgtatggtctctggctggcctgcgccgcgcatgcaccatgcaccatgcgctgggccctcgcccctcgctcgctcgctgcttgtctcagctcgtcgcctcctgcgcgctcagctcagctcagctcgctggtccatggcctggtggggtcgcgcgcgcatgcaaacaccaatctgtagccgcgccgtgccacgcttccttctgctttgcccccggccccgtcgtgctgcagcgcagcagggtgcagtgcagcgcaggcagccatggcatggcatggcatgtgcggcaggcagcgtgtagtgcacagtggtgtgtacctgtgcgttgcatgccaggctgcctgcccgggcagtaggagagtagtagaggggtagttcctcctcttccaccatgttcagctactgctatatgcctcagccctcagctgccgtgcggccgggcggggtggtgcatggtaacacgggcgggcagacggacggacggacgcgcgcgctgctgcacgctgcatgcagttactcggccgtgtcagtctggccttatctccttggacgtgatttccgttgcgtcggccgttggggacggctacgcgacgcgcctgcctgcctacgccttcgcttcttcgttccagcctgcctatagctagtgcagggctaccaccgtctgcacgctctgctcctatcgtcggttggggcctggggggtggtgtcaggctcactgtgttgtctgatgggagctagcacatcagtggtcctgtgcatgtgctaccactctcgactcggccaatgcgtgttgcgtgtacctactgctctcccccccccccccc

SEQ ID NO: 2796 - DNA, 3313 bp, Zea mays
  misc_feature (1)..(100): optimal_loci_32446_G1, chr1:199073564..199076876, Cluster 16
ttttattcttagttttataacactatttggtgcagttggaaaaagatggtacgaaattatcgttgacaacagcctaataagaggacaaattttagaaccgatagcgtctcttgctcttctgcttgaagataagctaactaccggtgctgtgtatacatcaaccgtggatatatagctgtaaaaacggggtctaaactttacgctataaaatttaaagatcgagttggattaggttcgagttcaattatattcattttaaactggaaatgatttagagccttaataaattgtaaagaaacatttggatgatgtacatgaaaaattggatgtacatttggatggagttcatattttttaaattggatcgagtcggattaagatggatcgacatctggatagatatatgcaccgtatagtacatcggtctgtactgttcaagcaaagcacactggttcaggatttcaatcaccgttttttaggccccctaagcgcacgcggcacgtcagtcggtctggaaatccacagagatcaaattcaatttctatttatttttaaactggagataatttagagccttaataaattgtaaagaaatatttggagggtgtgatcagttgtcaccctgaccgtggatgattcattacggccgatcgatcgacatctggataggtatatgctccgtatacatcggtctgtactgttgaagcaaagcacactggttcaggatttcaatcaccgttctttagacccctaagcgcgcgcacgtcagtcggtctggaaatccacagagatccaattcttccattcttcctatatagctaggagtacatgcgccgccccgtccgcgcgcagccatgcatgtgcggagaattcgctccgcggtccgccggccgaccggcccgcccggccccattcgacaaactgacctgtcgaggccgacgtgatccacgtgcccagctccgtcccctccaccgcgcaagaccggccggcgcccgagccgccgacggatcgtctgatgctggtatcttctctgaactctcctggtgggtgggcttggcaccgtaccctgcctgtcggcaaccaaccacagtccgcagcgacgcttggtcgtcactctcctgttgactgttggtctggcctggacgcgccgatacgtgccttaagatgagaaacgctggctaggctaggggggccgggaaaacaacgcgtgctctgaaccgaaccttcccaccccggccgcgtcctccgatcaatctagctaccacactagtgcatgggattcgcgtctcgcgagacacgactttcccgtcactgagaaagctgggaagaggtcgggtcccgttgccctcgccggcgtcgaagtcgaaacaacgtttcgcggcgggcacgtgtcgagcgatgggagatggacctagcgaggctcggccggccccacggcaccgtggcctgctccgtccggtccagcgagagacagcggctgagatcaggtgcgtgcagcgtgcgcctctcctggtcgtcacgcgcgcgcttgcagcagccgatcagccgtccaactccgatcctaccaaaacctcgctctccatcaaagctggcatcgtcttccgctccgtctcatcgaccagcccaagcggccggcgcctcctttgattagttacgtttcttatctcctcctcccgcgacgttgttttcggccgcggatttggttccggcatccgcaaacatgctccgcatactgtgtgggacagtcggaaagggaaactgtcgtcgccgccgagagggtgcgtgaacctacctacctactataccccgcttgcttagccatcatgcatgagcatgatcctgtattcctgtgtgtgtgcgcgcgtgctcgttgcgaccaacaagctactggcatctatatggatccgcgcgcgtgggagccacacactgaccgatgcttttgttttgccaacagcgacaggtgtggtgtggatgtatcgatccacagtactcctccgacatctgcgggagctggggattgagacaggtgtgtgctggaagcctggaatgcaatggaaggctgccgctggagaggactatagtacgcaccctgctgaaagcgcatgccttttatgtttgatcttaatttcgtgacaagctagggctaggaggccctgtcaaccaaccaaatcaggactcaactccactcgccagaacatgccggggggagggcgatgtctcgcgcccagccccaccggacgccggcctccagacggggacagcggctcggacgacgggtcctgctgctcgccatacagcacacacatgcatgcatgcgcgcctagctcgcggcgagagagccagcagcggcgacgacgacgacgacgacacaagggcatcggtatcacagtatcactgcacacagatatggccgcgcggagcctgggtcacgcacgtgtacgtacagccaaatccccgcgagatacgcacagggcgaagctaccacgtaacgtgacgacgtcgcgtcggaacgtgcccggccggccggcgcccgcgccatcctcggctcctcgcgcacagggcccggcaagcgacacctgagcgggagatacggaggaagacaccaaataaagcttcctatctcctcgcgttatcgtcgcttctcgagcggcgccgatcgtacgcgcgagagaccgaccgacctgggggctgggcggccgtcatctggccagccagagccagacacgcgcgcgttgacgagacggggtaccgaaccgatcgatcgcccgcggccggccgttgctgcatcgcctcgccgtgtacgtggacgctagcgcgcgatcaggttaacgttgaggcggcggcggcacgcgcaggggtgccgtgccgtctgccgacacggccatcacatggccatgcatgggtgccgcggccgggtgggccggcggtagcactgggcgtttgcccggccccggctacgtcgttggagcctggagggcgggcggcggcgggccgcggatggccggccccggccccctccaaactgaacacgacgatcagagggatcgagaagcaggtcatcagaacgattggacggaaggatctgtgcgggtcatgctcgccagcttgggccgtttgaggtgactgcattgaataggaatggaacgtgcgtggccgcgctcttggcggttgctgcttcagagttcagaccaacggcaacggtataccaaccactaaactctaaaacttaaacctacttttggtcttcacaccttcatgctaacttttttttttcaacgtaatatatagtggaacaaagttccggcttcatccc

SEQ ID NO: 2797 - DNA, 1455 bp, Zea mays
  misc_feature (1)..(100): optimal_loci_32522_G1, chr1:199498926..199500380, Cluster 16
  modified_base (696)..(696): a, c, g, or t
  misc_feature (696)..(795): n is a, c, g, or t
  modified_base (697)..(697): a, c, g, or t
  modified_base (698)..(698): a, c, g, or t
  modified_base (699)..(699): a, c, g, or t
  modified_base (700)..(700): a, c, g, or t
  modified_base (701)..(701): a, c, g, or t
  modified_base (702)..(702): a, c, g, or t
  modified_base (703)..(703): a, c, g, or t
  modified_base (704)..(704): a, c, g, or t
  modified_base (705)..(705): a, c, g, or t
  modified_base (706)..(706): a, c, g, or t
  modified_base (707)..(707): a, c, g, or t
  modified_base (708)..(708): a, c, g, or t
  modified_base (709)..(709): a, c, g, or t
  modified_base (710)..(710): a, c, g, or t
  modified_base (711)..(711): a, c, g, or t
  modified_base (712)..(712): a, c, g, or t
  modified_base (713)..(713): a, c, g, or t
  modified_base (714)..(714): a, c, g, or t
  modified_base (715)..(715): a, c, g, or t
  modified_base (716)..(716): a, c, g, or t
  modified_base (717)..(717): a, c, g, or t
  modified_base (718)..(718): a, c, g, or t
  modified_base (719)..(719): a, c, g, or t
  modified_base (720)..(720): a, c, g, or t
  modified_base (721)..(721): a, c, g, or t
  modified_base (722)..(722): a, c, g, or t
  modified_base (723)..(723): a, c, g, or t
  modified_base (724)..(724): a, c, g, or t
  modified_base (725)..(725): a, c, g, or t
  modified_base (726)..(726): a, c, g, or t
  modified_base (727)..(727): a, c, g, or t
  modified_base (728)..(728): a, c, g, or t
  modified_base (729)..(729): a, c, g, or t
  modified_base (730)..(730): a, c, g, or t
  modified_base (731)..(731): a, c, g, or t
  modified_base (732)..(732): a, c, g, or t
  modified_base (733)..(733): a, c, g, or t
  modified_base (734)..(734): a, c, g, or t
  modified_base (735)..(735): a, c, g, or t
  modified_base (736)..(736): a, c, g, or t
  modified_base (737)..(737): a, c, g, or t
  modified_base (738)..(738): a, c, g, or t
  modified_base (739)..(739): a, c, g, or t
  modified_base (740)..(740): a, c, g, or t
  modified_base (741)..(741): a, c, g, or t
  modified_base (742)..(742): a, c, g, or t
  modified_base (743)..(743): a, c, g, or t
  modified_base (744)..(744): a, c, g, or t
  modified_base (745)..(745): a, c, g, or t
  modified_base (746)..(746): a, c, g, or t
  modified_base (747)..(747): a, c, g, or t
  modified_base (748)..(748): a, c, g, or t
  modified_base (749)..(749): a, c, g, or t
  modified_base (750)..(750): a, c, g, or t
  modified_base (751)..(751): a, c, g, or t
  modified_base (752)..(752): a, c, g, or t
  modified_base (753)..(753): a, c, g, or t
  modified_base (754)..(754): a, c, g, or t
  modified_base (755)..(755): a, c, g, or t
  modified_base (756)..(756): a, c, g, or t
  modified_base (757)..(757): a, c, g, or t
  modified_base (758)..(758): a, c, g, or t
  modified_base (759)..(759): a, c, g, or t
  modified_base (760)..(760): a, c, g, or t
  modified_base (761)..(761): a, c, g, or t
  modified_base (762)..(762): a, c, g, or t
  modified_base (763)..(763): a, c, g, or t
  modified_base (764)..(764): a, c, g, or t
  modified_base (765)..(765): a, c, g, or t
  modified_base (766)..(766): a, c, g, or t
  modified_base (767)..(767): a, c, g, or t
  modified_base (768)..(768): a, c, g, or t
  modified_base (769)..(769): a, c, g, or t
  modified_base (770)..(770): a, c, g, or t
  modified_base (771)..(771): a, c, g, or t
  modified_base (772)..(772): a, c, g, or t
  modified_base (773)..(773): a, c, g, or t
  modified_base (774)..(774): a, c, g, or t
  modified_base (775)..(775): a, c, g, or t
  modified_base (776)..(776): a, c, g, or t
  modified_base (777)..(777): a, c, g, or t
  modified_base (778)..(778): a, c, g, or t
  modified_base (779)..(779): a, c, g, or t
  modified_base (780)..(780): a, c, g, or t
  modified_base (781)..(781): a, c, g, or t
  modified_base (782)..(782): a, c, g, or t
  modified_base (783)..(783): a, c, g, or t
  modified_base (784)..(784): a, c, g, or t
  modified_base (785)..(785): a, c, g, or t
  modified_base (786)..(786): a, c, g, or t
  modified_base (787)..(787): a, c, g, or t
  modified_base (788)..(788): a, c, g, or t
  modified_base (789)..(789): a, c, g, or t
  modified_base (790)..(790): a, c, g, or t
  modified_base (791)..(791): a, c, g, or t
  modified_base (792)..(792): a, c, g, or t
  modified_base (793)..(793): a, c, g, or t
  modified_base (794)..(794): a, c, g, or t
  modified_base (795)..(795): a, c, g, or t
attacaaacagggcccttcaatataccatctaccttaggctcttctttgagccaccgtatcatttagcggttattgttatttttctgaagaatctacaacggtggttttgagagggtagagatttggttgcctttgcctccatatgacacccctggcttgcgacgatgacgtgtctgtttcccttggctcttgttgtgtaattaaccacaaaacccgagcaaacgtgtatatatatagccccgtgctatatataacaaactcttttgtttgttcttcctcactttcgctttcaaaaacaaaaaggctttagcactctctgtctctcgtggactggtcaattgatcttatcaacggtgaaggaagttgggtaacccaataaaaaaataaattactcggaaatttgccgcgccattcgcagaactaagaaactcccgcgcgttgtggcggacattaggaagtggaatgccggacacgatgttgaagctacaacattacctgtaatatgcttgtcgaccttgttacgccaaaaaaaaacaacagatcaaaagattagcaccccgctccctactttttttatcccaagctgcggtataaacccaggcccgtcttaacctttagtgcctttgtttgggttcacgttaatttcccggtgggattagggtgggtcagtattatggttagtccaaattcctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcccaggcccccgaccaatgctcacagcgaagtacagtactgggagcccccagcgtgctgccggtgcatgtcaccgtcgaccgcccgccccaccccaccccacccctgcttccatcaaagttggcagcaagcagtgacagctttggaggagaagtctgccgctgcgctcagccatttcaaatccaaccaacggtcgcgatacgacgacgagcagccacgaccagagccgcccgcccggcgcccgcacgcaagggcgccaggaccaccgccaccggcacgcaagggctcggtgacgcgtcgctgttccgccacaggccgtggctccgctttccgcgacgccgccgcattgaatcgagagggcgcgcccggtcggtcgcagtcccctccccgacgcacaaggcacagcccaaacctgtctctctcagcgctcacatgacatggaggccagcgcagggcgagttccagtgagaaacgcgctgcgccctggcggccctgcacgcgcgcagccgccagccgcacaggcggcagcggcagtggaggagcagggcgggcaccgggcaaggacacgaccgcgtggcgtggctcacgaggccagccagcccggccgccggcagccggcagcgcgcgcgtgcgtgcgtgcgcgcgctcgctttgcctca

SEQ ID NO: 2798 - DNA, 2166 bp, Zea mays
  misc_feature (1)..(100): optimal_loci_325682_G1, chr10:6375124..6377289, Cluster 16
aaaccctactttagacgattttaaatgatccgacaaagttcgagaacatgtttttctggttttatgagttcgatgtatgtcgatcgacggtacagcctgacacacggttatggttgctctaattttcgtgctagctagctgctgaacactctaagcaatactactcctaatctaatgtttggtcagagtggatcgggtcgagccgcatgaatgcatgcagttgggagacggagagagacgagagagagagaggcgagagccccgcccgcatgcaggcagcgagtagagtaatggcgtgcggcgcgagcgcgacgcaatgcgttgcgttgcgcggtgcagcccagcccagcccaggccgacgatcggtggttgcgtgctgcggcgtcacatgaatttagtagcggcagctagctagcggacgtacggattcatttcggcagccggccgctcgccgatcgtctctctgcgtttcgggcggcatgcatctgccatgatcctcctgtgcctgtacatgcagctagcgcgccataatgccaactagctagcagtatgcctccaggcttcagcttctgccctgcgcctgcgcgcgcggtttaaaagccacctgctgacttgctcagtacactccagtctcactcaccactcagcagctgtgcgggatggatgcgaagatatggatggatgggaagatagatgccaaacgggccgagcccaacctggtacagcaccagcccaaaagagcctcccgttgctccaaatgtgttgtgtgtgtgtttttttatagcgcaatcaatttagacacacagaaaaaaatactctcagctctacgatcgagatcaccatgagatgcagtttctaactccttgagcacttctcttgattcccaacatcattcatccacctgggaatcacaggaccaccgcctcatctcgccgccctctcgcccttattgacctccgaaatcgtttccttcagcaaaaccatttttttggaagggtccctccgagcacacaaaactgtccaattctacgccaaaatcactacccttgtgtacaagtatgtacatacgtacgcttgcagccaactctccgaaacggccgaagaccatttctaattaagctctcttccacaaacttttcaaagttccattcatgaaagcataatatccaatggtattcactcctacacaaatgattttatatccgtttctattgaagtttttgtaagtgattccacatagcaactctggaaccccatggtgctcgtggtgggttccattccaaattctaaatctaatacgttagctgcagagtgctgcccacgcacacacgtcgccgtcgtttcgaagatctatggatgggaataataatggatatagcggccggcgagtgcgtgcgtgcgtgattgcaaatgaaactgctcacactcacaccgccgatggcgcacgtacgtgcgtgcatgcgtagacgagagtggcacacgtaccaatggcggcgcgtcgtcacgacctctctctgccacccacggcccacgggcagctcgctcgcattgacgccaaattgcccacgctctaaccgtaaccgtctaacgtaataatgcgtgtggacgtgtggtcagttagcgtttgaggcccattggagaagcccagcaggccagaaccgcgcaaggccccggccgcggtaattaaacctggttggcaccgttatagttggccgaaaggttggaggtccggcagaacggcccacggacgaggcttttttgctcggcccgtttgtgtggtgtaggaccgtgcctgagctgcatcctcgatatatatggccccataaacagaaagcccacttcatatatagagagagtgagcttttcgaaacatctttaaaatcaaccgaatgacagatatatagtaacaatgttaaaatttattgtattgaataaatataagtaaataaattatagaaaaaaattttcatgataaaaaaacgagagacttgtttcctagaaaatctactcgaaattagggcatatgcgagcgaccgtgactggctgcctgctacaggttgcgtcgtatacatgagggtgaccggagcaccgttgcacatgatcctacagagccgcaccgtgcatatcatacaggatggttacagatacagcgcgcgggtgtgctgc

SEQ ID NO: 2799 - DNA, 1471 bp, Zea mays
  misc_feature (1)..(100): optimal_loci_340077_G1, chr10:93819543..93821013, Cluster 16
gacggtgacagtacgcatcgaatatatgcgtgcattattcttgatggacttttatccattgtcgtttctgctgcaatgcaatgcaatgcaagctgctgcacacacgcagagaacgaccttgcctacactcctgcttcgttcctgctgcccatgcatgcatgcatttcgctcagcttcctctcccgacccgaggcatatgcaatgcaatgcaggctggccgccgcgccatcttttgaggcgtacggagtacgtccatattccatgcagagagaggcttcgctttccattgctgggatcgaggcttcctgcatgacctccagacgacagcagctgcatcggctcggggggcgggggacgggccggggggccatgccatgcatgcagcatgcatgaagcatgatggatggacgacgggccataaattcaattgtggtttttttttccgctgtcgagatcgaattaattttttctactgtttttattcgttttcttttcttttcttttctttttgtttgttcgtggaaaacctcatcatgtatcttcagtgcgctccctatcagcagcgacagattatctcagcagtcagcacagcacagcaccgtacagaaccatcaccacctaataactgagatgggctcaattatttaaagttcaacgcaaggcccattaataactaggtactagcatggggaaccaaattaccagggcatgcatgtgacactgacattcgtggggccgccatgtcgctaactagctttgcactactgtcgcccggcgggccgttagttactagctagctagctcttttcaaaattcaaatacatctatctacattttttttttgaaaatcctctaccacgtgcagtgcacgtacacgtacccaacggcggcacgaaataaaaaaaaggagctttattacgtgtcacacatcccatcatcgacccatcgtcccggcccggcccggccgatccccatgcactgcacggtacatgaaacatgcatgagccaggaataaaagcgttgacacggatggatgggggcttcacatgcatgcatgcacgtacgtttgcatttattgcattattactcgctttaggcaaaagcaaagcatgcacatgttctcgtacacgcgtacgcatcgtcatcgtcgtcacgagtctagtttgctagctagctacttgcctgctggccggtccgtcccagttccgatccaaacttgaattcacatactctctctctctcctaataaattagtacgtatataccaatctgttcacgtcatcatcacgtacgaagatagtcttctgctgcgtgcgcacgcatattatgcacgtgtgtaacacgacaagcgatggaggaatcatcactcgtgtgcatgcatgcatgtgacgcatcgttcgctctgcccacgtaacaaccacatgtaaagtcgtcggatgcaggcatgtctagcttacatgatgataactac

SEQ ID NO: 2800 - DNA, 1900 bp, Zea mays
  misc_feature (1)..(100): optimal_loci_345130_G1, chr10:121749070..121750969, Cluster 16
ttacgaagtcttgtgagttgtctggtacttgcagtaatcaagtgtttggttttgaaaagaatgttgtacgtgcaacaaacttgcagtagtactagtagtgaaccccgtattccttttcacataacaggtagttaatcaaatgaagaaagagaatacgagagagaatttatctattgttcaaatgaagcatactatatgactatatatatcttgcagatttgttaaaacatgaagaggggagttaagatatcgcctttatttttcaaaatacccataaaaaagaaggctttcttcttctatatatatatctccttccgggactactacagttaataagcaatctggagtctggactcgtatagttttatgatgtccacatatgtcctacttaacttaatttgacagtaagtaagctatattatagtagcgttttttgtttgtttgtttaacaatggacctccaccccctgtcaacgaattctgggtacgcgccggcctgctagctgaggcgtgcggccacgggagagagagagaggaagcgccatgcatcatgcatgcatgcatgcgctgctgcaccgagaaaaaacactccgagtccgagatgacgacgacgacgcgcgcggcgcgccctagtaagtagtaactgcgaggcccgggcggcgcttctgagagtgagagccaagctacccacccagccagctgccagccataaatatgcaacgagccacgccccgccgcgccattgctttccctcgcgcacaggcgtgcgtgcgatcgagctagcacggccttcatacgcccacatctactgctatctatcttccgtcgcgccctcgtcattgtcgcgcgcgtgtcggcatcgtcttggtgcatgcccagccgatttcctgcccgggccggccggccggcccgagggttgttcatccatgtgaatccaaccggggatcctgtgatctatcgatcgcccgcccggcgcatgcatccatccagttatttatggccacctggaccaagctctgatgcgcctgcgcatgcctgtgtcctattaaggctattatatacccgcatgcaagcacaagcgtcccctcccaagtcccaactcccaactcccaactctgatcgctgggtagctttgctagcagctgtgtttggtctctctctttcattctcctcggcatattgtgtttcttgccgttctactagctcgtcgaaccaccacagagcacctactaccaggaaagcgaggaataatgagaatgcgcgagtcctctgctagttgcgggatatggcgggctccaactccgtcagccccagcagcagcagcagcggtcgtgttggtgttcctgctgctcatcgtcagttcgtcgtcgtcgcacgtcgttgccgacgacggcgccagaacgacgacaccacgtgagttgatgcatgattatatctgagctgtaggctgtagctacttaatttatttttttgattcctctgtcggttcaccttccatgcatgttccagaacttggaaaagcttgcacaaacttcacttgcagcagtgtcgatcggtccgacgtactgtagcgtgtagagtacatgcgcagcgcagtaagtactgacgtgtcaggtcgacgtggcgcgcctcccgttaccatcagagatggcatgacacagcacatgtgccatccgaacgacgacacacgctgacgacgttcttttcttgttgttgttcctatgtatgtatattgcatacagctgcctgtgtaactgaaaacaaccacacgcaggtgaccacgccgccctgctccacgcggaggcatcggctgctgctggtgctcacgcgagcagcggcagcagcagggcaacctactacagaccagcgggccggagtgaggacgggtcgccgtcggtggt

SEQ ID NO: 2801 - DNA, 2127 bp, Zea mays
  misc_feature (1)..(100): optimal_loci_3455_G1, chr1:17886383..17888509, Cluster 16
ggccccggcacccacccactctagaaaacctgcagtgctgcgaatatgcgtgcgcctatggcgaaattttggcctttgttctttcggccttgggcgatgggcagcttattcccgccgactttatacctcacctcgatcgcaaaaaaggaaagaggcgccgtctacttactgggtaccacgaagagtagtgcagtggttgattaattaagaacggtagattctactgaaattaccagtggtaaaataaaagtacgttctaccgaaattaccactctgcaaattaaccaccgcgctcgttctctcttactctattattttagctcgacggagacgcgtcaagctagggcgaggctgaggagattccctacatagactagtgaggaatcactcttcctccctcctgttggtggttcacacgtcgcgtacggtggagacaagacatccaggcccagccgccgctacctgacgtcggttggaattcggtgtcaaggtcggagttggagttggagttgggaacatcgatcagctgcgtgttagttgttgctgctggcttgcattttcggccctcggcaacaaggattcggaggattcggagcgggagcagtacgagctgttgctgcgagctgttgtcggcaacaaggattcggagcggcagcgatggaatcgatcgagtccggaaaggctggcccaagcacgagttgagttgtgcacagtatggctggcacagctatcaggccgctacagtagcagggggttgtagtgcagtgtaggtgccgtgtcgccgtggcgggacgctggagatcgatggagatggacggacggcagacgatccatcctaaaaagtgtaggagtagcaaagattccaagtctaccgtgaccaccacttgcacttgcacgttctcgttcactaccccattcgtgaattcgtcgtatgcatgcatatggctggctccgtcccatttatctccagcgagaggtaccctccctgatttggctttgggggtgtgccattgcccattgccatatgctgctccccgtcggccggtttaattaccttctccattgctatcatatcgctacacagtcacacacactctcgtgctatatactctatatatgcaccaacttctgtttgtgtatacatgcatgcagtgacgactgacgaataatctagctacaaacgttgcaagaagaggctacaataatagagaaggattccatagtcaccaactcgatcaataaaactgactagagtagtagcgaggacacggcgatcgcggcggttcatacactacgcgatgtcgacagcaatggtggggtggtgcatgcctttggaattaataactaccacagaagaagaaggatccatccaaaaggcgcaaccccgaacaccttcactacaaaagcgtccatgcatgcatggtaacaacacagagcatccattcctccaaacccagctcagcctaacaaattaaaccgcgtgcagtttgtgctcaggttcccaacaaaagcatcccgacagcatgcatggtacgccgctagcttcatcttcacacggtgtggccaccacatgggcacctccgtccatccgctctcactgatgaaagtgaagcgtcgtctccccttgaggcgcctttctgtgccatgctagctgctccatgcatctctgtggcgagataacatcccatccttttgcaatctgcatgcccaatacatcggcatggaacagaacatgcagatgattccagtagatgcattcactattaattttctcttcaaatcacacacattattgtctcttgtctttccgtattccaaaactggatgaaaagagtttggtcgatcttgcacaaacttggtttatacgacactcgaagaacaagtggttaaattaaagccctgtttgtaagctcagggtctgtttggttatttattttttcaatacaatactatagtatttgagaatactgtagtgttctagaacaagatgtggttattaattagttgaactttgtaaaacactgttctgaataccttagtatagccaaaactgtgttattactatttattattttgttgtcacgtacaaaagtgtgatgtgtgaagtgtagaccattgtattctaaa

SEQ ID NO: 2802 - DNA, 1690 bp, Zea mays
  misc_feature (1)..(100): optimal_loci_345796_G1, chr10:125947702..125949391, Cluster 16
cgccgtgaggacctctactcctactgctatgggggcaaggatcagcatcggcgcgcgaggaggtgctcgtgcaggatggactggcaaacaacccaaggcccaggtgcaggcgacccaacgccacagcattcgggcctgagtggatccatcgtgtgagcaactagcgagtcgcctgcgtgcggctatttaggcgaaaacgctggcccaacgatcggagtactaagaaaaatgggccggtgtggagcagagtagcttcgggggccggagttcactgaacggttacggagcctgaaacgtccgcgagccgaacgttctgccagctccgcaaagccacgcaccggtgctgtactgtgcactgaacgtgtgtacgaaggaacagaacgactaggagcaaagcaacagcggctggcgggaaggacaggcgggcatctcttggggtgtggggggactcgggagtgtgtgagagtgccgtcagtgcatcgacgggcgcggcgcaccaggcctcgtgtcgagggctctgcccgccatcgtccggctccgtggtctggacgaccccggccccgatctcgatgaagccgcgcccgtgcgccacctcggtctcctccacggcacgtaccacgcgcggcgcgaccgaccgcacacgtcggtccctggctcccttcctccgcgaggctgccaccgtgccacggcatccaccaccacgtctcgctctcgtctgtgccagcctcggcaaggccgccaccgccaacgtccggttcccgggttcggtgcatttcggctgtggctcatctcgccgggaccgagaccgggaccaggagcacgaccgcgtctcggttgcgtttctttaaccgcttgctgtacggccgctcgtggaggccttcgggcctcgggtgccgcgcgtgccgggggcgacgcaagtcttcggtttttcacttgcccgggcgtcgtcctccgagtccgaccgagttgtttgaggcttggagttcgagcacacaaatcacagtctggtacgggtcgacatccatatctaccagcgggatgctgatggctggacggcgaaggggaacgaacggatccggccgaccacggctcacccggagacgtacacgctttacagatggacgttcaacgccgtacgagtacgacgacgacacgtctaaaactggaacggctccggaaaggcaacgtttccgttacgaagccgcggccgcgccatgccatgccattgccacgcgcccacgccggcgcgaggtggggcagaggcgcagagcgcggcgaaaccggtgggggcagtcaaaagcctaatcgccgttctgcccggagcctccgcggcgccccaggcgatccatgtgatgtgatcgctgctgttgagcaccaaaagtggcagctgcccgcttgctttccgctctctgcaagggcgcggataggagcaacctttttgtctggtgactggtggtacgggcgtacggctgggctgccgcgcccgccgatgtgaacaggaggaggagcgccggtaacaacgacgacgcggtatgtgtattttttgtgcggcgatttcgcggcgcgttcagcttcagcaaatcctgctaaaaacggagatgatcaccattcgccctggctgaacctctgaatatgggagaagtatatgttgccccttcctacaaataaattgggttaaatgtaggatagt

SEQ ID NO: 2803 - DNA, 1580 bp, Zea mays
  misc_feature (1)..(100): optimal_loci_348274_G1, chr10:139322829..139324408, Cluster 16
aaaagttggtgtcgatccctgctttcgcaacgtacagtgtactaacaaaataaagaaagaaagaaggacgaaaggctagatcattaagcgtgtgtttctgcaaatcagagcgttttactcgcgccgttattacaaagtaacatgcatggctatacatgttgaacacacgaagcgtaagctgagcgacaataaggtgcacaaacgcatcggcgcagcatgtgcggtgcgcaatccttcctcgtcttctagaacgaaggctgcccgcgtggcatatatatggcataagcgattctgtttcacagtgatgaggccgtctggccgtgcccgtgcttgcatcatcgacgatgtgacagcaggagcgttcagctcggccttttgtttacaaaaaaaaaaaaaaggtaagcataacatgtcccttgttgccgcggccgaatcattgtgctagcctcacgcatatcattggacatgttggccttttaacaacgctgggggttaccagcacagcacctagcagtagcagcaagatccgcgatctgtcacagagctttttatatggcttatccccccatcccatggcaattggcatcacagccccgcgctccatgacctccttgctcgccggccaaccatcatcgctgctcactacgggggtacggggtgggtgcatccatgcatgcatgctttgttaatataaacgctttccgtttttctgcactgcacgtctgcagtctgcacacacacgcacacacacaaacaccgtggcattggcgtcgaaagcggcgaccgcgtcctccttcctagattcagtgcactggcatggcgccaccgtgcatgccggctgcccttgcccgtcgccgttgtttaatcggcgcgatcttttgcgtggatcccgtcgcggatcctgccgagccgtgcttggaacttggaagacagcgcgagatgatcgggccaaggcgcacgggtttggtccggtggggggagccgggagcgggcaggcgcatcgtcgtcgtgtccatgatacgttggacctaccatttcggagccggcgtacgtggtggtgccccggccgccggcggtcccgtcaccgccgagggccacggtacggtcggatctggccgcccagtttctttctagtcccagctgagctgcgtttaatttgctgcccatgggcggggcctccatgggacgcggcacgatggccggatgggggggcacgggctgacattgggacagctcatttggggtgcggccgtgcgtgcggaagtctgagacgtcgtcagacgtgggcgcagggcgcgtgagttgtgtgacgcgtgtacgacgacgcgacggtggttgatggaatgaaacgctcatgggccccgacgccctggcatcatcacacatccgttaggtctctgctctgctccggagtatgcttttgtcgggggaatcggagattacactttaaacatttgccatgccagattagtttctctatgatggaggcaattggctctttttaagcaacgcctacctaacatacttactatagttaacattttaccaatgattcgtttaaaaaagatcattgttttaaa

SEQ ID NO: 2804 - DNA, 2074 bp, Zea mays
  misc_feature (1)..(100): optimal_loci_348351_G1, chr10:139741755..139743828, Cluster 16
ctccagcgaacaaagccagatcggcggggcaaagcatttccgaaacggtccacgacgacgacagtgaagaccatatcagcaacagggaaagtccggcctatgtgacgccttctctgactgactcggttggttggttttggtttgttcttcttccctttgggctcgggcgctctcgcctttccgtctgcctgcccacgggaccacgcctgttggattggatccaaggcgaacgtctcgctgcgtcgccacgcgtcctctcgtcctctgtcgcctgccgagagagactgtagcgactctgacgacgtgacgggagctgtgccagcctttgccccggaaacagcacaagcctaccttgcctgggcaggcaggcctatcggttccttgtagcctgtcgtatcgtggagagagggagggcgtggctggcgtgagcgcgcgaaaggctagaagaagaaggggcaggtaggggtgggcattaggttgtcggttccgtttttagattatggatggaatttggttgacggaaaatagaattaattaattccaaaaaaaatttagcaaccgaatatttcgattttcagttaatataaaaaatttaatatgtacattttaaccgaattaattgaattttccagctgaagttaatataataaaaaaaacatcgatggaggtgcaggaatggatggtcacgcagactggagactggacatgccaggcaggattcctgcttggctggctcgtgggggtcctgaatcaggatgctgccagtagacggctccgttgccgcgacggcgtcacatacgtgggagtgggatctgccattggctccggcagaccgctccgcttctccggaggacgcgacgattcggacgggctgcagcctgcctgcctgcttggcccaacaaatctccacatgtttttaagtactactagccatcatcatcgataataaagggaaaagggtggggcctggttaatcacgctcggctcgaactaggaccgtgcccgtgcggctcgctgctgcctgcgacgcaatgatcgtgagttggtgatggcgccacgattaaaggccgctttggcttacgatacgatggacagtttccgtcgtggaagacgggagccatcattcctgatgacacccatttgatgagcgatcctcactggcctgcctcggtgcgtcccaaaggcgtcgttgcgcctggcgcaagcgacaggcaaatcgaggccagctcgcgcgctaatgagtgtagtagccagagcaccacccactgccgagtattctgctccccggacctgaaaccatgcgtgagaggagcgcccacctcgtttggtcccacgggctttgcctgatccatcaccatgcgttgtagtagcaatatgttaccctttcagcaaagccgccgagctattagtacagctaatcttggaactgctttgctgcaggatcctactatgctcgcttcgagttggccagagacttgtatttggactctcccttccctgaaccctgaatcgtacatgttccccggcttgagaggcgccccagacaagtgccatcttttttttcaattttttttttgttgcgacaatcagctactctgcacaaagcggtaagaagacaggggacaggagctagccatggcatccaccgatccaccgaaatgcggtgcggtggctcatgcaaggctgacgacgaccctgacgacgcaaaatctgtcctagtatagcatctcggtctctcggttttgttttggtgtcatgcaaggctgacctccacctccctcatcgctttgtggcgacgtcaaaaggcaacaaggggacatgaacatggccgctgatccgactgtatactgtatccgtcccaaactcccaaccacccccaatacgtctcatacaccgccgccgcgcaccgccaaacttccgttcgtgtttcttacgagctaaaaggaccgtttcgacgtttcgtggccttgttcagcctggcccaagcgctcagtgcttcttttgtggaaagggcaagccctcttcggccaccttttctacgtgcccagtaagcccagtctaacttcagttcgac

SEQ ID NO: 2805 - DNA, 1671 bp, Zea mays
  misc_feature (1)..(100): optimal_loci_348413_G1, chr10:140044939..140046609, Cluster 16
gcgtctccgactgtcaccgtcgatggcgtgccttgcccctgagagagaacctttcccttcggcagttagcggttgttagattccgcaggttattacacagcaaaagaggccggctcgccgacgaacaaaaagtcgtcgtggagtgagacggcagacgcatgcatgcgttccatacttccattccgtcctgcgtttgttaaacattctctggtgtggcaaccgagatggtaacatcctctcgcagctagtagtggtttggttcgcacgtcggcgtcgagcgagcggcttagataaacgcggattgagagctgtgagacatgtcacatgtctcgccggtgcagtgcgttgcgtcaggcacgagcgtttttcagctgcgttgggcgtcagcgacgacgacggacggacggacggacggcgagcacgatccaccactcgcctttgcgctaacgacccagcagcagcgacggtcaaatcacggttactgtttgtgcctgcttgattttgctagctagcttctcgtacacgaatctcctccccgccgctcgcgttcataagcatttatccgttcatacacggtcttcgcgggtaaccaagcaacgtcagcattcagcagcatgcagtgtggaaaaaaaagaattcagggtaatcgtcgacagacgacaatgccggccgccttcgtgccatcattgcatgctgaaactgaaatacaaatccatgcatgtacggcactgagaagtacgtgtacgtggccatacgtagtacgcgcgtgcagaggtattattagttctcttgatctcggagacaacggggcggggaaatgtatttcgggatgaaattatatgtatacatatatattttttttagaaaagggaaacattatttatatattccagcggtagatgcatgcatgtggctgttcaaacttacaaaacagctggttcgcctcgatctgaaacgaaaaatctcacatacagaaaaaaaaaggtttataaatttaagcattcaatacagagggaggtctttaaaaatttatatattatttacatacagataaaggtttatatagaggccttaatcataacatggttcacttttcgacggatcattcacacgagacgagacatccggaaaaaaaaacacctttcagttgaactccccgtttcctctctggaaagtaaaaataaatactgtaacactgaaaagcaagtgcataggcaacgagacgacgtgtctagcttggagctacaagcaacctaaaaaaaaggtcaagcgagttcgttttaccttccgcataaaaaaatggttccgtcgtcatagcctctgaaacggccgcgcgagctgagatcaggcaggtttttgggagagtctcgaatcagaagaatgactcaaatgataagttgatgatccgctcatacccttttggacagtcaatggcttcaaacctcgggcaacccttttactgacggacctaactactacttacaggcaagagtggtgagtggtggtgacatggctgctaatgtgtgagggatcatcactcatcagggccgggacgccagaagtcatggatgggtgaggtcatggggtttgtttggtctgcaggagttgtaatcgatgccgttacatgctcgccggtgattgtactctgtagactgtactcctgcagtctgc

SEQ ID NO: 2806 - DNA, 1428 bp, Zea mays
  misc_feature (1)..(100): optimal_loci_41089_G1, chr1:243653252..243654679, Cluster 16
actgacacgtacttgagctagtatcggttctaaatcaaccggtgaaaaaaacctctttctacagtagtgaacctagcttgactgattctaccaaattctaattgcacttgctcaatgtcacttgttgcatcaactgcagatatatatacaagctcatgtttaattccttcatttacatgcgattatcatatattgttattagctgttattagaatttagcgtttgctgtatatagcattaatcgctgtctatgatctactaacttgacattaatccgctatttacagcgtgtctataagagaagatgaaagtcttatcggaaggaggtatagtacgtacacgagattttgcatgtcgtgggtttattaattagctgacactgacctgaacatatagatgcgtgctagataacacagacagtacaacgtacgcagcgctggctgctagctagtgtacctgacgtgcagggtactcgacctgggtacgtacagcacgcagcggactgactagcgtcgtagcacgtacgcacagaaaaccagctagctaggacgtggttgctgtgcgcgcttggcccttgctagcttcaaggctcacgtaacgaggagtacgtgctgggtgagtgtgcgtgtgcgtgcgtgcaaattactacctatatacgccggcccgtgcggccgtcgccgtcgccgtcgtctatccatttgtgcacgtaccacgcgtacttgtactctcttggggcgccacttgcaaccatgcattgcgctgtagtaccccaccggggccggacagccacgacgtgacgtggccggggacagccctggccatgcccatacctctgcaatacaaccctcgctctcgttgcagctttagccgtcctatggctacgtacgggcgcgctatgagaacttgggaaggtgtaccttgctattgctagtgtgctacgcaacgacgcaagcctgtgcagcctgtcgtcgtatgggtactctactgccagaacctttggtcgattctcgtagtgcccggcgggtaggggcagcgcattgctatactatactgggtgcgccatgccatgagctgcggccatggaagcgggccccggcaggcggtttcttttgagctgtatgtacgggtcgccacgtacgtgtagcggcgcgcaggctatagtttaccgacgaacaggattgatgcagtgtgtagcaccgccgccttagcttgtagtgcatggccgagatgatgagcacacccgctacccagacagtagtctctctctacctagctaccgatcgagacgagtatttcagtagttgcccaatgctcacacagaacgaaacatctatttcaagggcaaaaagaaaagaagcttccattcatccttgtatgtacaaaattgctgtctttacctcctcctcctcctcctcctcctcctcatca

SEQ ID NO: 2807 - DNA, 3421 bp, Zea mays
  misc_feature (1)..(100): optimal_loci_4447_G1, chr1:23114556..23117976, Cluster 16
ccgatcgagctggcagaggcgatcgaggctaaggtggtgtgtggtactggtagctagcgaaagcaatggcgaccgacctggcgaagggggggagtacccgtgtctgtgtgtgtgtgtgtggtggctccggccaccggggggacgtactgctccagcacaagatctctctggccaattctttaaagcgtcgggggagcggcatgtgcgcggcgagtacttgtgtccgcgcgaggccccatggctccggtgcacggttgcggtaagatacaaagcggcgacaggcgccgtgctgcgtaactgcgacccgctgcctgcctgcctgccagccagcgcgccctgcgctccaccgcgccgcgcggcatgctcgcccgcctgcccggccctcccgcgctccattggccgtcgccagcggccaaagtgctcggccctcggcccggcagcggcagctcgatccgtgcgccgccacctgccgcgacgcccggcgccgaggccgatccgtcccagtctctccagcgagccccgtcagctgccagagctccgtcctgttttctttggcgaaaccagcactcacattcaaagaccgatgatcgatatttttacaccgaataccgatgtaccacccctcgcggcctcacctcacctcacgccccccacatctcacgggtagcgcccgacttcaaaattgcatgttgcgtttgcagccttgcaggaagtggtaagcatctttcgttatgcccgctactacagctgagaacatactcctgcagccgctccgctgctgtacctgtactatgcccatacccatctatctgacatcttgttggtgaggggaatatatacatactatggtgatgtgtgcatatttatatatggtgacctgatgatccctttttttttgttgtggttgttgtgttcctcgcacgcacacgcactgcccttttatcctcctctctttctggattgccccccaaaaggacggtcgggtgcatgcatgcacgcaggagttcgtaaaagtaaattcggagcgcaggagtcaacgggaaacaagagcagagctgtagggcgcactgcatagtctgcatgcactagtgccgttcgcgtgatgtgctcgcacctcgcaggcatggtcactctcagaaccagggtgggctaacgctaatgagcgcgatcgacgagactagacgggagtacaagacgggacgacggagcggtgggcggtttccgcaagaacgcaacagctatccaacggccccgtggcgtcagaatggacggggggcgcgggattgttcgcatcgcgcgcatgctacgtgcaccagctaggcgccccggctgtactgccggccggcctcgccgcgctggcgatgacggtgcgcgcgcgcctgcagtcatcgtcgatcgatccatccatccctctccgccgtaccgcgtcgcgcaccgggatctgtgcgccgtctgctcggatgcgattcccccctgcttggtgcttgctacactagacgtctagaccgctagtactgactgcacgtctgcgtccggattttgctgatagggctgcgtggctactcaagcctacttggatgaaacaatgaagcgtggcgtacggcagtagctgaaactaacgctgacgaggcgcgtacagtacaggcacgtactactgtatatgaggcggcagtcactgtgctttttggtaatcctgctacctcttccggagcagtaatcactagtagtcactaacccctcccacgcccacggtgacttgactggtcgttgctgacctgtcatctcggaggattgagtccccgaatgggggcggggcacggtaaataaggccgggctgcgcggctgccgctgcccccgtctttatcgcagatggcgccggaggcagccagcggcgctgtccgtgaatctgaggacacggttgttactcggcttcatttactccgccagcgcgctggccgcgtgtgtgcgtgcccgcgctcaagcggcaggaggaggcgccggacggacggacggagggcagccagccagaccctgagcgcatgtgccactagtgccgccgctgctgcagaggctgctgtctgtgtgtgttgcctgcacgcgtcgtaccactagcgagcaggagtatttatacgaccagctcacacatactgctgctgggcctgggcgttgaatcgccctgttgatatgatgcgatacgatccagcgcggcgtagtgtgtgtgtgtgtgcagtgtattcaagtgaaggtcgtgcctggccatacacccacccaggccagccgccgcggctatagctagctagctctcgctgccgccgccgatctcggcagcacggcatcagcctatgatatgatgatgggggcggggcgtgtatgccgtatccggcagcgatcgttaaatgcgcggacggatggagccgttcttgcacagcgcgacaagattcccgccaacgcttcgagttcacggcgcgtacgttggcacttggcacacgcgtcccttggatccgtcctgcaggtccagtggtagtaatataggcaggctgcatccatagtaggccgccgagcactaaaatatgacagacagagtcaatccctgtcccctacaagcggaaaaaccagcccggttgcgcaacgcgtgcatgtacgacaggattggatcagcatcatcatcagctgctgcggatggatgcagagtgacagtgtgtcactcgggccgtcagatatatagcagggaggcgctaactttgcatacgcttgtgtaaactctgtctgaagctgacgataatgtcactgggaatctgggatggtaagcgaagaagcaaggtccagttggagcgctcgctcagtcccgcccaattttctcgaggaccaaaacgcccgaccaactgaatctgaaagtttcggagacagttttgcaaagccttctggggaagggacattatagtttgatccagccagcgatacctttcgtgatagcgatacgtcgtttcccctgcggtgcgtgcggcctatccaaaccgcggacagaatcatctcaggcgcactgaagaggcacagacgcatcccaatcgcggagatgagcaatctgtctgctcggcacagagcgagcatggaagacgcatgaccggtgccctcgctctcctccaggcggcggccaggccaggccagcccatcatgccgagtggcatggcaaggcgtcgccttcttcttcttcttttttttatctgcgggcctggggcgtggtggtgtgtatggacatggaatcaaaagcgtccctgcttgcttgcgaacccatcatccggttctgatgtccacatgggcgtatccatctatccaaggaaaatcgtcctgtctgtctgtcatcactacacccggcactgtgaacgcagtgctcacctagtccccctacaatacctgaattggc

SEQ ID NO: 2808 - DNA, 1539 bp, Zea mays
  misc_feature (1)..(100): optimal_loci_44933_G1, chr1:263608055..263609593, Cluster 16
ttgtacaaccatcattgtcggcataaggcaaaacctgataatggtaaactatatttatcgcactgtctgctcaagccacaattaaagccgcagtgaaatgtcactatcgactgaaacaagcagcagacagtgatagtttcagtgtcactgcagtcgatcggttcatggcttaaactattattagtgatatttcactgccgatttatggactgagccggcgcgcgacgatgacatgaaccttcactgctggtttgtaagaactgctaatcatttttttagatttttaatctaagaatcggcgcggcgaagtttattcatggcggttccaaacacagctgacgaggcaacagtataacagtagcgtagcagttactcgcatgagaactaggacaaggctacccgaggcaggcatctggttttaccataaacggggccagcaaagcggcacgagcgagaagagaatccaggccggccggggaagaccccgcagcgcagcaccccttggattttccgcggtgactgaggatgaggaggagggggcgtctaccgccgtgccccacccccatctcaaccgcgctggtgcacagattaaccgtgccacggcggcgacggtacgttcgtgccgcctgccggcgtgtctttctggacacttgcctgccgcccggcccaccgcgggcgcggggaccggcagaagcgctgcccccgccggctggcctcggtccgctgcggcctcgccccggccctccgcgctgcagtggccccgcacgtacgcccgccccggctccgctcgactggctggcagccgagtcaaaaagcctcggtctggccggcgtagtggacggaccaattattggggccggccgtgctacacaggcacaggcgcacaggcgctacgacgacgaggtactaactacaccgggtacgtgtgctcataccgagccacccacccacactggcccggccgccagccttgccgcgagttgccgcctgccttgctgctgctgctgctgcctccgtcgctagccgctagtactacaaggaagtcctttgttggcttggctggctcggtgcctttcttctctcctggcgagtacggccggcggggcagtggcttggcttgcctttggcccccagctctgctgctagctcctgcgcctgcgcgacacagcagaggcaccgagggagggagcgggtggactgcagaagcgagaggggacggcgtgcatgcattgcatgcgctggtgcgcgcacaccgcctgccgtgtgcactgcatcagcgcggcggggacagggccgcgcttgtcttcttgcgctggcgtccgattatttgtgcgggacggatcaggggggggacagggtttgctactgctttgtcatctgtcatgtcctactactacatactcactcgccatgcatgtatatctgctgctacaattactgagtccttcaagaggggatagttcggttaaaatctctaataatccgggaggatccaagttgtaggagactagaagaggttttgacttgtatagagggtaa

SEQ ID NO: 2809 - DNA, 2454 bp, Zea mays
  misc_feature (1)..(100): optimal_loci_47509_G1, chr1:278503565..278506018, Cluster 16
taacaacagagttgtagttagtagagtagagcagttccaaacacagtctaatactcacagagtttgtagctcacccgaagcgcaatgcaacatgacaaagagcatgacctagacggtggcgctccgtctgccacccatactaggagccacgtgcgccagtgcgcattggttcaacatatttgttctaactagtagtcttcatgactattgtaagcatttgtctttttttaaaaaaactttgaagggtcttttctatcggtcagtaacgtaaacacagactaaatagcctacattaattttggttggtactatgaactcggactaagtagtctagattttcagtctaccaaacgatattagagatcctctgatgagttaattagtttttaaaaatatcttacctaacgatatgtattaggataaaaaaactataggcaacataatatattaaatatatgagatcttgagttcaagtccatgaaccatactggcaggaaagtttttaacttttttttagccttgccgaaattaaacccgttatcagaccggcactaaagcttgtttcccgcgtacaggagatctgatgtccaccgggaaggccggaacaagaacaagtgggcagcatctgggcgggccagcgccaagcaaggctccagacgagagagttggttgctttcactgacagaggggcgacactgcgacagtgccgctgccagcaaccggacgccagtagagagacggacgtgtcctgcgaggctgcgacacgagcgcacacggagatacgagacactgcccgtgggccccgcgcgcagggaccatgggctggagcttcctgtcctgcggttgccatccctggccatcaatgcgagcgtgagctcctcgtcctcgtcctcctcgcgccaggcggacaggccgttctgggtagctggtcgctgctgcagtgtgtttgtagtttacgcgcagcgcaggcatgggctgggcgcagggccagggcgagacgaagcataacgtagtgcaggagcctactacaggccaagacatggacgcccggtctcttgcacagtaaagcacgaggctgcacgctgcactagtttggactttggagactcctgccgtcctgcgtgcggcagtgcacatctgaggatggtttttctttctcgttttccagcaccttatttatttttatctcctactttaaatctgctggccagttgtctgtgaattgctatatattatacgaatagattttattttaataagacaaaaaatatatatgtacattctattgtataggtggtgtaaatgttaagctaacaactaaggttcaaactcttatttgtgcatatattttttttgtaataggcagaaaaggtgccgcgtgatgatgtgctctatatataatagagactatgtgaatagtgctctctacacataaatgtttcaaatagtatgttgcgcgatctagatctactattcatagccttacaagtaacaatgtagccgctgctgtctctcctccctttattatttaccattaccattcctagttacttagcatcgtttttttgctataaaaatatactgcatgcacaaaaataaacactgacgtgtgtgcacacatacacagtgacacactcacccatacgaacaaaagcacaaatatatctatcatatgttcacttttgaagcattaaaagagttaccatatacatcttgttatccacggacatgtatgacatatcgtctaatacttaaaaaaatagcaccactaatttaaacgcaaacatagaacatacggacctttttatatcaaaccgattgcttgaatccgagtagtcataataatgactgctaccgacagttactactcccagcagaaaatcagtaatttaagttcaaaaggctcacacaaatccccctcccgtgccgccgtgtggccccccactttccagtcagcgtggttaagctaagcccagatgatgatgtagtagtagtagtacgtgcggccgcctttattcgttcccgcaatttgctcctgggcgagcctatgaatgcgagtgacgtcccttgggctcgaagcatacgtaccgctgtccgctgggacccctgccattagtgcgacggaacgcaaccgaaaggatctctagtagtagtaggagtattttgtactagagtattccgaagttccaaccgagccgatcgcttggggattgggattgggagtggactgactgcagggccagccgccatcccacgaccgtcggatactcggacagggcacgcaaacagacgggacggcggagccgcggagggagggtttgggtttggaacttggatcctccacttccactcccctcccctgtcctggtcgcgaatcccgcgcccggatggacgacccagatcacactggaatattctgccagttgattagcgtgtggtggccgtgcagcagca

SEQ ID NO: 2810 - DNA, 3787 bp, Zea mays
  misc_feature (1)..(100): optimal_loci_47812_G1, chr1:279772070..279775856, Cluster 16
ttagcttcgtttttgtttttgacagcggtggaagtgaaatcgactcccgctattttacccggctctgccgtctatacgtggcgaggtgtcggggcggcgattggcatcttggaactcccaagttgcactggcccactgctggcagcgtacctcgcgcgatctgccggcccatctatatacggctcgtccgatccagaggtcatctgcgcgcgcgcgctgatcgtcttttttaggacgacaatgcatggtgatcgtcatttacaagcaaatgtatgtactccaactttgataaagtcaggatacccaagtcgtcggaaaagtacactccactagctagctactacatatatgtaacagattttccatacgatacgcacggtaggtctagttgaaaggtgtcgacgtccgatcggttccgcggcaaatgcgccgtatatcatcgtgacccgaaattaagctcaaccttaattagcggcccgaccaagccgcgtgccgcacgttcccatcttcacaccgagagatcgatggagcgaaagcgagcgtccgtccagccgcccgcggcccgccgggagggaattgaattgaacgcacacgacgtagtgcacggcacgccccaccggccggggcgacgacgtcgtccgaccacatacgaccgaccccagcgcggcggccgctagctttgacggcgacgcggcccgcgccgaccgcgcacagcccatgcccggcagcaaccaccggccggtcggcgctcgtaccactgtcgcggtgtcgtcgctcgctggccgatcgcattgcactccgttaattgttggacgacgcgcgcgcgcatacagcatgcatgttgttccgccgtactgtgcatcacgacgcgcgactgcgccacccgcggacacgcacgcacgcatattggcaggcgcggcggtatacaagttccgggaccataacagatcgatggagcccggccgtacgtggtgccggttggccggccggcgggccgggacggcgtacggtacgcgcgcgcgagaggtgcgccggccggtatggaggccacgcgcgccaaaattaagggccgtttgcgtttggtcgccgtccggccgtgtgtacctgtcctccgtagcgagcgaactccgtcaacgcggagcacgcgcgccacttcgcattgtcctccatatgcatcttgcatgacagtagctaggacgtggatatatgcatgcatatgcatgggcttccttgttccttcctctattctaaacgtgcccccaataacacaattatgttactgcccgctgcttcgacctttcgagtccattgtccatctgatctttcttcttcgtgctagatggcggaccggaggtgtgagtttactaggggttaggtgtagtagcaatttggcagcttgccacgccatgcagcctagtatatctagcttattatctctagctaggctatacgtctacatatctagctatggctagcttgcgattactttgactaaacacccaaatggaatcgttcgtttcgacgcacgctgctagcctcttcgattcccatgcagcagacgcaacgtgataaaattcgatctcatctcatctcgtcgtcgtcgtcagcactgcatatagtgtcattattcgacgagagagaaaccaaaccgagagaggtggcaccggcacgcatacccaatcccaccaagaacacagaaaatactcgcgacgggttcgtgtcccccacgatcaccgcccatctgccgactggcgccgcgccccctgatactgtattgctcctgtccaaggatcgaccggcacgcccgtgacagccctgtccgagacgccgggacaaatcggatcggatcacttgccaggcctggtacagtgcgatggttcatgcatttgccctagttccccgtagcctagggttcaggaatcaaaggagcacacaatacagtgagctagtactatactaggagcatgccgcagtagtactccctgctggcgtcgtctgaccgtccccagcactcagtcccagcttaatttgctaaaagaaacgtgcaaccgaaaactgaccgacatgtgttactggcgtgtatctgttccgaccgaccgagccccacaagacgtgggtgtcatctactgtcattaactcccgatgccatcctcgtcggagttaatgtgtaaaggcattagcggcaaaccggcagatcgatcgatgatggacgataatcacggttctgaaattagtgtctcctcgctattttgaccttggatcactacagtttctatatataatatacagtttctttgtacaacagaaacaaatatgaattgtagtggttaaagacgactgcatattagtgcaaatcgacataatacatggggtagaaggcgcatattcattttgttattgtggaagcagacatgatcaatgatgaagagtggacaatattggcgatgagattatgttattgaacgaatcgaggagattgatttagatggtttagcataaagccaacactatggatgcatgatgaccatgttcaaagtacatgggggaaccatgcaaatagattgacaaataccatgcatgttgacgacacaatgacatagttgaggacaccgttggcagtgatgaaaatgcaacagtacgcggagaaggctatgagtgacaatgttgctgtgtgtaaagttatgtagtagaaattattagcgcctcacaagtatcctcatttttacttaaggtattaagtaagcaacatggtgatgcgatattcaagctaaggactagaggagggagaatgaaatggatttttatacgagaaactatgttgacatgggaaccaaaatagaagtgtgatcctaccacctttgtctacaaaggaatgcaatttctagatgcattctcggttgaaatgtccaaagtttaagcaaatatataggtaaaaatattaatatttatggtgcttacattataaaaacatatctcataacaaaactaacaatacttatttgatactataatatgtatatagtcagttagttaaacttgagatacgtaacttggtatttatagaaactatcaactataatacaaacattatacttgctcttagcttctaactcaccatattttggcaagtataagtaccccaaaataacataattcaatcatgcgggcagctaccccaaaataacataattcaagcatgatagtttctataaaatggagcaagtataatgataagcaagtataagtataatttgatactatactatgtatatagtcagttagttagttaaacttgagatacgtaagcttgcacattggcagtaccaccccaaaataacataattcaagcatgcctcgagccacttaaaagggtaatcttttgcgcgcttctccatgccaactgtggagtcaaacctaaacttgcccggaacacatctctccactggaccagacgatccactggcagtccattaacgcggatttggtctgggctaaacccctctgccgcgagattagctgtacattaatcctagattaacgcaagcctgcttccctgcctgcctatactgtcacccggtgcttacatgtgacttggtatttgcgcccttccttgggggtcatatggcccatgtgatgttttgaagcttgagagcagctactagctagtagggccctgcacatttccggcacgacagcagtggccgtacgtccctctcgtgtctggtaactccataacggtttttctggtgagcctgctgacaaaacaaacgagcaggaccaaacgatt

SEQ ID NO: 2811 - DNA, 1967 bp, Zea mays
  misc_feature (1)..(100): optimal_loci_49369_G1, chr1:286403537..286405503, Cluster 16
  modified_base (870)..(870): a, c, g, or t
  misc_feature (870)..(969): n is a, c, g, or t
  modified_base (871)..(871): a, c, g, or t
  modified_base (872)..(872): a, c, g, or t
  modified_base (873)..(873): a, c, g, or t
  modified_base (874)..(874): a, c, g, or t
  modified_base (875)..(875): a, c, g, or t
  modified_base (876)..(876): a, c, g, or t
  modified_base (877)..(877): a, c, g, or t
  modified_base (878)..(878): a, c, g, or t
  modified_base (879)..(879): a, c, g, or t
  modified_base (880)..(880): a, c, g, or t
  modified_base (881)..(881): a, c, g, or t
  modified_base (882)..(882): a, c, g, or t
  modified_base (883)..(883): a, c, g, or t
  modified_base (884)..(884): a, c, g, or t
  modified_base (885)..(885): a, c, g, or t
  modified_base (886)..(886): a, c, g, or t
  modified_base (887)..(887): a, c, g, or t
  modified_base (888)..(888): a, c, g, or t
  modified_base (889)..(889): a, c, g, or t
  modified_base (890)..(890): a, c, g, or t
  modified_base (891)..(891): a, c, g, or t
  modified_base (892)..(892): a, c, g, or t
  modified_base (893)..(893): a, c, g, or t
  modified_base (894)..(894): a, c, g, or t
  modified_base (895)..(895): a, c, g, or t
  modified_base (896)..(896): a, c, g, or t
  modified_base (897)..(897): a, c, g, or t
  modified_base (898)..(898): a, c, g, or t
  modified_base (899)..(899): a, c, g, or t
  modified_base (900)..(900): a, c, g, or t
  modified_base (901)..(901): a, c, g, or t
  modified_base (902)..(902): a, c, g, or t
  modified_base (903)..(903): a, c, g, or t
  modified_base (904)..(904): a, c, g, or t
  modified_base (905)..(905): a, c, g, or t
  modified_base (906)..(906): a, c, g, or t
  modified_base (907)..(907): a, c, g, or t
  modified_base (908)..(908): a, c, g, or t
  modified_base (909)..(909): a, c, g, or t
  modified_base (910)..(910): a, c, g, or t
  modified_base (911)..(911): a, c, g, or t
  modified_base (912)..(912): a, c, g, or t
  modified_base (913)..(913): a, c, g, or t
  modified_base (914)..(914): a, c, g, or t
  modified_base (915)..(915): a, c, g, or t
  modified_base (916)..(916): a, c, g, or t
  modified_base (917)..(917): a, c, g, or t
  modified_base (918)..(918): a, c, g, or t
  modified_base (919)..(919): a, c, g, or t
  modified_base (920)..(920): a, c, g, or t
  modified_base (921)..(921): a, c, g, or t
  modified_base (922)..(922): a, c, g, or t
  modified_base (923)..(923): a, c, g, or t
  modified_base (924)..(924): a, c, g, or t
  modified_base (925)..(925): a, c, g, or t
  modified_base (926)..(926): a, c, g, or t
  modified_base (927)..(927): a, c, g, or t
  modified_base (928)..(928): a, c, g, or t
  modified_base (929)..(929): a, c, g, or t
  modified_base (930)..(930): a, c, g, or t
  modified_base (931)..(931): a, c, g, or t
  modified_base (932)..(932): a, c, g, or t
  modified_base (933)..(933): a, c, g, or t
  modified_base (934)..(934): a, c, g, or t
  modified_base (935)..(935): a, c, g, or t
  modified_base (936)..(936): a, c, g, or t
  modified_base (937)..(937): a, c, g, or t
  modified_base (938)..(938): a, c, g, or t
  modified_base (939)..(939): a, c, g, or t
  modified_base (940)..(940): a, c, g, or t
  modified_base (941)..(941): a, c, g, or t
  modified_base (942)..(942): a, c, g, or t
  modified_base (943)..(943): a, c, g, or t
  modified_base (944)..(944): a, c, g, or t
  modified_base (945)..(945): a, c, g, or t
  modified_base (946)..(946): a, c, g, or t
  modified_base (947)..(947): a, c, g, or t
  modified_base (948)..(948): a, c, g, or t
  modified_base (949)..(949): a, c, g, or t
  modified_base (950)..(950): a, c, g, or t
  modified_base (951)..(951): a, c, g, or t
  modified_base (952)..(952): a, c, g, or t
  modified_base (953)..(953): a, c, g, or t
  modified_base (954)..(954): a, c, g, or t
  modified_base (955)..(955): a, c, g, or t
  modified_base (956)..(956): a, c, g, or t
  modified_base (957)..(957): a, c, g, or t
  modified_base (958)..(958): a, c, g, or t
  modified_base (959)..(959): a, c, g, or t
  modified_base (960)..(960): a, c, g, or t
  modified_base (961)..(961): a, c, g, or t
  modified_base (962)..(962): a, c, g, or t
  modified_base (963)..(963): a, c, g, or t
  modified_base (964)..(964): a, c, g, or t
  modified_base (965)..(965): a, c, g, or t
  modified_base (966)..(966): a, c, g, or t
  modified_base (967)..(967): a, c, g, or t
  modified_base (968)..(968): a, c, g, or t
  modified_base (969)..(969): a, c, g, or t
aaggcgggcgtgtggtaccttctcgtacagtacggtgaattgcgcaggcccattattgattatttttactacagagctcgctgtaacacagcagtctgccccgagtataactggggtggggtaggcagctttttgccggctcgctgcagcctgcaggtcgaaaagaaagcttccacgcatacataccactcatgtagtacgtgccagtgccgcgacaaagcccgacaccggacatgttttgacacatgggcgcgtctgacacacgcgcgcgcgcggaatattgatgcgtgagctgtacatgtcgttaagtaagccacacaccacacaggatctgctcagattttttttctcacacgaataaaataaaaagtagctggaattaagatggttaaaagagcctggtgcgtgttaaaactttttaacctactagctagtactctagctacctctgccagtgtggggtatatatacgtgcccatgtaaatacagcgagagcccaacaaataccacccgtaacgcagggcggcagtacaactcgtgtagtgctggaaggagcaagatggtgcagtgcagtgtttcaagtgagctagctgtctcgacttgactacagctagcttaactgacactctttgggtccggtcagaaggcaggcatgcatgcttagctggcgaacctatatccggcacgcttcctcaataggaaaaggtcgtcagagttagtgaccactgtgagcaacgagctagctactctcggttagctggctgcctccgtttttttattccatggcataagaggtaattatgttatatgaatcagtcatctaacaattagctattattagctgggattaacgcgcgagatagtaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactttctcgatcgagaggagaggaggcatacacgatgcgtttgtgtttgttatagctgcactgcatgctgggcgccgatcagcagccgggcacagccacagcggggtccagtatacggtcgagcgacgccgcagcaagagccaaacagcgagcgagggaggagcatgctgcgtgcatgcgagtgcgtgcccgtgtcccgtggtgcggcacggcaagggcatcggcatcgaatcacgtgagggtgacgaggatcctgagcgccggtgccgggtgggcgatcccagaatccccgcgcggcacgtgcccacccacccacccacccacccgtgcttacgcagttccgtcccacgtgacgcccgcgcccccaactagtagagcttagccagaacccacgagcgcataattagtttgtagttaactaatcccgcggccaacccggctctccgtccggcgccacctcggcaacggcatagccaaggtaaagtcattcgctggcagctggcgcccctaataatccttcacttccctgcaaaattaaaccagtgtagtagtactgcaggaaaactgacactggcacggcgccgcgcgcgcggcggggagaggggagccgcatacgctggctgtgaatgtgatgcatggcgctgttgctcgatcgaggctgcggcccgggccccgggatcaggcgcgggtgcctactctgcaatgtgtcggttggaaacttcgcaaggctgattaaccttgtgatctaaacattactagttcatttatggatcaaacgtgcaattttgtagggaaaatcccccaccccaaaatcggggatctggctggtcgggcgctcacagcctcacacgtacgtacgtaagcgcgccaaatataaacgacgaaaaacgtagacgactatgcatggcacgcgcgaaacgtaagtacgtacgtgcgtgccgtgcgcacagcatgttgatcggatgcacggggcatgcgcagcggcgtgcatgcatgcg

SEQ ID NO: 2812 - DNA, 1582 bp, Zea mays
  misc_feature (1)..(100): optimal_loci_49478_G1, chr1:286993021..286994602, Cluster 16
tgcgtggcgtgggtggatagatctgaaatgaccatggccagacgaaaaactcacgtacagaaatgaaataaattaaaggcgtccgtggagttggaccgtaccgatgctttggatgtgaagctccacatggatggatgcatggacggacgaccgggatgagtagacggccggccggcagaggccggtgcggtactagtggccagtgggctgcaccggccaccggcctgcgctctgctgcagcatgcgtttctgcaggctgctagctgcttttgatttgcagctgcaggggtactctctagccatttgcattgccttgtttaagacctcggacggcgactgcatgtggacgtacgcagctgtttttgatccacatcgctgtcgcgctcgcccttgtgcgtaccatgcatatatacgtacgtacgcggggttttataacgaggaggttggcagttttgcagctagcggagtgtacgtgcatggacgttactatattatttattagtagagggtagagcgaatcgtatacgtatgtgtatatactgtggcacgtacgtactacgctgctaggtgctgcatgccggcatggcgttgcaatccgtgccagtgccaccagagcacggggaggacgtccagaaactattaactgcagatgccccgcctgcccagtctcctgctcgtccctgccactgcactctcagctacagtatgtagtagtaggagtacgtgcgagcgagcagcccagagacggatcggcagcattcccgtggccgtggacggcatgcatggtgtgtccagtaatggagcccggtgacggcacgtgtattacgtacgcgtgcgtgtgtttacgtgctgcatggaactgtgcgtgcggtactagtgcagtcgtgcacgcgtacgcacggttatatacgtatgttcagcgcacgcgtgcatggcagcgcgatcaatgcatggtttgcttcatgtatgtatatatgtacgtacgtacacgtcaccgttcacgtgcccttgcccctgcccctgcccctgcccgatacgacggcggcgggcaggccagatgccctacgccgtgccgccgatcggatccgtgtccctgcctcatccctggcctcgagtcacgcgtcgtcccggagggcggaggcacgcacgcagggcatctgcatgctacggtacgggtgtgtatatatatatgcatggccgtacgttgtgccgcgcgcggtgaaggcgtccgcgtgcgcggcaccatgcacgcgctgcgctactacagtgtgcaaggccgttgcttgctgcagcacacagtactctccgatcgatctggccatgcgtgcatgcatgtcggggcgagcattattcaaggcacacgcgtctgccccatattcaaggcacaccgcaccatcgtatgctcacaagtcttgtacattgaacttcgtcttccgtttgttcctcgcagagtcttttttttttctttgcggactggaaagtgcactgttggagacatcagacatggcacgagatatacacgtactatacagggagttgctcgatcgccctgtttgtactactccgtttactaggccctctc

SEQ ID NO: 2813 - DNA, 1460 bp, Zea mays
  misc_feature (1)..(100): optimal_loci_50941_G1, chr1:295883584..295885043, Cluster 16
ggtcaacaaccccgtgtctagggaaattatgaaggaaagtgattagggcctttcgtcccctcgaggcacaatggcacttagttgatcggttccctttgctggcctgggtctctaatgcccctggcttcacgtgatatgaacagctggttgcaatttgtaagtttgtagaagatatatatagattattcaatccctgttgcaatttgatgcaggtcctcttattaacagcgtggcgtgcccccgtgtgatcctgcatgcattgccgtcgtcgtactacgtcggtcgaacaccacgtcaaggcatccacggcgcagcccacacacgcgcacgccgcccatgcggttgacacgacggcgtagtagtctcgcatgtagaagaagtcgccgccgccgtcgtaaagcggtccaggttcagctccgtggcggtacatcacgcgatcctcaactggccgccaatttctgtggacaacaacacgtaccacgaccatgctgggggccggtcggcaacgacacgggcattcactgtcgccttgccgccgtcgaagacgaagtaggaactaagaagagaatccaaaccacagcacgcctgcagaggctgccagaatcccacgtatgtaatgtacgtctgaggctggcttggacttggacggagcacgatgctgccgtagaagaagcactacggtatcgccgaagtgtgcgcgcgaacctcctctcctctcctctccagcagtggcggcggcggggcacctgctgcagtgcagatccggtggatgcacgccacgcctcgcacatgccgcgctgtcggccccgaacgtgtgctgcactgcactgctctgctgcgtcgtggctcgtgcggtaccataccacacacgactttacctgtctggcagacgacatgccaccatgcacgatgcaccacacacgcctttgctttgctttgctttgcttcgattcccacccacggccacgggcaaaggaaggagccgcagcaggcattgcagcacgtgtaccaacacccacctctacatgtgccctagctagcttgcgttcgttgttcattgtcttgttgactgccagtgccaggcgccatatatcagcggcaagagcaaggaacgaaccagctagcttaattcggtgtgtcccacccaaatggagatgatggatacggtggagagagcgctgcagtgtagtacgtagtagtgtgtggcagtagcagcagctagctagctagctacggtaggtgagacgttcagtcaggtccaagcatacgactgtctgtctgtctgtctgtctgtcttgccatccaccacgcatccggtcgtctccgctctccgtctccggtgcgctagctgctgcgagcctgctctacctgcttgctgttgctggtggtatcacgacgtggacgcacgtaccactctcctcacagcacaggtccgcctgactactatactagcgacgacc

SEQ ID NO: 2814 - DNA, 2038 bp, Zea mays
  misc_feature (1)..(100): optimal_loci_51281_G1, chr1:298275220..298277257, Cluster 16
gatgattgacggtgaagaagatgaagactgggcgcaagcttcagatggcgtcgatgatctagagaagcagagaaaaggatggcacgagagaaacgtttgagtacagagtagtattatgggccccaacgggctatgtaaaagagtcatgagttggcccatgtaatcggttctcaaatgcttataagcgcgcgatgctgaaagagacaacaagaaatagaatgagaaaccaattcccccttgtgttgtgtgctagcagcttctcctaattcttctattcgtctggccttctcttcccaccacgataaccgatgcaaacactctccccgacgaggacggggccttgatccaagcgaactcgtcaggcaagttacatgtgcacatcgtccacatcaatggagccggagctccccaatccaacaaggccagccagggtacccatgaatgaagtccacgtcggctcggtcaacagctaaccaaccgggattggcctgaagattgccaagtctgaccacagacacgaaccctaatttgtaatttgttatgtcttccatctatttctcttcttcttcttcttcagctcgccagaacgaagtcagcagtctgtctgtctgtcactttcgtttctttcacgttcccttttgagtttgaactttgaagccacgccaatccacataataggatctgggcaagctagcaccaataatccacataaattaataggatcttggcaacgcacaaaaaatataatgatagaagtgccggctatattttggtcattatggttttaccgaaatggtgttgttttaacaataaacaaataccgtttattatgcaggttaacctagtatatagtagttcagattttggagattgatgcaaataataaacgatgtttgtctctttggagatggtggctatggctatggagattttggaaattgatagaagcacactagtgagtgtgaccccaaaccaattatctaaaatctcatcttaattagtcccaataggtctggcaccgtctcttaatttggcttatatatctcaacaatccatgacgcgagaaacacgagtctctcctctaatataattacgagcaggctcactgtttgccagtaacagcagtggcatgcacgaggaaggaaaaggagcgacgacgacgagtagtcgtggctaggattcgtagctacagcagggggggggggggggggcattggctctccaggctccaaagcgttgtttttgctccgtctagctgctagtgctgtcttctcttttgttatccagcgagtccgatccgattcgtgcagtgtgcggactgagacgcaacggccgtggaagccagcacagatagctagccttatcttggaaggaatccccatggccatgggtgttcaacctgatgacccttatcgcctaccaatacgaccatatgctgctggctgctatcttcttcttcttcttcacatgcacacatatatatattcgatatgcctgccaccagttgtgcatgcatgcacgagtcaaccaatgtgaacaagtgcatgcaaataaattccctgatgctgtctacaaagcaaagcaaagcaaatgatctgctagctgttgtcaaaggccaatattcctttgacgatatggcgaagtcgtctcgtcgcccaggcagggggggagatagatcgatcgaggggcctggcctgtacgtgatggctctccctccttataaatacatacatgcccaggcgataataatgcagcgcagatcgatcgatcgatcgcatggaagtaagaggccatctttggtagccagggatgatttgcctgtggttcctgtcgttgccatgccaatgcctgtactgttcgatctacgggcaaatcatccctgctaccggagtgtctcttactcttctctctagctagcatgcatggccatcaaacacccaaattactgctgctagtggctatgatctagcattatattaattgttggttcagtactgctgcacagacagactgtgtctgtgttcataaaaatcaagga

SEQ ID NO: 2815 - DNA, 1493 bp, Zea mays
  misc_feature (1)..(100): optimal_loci_5241_G1, chr1:26915485..26916977, Cluster 16
taagtgcggcctcatgcatgtgtgtaattaataactgtatatatataaacacataatccttgattccttgttcgtgtggaaaattttaaaactgttcatcacacaagcgagtctaaaccagcgtacctgtgcgtgtagaagctagctagctctccagatccacagccagcaagcaggggggggtcgttatatccaggagtctatggaccaaatcatgctaactgcattgtgctagtacttctgtactagcttattaacaagttgtacgtataataaatggtccgggcagaaagaataatatagttgctaattgattcatcaaggctcacttgaccggaggcgcagaagcatacaaatcgtcgtggttggttacctgtctagatctcaccaccaccagcacttgatcatcaacaggaggctagccactttcacttgtgctaatcggaaagggacgtcgttcctagtcccagggaaaatgccaccacgcacccttgggacttgctcttccacctggtggtggcggggccatacggaaatgagagagagagagaaacgaaccttgtcagattttgtccgcacagtccaattaattaatggcgcaaggttcctgcttgtgcaatttgctcatttcatgagggcatgagtagtcatcaccatgcatatgggctgctgcctattcagtatgcgtaggtactgactctctttttttttaactgtgggttacatgcatgtacatgttcctagggccggatcgaaacagcaacttgcattgctgatcattaagacaggcatggggccggccacgaacattgctgtgatttgcattacgtgcccaccgcctcagcaaaagagagagtgctgcgcccgtgattggatcgttttgtgcattattctggcagtttctcttgtacctatatagcatcgacgatatatgatcgggtcgctagcatatactatcaaatgtttccaaaaaagaaaaatacacagagcctggatattgtgctgctagctagctacggccagatgctagctagcttgcatcatgaaacctatatatgttactgaccactgcaggccaagtgccccccaagctagcttttgtgtgcagggaattcatgatcgtacgtgtaaactgtgaacggtgtgcagtggctgcttttgcatgcttgcttgcttgcatgcaacgcctgactcgtatacgcaattattcctcccatcatagtaaagcctaacactctcgctagtagctctttgcgttctgcagttcccatccgccatctcgtggcctgtgagtctgtgacacttgttgtgagacatggacagacaccatccgctcagcacacccagacccagcaggtgctagctagacggtggaacaaggtacttgtctgcagacttcaggcttgcatcaatagactgcctaatcgtgggcccacctgctttgctagcttacatggcatgtcgtctgttcattcttcattttttcccttttc

SEQ ID NO: 2816 - DNA, 2031 bp, Zea mays
  misc_feature (1)..(100): optimal_loci_52564_G1, chr2:4265690..4267720, Cluster 16
  modified_base (390)..(390): a, c, g, or t
  misc_feature (390)..(489): n is a, c, g, or t
  modified_base (391)..(391): a, c, g, or t
  modified_base (392)..(392): a, c, g, or t
  modified_base (393)..(393): a, c, g, or t
  modified_base (394)..(394): a, c, g, or t
  modified_base (395)..(395): a, c, g, or t
  modified_base (396)..(396): a, c, g, or t
  modified_base (397)..(397): a, c, g, or t
  modified_base (398)..(398): a, c, g, or t
  modified_base (399)..(399): a, c, g, or t
  modified_base (400)..(400): a, c, g, or t
  modified_base (401)..(401): a, c, g, or t
  modified_base (402)..(402): a, c, g, or t
  modified_base (403)..(403): a, c, g, or t
  modified_base (404)..(404): a, c, g, or t
  modified_base (405)..(405): a, c, g, or t
  modified_base (406)..(406): a, c, g, or t
  modified_base (407)..(407): a, c, g, or t
  modified_base (408)..(408): a, c, g, or t
  modified_base (409)..(409): a, c, g, or t
  modified_base (410)..(410): a, c, g, or t
  modified_base (411)..(411): a, c, g, or t
  modified_base (412)..(412): a, c, g, or t
  modified_base (413)..(413): a, c, g, or t
  modified_base (414)..(414): a, c, g, or t
  modified_base (415)..(415): a, c, g, or t
  modified_base (416)..(416): a, c, g, or t
  modified_base (417)..(417): a, c, g, or t
  modified_base (418)..(418): a, c, g, or t
  modified_base (419)..(419): a, c, g, or t
  modified_base (420)..(420): a, c, g, or t
  modified_base (421)..(421): a, c, g, or t
  modified_base (422)..(422): a, c, g, or t
  modified_base (423)..(423): a, c, g, or t
  modified_base (424)..(424): a, c, g, or t
  modified_base (425)..(425): a, c, g, or t
  modified_base (426)..(426): a, c, g, or t
  modified_base (427)..(427): a, c, g, or t
  modified_base (428)..(428): a, c, g, or t
  modified_base (429)..(429): a, c, g, or t
  modified_base (430)..(430): a, c, g, or t
  modified_base (431)..(431): a, c, g, or t
  modified_base (432)..(432): a, c, g, or t
  modified_base (433)..(433): a, c, g, or t
  modified_base (434)..(434): a, c, g, or t
  modified_base (435)..(435): a, c, g, or t
  modified_base (436)..(436): a, c, g, or t
  modified_base (437)..(437): a, c, g, or t
  modified_base (438)..(438): a, c, g, or t
  modified_base (439)..(439): a, c, g, or t
  modified_base (440)..(440): a, c, g, or t
  modified_base (441)..(441): a, c, g, or t
  modified_base (442)..(442): a, c, g, or t
  modified_base (443)..(443): a, c, g, or t
  modified_base (444)..(444): a, c, g, or t
  modified_base (445)..(445): a, c, g, or t
  modified_base (446)..(446): a, c, g, or t
  modified_base (447)..(447): a, c, g, or t
  modified_base (448)..(448): a, c, g, or t
  modified_base (449)..(449): a, c, g, or t
  modified_base (450)..(450): a, c, g, or t
  modified_base (451)..(451): a, c, g, or t
  modified_base (452)..(452): a, c, g, or t
  modified_base (453)..(453): a, c, g, or t
  modified_base (454)..(454): a, c, g, or t
  modified_base (455)..(455): a, c, g, or t
  modified_base (456)..(456): a, c, g, or t
  modified_base (457)..(457): a, c, g, or t
  modified_base (458)..(458): a, c, g, or t
  modified_base (459)..(459): a, c, g, or t
  modified_base (460)..(460): a, c, g, or t
  modified_base (461)..(461): a, c, g, or t
  modified_base (462)..(462): a, c, g, or t
  modified_base (463)..(463): a, c, g, or t
  modified_base (464)..(464): a, c, g, or t
  modified_base (465)..(465): a, c, g, or t
  modified_base (466)..(466): a, c, g, or t
  modified_base (467)..(467): a, c, g, or t
  modified_base (468)..(468): a, c, g, or t
  modified_base (469)..(469): a, c, g, or t
  modified_base (470)..(470): a, c, g, or t
  modified_base (471)..(471): a, c, g, or t
  modified_base (472)..(472): a, c, g, or t
  modified_base (473)..(473): a, c, g, or t
  modified_base (474)..(474): a, c, g, or t
  modified_base (475)..(475): a, c, g, or t
  modified_base (476)..(476): a, c, g, or t
  modified_base (477)..(477): a, c, g, or t
  modified_base (478)..(478): a, c, g, or t
  modified_base (479)..(479): a, c, g, or t
  modified_base (480)..(480): a, c, g, or t
  modified_base (481)..(481): a, c, g, or t
  modified_base (482)..(482): a, c, g, or t
  modified_base (483)..(483): a, c, g, or t
  modified_base (484)..(484): a, c, g, or t
  modified_base (485)..(485): a, c, g, or t
  modified_base (486)..(486): a, c, g, or t
  modified_base (487)..(487): a, c, g, or t
  modified_base (488)..(488): a, c, g, or t
  modified_base (489)..(489): a, c, g, or t
gctgactgccccttggtcttggtatcgtatatatagccttattggtggcgcccggccggcggcatgcatgggatggaatagctacgcacgcaacgcgctgtgccgtgtccctgttgaccggccggccaactcccaacagtgttcagtactgcgcggccgatagattgcatgcgattcaccgtgtacgcgtacaccgtacagcggggaagaaggaagggggcgaaaaaaaataaaggaaccagcaggcggttgggggggagacgcacgcacgcacgcatgaaggaaccagcgggcagcctgcagccaggtaccggccgggcgcgcgggcagggaggcaggcagcaagcgtgcgtgcggtagatttttcatcagcatgcagaggcagggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccacgtacaattcaagtaatcagattccagataagtttatcctagactacgcttggagagaaacgtccgtgccttgcaaatgcgtagaccaagaccaagggctgtagcgaacaggcaactggagttgccctctgaactttaactatattccgacagtactctagaagagccttagcaagttaagtggaccgtcgtacgatcttcgtttactgtaatggctgacgcgtcgcctgagtgtagtatagttaataatagccttactgtcagcacccgcacccctccccatctggtattggataacaacgcatacaaagccctctgtcggatcccgtttagcgcgcggcactctcacacacattcaagatatgcgcgggcgattagtagcatgagattaaccatcgatcgaaccacgtaaagtcggggaaaaaagaagggggcaaaaaaaaattaaagaaccagcaaggggttgggggggggacgcctgcacgcaagcatgaaggaacccatgggcaatcctcacccccgtgcccgccgggcgcgcgggcagggaggcaaaccgccaacgttccttgcggagattttttgtcacgcaacattaaccaggaccggttccggggtcgggttccggttgccttttttttatgagacaaacggcaaccgggggggtgttgtgggtttagcaaaaagtttccccccccccccccccccccctgcggctgccacctgaaaccgttgtttcggcggatccggacgaccgcgcgggccgccggcatgcatatgcatcggaagcagaagcaggcgacgtcgcccttcgcccctgccttttgcagcggcacgacacgagcgagggcgcagcgcgtacccaccgcccgcccgtgcgcctctgcgcgcctgcccgtggccggcctacctgtgggggccaacagtcgcggctcgctcgagacgtgccacggcgcgcgggccgcgcgcctcgcttgcgtgctttggatccgcccgctcgtcgtttcgcccgccgtgcctgcgcctgcgcctgcgcctgccagcgcgcacgcacgcgtgtacgtacctgccggcggcctgcggcgatgcccgccccggccgggtgggggctctgcctgcggcctgcctttcatggccgctggcgctggccgtgtgcgggtacggcgtcgcgcaccgggccaccaccgcccacccaagcaaagcgcgcgcgattcatcgatcgactgatgggtgcgggcgaccttcgtgggggccacaggcctacgtttacctgcctgtactccgccgggttgtcgggcagctagcgcaagcgcaggccgctgatcgcgagccgcgcgcgcccgccctcctcgccagcttactaccacccatcaacgaacaacgatacccggcccgccggcctccaggacacgtcagtcgtcgcctggtagtggtagttggcagagccaaattaaattgttcttggcagattctctctctcgacaatacttgagtacggagtagcatacagaatattttaaatatgtttattataaaatatc

SEQ ID NO: 2817 - DNA, 1704 bp, Zea mays
  misc_feature (1)..(100): optimal_loci_52598_G1, chr2:4343533..4345236, Cluster 16
gcagctagcctagctgcgaattgaagaaagcatttgccatcttctctgctctatctctgatcctactcgccacaagtggcaccacagcgacgtgtttgtttcttttctccattatattgcaacgttgttgcgtgattagatcagcagcgccactggacaatctcgacctgggtttgtttgttaatcggcgaatggccttatgtgtcgctagcacagtgagcgcttcttcctttttcttttctttctttcagtgtttgtgtttgttaacgcagcaggaggagccccaccccaaccgaaggattttaaaacttctgttacggtgcatgcacttggctgacatcttagagctcgctcgctcgctttcagatttggtactgtgcattacccagccagaggcgtctatgatatcgacgcagatctcgcgactcgcgtgtcatgttcatgtctcatggctgtacgtactgtcgccggccggttccttctcgccatttttctcacaggccgcagaatatgcagcgcacggacgcacgggccgcgaaacttgagaggcagaggagagaaaaccgggcaccgggcgctgctacgtgccgtgcgcggctgctaccgcaaggcgcaaggccgccgggcgcccggccaagtcgtcgtcggcgttgcggcgggcgacgtttcaatgattggtcgctgctcgtggatccgctgatgctgtccctggcgactgccgtggagactcgcggtcgatgccggcgacttctcccgcgctcgtggggcgaaatttcccaaatgcgtcgccgagacgcctctgcgccctgccgggtgctgctgtctgctgtctctgctgcaccgtcgtgtcgtgtgtcgggacacggatcggcagctcgttttcgattcacaatcattgccgtgcccatccgtgcaaactgtcgtcgccgttgactgaccgaccggccggccgccgaccccatctgagtggctgcctgactgactgactgctctgcacctgcacggtgcaaaagcagcgcaagcctattttgaccaccacaccacgcgacctgacagatgaggaattgctacactggcgaaatttcaaaaccaaagcccacgttctcaacatttgctgggttgggccaccagcacgcttgttgtaccttcacgaccccagttcttctcgggtaacatgggccgcatgtatcccattagttaggcttagctgagtagcaggccttcttggcccgttggaccgttgatgcagaatgcaagcaatagcgtatacgagagagagagacaatctcaaatcacactcctaatagcggacaaaccacactcctaatccggctttgatggcggtttcacggcaatataaagagacaatctcaaagacccatctgagctagcgtgtgtgtgaaaacagcgtgcaactttggatgtaatctgaaaacgcccccacggctgctacactcgataagaaaagggaaacaatgattgttaggttcttttgcttatctcttctagtaacctcgtactgcctgagtgtgtgcttacctcagctacgtgtactcgactagtaaccagccgtcgtaggtgagacgatgcatcctgtgcatggcaatgatagattaacttattctgtttcacgaatgatttttttttccaacaaaaatgtgcggagatgcatggtaaagtactgtatctgtcaaagtgtaaaca

SEQ ID NO: 2818 - DNA, 3646 bp, Zea mays
  misc_feature (1)..(100): optimal_loci_52843_G1, chr2:5681146..5684791, Cluster 16
attgttatcccgctctcgctcccatttccggtgaaagaatatggtaacaaaaacggttgagtgtttctcgtccgttcctgttcgtttatatccctaataagaagtcgattaagcttaagataatttagctttggctagatttcagaggcagaaacatgcaagaagatggggtggagaagccacaactgttttgacgagaagaggcgagcatctagcctagagcacaccacatgactcaagtcgttgctgcactgcaccaccctcggtccctccctcccgtgaccaaccaacgcaggcgatggcaaacgcacagtaacatgaaagcgcttgtcacggaatctcactttacccgtgtcccctcccctgtgtctgtgtgggctcgctcgtttccgcggtgcgttgcgctgcggtgcgtgatcccattcccacgcatatgcgctgcgctgcatccacgacgggtcaaccgagcaattactactgctgaccagtcccgtgccagtgctgccgagccgtccagctttcggccaacgcacgaccaggatcactagaggtccgtagtgccccctggactggacacgcgagtcgagtcgagtcgagtcccaggcccagcgtagtcgtagtaggggcccagccggccgccgcagctagcggcacaggctgaggcgtacggcgtgcgcacgcaggtgacaaccatccagcctcgctctgcccgctgcactggcttcctggcttgggttccgcacatcgcacgcacagtgcgcgcacgatcccggccaggccaccaactccgccgcactcagccactggcgaacgaacgccgaacggtcgacggagacgggtcgtgtggattcgcggcggcctcccgccggtttcgggctcgtttttccatctaggccccgtgccgtcccgtccaggcgtcgcccatcgtgggggtggtacggtggtgcttcttcgtcagtcaccgcctgtacggtactacctacgcctggcctgggtggaaatgcgcgcgatcgtggtgggggccgtcggtgactgtgcgatttgctgctctgccaatcgccaggtcggaacggtgagcgggcgctcggcataatttgcggcctgtggcgaccgacgtgtcgtctgcgtactgcgggagcgggcgggcgggcgggcggctcgagctgcggcttgctccccgctcccgatgcgcggcgccggatggggcaacgcctaaactactctcactgacgcgacgtgccactgccagaatgagcgatcaccgctggccgtggccgggacgggaacacggcgctttctttagggtttcacccgggtcccgggggccgtgctgctgctctgctctgctatgctctgctctgctcccgtgccgtcccgaagccgcttgtcgcttgcgttgttccttgggatgacagcactctcgtgttacatttacacacccatggaccgcggcacggcaccccgaccgcggcccgacgtcgtaaaagttgcatcacgaggccagcgccgtgacgcagcaaccggcgatgacaccactgccaccttgctcgttaacaccggccggcttgcttgccacttgattgcggtggagacgcatgcctgccttgccgcggcacctcgagcagccacgctgcataatcatacatgcacagcccagaggcgagaggccagagcgcaccgccggctgcacggtttccaccggcgactgcccgaccccggctgcttcctacgccaactgccaacagcctgacggcacggtgctggagcactgcttgcctttccgagggcccccgtaccacgctacctacgagcctagctgtaactgcacagctgcctaacacagtgcagcggcaactaatcacacgccgggccggggcctcaagctaggagcctagctaatctattctggctgcctatgcgtgacatggtcacgaccttcacctgcctgcgtgtcgactatacgatcaattaacactctaaaaaaataatattttatgatggatggagtattattttggccgaacatgatagatacactagtgtgcactgtattcgttttcctacgctgcctctgccctgcttcccctgtcagcggttgtggttgtgacgtgaggtcggacgatggcaactgattcatacatgctaaaatctatctttacatcattgtagccaatagccatgccgtaacagcgaccgggaagatattggcaagccaagttgcgtctcacttcacttgcaggttaattgagattaggcaggccggccaaacagatactgctgctgccatcacaaccaggaggactacgggcgaaacgaaacccgcggcaagcagatgcagatcagcacttgtgaaccttagaacattcaacgttcaaatgtgacagtttgcttacaacaggtccaggtgcagccgcatttaaaccagtcaagaatctatatagtgccaacgaacacctaatgcgctactggtagccttttttttttttgaaggtctggtagccttgttgaaacgaccccttggttctaccatccaatccaagctactactcctatagaaacaggatgatgacgtggaggtttgggactgctctaataaactaattgttaattgtgagttagctaacaattagctagctacggtatcagttggtagtgtttagaacccaacaagtaatttttagtacctaactattaattttagaagttataaagagagctttagtcctcctcttgggtcttcacctccactccactgactactgactgacaggtgacaaggagagaaggctatcacatggagtcaaaagttgagggctaacgccgtaggctcgtttatttgcaactgttgacaaatccctgactgagtccctgaccttgtggcgtccgtgcatacatatactcgccgacgccgtgccctgttgaagtgctgtgtgtgtgtatttgaaggtggtatacggttcctcgtggaggcatgtgaagtgaaggtgacaacaactcacgagtgactggctcttcctcgtgagagggattactggtacacacatggcatgtggagcgtggaggcggccatgccgatgccgatgccgatgccgtggggagagagagatagagagagatcgattcctcctcgatctctttgggacggcgacccggctcgtacaaaaatcgcagagggctcgtaaaatgaaatgttctctcacagtcacacacactaccgtctgcttccgccctgctgccgtgaaagtatgcacaactgcaaagtgaggcttttcgatcatttctttcgccagaatttttcggtgttctatcaacagaggaaaggaaaggaaaggaaaagcttgagcacgcagcccgccaatggagaagcaacacgaatccgcgcccaggaggttactcgattgcctgtgtgtcctatcaaccttatatttataatataatccagcatggaccatcgggcgggcatctatcgcaggggagaacgaacggacaggccaaggaaagctacacgcaggtagctggggataacgtaaacttctctctctccccccgtcccccgcctcgtgaaatctgcatcatgacgacctcatcatggcgaccaacgaaaaccgagtggctccggggccgactctgcttgcccgaggttcta

SEQ ID NO: 2819 - DNA, 2458 bp, Zea mays
  misc_feature (1)..(100): optimal_loci_52875_G1, chr2:6001189..6003646, Cluster 16
aacaattttacacgagtcgatcgagaggggaaccaaggggaaagcatgagcacgtggagcacatggtggcgcgcctagcctggaaacggagacggagcatggtcatgacctgctgccgcgcctggcgcctccaatccaaaacaaccatgccaaaagtagcaacaggaaacacgattcagcgatcggggattcgggaatcgggggtgcacgtgcacggtgcacctccaaaaatagcaccggcctattcggttgcgcatttgcatttgcatttgcatctcgaggcttgctcggcccagtccttcgaaccattgggcccaatctagagtcacagggaaaacggcccttgtttgtctcagctaccggcccttgtttgcaggtgcctttggtttggcatgaaatggaaatatgcatgggtctcccatctaaagtctaaactgctccctccgttctcgtttttctttataaaaaaaaagctaaaatactttgaagtataaataactaaatatataaaaatagaacacctattatatcgaataaatccatagtaaacttgtttaaaagcacaaaatatctataagtctggcttcgttaaatatagatttattaatttgagacgatggagtatttagtatttactgaaaaaaacgaaacatagaacagactcagtcaactgatctggtctgtttttttgcccatccggctctgaggctctctgtgctgtgcctcccccgttgcagtcaggcaaggcaacatataataatgtcacgtattcagtgagacagtttgattttccagtttgtcccgagtattttaaaccttgaaaaaaaaaagcaacagcaggttctcaagccttctctgctcgagaaggatatgtgtgtgtactcgagcagcatatatgcaggatgggcgcgcgctgaaggaaaccctttccatccttcttgttccgcgatgcccgggccgccgctgccactgccagcctgcgacttgtttttatataatacattgctcgcttccgatccgtcagaacggcgcagtcaggggcagctagctgggcaatcaaatcatcaacatcgtcaggtggttgtcagcgttgagccatacaaaaaacgcgagcacggactagtggactacagtaaagcactaaacaaagccccctcgtgactggccctggtctggtgactgtactactgtagatacgcgtcccaaagcaacgcatcatgcatgatgcatacatgacgagtcaagatcgactcaagacccggtcgaaaagctgtagcggtacgtcacgtcagtaacaatctctttccgttacagtggcagtggaaacgcagctgcatgcatcccattccaccggcatctcaccgtcgtcatgcactcatgctcccgtatgggtatggcgcagtatttttctacggggccgccggccttgcgcggtggcgtagcgtacgcgcggatggcggtcgacaggcaggtcagcagacggcacggtacgcccgcccgcccggactgccgccccccgcgcggaccgcgtcgccatcgccggggtggcgcgcgcgtacctcctgcccgtgcgctgtgcccccctcccgtccaccagctggccttgccctaaagatggccatttatgacatggcacggacgtccgtccgtccgtccgtggtagggtagacacgatttgagggtggtcgataggtctggtatgatctgtggaggaaacatacatctatcaacgacccaggcacggtcctaaagattcccgtgctagctagacctaaggctcaacactccttaggctcaaaacatgttcgattttagtttttaagaatatattacaacacatcacacttgtttattacatcagagcccaatacattcgcacatccatatttcagtctcacgatatcacaaggtgatcagtggcggctgacgagagaagcttatttgtgatggtcgaaggtgggtggcggtgtcagttggcatcgctctccctgaggatcgccggccgaacggccgcgcctcaccaacccgtccgctgatctgattggaactttagctactgagaaatgattagtacgtagtgtgcatgtgcacattacaaagtcgatggatgaagacgagtaagtaactagatcgagcgggggcggatcggagttatcacgaataaagaaataataatcataataaaggcatcatgcatgcatgcatgcatgcagtgagaggcagtcgtcggcccccgtcgtccgcgggggactcgagatgagaaacgccaaggaaggcttttgtaatagtatctcgtcgtcacaaaaggcgcagcatttcctgcgatgctgtccagtatcgatgggtcactagactgtacgcgcggctattctatgtattcaggatcagcttgactgaccggaccgggtcgagagctgagctcgagcactcgctagctagctatactacggctagcaac

SEQ ID NO: 2820 - DNA, 1443 bp, Zea mays
  misc_feature (1)..(100): optimal_loci_53574_G1, chr2:9591520..9592962, Cluster 16
tactatggccagtaaaatttgcgtaaaatagaggacataaaactgttgatgacaagtactgattgataatgtatataaagtaaagtttaaaatagagaggtagattattaggggccggccggccggaggtgcaatgaagaagcgcattggcgagtgcaattgaagtaaagccacacatcacgcacgcccatgcatccatctggttagttgccgctctcccgcaatgaatgccccccattaatccatgccgattgagacgcgcataggagtagtgtacgtactatatttgcatccacggaggttttcgctggtcaattaatcaattaatcgccgcgataatgacgattaggaagcgaccagaggaattaaatgcgtggttaatcagctacggccgaggcgccagctgattggtccttgaaccgtagtaagtactacaataaaagccgttggcgcggttcattgctgcgtgcacctatgtagattgtggaatgtggagtacccgtagtatttctttgttccctcttcattaaattgggttggacttgcaaccgtgggcgctaatcaggtgacgttgtgtcacggagacgccgttgattccgtccgcgtgtcgccctcccgcgcgctgacggtagtattaattgccctgctatgctattgctactacagtactccactttgctagctagctcccgtcggtaggcgagcggtttttggggtaatttggccgtgccacgtggagtagcgcctggtcttggataatgattactactgttgctgcagctggcatcatttttttcccccagtgcaaaaaccgcgaccagctagaaagtctcgagccttgatgggctctagcaagtagtaacagagggttactactcgatcggtttttagatgaagcaccactgttgtctcattaacgtgtcgactgcgatatgcgcatgcttcatcggtacgttcaggtagcgcagccaccacccaccagcatccaccacggcataaatcgttgcaattgcaacccaaatcatgtgaccacggttgttttgacgcctctaaacatccttaaaatgtgcctttagttattagcggtggacattaaggtgacccaatactttttttttgggggggtcatcccagtcttgaagatagccaattttcagccatggtcacagccaatccaaaagaccactagagagtaacaacctaacgcgcgtatttttttagtaagagaggggctttatatattatcggtagaaagaagaattatattgttgaccactagtaatttgtttcagataaaattggcactacatggcgccagagacggtttcgatcttagcccatacttgatgtactaccctccacgtatggtggagacgttgaaccgctcgctatataatccaagtgtttatgtggcgttggatgcatgcaagcagattcatttag

SEQ ID NO: 2821 - DNA, 1757 bp, Zea mays
  misc_feature (1)..(100): optimal_loci_54453_G1, chr2:14326473..14328229, Cluster 16
tcgggatcaccggtcatgtcgacgcagagaaacacaacgtcacgttacaccagctctgcacggtgagagagagagtgacggcggcacgggtgaattgagaagcgctatgctccaaaccatgcattttcacctccacggtatacaacagacactcgtcggtcgtggccgtgtacgtaccaccgctcgatcgccgcccagtcgtcacgaccgggacaacaccacaggccacagcactgtagcgatagtgccaccgttaatctttgtcaaagggaagttactgctgcctgctgctagagtgacgtgacgaacgcgagctctagactttacgttcactcgcgcatcaaatgatttcagcgtcagtcggaaccggtcggtaccaccgctcaccgaggcaggcatgcccggagttgaaggaggtagtagtgaaactccatgtcactccaccatctggtggcatcacttgtagtaagtagttaaccccgcggtaataataacttggcttctagtaagtagttaatcactatccccattgcggtggcgtgcgcgcgccgggtcgtcgacggccgggccgggccaaccacgccgtggcttagtggcgaaacaaatggatggaacccgcgcacgaaccaccccaaccccaccgggcgtcgctttttcgcccggtcgagctccagcggcagcgagcatatagaacccgatactaattcgctaccgaggctactagctactagctacgtactagcctgacccatcgtcccaacgcgcgcgtctagagatcgagttctcttcgtctcatcatccatccggtccccgaaacgcgaaacaggagccctactccgccggaaaagatgacgcacgcggagtacgtactgtatgatcgaggaacgtacggggggcgggcccggccgttcgccggcgccgttgaagagtcgtctgatcgcggattcgtcgtggtgacgtcaaagacgggttcagactttggctggcccctagggtggctaggtgcttgggcttggaccagagctagcggcagcacgcagttggttggttggttggtgactggtgagggcggcgcggccggttgactgggggagtcaagtcaagctgtccagcttgtagtggatgggatgatcaagcggtctactagccacgccagactagagacgccggccggcggtgggtagtggattcactgcattggatggctgcaccataggagagagagcactctgcattgtgcattcatcgagtgccaggttgatcagctggcctcgctctctctgcggacccagtgactgccgacttgccgatcgagtcgagccagccggccggcgcgcgcggtcgaccagacttcatttacagtccggatcaatccgcggcgagcgagtgcgagtcggtgcgcactgcgcgcgttcgccgtgaactggtcccacactggccggcggcccgcagcccaccgaccgcgagaggacgttccatgcccatgcgtggattgaatgccatttgctgcttgcaggcccggagggagcaactgcgcggcgctctgctcccttcataaaaatccccgtgaacgcttcgagtcgaggtgcaaagagcccaaggtacaaaggcgttcgcacagtaaaaccggatccaagagctgaaaacctctggtctcgctgctgtcgatgaacgtgaggtttctcaccgtacgtgatgggactcttctatcacacgtatttggaaaatgcgctacacttgtaaatctacacaaactt

SEQ ID NO: 2822 - DNA, 2392 bp, Zea mays
  misc_feature (1)..(100): optimal_loci_54574_G1, chr2:15003970..15006361, Cluster 16
taaacaaataggaaacatacaatataatgtaaatatttttgtattagtcatatataccgagtaatacttatatttatttaaaaaatggagcctgtgtgagcacggattgaaagactagctagtgaatgctattaatccctgtacatggattcagttgtttctaaaaccacgcacgccgtatatgtggttacacatacaaagtacagtgccttctgctggcgccgtctgttctctgctggacgtgggttgatctggccaggataccccggcctgctacgaaatgcatcggtgggtgtgtctgccatattgtgctggacttgaatgatctgtggcatgcatgccacccgactactatctgacacaccttgctgggcttgctctggacaccgtctctactctctctcacacacacctcccactctggctggcctctgttcagcaaaaatgtgcatggcggaggcggatgacatgcgtccctgcagtacgcaacgcatcaaagtgttatagcagcaaaaatgtgctgtgtaaaaagtcatgtgttcccttcccggctgctggaaaaggcgcgcgtaattaagctacacactagcatagctgctgtgctgcatgccttctgggtttctcttctcttctcttctctttctccggggaagcatgcatgcatggcggcagcagcacgtatgtacccctacactcctaggactgcaggagtactattaattactattggtcgggagtatgcgcgagcgccgcccgtcgctcatctgatgcgattgttccatcgccccgtgtctaggtgagtatatgcatgcacgcacgcgcatgcgtcggtcgaatcgatggctttcctgacactctactactccgtccctagtgcatgctgtgacctgccgagaaatcggtaaccgtgtatggcttcgacgacgacctgatgctatgctattgctacccccacttgcttgcttgcagtcctatttgatccacgagctagagggcggacatataatagtgctcccgccggcggcagatctgcggtgcgtacacgcgtgctggacatgcatggacgcatcctgcagggtccttcgtcctgacacaaccaaaccatcaggcaaaaacaccagcggcgcggtcaaagccaatcaacaaaggcatcgatcgttatatatctgttctgtactctgttggccagcagtcatcgtgctgatatattagtgaactaaagagttcagtaattttcaggttacaccgcgactcactgttggttattaagtaggtggcaaagaagctaaagttatgtatagatgctcaaatggtgcctgaccataaaaggtcttattacactagctagtagcatggtccgagcactgaacctatatatagtgccatactgccattgtccatatacggcgtgcgaaggccacaagtctggtccacagtacacgaggagtatggcacggctaatgactgacacgatgtggtctgcttaattttcaccgttgtggataaagacctaatagcacaacagcatgtctggatcaatgcaagggttagaaatggtggcccgacatgacatacgttccctagctgccgaatagtacgtggcagagctagactgtccgcccgtttagacatctatatataacaaaagttgactcataaactttagtgacctaatgtagctctagttcgagcaactcatggagtaacacacctagttccaaatatgtccttattagcttccgatgcttgttgatagggaagcctgctccatcagcagagaccagtagtgtagcagctagcgcaaatcataccgtctagcttgtttcaaatttgagaaccccggccctcaactgactttcatatatacacacacacatgctagctagcacatcacttcagttcagctaaccatgcatatcagaaaaacttgccgcttcaaacagaagtgcttctaatatactcaaacgaacccatatatatattgctgccggtttttatttcgggtcatttctcgtattattattgatttggttttgcaagctaggaaaaccaccaaaaacaactagctagcactactagcagtggtccttcaattttccgcactagctcctgatggtctatcccatctgcatgccatctctatctctatggcattttacgggagctgtgtttgccatttttctttaggcagctgctcaggcttttcattggcacaggagtacgacctaaactcaaaaaggaagcctagcctgtaccgtgtgtgtgtgtgcaggtgacgagcgaatagagaagaatctgcccgtgcatgcattgtgcttaacgagccctacatcctcgggttccgcacctataaacgatagatcttcactttcatgagctttgttttccccac

SEQ ID NO: 2823 - DNA, 1412 bp, Zea mays
  misc_feature (1)..(100): optimal_loci_54665_G1, chr2:15475857..15477268, Cluster 16
tcgtgcatggctgcctgcctcatcgccggccgtgaactggtgcagatagggagagaggagagcacgcacgcacgtacgggcgccactatattaaacaattgccccacacccgtatgctgagtcgctggcatatgtttgagttgaaacgtcgtgccagatcgcttttatatatacggacagaaatgtataaagccacaagccagatttacgtcgctaatcaatcaacgcataaacttttgtagctcggactaggagtaggagggggccgggagagctctacgtactctggttgtcgtttatgcaggcgccgaacaagaacaagtcttctgctgtccattatattagaagaagaagaaaaaacaatattcatatcatatcgcgaagcttatgtcgtcagggaggggcgggggagatttattggtggtgacctttggatccccgaaagcatgtggaatcaaggtcagtatataataatgccgcgcatgcagtacatgcaagcaggggcatatatatagttgttgaggcggttggtttgctaactgatctctatacaagaagatctccgtaatctctggtttcatgtgctatggaaacaattcttttgtcggttgcgcgcaagggtctaggagaatctccaacactgaattccacaagcttgggatccgttagccatccagctggagccggctgaaaattactcgattggagaagctcgttatcaccggtccgtctcgatccgtgggtgaggccaggggggaaaagaaaacccctctttctgtccccactcccgactggaaaagcctttggatccttgtaaaataggaccgttacttcgacacaatatcttcaatccttataactcgtgtagcttaagcgcctaatattttatacattgccttgcacgtaacgttccactataccaacacagcacatgcaactttatgtgagacgctttccctttaagctaatccgagatcaaggctctcatgcatagtatgcatagtgaaggtttctcaagtcatcattggtggctttggccttcccctcatgacctcatccatcgttggtagaggattgagggaggtggattccaccactattgtaagtgcttgtgtggccatcgtgctctctaccactcgttgaaaaggaatatcttatatgattatatcaaatgtattagaactattgatccgtcaaaagaaaaaaaaacactatcggtcttaaacaagtcgattccacacatttatcggtaacaagatgacacatatctaagaaaaaaataaaataagatattcataaaagaattacttacattacattaaaactaccgcatgtacaaaggtcagctgcgtttggatgcctcaattaaaacatatggactgactcggtatagccacagttagacaccagta

SEQ ID NO: 2824 - DNA, 2402 bp, Zea mays
  misc_feature (1)..(100): optimal_loci_54666_G1, chr2:15483962..15486363, Cluster 16
aaaaaaaagagaggatgtggggtcatttatccatgcactgaatggaaccaaaaccgaactcgacgtttgtaatcgatggggaataatggcacatcaagccccgccgggagggccgggaccacgggctcactcattatcgtacacgcacacgctgggggccgggcctggggctgggcctgggccccggccagccagccagccagctctcgtcgcggccgccgcgtaaacggctggccgtcgcggccgccgccgcatcatcacgactcaggcaccgctggacacgtctgcctgtctgtctgtggctgccttcgattgcaaacgcctagcagagtagcagtacgcagcgcagctaaacaatggctccggtccgactccgacctacggtggtggaaagtttcttacgctagctcgatcgtacccccattattgcctgtcggtttcgcgcctaaagcgaaaacgataacgacgtcggcgaaagctagtattatcctggaatgtggcaactggctagtttgagagaaaggcaagcataattctgaccctttttttttttgcgctaatgatacgaacaaggatcgtattctggaaaacggtagtgggggaaaaaggagagaggctagcactcatcagtaaagcaatacccgtacctgtagtagcttcacttcactggacgatccgtcgttttcgccgtctgttcgcccgttcattgacggccccgcgatgccaaaaggccaagccaacgctccaggctacagcggataagaatgagccgagccgatgccgcagatcgatccacctcgcccagcctcacacaccaccgtccgcatcggtctcactatgggacactccggcattaaaaaaaagtggaatcagacgtaaaatttactgtacaacagttttactattggatccgaaattcagtatacttctatcgaacaactgtttaagtacacagtagctctatataaaaaaacatttcaattgtaatggtcagatttgctcctcatcttcctccgtaaaagttaaaaaaaaaacatgtggatgaacggcagggtcgtcggtgctcctcgacgcgaaggcaccgagtcatgtggacaaacaacggtcatggaggacggcaatttcgtaggtgtggtggatggccctgcgggcgaccaggccacatgcacgagccacgaccgatcgtgcggcctcgtcggagccggctagccgctagccccagcccatggtggacgcgggctgtgtggccgttccatggcaagagccaacaagtttgggacttggggagctatcttggggcacgaactggaaggtgaactaaagaaaaccaaaaacgaactggtacttgtgtaaccggcggtggtattggtgcgtaatatttttttaactatattaaacctgagttgataggtgccctttcaatagcttcactaaagtagtgaattcgaccgctagggatctactgcaaattcatcaaaaaaacagttttactctgtaaaaagttagtcaaaacggtttagattaaatagacttatgaatctggtggtcagattcattgtttttttggtgaagcttcttaaacagtggtgcgcggactcagatttggtgtgaagttggtgaaatttagaacgttctgatgactctaaacgggtcctgaatctattgttttgatgaatccaaattctatagaatcagaaccagaacgtccggttattttctttataaactaaaataatatcgttaaatccaaagctcgccagctgtcccaatgagaaacctggttctgtggtggatgcacacgaaagcggaaagccgcactgccgcgagcacacatacgaacgtgccgcggcccatccacgccgcgtcccgtggtccggatcgaggggtgtccacctcacctcgtgtcctcgtcgccgtgcggccggtgcgttgccgccatctcgcattggccgtacgggagtgctcgctcgcagtccagccgtttcgcaacgctccaccaaagcgtcgcttgtagacagacagggacagggggaggatgtacaaagaaaacgccgaagcccgtgagctgcacatgtgaaaaaagtcggtaaagcctgaaacccttgcccacacacacacacatcgtctgaaatttaattatccgcgaagaaaaaaatgtacacagtatctcgtgccaaacaaaccgttcagcaggtagattaaaaaaaagttcacgtctccatgagggctcgggacgccctgctctacgtgcatgtgcttccacactgtttggacttcacagacgtcctcaatctcaagcgtagcctgaactagtgaactgaaatacatgaaccttccgtttcgtttcgtttaagcaagtcacagcccacagttgatttgacacttggtttctgttccatgat

SEQ ID NO: 2825 - DNA, 2098 bp, Zea mays
  misc_feature (1)..(100): optimal_loci_55098_G1, chr2:17684973..17687070, Cluster 16
aagtacgttgcgcgttaggtcgacgaccgcatctcgtgaacggcagctgaaagagagcggcgtttagaaaatcctcctcacctgtacaaaacagtggccaaaaaaataaaaaaaatatacgagcagcacgagcatttgacccatctctgtccaacatattgtgtgacggtatgatttggtagtacctgtatgtaatactaagagataaaaagcacgagcagtgaaagattttattttttattagtttgtcttcttgaaaattaaaatacgccaagaaattatttagggattggatggcgtgaagaattttgtgcgtgagctgcctatatgacgatcccggctccgcccctcgtgtttagcaaagtcgcatggcgtcgtttcttttaacgagaaagatcagacaaacatgtcagcttcatttgactcgatcacccaaacgaatctgaagagcgaagtttagtaagagaaacttaagaagaagaagaaaaaacagaacggcggaaggctacatatgcatatatatacagtatattatagctcacaagtcacaagttttgataaacgacggacaacgaaaaaaacacggtatgattaatatacaccaagaataaccatatcagtttgatttgattggaagggacaaagcaaatgtgatgatatatttcgtttggcggcactgcttatatatttgtattttgggcttggacaaatagcacgcgaaacaaacccgctgccgctgtagacaaaaagaaggcccatgcatagctagctaacatacacggagtagtagtaagctgcatgaaacactagaggactaaagcgcacaatagtatatgcaggcatgcatctaataaaatggaggagcatgatgattagattgagatgtgaaaggcgaacgcttcggccgaacggaataatcggccctgcagctgcagccctcctgcgcgcaaaggcgcgggttaggccgtcggccgtggaggcaaagaaagcaacgcgccaaagaccgttctgtgttttttttttgttttctttttttttcccgccagacaaccattcagcatcggtgctcttcgacagcaacttcgtatcagaaatctcgtgtttgcctcaggagcaacgcctacgcaaggtaaacaaccaaaatggctaaagcgcatcagatgcgcgtacattcttctgacagcaagaagagggtgcgttgttgtcgacaccgatcgtctcttgttgctgcattggatgccattcagctgtggttccaagtaaatagtatccactgatgttgacccaaaaaaggattgttccttcgtgtgtgtttttacaggaaaatagagggagggggggggggggggggggtccttggtgaatgcaaagggttgtaccgcgtagtgcacagatagaaccagaaacagagatgggccctctgctaggatgatccaccgtatctgggctttctacggtggcctttttcaggtctcactgcaaacacctggtcaaggcctggcccattcagcccatcgtgtacttctgtccgtgcctaggctccggagctgccttcatgccgcctgctcgcctagtcccgtgcgacgtggttgaaccacgcggagcgggtcagcccagcccagcccaggccccgcacaggcgcggctgcctgttgacgtgaccacgcccacgctcgctttctacccgtctcgtagtagaggatagcgcatcggtcggcctttttattagaaccactcctatctcctacaggaacgaagaaactgacctccaaacaaagttctgcttttcggcttttgatcacccccaccacccagtttttctatgctcgatgttcgttttcattgtgccagttttccacgcctcgccacgccttttgacaagtccacacacgggacggggattggtgggatgccgatgggctggctcgacttggcttgcccccatgcatgcagatgcttgacctattgagtcctgagtgctactactacggtgtagtacggttggtgtgcttaagcattgtcaaacgctcgtaacaacccagcgccggcggttgattggtcaccaaccatcaaagatggcggcagctaacctttgatta

SEQ ID NO: 2826 - DNA, 1545 bp, Zea mays
  misc_feature (1)..(100): optimal_loci_55413_G1, chr2:19327120..19328664, Cluster 16
agatttcatccaagttcaaacgtacatttacacgagtcattagcaagttaacgtggcatgttaactcaaccatatacatagatgtaacagatgggatccatatgtcagcggcaaggcttaatcttttttttttcatgcaacctttaatgaagattcagatgaagatgattctgatataaaaatagtatctctcgatgatataaatataaaaaaaaatctaaagggctcgaaagttacaaaccactgactgagagttattgttttgtgagaagctaagcatgtatttcaaatgagggctatgtgcatctgctttggctttgctaggtacaacatacaattcagtgctgacatgcttcttatgacaacaggagactataatgagatcatccagggcgatttatttttcaagcaaaaggtctcccaaatacgaatttagctctcctgatttacacaaccggaagtttatcgcgtcccacaaatcgtcatccccctgtcgtgggtgtgactgtgatggcgacaaaaaatacgcccccgctgatcatgatataagggagggtgaaggacaaggaaccatctttggctgcagaagcaagcaagaatcctggcatcgggttggaccgttggagcgtgccatcgagtcctactaacagtagccccctcaacagaccagaggcctcctgcgccaactaaattctcgtgaccggcacacttatgatgttgtggcacagcatacatgaactggtgggtgatgagcatgagcaacaacgtatcgaggaagcacgcagctagcgtctgcggcatcatatgatataacaataatacataatgctcctctctctttttttttcctgacgaagaaaggcagtttcggttgcattattgttggtgagatgcatggtatcttcaaatgtctcctcgcaaagcgacagcagcctccctggaccctggcgcaggccagaacttaacaaacttgcagcgcttgttattctggaagagacacgtcatagaaaatgttacaggcaaaaataccatgtcattgtcgtggtaaacaaatcaatctctgatttgctttgcttgcttgcttgctcgctccgtgtcaaggatcagcattggctccatcgaatgagagagagagagagagaagatgagcgagagagcaggggagaggaaaggtgctgttggtgcggcgtgccaatacgctacgccgattgccgacgccgttctaactgcgagacagcaaacgcatgacagggtaccatgcgcccccttcactcgacgcgcgaggacgccgccggggtggtcacctaccatgtgagcgctgagcggcgcgcgccccctgtgtgctgtgctccacggaggaaccccatcaatgtactcatctcgtatacatgtgtgcgcaacgcataccctgctcctgcatacgcctatacgctaccgccattcaattcggaacacctcggcttttcagaagacaagattcatgattggtcatgccgtcatgcgatagtggctatacagtgcagaggctaactagctccaacaaag

SEQ ID NO: 2827 - DNA, 1804 bp, Zea mays
  misc_feature (1)..(100): optimal_loci_55494_G1, chr2:20004551..20006354, Cluster 16
ggtggaactataggagtaagtgagtaactaatggaatatcacttgtataactaatacagtctactactgaaacctattcgagtaacacttgtataactattggagtgtgactgtgtccagtgcttcgatgttaagcagttacgttaccttcagtgatgttgtcataggagttctattatgacccgaatatcttgatagacccgtggtgaagtccatatattgcatgacaattgacaagtacctcatcacgtcacttggaagcaaatactcaggagagaggctctgaatcgccaggcctacttcctctgtaacgggagcatcagcagcttggtaagtagcgacggcttgggaggctggcaaattatattagcggaaaattgaacgtgtcttgttagcggttgggatataagtacccttatcgaaaattaggtaagttttaatttctccaaaataaatggatccaaacggtcccgtaaaatgaaatgtgacgtggtggtaagaaggctatagactgtgattaaaattgagtaagattggagatatgacttccaattaatcactctccttgatatgcggattcatgtaaaaacgactagtatttcaaaacgggagggagtacttaaaatgctgctttgaatactcgccggacctcccagtcaatcaaaccagagacggcccgagtccgggcatgtaaacaggctcggctttgaaagttcaacgcgtgcaacgtctgtccaacccgacgcggacgcatagcaggcggcaggcaagacgcgggacgcgcaggcggcaggctttattttggctgcgagcacacggtggacgctggccggtgcatgctatgaatcccttggccctctgaccccctctctcctcagacgactagccgccgaaggatagtccacggcatcgccggcccggccgatggtcggcgcagcagcagaatcactgcgccactagtagtacttgccacggcgcagcggctatagctggacgcctctttggtttggcgtcttgcggtgcggtggatttgacgagtttttgctgcacaggttctcgctgagcgcgcggtccactactactgactgtggaacattgttttgtttcgtacaggcagcgctgcatgcgtacataccgcgtagtcaagccaatggtccatgagtttctggttttcggtgggtaatggccatatacggcgccctcctcttgcgttgcgtccgatgctctgctggctggctgcctgatggatgcgatgcctgcctggatgggcagctctggtcaaaacctctgctcccaaccatgggaaaagccgaaaaggggtaagatgatgaagccagcagcagcctggccctggcggctgttcacggcaggcagggacatgcgtagctgtgccccagagccgcgtggtgactccgtacgtcgcgagaagtgtgctgccgtacgccgtaccgccaggtcgagggcgtcgcacactctcgccagcctggaagcatcttgtatctgtctgcctgcgctgctcttgccggttggacgaccgagagcgacgaacgagccgggacacctggcgccgctgcacgcaaggaggcagcagcagcattcagagaactgtgctgtgctttgacgtcgtctcgtcgtacggccccctgcctgagtgcctgcaaggagctccgccttgacaggtgaaccttgctagctggaaataacgggcatggaaatgctttgctgccctcgcaatacataaaaggaaacggatgaaatacgtagccgctcccctccaaaaaaaagactcttttgtacaatgggt

SEQ ID NO: 2828 - DNA, 2763 bp, Zea mays
  misc_feature (1)..(100): optimal_loci_56193_G1, chr2:23731976..23734738, Cluster 16
acttgattgagatatctctcatcccccaatcgatttgcactgctaaaagttaaatgagaagtcaaagcctagacgcaaaaggtcgtttgttcgaacttgtcagctgcatatgaatatatatgatatgatcgtgcgcgcggcaactatatatacgtcaaagctgttgtcaatcaataacaagaaaaggacatgcaagcgccaagtcgttaccgcaaacctccagtcgaacttcaattaaaaaccatgtgagactgattatcaagattgtcgttttactgtctctacatgcaggcactaataaccgtgtgcggacatcatcctgccacccccctctaagcagtaacgacggctaccggcggcaaagacacgcacgcaaataagctagctaattactgtgattatatattacttaagaactcacttgacaaagatcgacgcatagtttaaaggtcgcttgtgctaatccacttcttcgtccgactattcaaccgcgagtatatatatgtatcgtttttatttctcgatgattccaaatacgaattgtatatggggtctcgaaccctagccagctagctgctagctagattctaccggctccagctacgactatacatatacgtatacgaggcctagagccctagaccatggttaattattagagctgggacgtataaaaacacatacgctacgcagttatatcattaattaaccgccatgacattaacattttattgggcgtagatctatcaagtaccgcgcgtgatgctctcttatactaaactactacggtgtttacgctttttattttataatcgaattgttcctttcgttttggccgggttgctttcgtcgtcccgccaatccagtttttttgatggtcccgttccgatccgttcgcaatcatgtttcgaaaataaaagtaaaaaatgaaaccccggaagagggttatgccgaccgatctcgttcgttgttgtcatctctgctctctatctatatttcgtagcactaatcatttttttaacatttgactacgtagttgagggatattaggtaagcatcatcaataacacggaggtagacgtatatgcatggatgtctatcggcactgcacaccttttggtcaccatcgcgcgcacaggtagagttagattttgacagatcaatatactattgttatatacagtcacaagccgaccacttacaccgtcaaacttggctttgtccgaccgaactgcgtaaaatcgacacgcaagctttaggacggtgggtagctacgatcgtccggcgcaagtggcgccacgtttcgacgcgcacttgggccgatgattcccccatcgataccgcctttgcagccggtggcggcagtcgtgcggggtggcagacgtgcatcggccagaaggacaaaagtctccgcgattcgcatgcatggtcagcgggctggccggttgggttgggttgggtgccgccgcggcacgcacaaaacaaaccgtgtccgggtcaaacccacgccaccggccggcgggcggccggggtgggtgggtgggcggctgcggcctccgggcgcacaccgtccgtcacgtacggcggtcgtgcgtggccgcgagccggcggccggttcgatggcggggccctcgtgacctcgtcccgtccgcgccgcgggcatatatacagtagctaagctaagcagtagattttcgttggacgtgctacctacgcaacgcgttcgcgggggcgaggcgtggacttctttttttcgttggtgccgaaagcgggccgatgccacgcgagctagagcaggcggcggcaggggttggtacgtcctcccagcacgcgtgccccccgatcccaatatgcgcccaaaaagagagcgccaatccgctgcccacgccgcttcgatctcttcctttttgtcatattttccggaagaatctggcgccgagacatggcttggacatgattgtatgcaatcagaccatattcgtgctcagccactaacctaaactgagcagaggagagctagctcactgaacaaggcattagcgttaatactaccattacatacttgcatccaccacaccggcgggtaccaatgaaaatacaacggcacagaaataatataaaactgcctctgctgatgaagcgcaacgacatgcatgcacgcttactccacacagttttaggttaccatgccgatccccaggacagatcacgtggagagagagagagagcggggggcctaaactgagcaggacacacacactgcccttattacaacaacaaaagcagatgagctttaggtttgccatgctagtttattcagcaaacgtacgcccccgcccaccactagcctaactaattcggagggataagctataatacggttctaataacaaggagatatggcctagttaattccttctcctcctgccgcttcgtacgaacgatcgagccaatgggccgggggaaccacgcacgcatggacaaaatcccattggacaccttctggcgtgcgattaagaaacctaatctttccataaaaagcaattaacaaagctaagcacttccatagcttctcctacctactgcataatgagggggggagccacagtctgctagtcctcgtcattatttgcgctagctacctggaggacagttattgacatgtgaagacgaggcgggggagagaagatcgctagcttccaactatatactcctatgcgttagccattaggtctatataatactccttccgtcccaacatat

SEQ ID NO: 2829 - DNA, 1706 bp, Zea mays
  misc_feature (1)..(100): optimal_loci_56847_G1, chr2:27580707..27582412, Cluster 16
agtatagtttaaaatgcggtcaggatggtaatccgtcactcactgtagaagagttgagtgtacgtttcacacgatcgccgaataaacggaacaagggtgtcacttcaggggagcgggtttttattttcctctggtgtttgtgccggtccaatttccggtacaccaaactgcaaagtttaaaaaggaaataaaactgcacgtcgcgagtggcgtcctctcacacaaggaaggaaggaaaaaaagatatggggacaaaaaaaagagcaaaggcagatcggtaacaaaaagtcgcccaggccccttcagccaaaaagcctacaacgagattctgcgaggaaagtcagctggcaccggctgcaggttattagcggaaactagtactataaaatatgtatgttacatggaaatactcctggaacaacaaacaacacttgttccaccgcctcgcaccgttttattttattttttttcaaaaaaaaaaaaaggaaaggcaccgaagcttggcgacacgtgacaggctgcctgacaccaggctgcctgcgtgacagtgtgccgtggaccacgcaccaacgtttaacacgttggctggcctgatgccctgatcggatcgtcgcagccgcccaggttgctggcagtacagttttttttaagagagacagcgtgcagtacgtggcaggaggtcctgccgagcgtgtccttccagatccgtgtgatgcacagcgatagtgcgcgacaacaggccacggacgaacggcagcgccacgattgttgttggtagcagtaccattccacactgtagcagcactaccgtaccagatggggccggtctgcacacaataatgcgcgcggggtcgagcgacgcgatgcgatgcaccgaaccgaacctctctcacacacacagacgcccgcccgcccgcccgcccgcgctccgtgctcgcgccggggttggtgatttcctgccaccgccccgccccggagtgggccgttcccgctgggtgccgtctgcccgcgggcgccgccggcccatgcctttttatttagcgtttattaggctaggcacgcgcaggtggacaagcggccgagccacggaacattattgccatggatgtatgtatgtgtacgaccaaatgcaaattgcacggtggcgattcgcgttgcggggaacgagtggccatgcccagattctctggtctttaccagtagtggccgggcttgacacgtgccgacggaatgtgaacctggtcctggtcctcccagcagcagaaatctctgaggcaggctgctgtgattcgtattcaaaacaacattataccctactactactaatgctagccaataacacccgccacccactttactctggtaaactcgatcgctcctccaccgaactgattcctcctgcaacggtcacatgtggcgctctcggcttttgtttgcgtgatcctgtccgcgaacgccaatttgtctcaacttgcagacgagagatcgatgcccctgtccgtcagatctttgctcttaacggccaggatcgcccctggtggtggtggtggtgaatctattgtgcttgtgcgcagccgacgggccccccagggcagatatataataatattccgcctgctgctagagctagacggtaactggagtagctgatgagtcacgctcaaatagcgtgctgcctttacatgcgatcttgattaagttttggt

SEQ ID NO: 2830 - DNA, 3497 bp, Zea mays
  misc_feature (1)..(100): optimal_loci_56988_G1, chr2:28312988..28316484, Cluster 16
taacattaataggacacatcttctagaataaaaccttataggaaactcaactccataaataggtcacttgcataaattagattgttcgtctcgtttaggtgcgaccttaaaatagtgacaacaggtattgaagctctttttatctaactgactccaatacgctataggtaaataagaaaccaaatttttttataacggtgatactgttaaatcttcttataagcgataaatagtttgattaacaaacataccattttaacattcttgtgataaggaatcattattgtagtactactcttttttcttcttctaaaagtcttggacgctccgggcacggaaaaggacagtgaagatgcatttcctccatggcagctggagcccttagaaaggctcgagcggcgagcgccgtgcctgcttttcccacaactgaggccgaaaaagcagccgccgccaatcggcgcgcacgcccgtggtgcgcgccgtttcattctcgggggcgggggcgggggcgggtcgggtagcaggaaagcccgggcggcctggcattttcgttgagagatgcaccgcgccagcgccaccaccgcgtgggatcatatggataacggtgggttcacgaggatcccgttccggcgcggcgcccgtccaaaacccaacccaaagagagctgcaaccggccatacggcaaggcacgacatcacagcgaaggctcgtacgtgtcgacaaaaaaaaaactcgataccgacctctggtttctattgatcggatgagcctacacacggctgcgtctcgaatctcgatcgcctcggtattctgatagcctagtatctgctttgcgctcgcgcgcgctgcagttatcagtgattggacggctgccgtcaaaagtcaaaaactacctacccctcgcgctgcaatgatcgaatgaatgatgtttggattggaatctggaaaccatcgcctttgctttgcttgtgtggtgtcgcgacacccaagccggccttttgatcaaaggccctaattaacgtgctacgcgcttatctccctgaataaaaacatcggtcaggatatctacttttaaactactcggatgatcccactacctgggggggggggggggggggagttcttttccttcatcctttcctttgttttaccgccgtcgttttctctagacgactcgtgcaataagaatctactacggcgaaacatcatactgcatgctttagttttgatcactacgcactctactactctagggtgcaaggctgcaagcaccgtcttcctttcttaaccttttttccttttccttcgattttgggatgccgaatgaagccatggtctggtgctcgcaacttcacatgcatgcaacttggacagaacaaccaaccgtgcctgcagaagagttgccgcctagctctcccaagatcgcatcgacgacagtggtcgggctacagcaagctagggatgccagcgaaagtgcaatctaatctacagggtaggataggatagccgaaattctctaagttccaattccatgctcttggtcttggatgcccagccaacggaccttaacaagctccatgcttaacattcttatatatatcatggctgatggtccaactccagccccgactgcacgcgtgactactgcaacatgcaaataatgcaacttttgcttcgatatatatggtctgctgcactacatgcatgcagcatgcatgtcgttcctgcaaatctcgatcgcgtttgtaatttgttcgttcatggttcaaggcaacacacccgatacgctgttaaacgcatagctggtggctatgagcgagctgcaaatggaatcgccaaacactgctgcctgtgagcgatgaggcttcctgatcaaaccaaatacggaaataccccctttggatgtaatattggagtatcgaattgggaattggaatcagctttcctaaattattttgtttgactgcacatggaattgagatttagaatcagagacctcattcctggaattgaactataactagaaactctctctcaatccagagtcagaccgtacaattacaaactctaatttggtgacatccaaacaatagaattgaaattgtatatcatggttgatttagtattcaacacaacacaattcaataccatacccttcaatatggacatccaaatggagcataactcaattgcagcaagaaaagaagaaaaaataatgaacacacgctagtacactaacgcatggcaaggtcaggccaaaatcgaagcctcaccaccgccattgcctgtctgagactttcagagacgacggcgtgggtggcttccgccgtggcagtatgcgcgcgagacactattgtattgtacgtacgattcaaaagcagccgagagattcataattcagccagtgatcgtcaactagttttgccaaactcttgaggctagttctagctgagcaaggcggcgtcgagaagggtaccggagtgcgagcggcttcgtcctcttcctccgcattgaaccccacagcttccagggcggcttcctccgccttgatctcccgcatgaaggcatccgcgagttcgaagaggaagttgttctccaatgcttcggtgtccgccgcgtcgtccgtgtcctggaggatggattccatcgcttcgcgtgccaaggcagcctcatcggcgtccgcagccgccatctccgcgagctcgcgagcgaaggtgttgaagccaagggcttccaagacagcctcgtcggcgtcagcagccaccatctcctgggctgtttccgcgagctcgcgagcaaaggtgttgaagccaagggcttctaagacagcctcgtcgtcgtccgctgccgccatctcctgggctatttccgcgagctcgcgagcaaaggcgttgaagccaagggcttccgagacagcctcgtcggcgtcagcagccaccatctcctgtgctgtttccgcgagctcacgagcaaaggtgttgaagccaagggcttccaagacagcctcgtcatcgtccgctgccgccattcgtggatgatttccgcaagttcccgggccaaggtgttgaagccaagggcttctagggcagcctcgtcgccagcgtccgccgcgacgatcacatccatgagaacaaacagatcgaggcacgcaacgcaagcgctagcagagcagcgatggatcgatcgacgttcatgggtaggcaggcacctggacggctggaccgccatctgggagatatatatatatatatagtggtgcgtgtaggaatcagtttttgtccacgccgatcggaatcggatcagaatcagattagatcccgtgagcgccaaactgaactgtctggagagaaaattgctatctcaaaactgtcgtgcgcttcggacttcgcttggactttccaagtaattcgtggctggcgaactgccgagagattggtgggcttcgccaatttttggcccgattagatggatggctggaccaaaaatgaatagaaaca

SEQ ID NO: 2831 - DNA, 1769 bp, Zea mays
  misc_feature (1)..(100): optimal_loci_5829_G1, chr1:29680228..29681996, Cluster 16
aaaagcgacctggcatttctgtcaccagccgttgatttgaaaccctctcttgtgtacgtacaaggacagctgaccgaaacatcccggaacgataatgattgcagcaagtcacaggattagcactgatggatcatcgtatcgttactaggagggggtagagagagagagagctgttgcgtgcgtgacgacccaatcttaaccatcccctgactgaaaccacaggcctctgtctctgactctctctctctctcgtgcgcgagtcgtctcgtcacgtatacactgatgaaacttgccgtgccggaacagtttgcgtacttgccgaacgaaacatcatctgcctgctgctggggctgggctggtgcagatcaagtgaatgcataataatagctttgcctagcttgaagcggaagccgagaaagagagcgagctgagcaagcgatttgttgtcgattggtcgggcgggcggaaaagggcagcgtggtcagccagcgacatcaccatggcagctgagaaagttcgtgagcggcctcgctcgcgcgcggcgccatcttccggaaggaaacaagaaaggcaggcggaggcacccgcagcgccagcgccaccggccggcctgaagagtgaccaccccacaccgattcggccgggacatgattgaaaattccgaccaagccacggaaccaacgcgtcatgtctgtcactcgtaccccggcctggatgatgatgatgatgatgagcgatcggtgttcgattagttgggttattatccgcgcggcaggtgacgctgtcatggccgggacgtgtcggctcgggagagagggggaggcgaagggatatgcaaaacaatgagcagtatttcctttgatattggaagggatgagcagagcaggcggaggggacgacgtcatctgcgcctacctaaacactactagtaaattggccggagggacgagcgtggccgaatccatcgcctcgccctcgccctcgtgcgcgtcgccgcctgattgattgcctacggccaaatggttgctgtgtggtggcgcttgcttccccttttgtgttcggttcgggtgcagagttcggtcagcactcagcacctttgttagtttttagccggcaggtttcgagaggccttttgaccagacgatggcatatagcttgctagagcctaatacagcccgcgccgctatggcctactatggtaagtacaaagtgagtcggcatcagcggccgcggaaccctccacatctgtgtatgccagcccagcccagaccagcccaagccggcgctgggctccccgtggcacacgacgtgtggctcctggcccgtgaggaactgaagatgtactttgctgggttaatcctctcagcgagattgaaaatgataaacggcctcgttcggcaggcaaaacccggttctagaccagaaatccttggatccggccctttcactcatccagggtgtgtaactaatccagctacactgcttttaagcagacaatttttatttgtccggtagcaaacttcagttcaaatcaatttcagccgtacacagtgtcacaaacaaatctcggaaattggtacaccgaaaaagaaaaaactatttcatgcatcaatctgagcttgtaatacccatgtccagctctaagcataaacccattccgtctctgtatcacgtacatcatacatagagttaaacataatttaaataacttgtttaaaagcagtttttaggtcgtcagagcgctagctgagtggaagataaaggcagaa

SEQ ID NO: 2832 - DNA, 1835 bp, Zea mays
  misc_feature (1)..(100): optimal_loci_5863_G1, chr1:29790338..29792172, Cluster 16
gtgccccggcccggcccctctcttaatcttaaaataacaagggcgtgtaaaggcacccctcctcattaccaaccttccacattccttttccaaatggtaccatttcccccttttttttctcaaacagcaaaggtagacaccagacaccaccaatccaccatgcatatctcgctcgcgcgaggccttttcccgggagaaaatagaaataatcactgcagtgccagtgcttctactcaagtgcgccacggattttcggtaccggccaggggatcaaatcgacgacgacaggaccgactaccagcaggcagcagcgcatgcagcaggctatgtctatgtgcgtgtgccggcgacgacgggcggcaatgcatgcatggttcctgagatcggatcacagctcacacaagctcatgcatggcatggatatgctaccaccagcgggcagtactgtatagtagcgcccgtgcatggcgtgccgccgaagccgacgacgacctcgccgatccggcctgtgccgtgatgtcacggcacacatatcgtcctacaattagctatatatatccaggcgattgcattatactcatatatattatactccatagcatgagcttgcccattatagattacattgctgtcctaacaagctagctaagctaaggcatgtatggccgagcacaagcacaagcacaagcacaagcacagcacagagctagctagtggcttttcgttctttgccggccggtttcaaagctaggaaacgaaacttagtacaggatcagaaagcacctccacttgcttgcgtttttttggctacgtatcttagccacgcccatttatgaaatcgagcgcactagcgagagcacacattgccacaacaagagtgagctctgcaatctgcatctcgcttgcgattcccccggatggtccaacgatcgcgcactcacgcttaccgctggacgagcgagtatcctaccgcgcgcatatagatgaaggggccggaagaaaagagagagcacgcgtcggctcccactaccactaccaaacacttttttttcaatagtgtaagttgactatataccagtgttctctggttccttggtctaattaactagcgttcggtcctccaatttacaaataggctatcaacgtcaagtgttccaagttttaaaaaaactaattatagaaagtgctcgatagtagtatacatgccaacgcataaatgcctacattatattcaagcaggagtgaacaacaatattacgaatataatattgactttttcaaagtgggtgctcgtggacctttgtttccatgaactgagtcatttttcatggtttgggaaaacatcattagatggcatataaaatctttttcgtgttttttttctcaaaatttttttgcacacttcttttctcgtacagagcctgtttaaacagaagcacgtaccagtatagacatctggttaggtcaacgagttgtggtgttaattctctatgcattatatattgttgatcatctaaactgacaaattttacaagtcgtgttaactttttttaagcctattgcaatctctggtaaaaaaagggcatcaaaatgagatctttttggcacaaacacgaaaatgccccgaagacactgcctaatatctatttctttaaaacacaagtttcatgcatcatgcatagattcatatgtcttgcgcatacatgaagcacgtagagaagatttgtttttcttcttcacatctcgtccaataattagaacgttacaccccgatgggccgtgagaaaataattaggctcaacatgatatgaagccaaacacactgcaacgctccc

SEQ ID NO: 2833 - DNA, 2735 bp, Zea mays
  misc_feature (1)..(100): optimal_loci_6209_G1, chr1:31770067..31772801, Cluster 16
aatgtttgccttgatctgatgcatgagagtgttttttttggggcaaaatatccagtgtaaacccctctttggtgttcatgtgaaagagcccctctcgaaaaaaaaaatatctgtgttttaaagatttggaaatgatatacacttacatagtaataaatctattgacgtatttgttgtaaaagtattgagatgcaaactcagtttagtattcgtatggaattgataaatttcatacgcatatataatagtactccttatttgtattggttggtacgtacgtaattggtagttgtaggtacttagctttatttatttatataggatctattcgccgaaaagaggaccatttttggtcaacgctaagatgtttattcttttgttccgaagcagatatatggtttgtaatgtgttggtcatgatatttagtcttatttactgtcatattctcccctgctggtgcaatgcaaacaaacaaagttatcgattagaagaaaaagggaaggctatataacttcatgaattatatatgtggttgtgccttattaatatgtgatgatttcattatttcttttgcgacgagcacatgaacaaataaaacaactgagcatgatgattaatgatgcatggcgtgtatagcttgcccctgtcaatggtcaagcagaagtatatgtgttatcaagcatcatcatcgtcgattattaatgcttagcgacgtcatatatatatatatacttcttcacgccgtacaggggcgaaggtgcggcacacttcgccatctcttccaacaatatataaacgtatatatatagctaaatactgacacagtagtaccatatatattttggggagcagccgctttcccccctcctcgttcgcctgtttcatcattcggggtctatgcaaacgcacaccacgtacgcacgccagccaaacaccaaaagtatgcaaaggcaaggaagtacttttatctctgggtacgttgctcgcgccatcatcatgccatggaggttgttgttgcaataagtttgtacgcgccagcatgcatgcagacgtatgcagacgacccatggatgtatatgtacacgcctcgctcgaatcccaagcagccaacatgaactagtgcctacggccatgtgtgtcgacctattattactctcgctctcgtcgtgcgctagctttaccgtacgcccggcccattggcagggatctaaagatggatggattatttcgctgtaaactgatgggatcggagtcgttgcttgcattaattattgcgcgatacaacgacggcaaagctagtatatacgacgtgtacgtgtgtttgtgacgggtctgttaacaattcgttccgtatcataattaagcgagtctagctattattttccgtcgagcaatcatcatcatttcggccaagacgaagacgccgccgcctacgtggaaagccgggagacaagcttactaattgaggaaggctctctacgacgtcgtttcatacacaaccgagtgacttgtgttgtctgaatgacaacaacacaacactccatccataaccggccggccgtcttaacaacccgacgttcctgacgacggtgtatgcttttggaaagggatctctttttttttctgagagaaaaccagaaagaaagagattatactagttgtttttttcctcttggctacaacaaactagtagtacgtactgattgtaggaacattttggttacgaattgggagtgctgtttattagcgggcggtcagcggcaaaatcatttggccgaactccaatcaggagaaacgaaagcccgcggcctccatcgagatcgagcacgattctgaacctccaacgcactccatggcatggcatgccagcagtctgacctttttttttatctgacgccggccgcgcgctgtaacttttctctcctgtacacggtattcagacggagcagcggcagtacagacgtctttctcccggcgatgtgcagcacatttcactcaagagtcaagtctgccacacacactcgcctttcgctctggccgatgcaatcatccagctcccctgaagtgacccatcagcccgtgcccggcgcgcgacgctccacaacgcatttctcgggcgccggagacgattgaaaccccctgagatcgacaccgatcgagaggcggccggagccaattgaaaaaggaaaacccggccgggggaaggacgcattgcaatgcggttttaatcaggcggggcctgcgaggctacgtacaccgccacctctgtgacctctgcgccgagcaaggcccctgactctttgtgcctctctctctgcgggacggagcggcgggagaaagaagaaaaggtgcgtgtcatgcatgcgtgctcagttgccagtgagtccaaggtaatggctaatgaatgtatcgccgctgccggatgcggagacgagacgaagaccagcttttgatcaggaaaggagggcgaggctgccttgccacgctcgtgatgattataccacctagcctggtgcaggggcagacggccagtgctcagtgcagtgctcaccggagaagagagagagagagagggaggagctgctggcgccagcgagctccacctccactccacgcactgactttacgttacgtttcgttgctgcggcacacgtagtatactctccatgattctggctttcggatcttttcccccattgtagtagtggtctgttcattctacgccgttgcttctt

SEQ ID NO: 2834 - DNA, 1765 bp, Zea mays
  misc_feature (1)..(100): optimal_loci_62519_G1, chr2:59713786..59715550, Cluster 16
accacaaggaacaaactagcgcctcctaaccactacaccacttgttagtttatgttatataaaagatatgtactataaatatatatactagtaattttaaaataagaaaaaaccatgccgttgtcatttacattatatttcatgaactagacaatacctaactagttactgtacccttaaagcaatggatgtaaaaaataatggtagctttgtggcagcacaggagcagcaggtgcaggccgtactccagcaacgtgcagtacggcaccatatggctgccactgccaactgccagtctgccatagcctgcgctgcgctgcgctgctggggacggagggaggagtgtgaccagagccttttttttcctctgcctactgcggcggcattgctggttgcatgcatgcatctgcacacatcccacgctctcgtgctaccccgcgaccagagcagagcctctagaccccgtgccgtcgtctcgtacgctatcgcccacgggcctgcccagtgctggcagaagccggcagccgacggtgcgcccgtgccgtcaccgcgctgccgtagttgcggtatgctgtatgcgggttcacggccggccgggcgggcggggcctcggcagtcggcacgtacgaaccggcctagatctagaggagtcgtgaatcgtgatcgtgctagcaggcctgctggagattgccgctcccgttttgttgttgttgccttcttctaaaacagccgggccgggcggcacggtttgctagcttgggcggaagcggaagcggtacatgtgctgatgtgcacgtgtacacatgcgcacgctggtccgtctgcatctcagatgcgtgtgctgtgaaccgtggtaccaccagttaccgatggtccgccggccgtgtacatgtatgctggtcaccagacggtgctggctggtgcgtgatcgtgacaggccgcgcggcgattatgagcaaaccgtcgtggcgtcgtccgggtgtgctagctagctcgatcgcctcgttgcttcgattgactgcagcgcggccgtgctgtgcccgagattcctcgctcccgaataatgaaatgagagacgcgcgcctcctcatatgggcaccgccgcgctgcctgcccacgtgatgcgcgcacggcgcaccccatctggccgggctccatccatgcatgactgcatgtgcacgtccaatcaatgctgccatggcggatgcgcgtgcttgatcagtgtctagtgtctacgcagcgcagggtgttcagtcgatcgtaattcctaatttgttttttgtttgtttatttgtttgcatcggtatcggtaaactgatgagcaagggcaagggttcgttgcagatatatatgtgtcgcgtttcacgtcaacgtcagaacgtgcagtgtgcatgtgcgtcaacagtataacaatgtaccactaacaccgcacacggcgaccacgccagctcaaggtaggtacggtagcagctaggtgcgtatatatacgtattggtattgcctgtggaaactggagtgtacaagagtacacacacagtacgcgtcagtacgtaggcgctcaagggtcgccagattaatacaactatacaagcaggggagggagggacacagcaggtagcaatcagcaatcaagcatcgtctgccatgcatgatgctgctataaccagctagctagaggcgcgtcgaatacgggccagggcccaggagaggctccgttctccgttttgttgattgattcatcagccgaggcgagctgctggggtgt

SEQ ID NO: 2835 - DNA, 1663 bp, Zea mays
  misc_feature (1)..(100): optimal_loci_6381_G1, chr1:32753297..32754959, Cluster 16
tattatgtaggagtatagatggagcagtcccactgctcccagcgcagaggaacctcacatcgccaccgacttcgaaccagcagctacatgtgtcactcgtccttggataactacatatatcaccaattctcctcctcgtcacttccggtcgcgagtagcaatggaacatcccgagaatattattattaatgtatgatatggtgtgcctacaaaatgtgagaagcatacggtgcctaggaattgagttcctctcttggcatcttggagcagcttaatgcctttgcttgcagcatttgtatgctgccagggtgatcttttgttttgttttgaattccttcctatcgttatcagatcaccaggaagtgattctttctccttttcgtctcctttttttatcttccatctgcagtcatccagattccagaatacacgttgactgctgggagcaaatgtaggttttttacttgatctggtcaagctcagcaagcttaactaacctggtgaattatgttgagaagtacaccttcaaaatcacagcaagggtaagcccctctagccatgagggtgagcctttggttcttcaagtcctcaaggatcagatcattaccattatggccgcctctggtcggtggcgacctcatcgctctactttacctttccggcaaacggcgatagcatcgttgcgccttagctccacccgtgacagcgtcagtgcgtcaccgccgatggatggagcttgctgaaatccaacagaccaaaacgacaagtggcacaggccctgtagaagcagccggtcggctcggtgaatgccacgtgaagacgtccgtgtgtttacccccccccccccccccccccccccgttagcctcccatagtcccatggtgctcgtcgcgtctggagtctgaaccattgtacgggcccgcccgcgctccaatttcaattcatgaccatccatcccacccgtcgagccgcatcacgcactgccgcacgtctcgactctcgagtgtcgcccacgcggcgctccagcagccccagccggtattcagctgtcatacgtcagttgtgccaaccagaagtccagaacggactccagaagaagctggcaacgaaccggccatactgcctgcttgattggggtttagggcgtgtttgggatcaagactgacgatagaaagagattaagggctcgttgtattttgaatagcaagaaatttaatccctctcaacttcgtctcatacatgtgcaacctaataaggcctaagggactaagatactctcgttattcaattgaatagtaatagaattttagcccttaaatccctctaattctcttgctcccaaataaacccttgatgtttattagttggttattaaagttttaggtcatttttagctggtctaaattttaggcatgttttagatctagttgttggaaataacagtaatttagtgatgaacaaaatgatttcgacaataataaaataagcagcaacatgtttcataaacgcataactcactatcatttcacaatctagtgctattgattgaaagaatacgagaataaccgacagggaaagatagccattatcatagtggggttggtggcgctagaacaacacaaaagtagggaaagcagaacaatgagaacgacaacatcggcgt

SEQ ID NO: 2836 - DNA, 1987 bp, Zea mays
  misc_feature (1)..(100): optimal_loci_64364_G1, chr2:71308912..71310898, Cluster 16
atatatataaagctaactcgagacagtgtaaggtcagcgtctctcccccttttcaaatgagctgaccaaatgtgtagcctgcaaatgttgacaacacaccgccgcaccctatacatggaactcacagtcacacaggaacttgtactgtgcagtcttgtgatgtgcccaaagcagtggctttttttttttggagcggcggtttccttggaagtgcaaaagcagcaagggatagaccgagctaggtctcgtatatatatgaaaagtgaaagaacagtccaagatggaacgggcaaaaaccatagaccggagagtctggttcatgctatatgcatgcatgcctaataatataaataatggccaaaggctctcctctctctttcacctggtcaaaaaccatagaccggagtctttcactgctgctggccgcctctctgggcaacgttgatggaccatgatgcataaatcattgtccaaaaggagaggctctttgttgccgtcaagtttaccagtgtgtatatataaccaataacagctcatgagtagcagactactagcagtggcacgaatatattggtgcagcattgtattgcagcagccagcagcagtatagcagaggcgagaattaagttagtggagagcacgtacgtacacaagggcccccaaaaccaaaaaaaaagctggccgtgctagagtttacatgcatgcatgtatacaaatattcatggtggcctgacatgctccatgtcccctttgatcccagcttttttcccccccacataaagcaaaacccacgcactcggatgcacttgttggatcttgtgcagtcttttcctatcccttttaattttttttcgccctgcgctgctctgcccggcctgccttctttttaccatgctctccagcaaaagctactgcgtgcacccaaaagtgggatttggcatgctatatattctctgtaacctgctgataattaaccaacgacatcactttatttgctcagtagtaagctctcttgacgacaggacctcggacctcctaaatgcagtacatttcttccacacacagagagagagagaatatatgtacatttcagttcactgtactctctccaaccgtagttcaaacagagtacgtattttgtgtaatctgctataaacagtaaatcgatttcatatttagtttctctcaccttcagcaattaagataaccatatgtatgtatatatgggcatgaatctatcatagttgacgaacagcctctccaaaatcagctgagctaataaggtctgtaacaccagctgcaggatgcaggatctctcccaaaatcgcatggcagacaaggcctacacatggtgatgtcatctcccgggcaaaaagagagagagggcagccgcgcttttaccccatgcagacgcgcgccgtgcgatgatttcatgcaggtgtctggcccctggcgccagcagcagcagccagtcggggccgttagccagtgactgatttggagtcaccctcaccccctcccatctttttctcgccactaaggtctgttctctgggagaacgcgcgaccaccctctgcaggctgcagctgcaggtagcaggtagcaggagcacacagcacacactcacacggccggtgtatgtagcatgcagcagagatccccagggaagatagaatcatgcatctttttatggccctgcagcagggagggctagctcttgttgattttttttttttgactagtatgtatcgatcgatcactttgattgatgcaatgcaagggtgagttaacagctgggggcattgcagtctctaccactttgggcaacaagcacacagcagtttttatctatctatctatcttctccatatatacgttccataaacaaaaacaaaaacaaaaatgcttcgagccaatgcaagagatcgatcgatcgagcgacaaattctttacaagcatgcatgcatgtgtgtgtacataacttgtg

SEQ ID NO: 2837 - DNA, 1634 bp, Zea mays
  misc_feature (1)..(100): optimal_loci_6841_G1, chr1:35210711..35212344, Cluster 16
aactccgatgcctgcagaaccgacacaaggcacctcaaagccaaatttcgatgctgctgctattattatttcggtggtcttcttcgcattgctcactctgtagtctgtacaaagcgtgaaatccaggtacccgctctcttgtcatcgccactggcgtttgtttccaccgtccgccgatgggctcatcaggagtcagggcacggccgcaccgcatggcctttttttttgtatgaataaattagttgtcgctaaagcgggcatgatggccgcgggacccctcgtcgtttgtctctgcttcgttctcgtgcatcgtcggtgctgcagacggacgtgtgacactttgctgttaaacttctcaaggagcgtgtctcgctttctcggtgactaaatcatcttgtcggctattcaaaaaaaaaatgtatttgccttgctctgttgatctcgacaacgaccttacggccacgcaccacccggcatgtataaaactaagggaggtgtccattgtgtgtttctcagcttttgttccagtgccacgatacggaggttttctgtagcttgctctagaccagcaagttaattaatcatgcattccccgaaggcgatactcattctttggtcatgagacgatgcgaggctgctgccatgtatgttaggttaggtcacaccgaaaccgagcccctgcctgccctgaatggagtttgaactggacatgtgtacgtgtacgtgcggggtgagtggaactctgtctctagcctaagaagtagcgtcaacggagtcctatcatcacttaaactctgcttgcttttccaatcttttaatttctgcgtctactatacactagtgatacgcttacaccgcatatataaattaaacattataaacaatcgtgaggtatcatcgcaagctgttagtgctaccagttctttatgaaatgggaatagtgaaggccaggaccatccgcgccacttgtgatgtgagtacgcggcggaatacgatgtacggcctaccgatggacgacgcgggcgacgtaggaacaggagaccggacatgacgcgaaacccgccgtgtatgcgtgcgtgcgtagccatgccttcatcactcatcagtgagtgctgcgtgtgggagtggaagatacggatacgatcactgttcatctcgtcgtcagagtccctgctgcacacactggtgcacgtgcacccctagcttgttgttgccaaactggattagctctcctgtgacggcaaggaatttccttgccggcataataagctccaagacacggcataatggaacggaacccgttgcaaccgtgtcgtgtcgactagggagtagagagggagtaatgtacctgctgaacggaacccattgcgtccggtcgcttgctgatgtcattcctcttccggctgaaaatccggacctcccaccgtttggcactgttcgtggaaggcatgggcagctacgcgattgtagggaagaaaggtatctgtccaacttgacatctaacctaatcggctaatcaacacctccccctatccaaaacaaagagggctgctttacttgcaaaatataggagtatattgcgcacgtacgtgcgcgagcagacacgtcagccagccaggccgcgccaaccaaac

SEQ ID NO: 2838 - DNA, 2239 bp, Zea mays
  misc_feature (1)..(100): optimal_loci_7267_G1, chr1:37709851..37712089, Cluster 16
atctcccaaccctggttagggtttcactctctaacagtaattgctttataaattaattcgattttagaaatgcgtttttttataccaaactgtatcttggcggaggacacctggtccctcagtgacacaacagttttcaaatgtgagtttgttaatcacgggcagtagtagaaccccgctggcaaacatgtttgtattgacctcgaaggcaaacgcagcgtacgtaacatcaatacactacagcacaagggacagggcagaaactacacttggagacgtgaagtgttaaaaaaaagggggggggggggggtgagagaaggaaagattcttgtgaaggatgttttgattaagggtagtttagagcccccagacaagcatgtgagtcagttgggtggctccaatggcctgtggcctgcgatgtttttttaggccactatatatttctcagtgctggtgatgctccatgtcccgtggcaagggaccatacatttcctaatgcaaaaaaaaacgttattaagtagtatgatagtatcgctggacgacatgccaacaacccgtgccccgcttcctccaaccatcgtctacatacatggatggttttctgaggactggaatactgcccatttgcctgcctgccgtttgcaacttgcggatttaaataaatctccctgcttgatcactcgcaacaggtcacgagtacggatgccaaactcgcctcttcctggctgcgtccattctgactctctgagggcacagaccaggccagcatgcttgtccagttggttgacgggagtaactaggcgatcatgtgagagtcgatcagtttgtttttgtttcgacaatccacagaaaaactcgctctgtagtctgtactgcacgcacttgagaacacgtacggtttcaatatcgtgtattttttgtgtacggcttgtggtcagaaaccagattgcggtctgaatataccaaatggctaagctaaacgcgggaataaccttttaaacgtggatgggaccggacgctcacgcagtccgcgcgcagattatgttgctcgtccagaacacaggtgacactactgtcctgcggcacaccgcatatgttacgacgagatgagacgaagacgagaccactagttatgcttgagacaactggctgttgtggggaatcagatgagacgatcgatgacggcctgtaataatcaatgagatgggctacgctaacactaacaccacgcaaatcgcaaagaccttgtaaacgtgcacgaggaagaagaacaacaaaatccctgccatagagatcgagtgcagtgttggatcggggcgggcccgtgggccttcgtgggcttaaagtgcgctccgtatgttcctaaaggccaacacaccgttaaggcggaaagcccgcgccaagcccaccatgcggcagcagcgcggcgtcggcgtagcctaagcacatggccggccgggtcacgactcacgactccggagcaagcaagcagggttcctgcgttgcgacggatcatcggagaaaggcaaaaggcgagctcggaagagatgaactcaacaaccagaagtactcctactagtagccttagcactgcagcgcccttccttccgtggcaaggcatgcatggagccaaagtgcgcggctagctaccatagcagcctagcctacccaacgtacgcgatcttgatctcgctccttgatctttttcttcttttcttcctctacagggtgtgtgcattgcatactgaccccctacatatatacacaggctcggccgtctgtttcggtggttctcgatcctgcaactgcactgatgggtggtcggaaacaaatcgactgcactcactgccgcccactgcttctggtctggtcactgatgacggagaagaagggcggcgtgccttttcgctgcatgcagatgccgccatgcgttgtgcgtcaagcggccgtgacgcgctggcacatgcagcggccgcggtgcggcgcgcaacggtgggatctgcatgcgaaactgcaagagtagatgctgcgctgcagcttggtgttttatctctttttgtctcactgcgtcaataatggtactagcatatcaatatatcatgctgttttatctcttaccctgtgaataccgtaaaaaagttggcgttgttgctacggtgttgatcgtttgagagacacatgtaaatatgctgttgcgcatctagtaatagcgatctatgatcatctacatatatgttat

SEQ ID NO: 2839 - DNA, 2059 bp, Zea mays
  misc_feature (1)..(100): optimal_loci_81630_G1, chr2:179985424..179987482, Cluster 16
ggacgtgaatggcaaaacaatacttgtaatttgaagtcaagatctaatgttttgaacataatgtcatcaccactaagctattaaagcatctttgtttataagaaaacaatatcgtctgaccctataaaaatacatttactaaggtataccgccataacaagtccttaatttgcccctaagtatgacctgtcgttctatccggaccctgccgaagaagggccctctttttgaactgagtcagtccgagtagcctaatcatttagcgtgttagaccttatttttatttattcagttttatcaaataaaccaaattcaataatctagaatcgagaaacaaattagatagggagacggtagaaatagatctaaggagtcaacaagtccatacatgatccattattgtcgatgccctcgccggtgatggcggatagctaggtgggctagagtcagcgctgactacgagcaccttcccccatcaagttggcttctttgttggtgtcgtcaggtgctcgaccttctcttacaaggtctgatgcaatggctcgagagctataaccagtggttggggatgactagggagcgggcagcatgcacgagtattgagtgcggcgcagcgagggagggaaccaaggcacgactcgtgagtgtggacatgtggcgtgaggagggaggggacgagcaagagtagtgtgtgtgtgtggcacggagaggatgatgtttgggttagagtcattgtagttgcacaagatctcagatgagcatttgacctatttgtgatgatcgggtcaaaccatccaaatagatcagtgtcgacgtttgactctagaattccatgtcaccaagaacgctagtttcacaagttgtcgctagatccagcgcgtgacgatataaaccgcttgtgtagcattttcgatggtcgatatcgaccaccactgctccctcaatcataacatatatatatatatatatatatatatggtctattctagatatcctccctcacatctatcggtttggcctcattcttgtcgacatccccgagacctgatccgccccgatgctcgttcccgacaccgcttgctgccgccactttctcaatgcgtgatgcaacccaaccctgccccactcgttgttgataagacgtcgacccgcctggcaggctctatcttgctcgccgtgacgatgcaaccggaccccagcgatcggcgagcttggcaaaccaaagagcactaactcccggagacgccacatgacctataggactaggcatttttcacataaaccaaaaaatcaaaccaaactttcggtgtttaggtgttcatttatacgtgatgtagtgccagtgcgtgctggatcgcctttgggtaagggaaaagcctggtctccagccgacgcgctggcgctgctataggcgcggccgccatggctgaggcctgagggggagaggatgtggtcgtgctgtcctgtgtgtcgtgtcaggcgcacggcctacataacagctgcgggatcggagcgaccgctagctataaggcggtggcgggcaccgggacgatggacccaacatggcgacgtgcgtagcgtaggctaagccccgtgtcttcagcagctagccaggcaggtcaaacaaaatgttgaccacacgataagaaaagactagctgtcagctttttttcgaacaagtgtcatacttatatgtctaaatcatgcaagattgcggtgtgtgtcacggcagcggcggcgtcgttcgttgaaccctagcggcttctcccctggcgtcgacggggagagggagaaggcggccattgcggcgccggcggcgcaccggatgtatgagcgactcctggatgcgcatgtctcctgcctccgtgtctagggcggagcaaagcacgcggcccactgttgtcctattgacttgcctggcttgggcctggctcctctaaacgggccttaggccacagttagattgcaggcaggccagggtttccctctctcgctcgatgggccggacatcgcctctgctcgatgtcgcgtaaaaaccttggcagcgaccgccttagcc

SEQ ID NO: 2840 - DNA, 1951 bp, Zea mays
  misc_feature (1)..(100): optimal_loci_82593_G1, chr2:185012964..185014914, Cluster 16
cctaagtcgcttggcagacggctggttggttagcgagctgtctttgtgaggccttctagaccctctccgcccggtttctaagtacaaaactataactatatatatatatatatttattatgtgtttgtttggtgttacaaatattgatatcttttttatataaaaaatgaccaaagataaataaggcagcagcagaattgatgtagtttttctactgtaacttccggcgggagcgtgtgtgctattttttttttaaacgctgctattgcacttcagccaaatagagtaattgatacccacctgttcgccattactaacatctttcaggacgtccacgcagcacagcgatctgcaggcgggggcggaggcaggtgaacgcgaaatcctaggtggcgtgatcgcttataaaaccgtctcaggcgtcactaacgtggagtgtgtcagtgtcctcgtcgttgtcgcgcgctgcgagctgcggcgacgcattgcgccccgtccgtccgttgtagggaaaggccggaaagacgatggagttggacgagcatcattcatcagtcatcacactgtccagctgataaatgccccgccgagtcctgctcctacacgggctggactacaggaacaggatcagggacgctgcgggatgttcaattcaaatgcgtgcatgattctgccatgccacgagagcacgccgcggcgcccacagcagaggtagagtagagatctgtttcgaaacccgtcgcagcggacgaaatgacatccgttgcttgctgcgctcctgaatcccacgcggagaagaagggccgcgcgcggcagtcccggtcgtcgttgcaggcgtgcacatgaacggcgcgcccggtaccagtgccacctcctcctgcctggcgctgcctcgttgaccatccgcacgcgggcaacgaacgcgtcgccgtggtcgcgtcgaggcgcatcatgcggcatgctgcggcggcgaggatgcgaggcaggcggctgcatgttaagcctgaatcaaagcgccgtggccaggagccccgctgccccggatggcaaacccgtattttgatgatcaggctgctgcgccgccggcgtgccgcgctccaggcattggtacacccgtttcagcttcaaacacgtcgcgtacacggatgtgccgtgcaccctcgtgtgacctctaacaggagctctagaggctcggtatttggtgggacaacggagacgtcgtttctaacgagtgactctgtgaccgtaaaacaacacgttcctggttactcgtacggtttcatcctaagccaccacgtatattgattttgtgcgaacatcttttcagttgcctacacgtgtaagacatgagtcgttgcatgagtgaacataaaacaaatcattttaagctatttggttgcatccacaaataggaccaaaattaacatacctagccgaccaggctcgcgcttgcctgatttgatgtgcttagtcatccaatcagccggattatggaattagattcaccaaaacagttgtactctataaaaattttgtcaaaaactacgtctccaccaaattcaggtccatcgaaaggatcaatgagggctagtttatccggttttatcgtggagatcctcaaaagatgctacacatgactttcacacgaggagtgaaagttggttgaaaattacccaacacaaccactaaattgagttggttgaaaattacccaacacaaccactaaattgtggagatcctcaaaagatgctacacagaatccactttcacacgaggagtgaaagttggttgaaaattacccaacacaaccactaaattacgcagcataccgtttcattgtcaggatatcataagaacaaaaagggttatatatcgttaccattagacatcgtgcagcacatcggaataagaacacattgacgtagtggaattagtcaaacgtccttgcata

SEQ ID NO: 2841 - DNA, 1757 bp, Zea mays
  misc_feature (1)..(100): optimal_loci_82665_G1, chr2:185430453..185432209, Cluster 16
gttaccaccaaaggtttcctgccctttgcgccagaggctgatttctgggtgggtaaacacggtgcgccgaaaattgaaatccagatgcttgactggaaaacgcagcgtactgatgccgcagcgggtgtaggtctggaaaactggaaagtcggtccgggtaaaattgatatcgcgctggttcgcgaagatgtcgatgattacgatcgcagcctgcaaaacaaacagcagattaataccaataccattgatttacgctataaagatatcccgttatgggataaagccaccttaatggtaagtggtcgttatgtcacggcaaacgaaagcgcatcggaaaaagataatcaggataataacgggtattatgactggaaagatacctggatgtttggcacatctttaacgcagaaatttgataaaggtggcttcaacgaattctccttcctggtcgcgaataactctatcgccagtaactttgggccgttatgctggcgcaagtccatttaccacctttaatggtcgttattatggtgatcacaccggcggaacagcggtacgtctgacttcgcagggcgaagcctatattgggcgatcatttcatttgtagctaacgcgattgtttactccttcggtaacgatatatatagctacgaaacaggcgcccactctgatttcgaatctattcgtgcggttgttcgcccggcctatatttgggaccaatataaccagacaggtgttgaactggggctatttcacccagcaaaacaaagatgcgaatagtaataaatttaatgagtctggttataaaaccacgctcttccatacctttaaagtcaataccagtatgttgacctcgcgtccggaaattcgtttctacgccacgtatatcaaagccctggaaaacgaactggatggcttcacctttgaagacaataaagacgaccagtttgctgtcggtgccccaggctgaaatctggtggtaatggaacttaatgaaaggaatattacgatgaatataaaaattgctgctttaacgctggctattgccagcgggtatttctgctcagtgggccatagcagcggatatgccagccagcccggcacccactatcccggtgaaacagtatgtgactcaggtcaatgccgataacagcgtgacctttcgctactttgcccctggggcaaaaaatgtctctgtagtggtgggtgttccggttccggacaatattcacccgatgaccaaagacgaagcaggagtctggtcgtggcgcacacctatcctgaaaggcaacctgtacgagtattttttcaatgttgatggtgtacgcagcattgatacaggcaccgcaatgactaatcctcagcgccaggttaactccagtatgattctggtgccaggcagttatctggatacgcgttctgttgcgcatggtgatttgatcgccataacttaccactccaacgcattgcaatctgaacgtcagatgtatgtctggaccccgccaggatacaccggcatgggcgagcctttgccagtgctctatttctatcacggctttggtgataccggacgttccgctatcgatcagggcgtatcccgcaaatcatgataacctgcttgctgaagggaaattaaacgatgctggtggtgatccgataagaaaccgatgcgagggcattattcccgagattcgtgctcagaaagacgtaagtcttttttatccgctgatgctaagcggcagaatccgcgaactgat

SEQ ID NO: 2842 - DNA, 1648 bp, Zea mays
  misc_feature (1)..(100): optimal_loci_86657_G1, chr2:208940291..208941938, Cluster 16
cccgcaaccaaacacactcttagtgtctctaaagaacagagacgtctcaacgttgcatccacatagagccaacgtttattttttatataatattcaatcttttatttgatgaaaatattacaactaagactcttaaaatgatatatagaataatataaaagtagtatataatcaaatgtactaaaaagtcggttgcatgagaaaaaaaatagcctacccctgtcttgaacattatagttatggacattatagttagttgcacatgcgcggctacgaatcatatatacattatatggtggttttatttgtacaacataaacaaatatgagttgtagtggttagatttgagtgctcactttgtaaagaccatgtttcggaatcctagaaactcctggtagccagccacctacactacacggtgtgcttacgactacaggggtttaggccattgcattgtttacacatgctgggtttcctccatcacgttgtcgcgttggtcaagcacacaagggcaaccctcctccgcctctccggcgatcgggcggggggggggggggggggggggggggcatttgtctcactgggtcgcgagtcgtggatctggccggcccggcccccacgcgaggacaacggtgatggcatgggcgcatggccctggtcctggtcctggtcgtggtgtctctgaacaaaacaacccacaactttaccaaccatcaggctgctagtgctagctgaaggacaggcacgctgtgcggctccacttgtgcagtgcatcgatcggaggaccccccatcttttgtccttggtggcgcccctccgggccctccctgtacgtgttccttcctgtggctgtggcagggaaagtgaaacgctgctcgcgaaaatcttggcggcagctctagttagacggttccacgcaacgctctgcgtctgggtagagcagtacaagctgggcagggccggtttccttgcaagcatcacctccccctgtgcagtagtgccagtgtacttttggtgccttgccaagatccacccattacattacatttttcctgggagcggcatgggcaatgggctccatttcgtagggagggacacatggacatggcgtcatgctgccgtcctcccggcccacagcgacatgtgcttgattagactgggtccgctttgattagggctagacagactgctgtactccatacaataagcactcttaggcgcctcgggaattggaaccaagcggctggctgcaaacaaaaccgtcgcagccttttctgcgtagcggcgtgaggcgccatgatgacctcgttcgttcgttcgtttagagttatgccgccttctgcactcacaattgcacactccaagcacgcacgccatgactcaccgctttgctctctgttcaccagctcactactggcagtcgtagtactggccagtggtagtgcatagtgtttccttccctcacacactccagtagtgagtgccctacagatctcgctacgttttaccccttttgcaatcggagcaccaaagcgcggcacgatcgactaggcctacgagctacggccccctacgaggtagtacgcgttttcaccatcagtcgtttccttggccttgggcgacacgagacgagaccccggcggcagag

SEQ ID NO: 2843 - DNA, 1493 bp, Zea mays
  misc_feature (1)..(100): optimal_loci_89320_G1, chr2:223395433..223396925, Cluster 16
atgattaacatgtgtattctaaagtgaaattgagatcacaaggatgaagattgattggcctatacaatattcatgctctattgatagaagtcacttctcgatttgtaaaacaacgagcaaaaagttaaggatgaactaattttaaatgtcacacatagattagcgatgtttttttttaatcttttctttaagagtactaaaatagaaataggcatcttgatctaagtaagtttagtggtgagcagcgatgcatatttatgaaaatctagtgctaggtaagcctacaaaagtccataagaagtttgatattaatcataactcaaaaatcgtttaaaacaagtgagttggtgttgcaacagagataccaaatatgtttgatggacactggatatgtgccattggggtcaaccttgtttagatcggagttaactctacgcatcggtatgatgtacatgtactatatatgacacctatagagctatgtagacgatcgtttgaggtcatacatttatcagacgtgtttgatgtggcactgtatatgataatgtacataatttctagagagattgcaaactgagtacgagacgagtatgagaggagagagattgcaaacagagtgtgagaggatgagtattcattgaacccgcttctcgaggacccagagcggcgcgcacggagtcgaagtgaccggtttcgggacgggcctgcaccacgtccggtacctcgtccggtcgtccccgtccccgtcgccgccgacgacccagcgacctcgttggcgcctcgctgacggctgacctctacccgtaccattactacttacagctccaggcgctagctgtggtcgagactcttcgcggtgctcccggcgcgggccacgcgcgtcgtggtcaccgtcgacgtgggcgtgctccagaacgaggaccgtacgccggagcgcgtggcacgcatgcgcgcggcgcttgaggtgctggcgcgagagacggacgcgtcgcccatggcctgcgttcaagagagcagcgcctgccggtgccggtgtgctgcgatgagtactcaggtgggggcgatcggccagcgaagcgggtgaagaggttcgctgttgcagtcgcagtcgcagggaagttgtgcgccatctgccacgagacgctggagcgtagactcgcagcgtggccccgctgctcccacgtcttccacggcaagtgcctggagcagctcgtcgtcacggggcagcgtcgctgccctatgtgtaggagactaggagtacgctgtcaatcaatgcatgttcgattgatctgaagcatgaatttgctggttgtatgtagcagtaacattttcttctacttctatgaacctttaatttcacgggaacagagagattcgggaacaaccagatgttctaattgctactttcaaaccatgttcgattgatccgctggtttcgaatagcctgactgcgtgatcattgaaccgctcaacggacctaacggttgggttga

SEQ ID NO: 2844 - DNA, 1647 bp, Zea mays
  misc_feature (1)..(100): optimal_loci_92455_G1, chr3:2150008..2151654, Cluster 16
agcggatgcattgcattgcatgctctagtagtggcgtagctggccgatcgtcatccagctagctgaggacgtacgtacgacttgcagaaaagaaaggaaacatgcaaaagtatgcaactactacgggatgcaattgtagctctgttaattaccctgctgtatatatatccagtatgcttatatattgcttaattcttgaaagagttgaattacatatgtaggaataaggttttgtgcgggtgcatagatctctccattgtccaaaaccaagcgtagtaggtcaatgagcacacagcaggctaggcacagcgcggcatcagccaacagggccttcaaactctcaacagtacgtgcagagtgatcgagcgggggagcgggcagacaggaagcagagctcggagaccgcccgtgcatgtccgtaactacacagcgcacatgcatggtgacgactgatgagcgtcacatatgcatggcggaattcctcgacgaacctctgtgtcgtctcgtcgtctttggccgtaggaccatgcatgcattgaattcaaacgagaaggagtagggccggcggcacccgttttgaaaatgaaagctgatgggttccccgatccacaacatcaaaccacctgcgtgcgtgcgtgcactatgcagcgagctagcgcctagcgaacagcctagcatcgtccctgttcagcagcagcgtgtccccctctatatcatgtccgagaccccaacagcagctgctgccgccgccgactgtagcgtggtacgcgccgcatctacatgcatgcatcacagaaggccagccggccggccggcggtgcttgtagtacgtcacagctagcgatacgtacacatgcgcatgcatgcatgcatgcatgcatgatacacgtatccgtcctgcccccccctgctgcacacgcgttacagctagcgatacgtacacgtacgctagctcttgtgtgtctgatcgctggagatgatgtggcacttcactagccagcccagtctgcccagagcccgtctgtatggatggattctttcagctctagcttcttaatttgacatgcgcgcgcagcgcaccatatgcatgcgtagcgacgcgcgcgcgctgtttcaacactgtttaatttgcaggagttgttcaagttccggccggctagctcctcaaacgttaccgtagcggctgaacagtacgtactagaagaaggcaatgagttggagttgacgtgagctgcttgcattggactccctcccggacgtgacgccactctgactctattagctctctgctctcgtgtcttcgtactagtgtgcatgtgcagcgtgggacaggaggaggatgcatgacagtcatttgatgcccagcagaaagctatggacaaaaaaaaaatgccaggtattttagactgtaaaaagctccgatccgttcgttctcatcagagatagtggaacctgcgcttcgcctttttgattgttattgtaaaagctgtgtgtgcatagcctgctctgggcacgtttggatccctagctagctggattctggacgaagctagctttcacggaaacggaatcttggtatccggaacagggctaggctggctggcatatgtaactgcgatgcaaagctgaactggcgatgcgtgcatg

SEQ ID NO: 2845 - DNA, 2002 bp, Zea mays
  misc_feature (1)..(100): optimal_loci_92573_G1, chr3:2626286..2628287, Cluster 16
tgtacttgcttggctatatgcgtaagttaagtatgtcggtctattaaagtaataacgtcggtttatgacctaaaccgacgttctttaatagtatatcagagagataaaaaagataaagaaaaagaaagtcttttacaagtgtctgtccagagacgaggctcacgggacaggaccaccgcgagcacggaaatatatagtcaaacgaaatgtccctccctcgctcccctggagattatgactcggaatcatgaggtcgcctgctatttggtgttatccctgcacaaagggatatgctagagagtgagtgagagagacagagcaaaaaagacacaagtctagtgcatgcatgcctgattatacagcacctccgtccgtccatggatgtccgcctttaaattttattttgcagggatttcagagctttgtgtttggaatgcatgattgggtttcaagtgcctgagagcgcaatcgattgcaacccagatgcccacaaggctaaactatcaactcaagtggagtgctgccttgaatttgaaatggcgtcacgcacccagatggccatcagcgtgagtgcgtgcgtgttacagattgcgcgtgtcgccgctacagtagcgaacgctctctagtactaggcaattcatggagggtggtggtgctgctggcctgctgctgcaccggcggtacggatgcatgcgaccagcacgaggcttggtcactcatgtaggaagcactggagcagcgggagggggaggaggacgaggacgaggaccgaccgggcggcccgccgcggcgtcagccaccagcagcagcgcggcagcacagcgttccgcggctcgggaaggcttagcttgttgcgcactcaaagcctggcggccccggccccggccccgagcacggacaggcacgcggccccgggagcgggcagccggcagcgtacggcgcacgtgcgccgcgtgtgcgcgcccccgcctaggaaacagtggtcggcacgcctggccaccacacacggccgggcccggggccggggccgcgacggcgacgccacttgacctcacgctcgctcggtcggcctggctcgccggcgtgcagcctactcctccgtctgcccagcgagtcgggtcgagagtgtgaaacgcggcccgcactcctcccgtgttgttttgtttggcgtcgcgcgcgtgtttttgctgctgctgctgcggcggcggccgtcggcgtcgtgggtggcgagtgcacacggcgtggtgtggggcggcggggccgtgtacccgtgccgtgccgtcgcgtcgcgtcgtttggcaagccacgggtcaggctgacggtgacggccgacgctgacgaatccatagacatagccatagctctaggttgccgcggtgtgtgctcgctctgtagttgtctgctcccgttaaaatttcggacgagacttgaggcgacgccgccctcctcccgtcctccgtcgccctgtccctgtgcggactgacgcgcaggcaggcattccgggccttgggaggcacacacctcgctcgcaccgctagctagtactgtagagagagagagagagggcagtggcagcagcgcaggcaagcaggcaagcaggcctaggcggctaggctgctatggcagggcgaacgcggccaacgggggcgagacacgagggcgtgcaggtcccgatggaggggacgtgaacgtgacagacggggcttcccttcttccacaatgacccaaaaaatcctcacaatctcaacgccagaagccgtcgtcctttcgcacagtgagcctagccgcgtagctaggacggtccacgaaggacaaatacagtttgctcgtcttctttgccccccataccaccggcttcgcctcgccgggctggctaaagttggtttcgtaaagttgtcttcgttctcggtgggtcgacccctcgcgcgcgcgtggtggggccgccccgtcggccggcgacgtccccgtccgccgctcgtctcccccgtcgagagattccgac

SEQ ID NO: 2846 - DNA, 1626 bp, Zea mays
  misc_feature (1)..(100): optimal_loci_92613_G1, chr3:2758527..2760152, Cluster 16
ttggctaggaatgtgaagataccatgcatgaatctgctacgaaaatctagtgattcacaggacacaatagatcatacatgatgtcacatagtttggccctagtggcaactttgccagggttaattatatgattgaaagaagtgacggtacgtgcagccgtaaggtatcactgattgaaagagggtttgtcaaaccctagaagcacacctagaaagttaaaggtagggctattttttaggagcatgtatggagaaactgtgcatgaatctgctattcagacctagtaattggaatgacatagtacgtagatcatacatgatgctgcacagcttggcaatgaccttgccaatgattatgataggattagaagaaatgacgtcgttgggtacgtgagagatctgtcactgattgaagagtgccatcaaactccgaggccatgtttctttgagctgcaatttttagagctattctgaaaagctgctgctgaattttgatccccaagaagctaatgatagcttttcgatgatgttattaacttcctaaactcaagaaatctataaaatcaggcttctcagctttccacataaacccagcttttctgagctccgggtttcaagaagataaaccaaaaagctagctatttgtttcaacttctgtcttttcacactaagaagatgccgagaagctcaaacaaatagggtctaagactgtctccaacacaaacattatcaaacagcttcatctatagtgtggcgtctgatttacactatccacgtaagacagcctaaggctaagagaacacctagaaaatgaaagttagagctaagaactaccaaccgtttgattgcatgaggagggcgagtcctctttaaatattttttttttcagaatcgtctatctatcccaaactatgaggttttgtggtgtactctctctaacatgaaaatgtaacaaaaaattatccaaattatgagggaacgtatgtgagttacctgtcatttgtgtattatcaactcaagcaccaaagctattaagcgatagtcacatgctcaaatcataatctgctctaaaaatccatagtctgaattcaggacatatccatgcttcaaagaaaactgctgttggtaaaatggtatcaccacccatgctattcatgggctcgtaccgggccagcaggcagccatgcatgggctctgctggcaatggcagtggcacgcaggcgcgggggccgcccgccgggaggcacggccgggcgcaggctcgctcacgtacacggtacacggtacagcaaccaaccgcggcgccgctgcatgcggagccccggcccggccggcgggaagactgcgcgacgcgcggcgccgctggcctctgcctctgccgttcacgagtctgccgtcgtacgcggccgcactgttacccgatgcggcctgcgcgcggctactacagccatagctagccagtacggcgccacggcgaccgtcgcctgctccgagctctcacgtcgccccgtcattccagccgtctcctcagctccctaagacctgcacagcctgacggccaggtcgccggccagacctgcagccgtggccatgttctggttctggcaaagtggcaacgcaaaggccg

SEQ ID NO: 2847 - DNA, 1753 bp, Zea mays
  misc_feature (1)..(100): optimal_loci_92791_G1, chr3:3554339..3556091, Cluster 16
gggacataaaaaccgggcagagcaacttgaagggcgtctcgtatgggtgacggattcgcatcctctctttctctttgtgtgtgtgtgtgacgctgcctaggtttaattgtatgttccaacagtgtgggcctgtttcttccgagactgaaacttttatctacacagcatttatatacaacttgcttgtgtgggcctgcgcgctgtaacaaacaaaggagaatgtttcgtttaaggccaaaagaaaaaaaaagttcgtgacccgtatatatatggcggtatatatatggtttcctaaccccgtgcacctggtgtgatgaccacaccttttgcgtacgcaagttgatgccctggttaattaataatatgcatgcatggagatgattgtgcagcgtagcaatatacagtagcatatatatagccgtagcatcttggaaagctcaactttggctcgccgagctgctctttcttgttgctgttgtgaaaccgtggtggtgcagatgataagacgcacgtagacgtagggttgcgatcctatgtatatctcccccatcgaatgcagtgatggatcacgaactcgagacgtcgtcggcgccatgccgtagccgtagccgtagcttgggccacgtagtaagtatgttattgtagggctaccatacagccgttccgttccccagtagaaccctacgtacgggtcgggtgtcgcgtggcgtatctcctcacgaactcgagatgcgcggctagcggtggatggatggagacgcagacgcagacgctgttcccttagaggtggcgctcgcaatcgcaaccgccttttatcttttctttttctttccccggtcgcttagcttgcttgctgcagcgggagattattccacttggcagcgcccggttcggtcgtccgtgcgtgccttgtggatcgtgctctgctttgtacttggcacactcttctttccttttcagtcgaaacggggaacgcctcttgggcttggctcttgcttctcccccgacgcgagcctctttgatttggcgtctctttttccttctcccccgacgaaacgggaaccctgaagtgagccggtcgggccacgggaatccgcgcgaccggacgcggcgagcgcacgctacatgattccaccacactcacacttcgtcttcatcccccggccgtggccgatatgcgctctgattggctgcgatggcgagctatgttaagttgttgtgaaccgatcggtctctctcgttagtctacgcttgcattgcattgcattgcatgctttgggcgtgggccggtatctggcactctacccgatcagattagcggcgcccgacccgaatcagatgccgtcacgaccacgctatccgacctgatcccacaccagtacaccacaccgcacgggacctcggcctccttccggggaagcgacggggcgggcggctgcgggccgttgcttgggctcaattagcctggcagaccgatgcccgtctgctcgagcttagcgacgctgcacggacgatacgggccggcctcagtacagcacagtacagtgacagtaataatgggctgggccggccatgcgaagtcattgctggagagagaagaaccgaacggaacggaacggaacggaggaagggccgagcgggtggggtggcgtaccgggaacggagaggaaggacagcatcgcaacaataagctacgcgcggaggaggagtcagcggatcctggtgaatctttctggaagctccaaccgcgcgg

SEQ ID NO: 2848 - DNA, 2248 bp, Zea mays
  misc_feature (1)..(100): optimal_loci_92958_G1, chr3:4670333..4672580, Cluster 16
atcggactattcaaacttgttacagacagtaatcaagtgtaaaccgttaccgttaccctttacgttacatttcatgaaccaaacaacacctatatgtctatacatctaaacaaaggcttagcctaccggactgttttccaaacaaacccgggactgatgaaggattgaaggtcaatggagttgcagcaacgtgcaagagaactcgagaggccagtgttggatggagttattagtgcagacctgtatgagctttgagctggaagctgcgtcctgcgtgtatatttcacgggaggaccgggagcgttgcacatgcatgctgcatgcaacctcgctgctgctgcctgctctctgcaccgcgtgacaatgcaagaacgagcaggcgagtagctactacgactgcactgcacactgcagtgcactagtgctgctgctgctgcatgcggcgcctgctcgctcgcgcgcggccggatcggaagggatcgggcatcggacgagagcgcgcgtccttagctagccaaacttgattcgctcggtctcggtctcatgtcgtctctctctcacgtgcatgcatatatgtcgtctctctctctctcgtgcatgcatggacgaggacgaggacgatggcatggtcgtctcgtggacgacgacggatcccagcagacactgacgagcgatggcacacagtctctctgactctctctcatcacatgcatgcttctcttcgtctgatacctccggcctctagccctctactcgtacagtcgtactcgtacgtaggaggacgacttggacttcaaagtaacgtaccgttcgctgtgtgtgtgcatgccgccgcgcgcgggcgagtctggagcaacaaagttgtttgtctcttgttctgccaccttgttttgcttgtcttcttcttcgtctggcctcctcgatcgacagtttgttagaactgaggttaataccctacgatcgacgagactacgactacgtaaccataatatgcaataatcatctacgtatatatcgtccgaagccgaagcagacatgcatgtgctccgtgctcgagcttgagggccgcctactaggcgaggggggccagtactggctggcctggtcgctctgcaatgcgaatgcagctagccaattccatagatccaatccaatccggccggcctgcaggctccaggctccaggctccagcgctgctccattcatatatccatccatctccatgtgctccaaggtaagccacccctggcctagctacatgcttgttggtacacgacaagccacacacatgggccaaatatatgatctcatgtcgtgtggaagcaattacgtacgcaagtgatgattcattcggctgttgcggctctaattaatctcgcagcagcagcagccgcagccgctggtgatgttggacgtacggacccatgttatcctgttttatcctatcgatcgatccatccacaacggtatcagattttgctgcatatacatgacctgtctctgatgctctgatgatgctggctctctctcctagctagactaatgtcgttggcctttcgtttgatcctactactaccagccagtcgcatgcatccaaatccaagtaagctagtaataaggcactgctaataaaggaaggctttgcagtacaataagcgatggatgccatcaaatagataacgccaccttcttctttttttatttttttgctttgctttttaaacaaacataaaaagtccatcgaggtgcgcgccggcgccgcggtggaggcgggaacgagcctgccgttacccgccaaattttctttttaaccgggcagggagggtgaggcggccggccccgcggcgtcagcaagcttgctccagctgcgcctgcgcagcgagagagatggtagttggtagcctgcgcgaagggcccccaggcgcagggacactgcagcgaacaacagcacagcttccgtgtttaattctgtacgtgtatgtctgcagtgcagatgcacttgacttgaccgccccccgccccccccccccccccccccccctctaccgcaggcaggattcaggaggatcggtcaaccaagtttaagaaagattaataataacacacgccgtagtagtcgtagcatggaccaaaaacatatgtctaagcaaacagtggcacgtctagctaggtttatgatgtggcgagttatgatcatgaatcaaacattgttctaatcccgtacaatgaagttcgaagtaatatacca

SEQ ID NO: 2849 - DNA, 2475 bp, Zea mays
  misc_feature (1)..(100): optimal_loci_93314_G1, chr3:6000208..6002682, Cluster 16
caaaatcactatgggagcatacacgagtcaaagatgatgtgagtacatggatgacgtgacgtgttacccacgtacttaactgtcactaggtgttatgtattgatgtcaacgaggaatttcctaccagggaacgactctccatccctgccccaacgaggagaaaaaatccatgtcctgtcccttcgaaggctcacatacatcgctttctcctatctccgtcctcgtgaggattccatctcttttaggaaatgcaatgtttaaagacaactccatgatttggttgccaaacaattaaactccatgaactttgttgtcctaaaaaaacgtagagttagggtaaactccaccatttttagtggagcagcaaaagaggtattccataaagcttattttctgatataaacacgaagtttgggttaattacccacaaatgctactaggagaaaataatgttttgtctctctttattttccttccctgtgcacacaagtttctccctgaactcatcttcttcctcgcatggacaccctagcgcccaccatggatgcacctccggagtccaaatctatgggatgggattgacaacacgaattaatcctccccttcttcatgctcctaatctccaagttattcgagccgatttgaccacggaaactcaggattttgtcacgccatcgttcttggttccttcgacgactgctgctcggcacccaaggccaagggcctgcagctcctcctgctgagcgtggcattcttggttccttcgacgactgctgctcggctcgacgcccaggggactgcagctcctcctgctgagcgtggcatgggcaggagcgaagccagctcaaaaggaacaccggtgtatactctattaaacataaagaaaattatacattttgaaaaaagaatacatgatacatttaggatggttattaataaaattttatcttacatgatacatttaagatgtagaagatgagccaaatcagcaccagaaagaaaatgacgatcaaggagtaactgaaacataaagatcactgctgcaagtgtcggtcgagtggcccatagccgcgattcccacccatgggctccgcgcgagagaggaggaggccggcccatggttctcgttcgtcgccgcggcgagcggcagctttccttctagagaaggaatcacgacgcgtcatccatctctggaaacacaagaaaaaaaggaggccgacggcgaccgacgcatcaacaaaatcgtggccgccgtgacgtgatcgtcactgacggaccgattaggatcagctaccttttcctcaagtttctcttttccacggatgtattaggatcaatcacggtcctttttcagattctctcctctcttcttcttcttctcgataatgcagatcacgacggatcggtgagacggtgacttgttagctagctttgatttgtcgtcgtgcgcgtgcgcgtgcgcgtgcatgcgcgtgcacgtgtgcgttgcgtggttgctttgcttgctcggtttcgccgccggccggccgtcggtggcctcggccgcgctcccggaagccagccagctgccagcacgcagcggcgaaccaccgacgacgagacggttacttgtccggcaactgctattcgtacgtacttcctgtcccaacacgtcaaggcaatcgatgagaagtttgtatggcgcagcggctgaaaagcacgtgtggccggcggcgcgcgctcatccacggccacgagaccagatcgccagactcacaaacggcggcgtgccgtggcgtcgcagacgagacaacagacaacatgtgattgattttctaggtggagtacctgatgtgtttttgctacggctggctggctggctggcgaagaatggaaaagccctggaatggcgcagcgcggcgtgacgtgacgtgacatgatgccgagcacagcacaggcacggcaagtttccgctgctggtgctggccgatctgaccgagacgaagtcgccagtcgcgtacgtatgggcggcgtatatgcctcgcccgtcgtcggggaaaagaaactccactgcatctgcctgccccgcccccgtgcaggatggtgcgaggtggtggtctggtccgatgatggagccgcatgcgttgcgttgcttgacgacgaaggagctcccgtcgtaagttacgtgcgtcagcaccagccgccaggccgggcgcatgcgtacctccgtacacgacctcgcagcatatgccgttctggaactcggtccgctgtcgtcctacgtttgcagtgtacgacatcaattcctggcacacaatcaatcagctatatataaaaatattactaatgttgtatacgattacgatgtaaaccaagaccgtctgcagactgcagcggctcccgcggagcgcccctgcgcctagcggctacaggtacccgcgatatgccgcagcggcgcaccctaccgcccccctctaaactgcagtaatgttaaca

SEQ ID NO: 2850 - DNA, 1866 bp, Zea mays
  misc_feature (1)..(100): optimal_loci_93549_G1, chr3:6976075..6977940, Cluster 16
acttgtgcatgtcgtacagcactcatagtcatacatacatcaggcgtgcatggcgcatgggttggaacttggaaagtgctacgtagctgcatgtactgtggcagtggcctcggcaagggtgggggctgggctgggctggctcctgtgggcagccactgcccactgtcccgtgcaaagcaaagcaaaagcggccgcgatgagtcacccaccgcgcgcgacggtggcgcaaaaggatcttttgcgatgaaggcgcgggggccgtatacagcacaggtggatgcatgcacggcacggggagctgacagctgagatcccacagcatctcttcttgagcatgacaaggatgtatgcatgccgcgccacgcaacgcaactcgtcgcgatcgatcgatcatgttggcgttgtgctgtgcctgatttgaacatgacatgcggcagagttccaggcaagtgctgtagctagcgtccgtcatggtagtggtagtgcacctgttgcgggcacaggagcttcgccgtacccgtacatacggacctaccagtgtctttgggctcttggcgacctgggcgatctatcgccaggaaggacgcgtactcgctcggtctctgtgtcacagcaggcgagtggtgatcacggccggcccgccgctgggtgcatgcagctagctagtcaagtcaactcagccggccgatcgagctcgatcattgctcgctcgctgttgcccctgtgatgtgcaagtgcatactgtacgtactacgcgtgtggcagctggctgctgactccgaggaggcgggcgtcgctgatgacgtgagcaccacgggcatgcagctgggcgcggcagtgggcgtttgaccgccccagctccagctcctcctggaaaacataaagcaaggtccatactatgtgcggccatgcatctcagcttcagagtgccgtacgtatgcatgtgtggagcggtagtagtagcagtaaaagccactggtttttttttttttttttttgcatggatggaccccggagctagcagcagcctagcaaggtagcggtgcatcgtgagttcgtgacacgcatagacacagtggacagtgtgcttccatacctgccggacgcagtgtttccgaccgagctcgttgtggaggcggtagcggacgcactggtgacaatactctgagtagtttacattgcattattgtatagtattgtataatgggcaaaaccttttttggcgcctatcgggtgtcacgtagctgtacgaatcctgggtccaaacaaaaaagaaagcagcaaggaagcgccaaagggcccagcccaatcatgccaatttgaacccgcagccatccatcccctcccccccggggcagcaagcagcagcacgcaaccgggtccggtccggtccacggagggaaatccatgggattccgcaccgcaccgcaccgcctctttctttcgccccgccccgcttttcggatgggttgggttccccgtgcgggcgggtgcgcggtgcgccagcaagcacgtgccagccatacgccgaggaggaggagcagcagcagggcctgaatgcccgcgccaccaatcagcgctccggtcaacctggctgctgcccgcgtgtggaggtgcgtgcgcgcagggagggagccaacccacccaggtcccgctcccgcctcgtctcgtgtgcgccgcccagatccaccggagaaagctatcctatcctacccctcgtcacgggcctcacggcccacagcgaggatcagcggacccatcagcgaaccatggattggatcgggtcaccgtctaccgcgcgtgggctcccatggcggaccgaaatctctctgcgccagttattataagtgttctccgggcgattcc

SEQ ID NO: 2851 - DNA, 2365 bp, Zea mays
  misc_feature (1)..(100): optimal_loci_93690_G1, chr3:7942560..7944924, Cluster 16
acggggggcattataggcgagtcatcactcatcagccgccgggctctcccgaagcgcgccaatccggaagcaaagcatgtgtgtcgtagcagagctggcgcgtgtttaacgacgggaggggaagagtccgcggggtggtcacgtcgggtgagcagcagcagctcggagcttcagacggccgcgggcgggagcgggaccaggcggacaggctcaggccgcaggcgggacaagctctcgcctcgctccccccaccccccgcccgccccgcgtgcgtgacgcaccgagtggggtcaggcggtgacgcgctacacgctttcctggccctggagtgcacgcgtctactctgccagcctatgcggccgtcgctctcgcgtccgtgtccgttggctcgttccgagtccgtggcgaccctgtccctgtccggctcctcccgccgctcgtcgtctatctactgctcgctccgcagagttgcggtgccttgccttgccttcttcctgctcttttcagcctttttttcttttctcgacgcaccaaagggccacgggttcggtatcggtctcctgctgctgctgccctgtcctgtgtgtgtcctatactgcttgtctcttcaggttcagggtcgcggctgtggcaagtggccacgccgttttctttttctttttctttttgttctctccgaccaaatgggtcccgtcggattggattggatccagatcgaagcgggcaagcggccaccattttcctgcggttggcgctacgatttcccgtgctcccacggggacgacagacagacgccgccaacgtcagcgcgcgctgtcaccgttccgttccgttccgttcctgcacaataacccggtccgtccgggatgcattttgaagccgttttcggcgaactgaaggcgacggctcgtccagtcgccccccggcccccgcgcacggtggcactgctcatccgcacgcgtgcaactcggtcggtcgccacgtttacaggtggacaaccagtgcgtgttgtgtgtgtgcacagcacaacagcgaccgcgaggaagactctgacggatcccgtccgggtctggtttcgagtttgaactggagccggccactactgttccccgagcggctggaggtacgggagaccggtaagaacacagcgccgcgacctggacgggacgggagggggggggggggggggggagcttgcgggaccgggcgtgtcgtgtcggccgcgtggaagcggacgccgccgtcgccgtgccggggcttgtcgcgagaaggccggccacgctcgggctcggcggcggcggagtggctcacacggctcgcgatggccaagagcccggggctgtctgctacttgccgtgttggaccggagacggagccgccgaaattaatgttttctaaccagcaaactcatccgtctcgtttggagtctcgtttgctgctccagtggtgcaggaaccgatcttttataccaacccccaagcacaccagaaagcgaggcaaagaacgaaacgtactactactccggtaaggtctcatcggccctccaacaaacaggagtacaggacaacgatcggctgcatcggcgctgctgtacacgagttctcccaaaacaagcttcaaatattttcttgacgactcgtttgaatccttaattaattttaattcaaaaataaatagaaaaatagaatctgatatctgactcggtgtttaacctgtatttacaaatacagggatattttgactctttaaagggcgcaacgttttcagacacatctcgttgttttacgcagtaatcaaagccacaatttagaaccaagaatccagccaacataattccatggctaccttcacaactacaaattttctagccagacatatctttcgcgataagcttagcaagatgaatcatggtctatgaaaggcacatgttctagccatggtgcgaaaaatcgcacctagatagccacctcaccgggacgtcatcgacattgcaagctactataaaggtacaacaaaataatgagaaagacgtcaccgacaacccttaccttctatcatctatggcaaaatatgtcatgacaaatatagcgatgagcgccaccacagtgggaaagttttcctctatgactagaacacacttcatcagcccaagaatagttaaattgttacgagcattataattatcataatacatattcatacaatataggtaaattgttattagaggttataattgttcgctttattttatataaacttaattaggctcagaataatttgatttagattagttctaaaattacattcctttcagaacagaggtagcatatacatttacaaagttgaggaggtcaaaagggaatac

SEQ ID NO: 2852 - DNA, 1548 bp, Zea mays
  misc_feature (1)..(100): optimal_loci_94557_G1, chr3:12525401..12526948, Cluster 16
ccctgctcccatcgttgcagcagcgactagagaatgtgcatgtgctgcccacctagctagttgccgctccactcagctggtactacgccataccgaggagccgtgctatatatgcgcctatctaccaccttcatatcatctgatctggccgcagcccgcagcctctccactgacaaagcctcaattatgcaaacgtttgcacttgcagtcaaacataaacatatatatactctgatactccataaagggagagagagagagagagaagtgaagctaaaaggtgaacaaaaaatgatcaattttcgcagtcctagctagtcagcgacgattactaccagcagtcagctaggttacacttaaaccagggtcgacggcaacaagcaggataggatagcgagggtcgaggggacacgcatgccgtccctccatcagagaaaaaggcgaagagcgagcgagcatgcatgcttgccgatgatgcgccatcaaagtgtgcccgcatctgaggctcatgaaaagcagtgtcgcagtctcccttaaaagaagaacatggaatggaatggaatggaggacagtaggatggcactgctggtgctggtgccgaaacaatcgatcggttcccttcccccgagatctcattccatcccatgcatttcccaatttcccatgaccatgcatcccttgtgtgcagctagctcgcagtgcgggcaagcaaagcatccgcatcagctggagcaggcagagagagagagagagagccccacagcggccacggcgccatagccgatgggcgatggctgtcgactgagatactactagtactatcttactctttcccccacacctctgtggagtagtgtggcccggccggccatgtgtgcggcgcaaaaggcaccacgccggtggcccctcacaccactcctgcggctgtggcctgtgggctgtggccctagctagctcaaccaggccacgcacctttatgaacgaacgcgctgcaatgcgctgctgcagtggcgccgtgtgttgtgtgggggtgttgttgtttggtaggtgcaagagagatgccaaaagattaggatgctcgatgatgctttcctgctcggcatatattgctagcaactagcatagcaagcagcgacatgcatgaacgaagggctctggggcctgagggagacagggagagatagataagtatactgaagagaactcaaggcaagcttgacagctgcctatatggcgcttgctctacactatagcccagttgcagtgggcctgacccctgcgcagccgcccgcttcaactcatactagtgctgtagtgtgcataacgcagcaccggccagcctctgatctttgcgtggcgtgcatgcagtagtgagatcggtcatgctcattcaacggaggatcatcgtaaaacgtaggccatggtagtagtactgcagatcgatggtctcttggttgcgttgtgacttgtgagagtgagaggcatgggaagtgagtgaagcaacaggaccaggccggccggggggtgggacgactactggtcgacgac

SEQ ID NO: 2853 - DNA, 2111 bp, Zea mays
  misc_feature (1)..(100): optimal_loci_96445_G1, chr3:23013761..23015871, Cluster 16
gtttcttgccgccgccacgcttgtttttccagaccgaacgttgcgcttaaccgcgatgaagcgagtttacccggcgacgcacggtatctggtttatgggcggccttccttgttttgccgggttggggggaaatcgggcccagctaccgatgcaagcgttggctaccggaccgcaatggaagcggccaacaccgatcagccgccctattctccacgccgcatcgatggtgaaagtggggcgtttacatttttgcccgcgctattatcgacggcggcaatatcccgcatgtgattgggcggcgttggcatggtcatggcactggtcaccattctttatggctttctgatgtatttgccacagcaggatatgaagcggttgctagcctggtcgaccatcactcaacttggctggatgttcttcggcttgtcgctctccatcttcggctcgcggctggcgctggagggcagcatcgcctacatcgtcaaccacgcgttcgctaaaagcctgtttttccttgtagcaggtgcgctgagttacagctgcggcacgcgcttgttgccgcgtctgcgtggcgtattgcacaccctgcccgttgccaggcgtgggtttctgcgtggcagcgctggcgattaccggcgtgccgccgttcaacggcttcttcagtaaattcccgctgtttgctgccggttttgcgttgtcagtggagtactggatcctgctgcccgccatgattcttctgatgattgaatcggtcgccagtttcgcctggtttattcgctggtttggtcgcgttgtgcctggcaaaccgagcgaggccgtcgccgatgccgcaccgctgccaggatcaatgcgcctggtgttgattgtactgattgtgatgtcgctgatttccagcgtaatcgccgcgacctggttgcagtaaggagatgatgaatgaccggttctatgatcgtaaataatctggcgggactgatgatgctgacatcgctgtttgtgattagcgtcaaaagctatcgcctgtcatgcggattttacgcctgccagtcactggtgctggtgtctattttcgccactctctcgtgcctgttcgccgcagagcaactgctgatctggtccgccagcgcctttatcaccaaagtgctgctggtaccgttaatcatgacttacgctgcacgaaatattccccagaacatcccggaaaaagcgttattcggtccggcaatgatggcactgctcgcggcgttaattgtcctgctttgcgcatttgtcgttcagcccgtgaagctaccgatggctaccgggctgaaaccggcgctggcggtagcgttaggtcattttctgcttggcctgctgtgcattgtcagccagcgcaatatcctgcggcaaatttttggttactgcctgatggaaaacggctcccatctggtgctggcgcttcttgcctggcgagcaccggaactggtggaaataggtatcgctaccgacgccatcttcgccgtcattgtgatggtgttactggcaagaaaaatatggcgtacccacggcacgctggacgtgaacaacttgaccgcgctgaagggataatgagatgagttattctgtgatgttcgctttactcctgctcacgccgctgcttttttcgctgctctgttttgcctgccggaaacggagactttctgcgactcgcacggtgaccgtattacatagcttagggatcacactgctgctgattctggcactctgggtggtccaaactgccgctgatgcaggagaaatattcgctgcgggactgtggcttcatattgatggtctgggcggtttgttcctcgccattcttggtgtgattggctttctcaccggtatttactcgattggctacatgcgtcatgaagtggcacacggcgagctttcacccgttacgctgtgcgattactacggtttcttccatctgtttttgttcaccatgctgctggttgttaccagcaataacctgattgtgatgtgggcggcgatcgaagccaccaccttaagctcggcgtttctggtaggcatttacggtcagcgttcatcgctggaagctgcatggaagaacgaatcaagctgatcatcaa

SEQ ID NO: 2854 - DNA, 1701 bp, Zea mays
  misc_feature (1)..(100): optimal_loci_96782_G1, chr3:24905023..24906723, Cluster 16
cgtccagtccaacaggtaattgcgtcggccggatacgcagcgcgctcgcgctgatgggaagacggcacagctgtttttttccactgaagtttgacaaacttggccccagcgcatacgtagcaggcagccatggtgtgcaggcagaggaggtgccgtgccgactagtagagaagagaatggacggaggggagcatgggcgctgctgcacctgcactgctccagcactggggcgcatgcaacagtgacaggcaggcaggcagcaaccggccgggacggacgggcgacggacttttacgtaggattcaaagtctttgttgagttgaatcaactagagctgctgtgctgctggcgatcaagactttcacgtactctacgcctgcgtctgccgtgccgcggttccgcctgcctggacctcgacctggacatggcgggactgcgagcactgcaccgccgctgctctgcttccctcaacggggtcaggtataataaaataaataaatagccgtccgtgcgtgtcctcgctggtgcagctgctgccagccaccttgcgttgcgttgcgcccctctcgggtgtgtgatgaggccagagcggtaaaaaaaaagcgagaggagaacgatcgggagagggagggcatgcagcaatcactgaaactgaacccgcttttgtggcggtcggatttttgccgaggaattcaagctttgcttcaaggtgattcgagatcgagaggtgggagcccggaggagcacgcgagggacggatggacgtcaggcaactgcgcccggttgaaaagacgcaacagtgaagctggctggctgggagcaacacaagctagcaggaaggaagctctgctcctacgtacccacaccgtttttttttatatcggcagccatgtcccgacgacgatgtccgtgctgttcccttccagtcgatgggatagatggactgcttgactgaggtttccattccagaatccagatggatggttgctgaattttggatatcgctgcgagtctcgtctcgtctcgtctctctcagaccatcagacgacgtgaccgctaccggagaaaaatccagctcaaccatcatgatgtctgaaacaatgacatctactacgtatggggacaggcgggcggccggccggacatttggattatggaggtgggactcgtctgatctggattatggtttttctgttcgtgtcgagctaagtaacattttttgtgatagcatacgtgcaccacactatgtgcacgcacatacagtcggacaggaccggaccggatgtaccacgggcccgtccctgtccccgcaccacagtaaacgtagcgtgtctgtactctgtagtctgagcgagcaaggtgcacagtgaggcccgcagtctccccggcggtggcagcgtgtgcggagcagatagtgtgtgctcctggctcctgctcactcgcacggaggctggagatgcaacacgcaacacatgcagctctcaattcacatcgtgggccgtgtcgccactcgccactgccccgcccagatgccacgttcgcatcgatcagtaggaggacgtacgtgggcgtcggcgtaggcgtcgtcgtctgcgactgcgacgttaggaaagcgtgaagctagcctacggtttttttttgttcttgttttcgtctcggactcagagacccagttctaacgagtttttggagttctttttg

SEQ ID NO: 2855 - DNA, 1105 bp, Zea mays
  misc_feature (1)..(100): optimal_loci_66202_G1, chr2:83483805..83484909, Cluster 17
atagacagaaaaaacacaagggcaagtaataatacttaacaagtacaacttagaatcggaacactaaaacggggacatgaataaaaacaacttagaatcggaaaacaaacgaagacatgaatgaacgaataaaaaaagcaatttaaatgttattgctatgtagtttccgatagaaaaggacaatctaaatatttcctttgtgtttattggtaaaccgagtaagggcttgttcggttatttaggggattgaaatgaagtgaccaacaccgatatataactataattgtaatatcaataattagaatatatatgtatacataagtctctggtcataacagttaaaatatgtatatgttaagtacataattaattttaacttattataaactaaaccttttattttagccatagatatacaactaaaaaaatctttttagttaggggaccatgacccgagctaacctagctcccctgtctacgccactgctcatacttattaatgctcaaaactaaagcaaaactcctagaaactaaaatcctagtgaactttgtttttctaaatgaggcaaacaggtacattttagaaattgcagaatattttctacaacttttatgttgaccatcaataccaattctacatggataatctctagaaattaggctagactttttacccaaatatgtttttgttttcaggacatcattgttgtttctacgattacttctaaactgctagtcagattgaaactaaaccaaaccaatttagaagttaaaaatgaaatctacaactgttgtattcatgaaattaccaaaaccttaatcgatccatacctttcaagttgtaactactatttagaattcaaagaacaacaaacaacgaacaacgaatgatttcaccacttccctttcacgtgcgggaaggacaacctagaacatggatattggtgccatggtggagaggtgaaaaacgacgatggttactggggagagagcagctagggtaggagatgtagagaggggcatctaggggttgctggagaggaggaagaagcacgatcactagggagaagaggagttgatgttcctagtgcttgccaggaagaaa

SEQ ID NO: 2856 - DNA, 1346 bp, Zea mays
  misc_feature (1)..(100): optimal_loci_10086_G1, chr1:53649865..53651210, Cluster 17
tataaagtgggaactttgcgattttttttaaaggaaaacaatatatgtgtacgaaaattattgtgaatgatatagctagactgaccaccaaaaggacgatgtgttaaataggggggaaaagaccaaaagtacaaacattcaaacgtggagcgagcatgttaacaaatatgccgtaagcctagctcgctcggcggtggaggggacaacgaatctgcagcgaccaaacaaggacgatgctacagcaatatttccttgttggagcctttttttggtaagaagggcgcggccacaggaccaacgttggagtagtactgatcgaaggtgcagaacaaaagaaacagtggcgcgacatggattctttagctacgtactagcttttatcacttcgtaatgagaccatgcctagtattatcttgtgtgtccgcatgaggcggatgccacgcctttatctatcttctcctctctgaactttgatgatataataaacgtagataccgcttcgactattgtttcattctctgactattattttaaactggggtcgacgatataaccttttcctttaagcgaaaaaaaatccgtgagagagatttttaacaccaaaaggatatgtgtgaactcgatttcttgtcgtattatcgttcgtcgaatgacgactcgacaagatccaatctatcattttgtttgactcctgattcttgactggaattttgattagtttgcagtgcgtgacttgacatgtaaggtctttgtctatcgaaaggccaaaatcccaggtgcagctccaccgtaccttagcttatctcctagctcatgtggtggagacggacactccagtcctccacgtgttaagaaggaatccagatgtagctagatcacgtatacgtatttcatacatacatacatactacgtaaaaatcctcatactgtatatcgtgtcgtgctgtcgtagctgcgtacgtaggaactagttgcacaaccgagcctcatataaaatctatctaatcgatatgtgtacagtagggttcgcgagatctactaccagctgtttcagaatttgtgttggtcaaacatacatttagctttttcgttcggtggtcacacgtacaaataattgttttagacttagctttgattatcatcagaacatttgcgtgaataataatattttatataaactatcaaaagataatttgtttgaaatgatatggtctcatttttttctgatcacactatatgcatatacactcatgcatacatatatacgcaactgacctttataaatacgatcgagcataatccatgtgggatagataggtttcaccacatgaaacctgtatggacca

SEQ ID NO: 2857 - DNA, 1108 bp, Zea mays
  misc_feature (1)..(100): optimal_loci_102395_G1, chr3:56879405..56880512, Cluster 17
attagtatagaaagaggttgtggactcatggaataggtataagcagaaaaattctctccacgatgttgtataagagaaagaccatcaaagacctaccccacaccaaatgggtgttaggacattatggatattggtttttaagaaagtttatgaagttttcaatttttgaacttcacctggaatccatattgaaatagtgagcgagatgctacaatctaaaggaagatgagcaaacttaagagtgaggggtgtgaatgaaccgaaacaccccctctatttatagagtgaactctaggatttttttaaactttttggaagttgttttgaagtttatagactttaaacggccaagatggtgtggaccaatcggaaggtgacacatggtaattgacgatcaataataaccaatacctctaactcagagaacctaacgtctttggatgatcttaatctgtggaagtgttgcactacttctatagaaacttttttcatgataaatcatttcattttgatctcaataatttcttattagttacaagtgttgcaagtaattttgctagaagattttatgtcagtacatgagattcagttcattacagttgcaaactattacaaaaaaccctcaattgcatatcggattttattgaccattcttgtgatcgtagccctagctgaaagaattttctcaaagttgaaataattgaaacattatttaaggttaaccatgtcacaagaaagattaaataacttaggcgcttagctacatgttatatcgagaatgatatattggaaaatattattctgaacattggtctgacatattttgctttagaaaatacgcgacgaagttatttattttgagaaaaagaaaaaagagaagagcgtcaagaatatttgtatctattaatttttcgcagccaacgactcagttgccaaaaaataatctaattttggtggctaggggagtgaccaccaaaaatgtgtcaggaccgagccaccaaaaatatccctagccaccaaatgtgggcacaattaatgttgtgtatgtccagaagatgaagtcgcgacatccagggatcactgaagtgcgaggaaagaaaacaacaac

SEQ ID NO: 2858 - DNA, 1371 bp, Zea mays
  misc_feature (1)..(100): optimal_loci_102398_G1, chr3:56888129..56889499, Cluster 17
ctacggcaaacgcaaatcccactaaagatgtacattatcgaatgatcatgacattggtgcagggtgtattctatttatcatataggtgaatcgatgatcctcgctgccataatcgtgatgccatttcgcttcacctcccctaccaatcgctgaggtactatagcacctggggctacgtcttcttcaatggatcttcgtcgcctcagatcgccaccgtgagccccgaccacaatcaccgacgatggagtcgaggagaagcctgggagaaagccaacaaaggaggaacatataagacacaaagtattaggtcggttctggcccattatgagttaagtgagatccaaacaacgattaggacccaactagataaactttaaaactttatggaccgagtagacacatgtgtacaagttaagggattagaaattcactttactcatttaccaaactattggacatgtttttacataaatatagactcttactctgcattcgctccgtaacaaaaaaaagaatgtaattctagaggttcgaagtaaaattttgaagtattactagttttataaaaggtaaaaatctcgatatcaaattttgtccagtaccttatttaccatcataaatattataatcttttctgtgtgacttggatataatttcttatcctttcatatcacagaggtcatgagagtaagaaaattggatgtcataatcctttgaatggatattgacatattaaatatccaacattgagtatatgtataatgaatacatggactctaatacgaataggatctaagccatgttagacagatcaaattcgaatatgaacagataatattcgtaccatttacatccctattactaggtttataaaagggaaattcgtgtagttttgtccaatatcttatttctcactacaaatgttataatcttttctatgccgctcggatggcaggaaagggtaagaaaattggatgtcataatcccttatatatgcgattgacgatgatatgaaaaggtaataaattacatccaggtggcataaaacagattatgatatttacgatgactaataaagcactgaaaaattacaatgacatacagggtgcaggaaattctcttttttttttataaaaagtagtatagttatttgtacttccaatagatttattatggaaatatatactattattcatctactaacatttattgcacaccataaatattagtacattttcgtatacaatatggtaaagtcaagacaaattgactcgttaaaaagcaaagcaagaatggcgccattctttctagaaacggagatacgttcgagctcttcccatctatctatatatatctctactacttattaag

SEQ ID NO: 2859 - DNA, 1170 bp, Zea mays
  misc_feature (1)..(100): optimal_loci_10467_G1, chr1:56067352..56068521, Cluster 17
attctacaagtgcctgaagcataaggtttggattcaatttcgtgttctttggttgttttaaactgaattagaggtaatgtgttcttcttgcttttggttgtgacaaagaaatggttctggatgctctttttgaagatgggaggaggatgctctttttggagatggcaggagaaatggttctggatgattagcacgatgtagaagaaacaaacaggcttggatgatgaaataaagaaggcttatggattgaagaaggggaaaaagatttggagatgtccgctttccttagcttaggatagaaaatagttgagttgctgaagatcattgcttgtgtgtgtttgcattttagtgtgcaatgtgtaccaggtggttaaaattgataaacctatgtgcaaactatgtactctttggaacctatgtggaatctatgaattcagttaatgtttcagctggacattcattgtcacataagcatcatagataacagataacacatcactgataaacatcaaagggttccatccattgccacaaccatgctattttcttggcccacgcaaaagacacaaaagattaggcccacagaaaaggtttttggccgacacaaaagatcacaggactggtttgttcttcctgcctactccaacagacaattacataaactagcatcataaatctgcttactccaaaatacatttaggcgattcaagcaacatcacttttcttcttcatgcttctcttgatttcagcagatcatgtccccttcctcttccttccaagtgcttgctacccagactttgtagatgtagtgagtaggacaggcatatgcaccatttcatttgagcttatgtatgaagaatctggtagaggtccctagggttgagaaaggcttcaaggtccaccttcctttgtgcatagacaaacaaagtcattcacatgccttaatagttgagaataaacatttttctcacctgttctagtaattgttggatcattgttggcataaatccatgtgcttcttcaaatccatgtgcttcttcaggtccaaatatgttaagatcttgatttagtggggcttcttcattcatacgttgttcaagtgctacagtctctatggtagtagcagcactggcggcctgccttgcctcttcctcaagtgtagccatagtt

SEQ ID NO: 2860 - DNA, 1089 bp, Zea mays
  misc_feature (1)..(100): optimal_loci_109578_G1, chr3:108166642..108167730, Cluster 17
ctgaaggtataatctgttttgtgttttagatctagtggctaggactttgaggagagattcttttagaaatcacattattgtcttgaaaaaaatggaataacatttaatcacaaaatcccgacctcactatttcaatacccccctgcaaataaataaagttgtatgttatatcatgaaagagagaaccaaccatctagatggagacatacataaaccatatgtttggttgcctgcattaggagagtcagactcttcacatgtattgactatgagtcaacacatgtttgattcgttgtatctaggaggccagtcccgcacgcaccggtgcattgtagtctcatttagttgcatctacaggaacgcaaaaaacgctcgtatccggtggactaggctgctgtgagccagactgcgcgtaatcacctatccaatcatacagaaacagatcaacttaatgcatgattataaactcaaactgctcataaacacactaataaagttatatgtgtgtatagaaccatagaaaatattcaccgaaggccatttccacagtagagtttcacaaacgttagtaaattgatacaatgaagaagagagatatgataaggattttatgggatgaaataagctttataaggatagctgttttcagcgcatagattgccttaaaaaccgtgagataaaatcttcatcgagactagtctagagaacttaagaagtttttccgtcaaatgaggaatgacttagctatcgtcgccgtgtagcatcaagttacttgcaagtgtctcattcaaaagcgaagttgcttgcataacgtgcaaaagatcttgaccaaattgctagatttggggagacttttagtgttggggtttgctacttcagaatgcatgcaccgggagaaaagaaggtggggcttgaaggatttctgtccatttcagaaaaaagggtgtgtacgtacgtggtcacacgcgctgaagtgacatggttagcttacaaataatctgaactggtacacacatacaagtgtttggttgtctgactaaaatttagttcataacacattaaatatatttaaatatcaattataattat

SEQ ID NO: 2861 - DNA, 1296 bp, Zea mays
  misc_feature (1)..(100): optimal_loci_11268_G1, chr1:60772704..60773999, Cluster 17
catttttacctttttattttccaattacttgatcttcaaaaactgaccgcagtttggatgtaacaatccttggagtttataaaaacatggttttgtagtaagtgtatttcttttttggagtaataaaaactccattcagggacctgtcttatcgataccgtaatttctggaactatcacccaaacagaccgaggttactagaagccagtaatttaattttgttttataaaatttcttggttaaaaagtcatcggtaaggactgaaatcttcccatgttatagatgtaataatgatctgttagcatcatttctgtgtcctttttatgagcatgtgtttgcttaaattatagtcatcagtggaatgtttatcagtgtattgatttgacaattagataatataacaagacaggctcaggattatacatgtttttgtagaatgtacacacatgtccatagcataaggctaaccagtcaatattgtccaaatcacaataacttgcgcgagtaatgaaaggtaagacatgcaaaaatgcaattgacactttcataccaccattggcattcaagtattgttatcatcatcctcgatatcccagcttaaatccttgtcatcttcagcagcatgctacatttggatcatattagacagtttctttacatgaccttcccaagacattcttacgagctactgaaattaaatggtttgcgaaaagcgtatactgccttaagaagggcattgacctctgaacagcagaacacacacagaactagatgaagcatttactgcttcaacgcctactagataagaactttgaatgttcgaggtatgtgccagtcattttttaaaaatacttaaacagcacaatcaagattatattccacatggcatgatctccagattattagcagcaatgcagttagctttatcacaattatccagtgagcacaggtgccatgttgaattatataacatatagaagatgcaataattctgttcaagcatatgccagctcgtgatgtcaagttcttgtttgtgtagcacatggtcacatgctcatattttagttaggcatgtcactaattgatgtcccatgcatggtggactagattgttaagagtgtgtttattttgagaaatcacttcatgagtccattcctcaaggggtgtttgttttgagaaatcacttaatctaaaataagatggtgcatcatagatttatttctcaaatttggtgggatgactcaattactcataatagtaccaactaactaactatgagaaatgcggtggtgatca

SEQ ID NO: 2862 - DNA, 1011 bp, Zea mays
  misc_feature (1)..(100): optimal_loci_112689_G1, chr3:128670994..128672004, Cluster 17
cgtgcacacctgatccaaagcaatcgatcgcgccagtcctcaccaatgaccgtgttagtcgtcacacatcaaaatcaggtaaccccaaggctacatgcatttggctcacatttttagttcaaaaagttattcttattagttgacttatctggctcaattaaatttgtagtcgaaatcatgtggaagctcctctacgaggattaataatgctttgatttacataacaatattatatatattatgtatgatttaattttcttttatatatttatagtgaactattagaactcgaatgagacatctgtcttggtctctatagttacgagtttttcattcgaggaggaattgaatggagagctactaatgatcatgtaaatgaatggttaatatttaatgattttgcaaaagacacgagtttagaagaattaaaagacaatattattcatatggaaaataaagtcaaagatcatagggtaacaatggaaactataatataatctcaaactttttcattagtagaccctttctaattgatatttttttttgtaatgaaggaaggaaaaggacttagtgagaatgtgcttacatggctagctttgtttgagtatgtcgattttgactttgtccccaaatctctacttattctgactaaaatcgtcccaactgccccgactgctccatccaacataaagaggttgaggacgtcccacacacctagtagttcccacacaaaacaagcatcgatcaacaatttcctaggttgctaaaaaacaacacatgatattttctatggtccaatgaatatggagaagtatactaaaaaacttaagaggtgtggtttcaaagtcaaggtacttcaacttggtctcaaaatactgaaagaagattagaaacaacgtcagatattcttgatattagagaactttgaagctaaagactatgttttatctgtcgttgatgcttagctagatgaattgtgtgggtgttgagtgatgtgtgaaaggaacaaac

SEQ ID NO: 2863 - DNA, 1199 bp, Zea mays
  misc_feature (1)..(100): optimal_loci_112780_G1, chr3:129205622..129206820, Cluster 17
ggaggggcagggatgtggccagttgtccaccctaaagactggggtggctaggggatggacggtcgaccccctcggctcatgtctttgtccagaggtgccccatgttgtatgttttcgtcatattttgtcacatgcatccaaatatctcaacactacttgttgaactcattattattacttttattcactacgccataaagattttctcatacttaggatagtttaaggccaaagatgatgaaataatggccatcaacagttacacatcgttagatattagtattttctagtgtggaagtggtccgaccatcgaaattcttggcagattatttttaatgacttgtaccataaattgttggaaggcgttaatttttatgggaaaggcttttttacggtttcaacattaaaaaaataccgattttcttatggcgtaggacaaatgttctctcatcaagacaaagggtcacccatggaggagtgtttggaagtggagaatgaaagttgttgactcatggaacctgaaacaccatgtgatttccttttataaaagactgaggaagttaaagcgacgcatgattacagaatgattcctaatctttgatccgagtctatagactcgagagttgcatgaatgagagagtctcgaccaaaggcagatcgatagagacatgataactcaaggcattctataagaaaagtatcatttgcttgaatcaagaactcaaccaaataaaacgagggggctcttgttaataatatgtaccatgaatatccaaatcaagcttaatgaagcagagcctatatggaagggctcatgagctctatacaagccaaagggctcaacaatactatcaggaggaagtctatagtcagaagggttctagaagtgcatatatgacaaagatcccaatatagtaagagataagcatgtaaacatagagttggaactgtatacaactcggtaccaatctagtttcatcataaacttggtaaccgactctgtgcctaccatgtaaccattgcccctctttaggatataaaaagagggcgagggaactcgctgatcatcaaaacatacaaccatagatccaccacacctacgacataggatattatctcacactaagagcctggataattgcccctctttaggatataaaaagagggtgagggaacttgctgatcatcaaaacatacaa

SEQ ID NO: 2864 - DNA, 1061 bp, Zea mays
  misc_feature (1)..(100): optimal_loci_114606_G1, chr3:139857344..139858404, Cluster 17
gaacacataacaggtgtagcctctgagctcctaggtgattagatgaaccggttaggggattaatcgcattatcatgatgttaatcctagggtttagataaaccccattatttgatactcaatagcccccctcgagccccacagtccctcaaaccttatatatgatgttagtgaggggatcttctcttctcttaatacttcgcccaaccaagatgaagccccattttggatgcgatagttcatctaaggatgtgagtactcttgtcatggcctatgggctaagtaacgccatcggtgagctcaaatcaatgaagcctaactgaaggcctagccaatcccttgaaggataaccaactctaagcctacatgaggtgcccctaaaaggatttaaatcactagagtgggtgaatacaatattaattttcttctacaaaccacaaacactagagcaagtaattagaacatactatgatcctagtagccactacaagcactagctatagttcaatcaagcaaggcccctataaatgtctagacgcaaatgctttataacttaaacactttaccacacaagagctattaacaactaactacactagagagctaacctagagagtaactaacatttatctaccactaacaagaacaactacctactctagagctagaactgacactaacttgatagcacaactacaatccacacaagaaactagcacacaagcaatgaatactaatgtaaattcaagtgtttatcttataccaacattaggcaagagagataaacacaatcaattttgtaatatggtttgattttttgttggcaacttactccttgttgtggtaagtcttaaggggaatgattcaccactcagtagcatgacaagctagacccacaacttgggtgtcgcaagaatcaaaccttagagcactccaacaagccacacagaatttaatatagtattcatttgcaccccttgaattgggatcaagaacctctcatgaatcaatcgattaagagtagaaacaatcaccaatttccatcaccaaacattgaagctt

SEQ ID NO: 2865 - DNA, 1079 bp, Zea mays
  misc_feature (1)..(100): optimal_loci_11463_G1, chr1:62358065..62359143, Cluster 17
gtttgcttgagtttgagtgtagtaatatgaacaaaataagtgtatctttgtttctcttgtaccttgtatttgtatgactgaaaccaataatttgttattgtttgcatcacatatattgaaagtatcatgtctatgtgtgggtctatggagcttaaaatatagatattggtgtggtcatatggttgattatgacgaggttagttaataccttataacaaaattttaaattaaacctatcatatataatgactattttttccacaaatcactacaaaaatgtgtctaggaggatttcaattttagacgtgaattcgaggaaatgaatagataagtaatgcaacaaaagttgaagtgcgggacgaggataatacatgatcgacgatgcagggacaaaaagatcatggatagtggtctatggtgcgagggcatgggctagggcaatgagacaaagagcatgagcattacatgatgaagatgacatcgtgactatagagaagtaaccttgtggtatcgagatcagtaccacgagctataacactcaaatattactatgagctacaataacgtctatattatatacaatataatactttgatgctactatctattatgtcgactcttgtaactgtaatcttgacacatcagggtttgtttgggaaacatattattttgttattagtttcgagacaataccatcgtaattgagtagaccatattattttagaccaaaggatgtttgtgagcatatctaaaaactttgtattttaactcatgattttaccaataccacggtatttttggatcaaaaaaatgaccaaagtttttttgcttgtactcaactgcggtcttctcttctcccacaccacaactaaaaaattgtgtcttcaaacaggtgttagattagattaatgtaaaatataccatactaatgtcatgacatacaccaagggttgtttgagagcaaagtttttcatagtgctaatgcaataccatggtatgataatacgttggtattttatacagaatggtgtttgacaaaggttcaaaaactatgtattaaaaaccacggtattacgaat

SEQ ID NO: 2866 - DNA, 1158 bp, Zea mays
  misc_feature (1)..(100): optimal_loci_115806_G1, chr3:148015443..148016600, Cluster 17
tcttgtctcttgttgtgaatgcggtgctccttgattggaatcttgtgtgcatgggtgaactaagtctctccggtgaatctccaatcctctataccactccctactatatgaatacccctagcaccatatgttgcaacatcacctccaccttccctgtggctaggatcattgtcgtctgcacaaccaccttcaccagggttagttgtgctttcatcagtcccaacctcctcctcctcctcttcttcttcgctttcatcgggtctagcattttgcctacaacaatgaaacattgaactatcaactttgttgtagaagtaaaatataatgtagatatgagataacaactatgaactaccatgacagaactaataactacattcaaaataccaactaacacctatccgctaaaccaaaatatatcaccaagctaccatctactacatattgcctcactaacatatcaaatattcactaaatattgttgtcaaaagacatttaagtaaaatcacatgctaaataaccagaaaatatgaaatatcccctctacatgtcgattatgacttcaaatcatcggatcccgctggctaattagcggatttcgatgagaactgggtgggacctgctacctaccctacgaaagtcgttgggcactaacctgatatcacgtttcctgttctcggtgactgagctgccaaaacatcagatctcactattttcttggcgagaatcgatgtatctcgcctagattgtgaagcttcggcgccgagaaatgttgccttcaattgagctgagcctgaggctgagcggagacaacgagtgaagtggagaatgagttgttcgcccactaggtaacagacattgagatatcaaatgactaacgggttggagaatttgggttaacgagtctagaacccttttttgttttttggcatcaaaaccatgaatttttaataacaatttttagcacctctttaagccctctagttttaatacaatttttttccaatattttcaatggatatttttaaaattcaaaattttgaatcaaaattctcgaatttttttggtaggatccgaacccgttgagaactgagaacgaaaaagaaaagcgaaatccgctgatttttgatcgggaaagttaaccctgctaccggcttc

SEQ ID NO: 2867 - DNA, 1163 bp, Zea mays
  misc_feature (1)..(100): optimal_loci_116543_G1, chr3:152169368..152170530, Cluster 17
aaatcttattggttatttatatgcagcatttaataagtatgttgacatatgaaatggtgagatgaaactctctattgagagaagatatttcattcatccataaatctgatgtggcatttttggaaagagtgacatgaaatcccattgtgaatagccttatcgcatgcattcagcatggctatttaaagcatgcaggcttgattgagaagacaaccaatcagaccctaacctacacagtgcgctaacagagacacgtttagcagcactattgcactgtcttttcttttccttttacgagcatgaaaatgcataacgcgagtcggcgagtgtaattcgcgctctcacgtcgatgatgccttcagtatggccttccaaaccctactcctctatttgagtcttaggtcatctataacatgggccttaaagtatcctctgcgctagattttagaggacagagttgtcctctagacacccaacaaagttctctagatttgctgctagatcctccagacctagcaaaactgaattatatagaatacatttgagaatatgataaatatgtacatacaaaaaacaaaaataaaaatatgtgtctagtattggtattagatgagagaatcttttagaaaagaccttaaaagataaatataaaagacgttgctagagacaatcttagattttagaactggcaaaattattgttctacaaacaacgcattgaaatctacatcattcactttttttcaaaactctaatcatccatctttttcaaaaaaaaacgtgagttatcattttttttgttatgatttgttttatcacctaaggtcgtttgagcgtgacttaaagtttatattttaaataaatattttgtataagacaagtaattggacttttataaaaagataaccacgtgtcgtataaaaaataacgacgttaagtcccatgacacatatagtaaaacaagagcagccttactgccttatgaaatatatgactttgaagtctcaatttgttgtacaaaataaatcaaggccagccagaatgtatatagcaaaacacgagcagccttacgagtaaatgactttcaactctaaagttattgtaaaaaaataaatgtacgggcagtcaatgtataaagtagtaatataaatctgaggccagtct

SEQ ID NO: 2868 - DNA, 1163 bp, Zea mays
  misc_feature (1)..(100): optimal_loci_117303_G1, chr3:156498120..156499282, Cluster 17
ctatatattaaagatataaattaaaacaataaggtagcgtcaagtaaatcacagtatctcgtcaataccattagcaagaggtaatttaatcttccgtgttctcgatattctaggccgcttcatccttattaaaatcctctaatctcaatatatattaaaaaacacctaaaatcaccagtacaagaaaatattggtaggataaacggaaacatcaaggccaactactacacggtcaaaaatagaactaataataatgaaccggaaatagtgaaatacataaatacattgtggagagagtatagatagcgtggcaaagggcacgagaaacagagccccatgcgagctcagagctctttacacctatttcgctttactcaaccactaacggcaaggagaatgtacatcatagtgtatttttctgcactaatttcttttaggcattttatatcctatcatcatttcatacagctgatcttctgaatgaggaaattctaggttcatcacgtgttggatcaagaatgcattaaaacatgtcctgccctcatcaattcagtgaatggatagatcccaggaccacttttcatgagacattacttgccacatgtttttatgtacccagtagccaacatgcagaaaatattttatgcgagattgtataatagaaacgttgtaaaaaagaaaggcattccaatgatatggacaacataaatttgggggaaaaattatgtcagttcctagaaaccaactttagaccatgtttggatcctcctgactaattgttagctaattagtcgataaaaaatagctggcaaacaattaatcacggtatatttggagtcttctctaatggatgtctaaaacattgtaaatagtttgttttgtctcccatggcaaacaattagccaggagagaaaggaaagaatcggaaagggatagagatcgtttttttctttttttatgatctactagcacctattagcaaggtcaaatagctaatgggtaaacaatttgtcagccctctagctaacaattaactaatttattaaccaactgtttgtagcccaatatgctaaaattagacgataaactgtttgctagatgaatccaaacaggcccatagaccaacatccgtttttctagcccgatcttgtcgtcaacataag

SEQ ID NO: 2869 - DNA, 1267 bp, Zea mays
  misc_feature (1)..(100): optimal_loci_122664_G1, chr3:187705413..187706679, Cluster 17
cttaatactccacctagatttggccaccatagagtgggaggaagctaggcgcatgccacccaatatgtaatgctgcttcatgcaaattctaaaatgatcatatcatataactttgattcctttcaaataatttaatttatgaaacaactatgtttgtaaatggatatattgattccgtagcaacgcacaaacatatatctagttaacattataatcggtatgcaaatgtgctttagcgttgagtaggtcaaaaactctctatctctacccaccgaaaatgaagttttatatttttgtcaaaagtttagatatattatgtttgataaatatatagaaaagattaacaataggtatatcattaaatagatttgctataaaatatttttactatgaatttattaatatttatcttaaatataaatattgtttttatctaagaatggtttgaattataataaaactagacgtctagaacaacacactcgtgcgtgaatctggggcatatgattattggaatagtgtgatcagtacgtttccaacgagactacgagaacagtaccattggagtttggacttctcctttctttttctcaacgaaggaaaaagcagagagaaaaacaaacgtacgcaagccggtcctcctgccatctttttttttcaaagacgacaaagacaaaacgagtggacagcggagggcaagtttccaacgtgttcttccttgctttttctctcctagatttgaacatcgaggcaatcgctgacgccggccccttaccagaattgaatggtgactatgtttcagttttgagaattaaaaacgtgacacgttattctaaacgcgggttgaaacggaatcaagaatgcacgaagtatagggaccaaaccaagattctcagtctggggttatcatacaatacgattcaattagagcagcccccaccaagaaatgatttttatagctgccacctcacttaaaaaatcaattatagaaataataagtttcaacgctatttttttattgtgctgttgtaataaatatggatgcggcactggcagtgcgacgcgatgacaccgattctcacgaagagtgacacgtgggctccatggatgaaagttgggtgctcgttcccaacaccaaaacaatgttttcttgggtctttgttgcacgtgtagacctagtttctcacagaggaaaccattttctcttctttctcattaattttcatgttatgtcaccaaattgcttaaactaatgctatagaaacta

SEQ ID NO: 2870 - DNA, 1122 bp, Zea mays
  misc_feature (1)..(100): optimal_loci_123956_G1, chr3:194723692..194724813, Cluster 17
aaatataatgtaagggcctttctctttggcaaactagaatgcatcctggacaattgcttcatcaccaataaacatctgaaccagcaagaacaccgttactatcctacttgaaaatataaactatgctcaagataacatcagaatagaaaatattttccatggtaatgcaatgtctccaatgtatcttcaatgaaaatggaccaaatttcaatgttagtcatgcaataagactaatattttagttaaacaactaaaccatgcaacgtatcatagagacaaggaattatatacaaaatcctaacaattcatcatgcacggcatataactggcaactgattaaacttcgacaaataaactttggactgacaagctccataataacagaaagataaaatgcacagatctattttctacaatagtaacaatattgtatgtacaaaaaaaaaatattaagacacgcaggaacacactatccttagcaggggcgggccggcaaatttagaggccttgtcctaaacttcaaaagaggccctattttatagaaaaaatataatcgaaattacattgtaatagaattcatgtattctgaattacaaaaggtttactagataactcttataactatttatattaaatctatccgtttttacgaattatattgtaatagagcatataaagaaacatacgtattaatagatgtatttgaagagcaacagtctagctgctaactgagttcaacttagatggtgtaatgttagtttacttattgatacatattattgagataagaagttttttaggccctcagaattttaggccctatgcggtcgcatttgccgcacgtgcatgtggcccggccctgatccttagttaagttaacaaataaactatgttccgtaggtagaaaagcaccaagagtccaagacattcaaaacttgcttctaagaacatttgcataaggaaacattgctttaagaccatgctatagtacaggtgacaactgaaaaaaaaacaaaataatagcagttcctgaaatggaaaccgagaagaaacaaaaaaatatttgtctacataagaaaaggaaattaaccaagatgatgcaccccgtccgtgcttaataga

SEQ ID NO: 2871 - DNA, 1027 bp, Zea mays
  misc_feature (1)..(100): optimal_loci_124781_G1, chr3:199495406..199496432, Cluster 17
attagtaaccctaacaaccagattctctctacaattagaatataaaaaaatctcctaaaaatgttgaaccaaactggctctataatcccaaataaacaagccattattcatgcgcgatgcccaatcctactaactgcatgcttacattaggtacaccaggaatagataggtacattatattgctacctatcaataatcttaaagattatctcatattatatcacatattgttttcgatgatactaagagagaatgtaacacactaatttttgaaccgtcattttcaaaaaaaaaattgataaggtttgagtgatttgaacacacgcaacatgattttaagtaattttcttttattattaaccaactaaaaagaatcataagtttgaactaaatgtatttcattcatgtctttgtgttgtgtttttagtgtaaaagatgtttaaaacatgttaatatatcccgtagaagtctctggtattatctgtgtttatccaattatttatcctattttcgaaaagctaaatctaattatttgaggaacttaaatacatttttaaagatccaaacatttttattgagttcattgggtgccaaaacatttctagaatttagacattttgagtattaaatatgaatttctgcattttctaaaattcattttaacctgattttggatagactcaagccgtccttatatatacatgtctagcttcctcttgatgagcccattccagaacacaaaacaattttgcgagattcaatctttagctccctgaaccgctcgtcgaagttctagttcctgcttaactcccgtgacaactctgacgagaaattactccttgatccttcatctccagatgctcactaggacattaccgtgaccttcatcttcacgcttttgaattgtcaatcgaatcttcggttcgccgtcaatctacgaaaaaccgagaactctaacgagttcgtcatctccgtgaactccaccatagccacttttctttgttcttcattattcacagattagagt

SEQ ID NO: 2872 - DNA, 1041 bp, Zea mays
  misc_feature (1)..(100): optimal_loci_125567_G1, chr3:203520262..203521302, Cluster 17
tataacttgtaacggtggaagtacactttaaggcttagtgtcttccagcgttgtcgattatttattattgaagtggattgattgataactggtcttaaggtagattttgttggaatatcatctaaattttaacgtaagtcttgcggggatttgattctatattggattgtagtttatttgctctatacgtacatctttaagtcacacgggaagacaagcgactcattatgttctttgtattatgtaaattcttcttatatagtgaagattgattgccacatgtgttttccccgcaagaattttcttcataaaattttgtatcccttgtttgatttgtatgtgtattatttgccaacatagtataaggtacagacttcagacttggaaaaaggccataaaattttcatagtcagtagtatagaggctcagagtggcagcttgtcgtcggcggcagcatgccagtcatttatctcaggagaaagagatgcagattagctccaagaattttgaaattttcatgtatgttgttagatgatagcagagaaattgtgattcagtaatggaaagcaagaaggtaattgtagcattctggagtcctagtgtttgcacacaacagcaaacaaaagtgccaaaccaacaacagattttcagtacttggcatgggcactgtgatcactcaaaataggttctgcagaggttgattcccgagagctgcagttttaaagcacttttgattgcttgtgacttaagaagaatagtacgtgagttagtatatagactaagcagatgtttgcccggtgattgtgatcaaaggatgctagctagctgatcagtgcaataggcacatggtgaaattgaaacttgagtgcattgccagagctagctgcagccccggtcctatgattttgagggccccaggcgaactgatcatggtgggccctctagactatatcaaaaattctatgatatgcagcggagtagattagtacttcgtatgtaaataatgatatgcattgaaattggtttttaaaatatctaaga

SEQ ID NO: 2873 - DNA, 1079 bp, Zea mays
  misc_feature (1)..(100): optimal_loci_126431_G1, chr3:207542038..207543116, Cluster 17
gattaggtaaagtagctaattttggtcgcctaggaggggaagtcggcccaaattagtaatttctgttggttgaaagcatatagacgatgtaaattactactccctttgtctcaaattataatccgtttgaccttttttgccaactttaatcgacttgtcttatttattttttggtgaaaaaatgaaaaaaaatcaaaaccatacttaaaatatattatacgctaaataatattatattaaatttttttaaataagacgaaacagtcaaacttagaattaagagtcaaatggattataaattgcaacagagagagtaatttctaactgcttctcccggccgatgaaaaatgtttagtttctgtaggccgctctaaaaatccaaagaagttattttggaccataaaaatttcttattttttttgttgtgtaaatctagaagtgcagtaaaaatagtagagttatcaaaatttctgctatttactagtagtactaatcaatagctctccacaaacccaccattgccatcttgtatgtgtgtcacgtttgtagtcctgtcacacccgcagtttaatttcataattcaagatcatcgtgatcttgcacgtgacacgcttgacgctctaaattcaactcgaatttattggacgtaactagtctaaaacaaacacaactttaattacagagcactgctgctctgtaattatttgaggctctctacaatgcatacacgtgaccactgccagaaagtttggaataacacctaatttgaaactagattgaataatctagccgtattgagttttgtagcgtgaacagtagttaaaacgaagcaccctgtcaagtttggagcaacaccgagttcatctatttctgaaatgcgatttctgtctctgtttcctaagttcttactgtaaaaataaatttctacagaatgaaatccctatgttacaacgaggaaatggtaaactgaaacacttgaatctgaacacctgcccttctgtctctcttgagtctctgtcagtctgtttggttggcttctccgcgtagctcgactgcatgagccaggccggcgggagcct

SEQ ID NO: 2874 - DNA, 1019 bp, Zea mays
  misc_feature (1)..(100): optimal_loci_126671_G1, chr3:208793440..208794458, Cluster 17
gacgaccaaacgaccaaggatcgttatcgttaggggtgattggttggctgcaccttttggcctatggctcgtgggatgtaataaaataccttttagatacatgtgcttactcaactaagctaatggtgttattaatacatgattagttgatatcgagtgataataaacgtgttttaaagaagtttaagatatattaggataaaataaaataacttcaagagtgtatatgtacaacataaaaaaactttaagagtgtatatgtatacaataaaaaaacatgaatgcaaacttgtactatttaaaaatcatgaatgtaatcttgtattatttttatgacacacaacatatcttgatacatgggaccggacgaaacggtttagttttaatccgaaatgacttctactatttttataatatttctatattttatctctataaattgtaaatatagcagtttaaataattatctttaatctaaagggaacatgctgaataggttgagtcaacttgcacttgcacacgttcaattttatcccaccgcagcatgcctgtcccatacgagtatccaaacctcaaccaatcaccttcttacctgaatggaatttttggatagaccatagtcgcccccctggtacaggacgatcgtgtgtttcgatgtggatctgccaggcccaggcactctctgtttggtttcagccggcgaccacgtcggtgcggcaggccgcggcagatcacatccatagccaggccgcggcacaggtgaagaagattggaaaaacgtcctcgtcccggtaagccgtcgcgtgcccggtgtgccggcccgccacgcaacggcgacacgtaaaagtcttcgttgccgtgccctgcacagatcataattaggaggacttaatcaggctgcgtcttcgtgatttactgtgtttgttcgagagagaaaatagtttatcatcttctcactccttatttttttaatgcaatgaattgatccattagcacatcatttctcatagttagttagt

SEQ ID NO: 2875 - DNA, 1331 bp, Zea mays
  misc_feature (1)..(100): optimal_loci_126747_G1, chr3:209103488..209104818, Cluster 17
agattcaaatatatctaaaaatagagagcggcaccattaattaatttttcgaaggtatgttttttcgtggcaagacacagacacgatcgctagtcaagtttacaagtcactagttagatgcccgtgtattgctatgtttctaaaaaatgtgttctgttgattagatgaatatgaatttaaatccatgatactctaaaagagttcgctgtaaaaaaattcaaattcacggacaagtttaaatggcaaatcaccgattgatcgctcaggctgcatgtgcattactaaatgggtaaaagcatgaagtagatggggaactcaaagatagacctatatttttgaaatgacccaacacacatccatatatatatagtacaatggtctacaacattacataaattattcgataaaatgttactaaaactttagagtgaaatattatgtccgttttcttttcttggagaggggcgaagaaataaggaaatggttatggctttgttaggaggatatatgctgactactactaagcaacacaaatatatggcaaaaggaacctgaactttgctctagtttgataggtaagtttaacagcatgaataagcaattctatgatctatttagcaatcggcaggctagatagaagagcgactatgttcaaaattcttacaaattcatccggataaatcgatgttaacttcatgcgcaagtaaaataaataagaatatatgcaaagtatactataacttagctcgtaatcaatcaaaattgcagagcctcaattatttgaatcgggatgtcaaaactcaaaacccagctcggaagtcacctcgtgtaagggcgacgcggcaggaaaggtgcacgccgtcactgtgcttgcgagcaccgagcctttgcgcgttgttcctcacgaaacctagttctaccacggcgtcggcggccacgtcgtgcgcggaggcataactaattcagcaagttactaatgtgcattttattattatgtaataatttctatatacgaatgtttatgtaacgcaacttctcaatgcttcccccatgctaaggcataactaattcagcaagttatacatttttacttatgctttctcagatagtaagttacagatttttacttatgttttctcagatctaaacaacctggcgtaagtgctaattcaattcaactgcttttatgtcagggataacattccagtatgaacttaacgcttcaatcattgtatgtggctcatcaaatagccagaaaatgcacgttgttgtagaaccggggatcttgaaatgtataaactacgattgatacgatgctgcaaaaaacttgc

SEQ ID NO: 2876 - DNA, 1285 bp, Zea mays
  misc_feature (1)..(100): optimal_loci_12753_G1, chr1:69864316..69865600, Cluster 17
atacccttagactttattcagttgtacagggacctgagaggattgagagagattaagtctctttctattcaattttgaccaaaacagatttaatctttgtcaattcacttcaatccccacctaaccgagcatgccttagccggccatggtagggttgggcctcgggtgcatttggtttagctgtgagttgtgaaaaagcttttgtgggctgtttggtgtgaaaaaacttgttgtgagaaaaaaaagctgaaaattgtttggttgaaactgatgcaagttgtcgaatgtaaacaaactctatgttgtttatatacactcgatttaaatatatctcttaatcaatatatctaatttaaaaatgatttcacatttatgttcctaataatttttgttacaaataaataaaaaattaattctatttgtaatatttttattgaaaatatttttatttcatttattataacacttagttattttaattctattttagtttcaatttattgtgtgtgtttattaatataacgaacatcgggtacaagttgctttcatatttgtagtaaagaaaacctgttttttcctagcaggtacgaaaaggttgaacagttttagtttaacttcagctttttgtaaaacagaagaccctcccttgtcacgccttggacacttttgcaattttacactcgcagtttatcccaagaagccggttgtggtggctggtttcacgtacgaaagcaaacgggccaggtataaatctttcttccatttttaaaaataaatcttatagattagtatcttattcaacaaacatttgctggttcagttgagagttgaggccgtactgcctttctcgggaaagagaaactgcaccttttgacgaatattaggcctttttatgaatattaggagaaataaggcctctgtgtcaggtttcctttcaccggctttaccgtttgctcttggagccatcttggattccttcattggtaacgacaccactgaactgcactaatcgcccccgctgtacgcatgtactgtacccgtggtagcgacggtacgggctgcatcctgtttcaaatccattcaatacgctgtctgagccacatcattcagcattgacagaacctctttaatatccttgccccctcaacgtcacgctctccacccactggtttaatcagactacgagggggctttgatgaattgcagagacttttttgaggttgggaaagaaatcaaacgaaaataattttaaccgaaattcaaacagcttttgcgcctgcagcga

SEQ ID NO: 2877 - DNA, 1305 bp, Zea mays
  misc_feature (1)..(100): optimal_loci_128196_G1, chr3:216144761..216146065, Cluster 17
ataaccctaaataaacactttactactctattattttagaactaagcaaacctattaattaatgtgttgtacaactacctagctagtggctaattatgttattgaaatgctgaacacttcaattctatgaatcatgtattatgtaatgttcaatatcctagagccttggaaacatattactcttagtcaggtatcttgatttccaatttttgcataaattatatatatattaatgttttttataaatctgatgttttctatagccaccctatagctgtgtagccttaaaaatgatgttattttgtatagcttgctactttaaacattgtagccattagaagggcactggcatgtctaaggcaacatctcgctaagcattggacatatttagtgcccctagttttagtgtgttcacgtgtaatagttagattcatttgagaggctatttaggctataaatacacctcttggatagccttggttggtaactactagggcttattgcaattctaaaataacaacaacatggcaacatgattatatcattagtttctactcttctctcaagttttggagggagagaaggtattgcgaggggtttatattctccattgatgatttataaaggtcatgttttactttcaaacacaattatctaatcattttgatgatttataaatgtatgttttacttttaagcacaattatgtaatcattcccgaataataatataacatctaaaacaaacaatagcttgaaggagaaatgtttaacataaacaaacataagctttagatataaggtaacataagagacactatcaatcacaaacataaacttcaacatcgtcattatacatttgatagctctctaatgacacgggtgtaacaacatgcaccgactcagcaaaaatggtcaacccccaagatggtcacactattcgccaatttacagagttgggcctttatacagcttcatgtgaaattataattttgtctctctttctcacatgacaattattcacatttgggggagtacatttaatttatttctccttgcaaacgaatcgcacacctcttatgttcaccgaagcttcctatatcttttctttgtcgaagctccttttgggcctcatttcaactgaaggttatctttatcgacgctaaagatttacttttgataccttcaactccatgcacttttatctcacccacgtgttccaaagcagtctgataagggttcaatgatcagaggtggttttcctttgagtcacgttacatccctatcctaaaacaccatctaaatac

SEQ ID NO: 2878 - DNA, 1288 bp, Zea mays
  misc_feature (1)..(100): optimal_loci_128355_G1, chr3:216965794..216967081, Cluster 17
cctaagaatactggttagatttcaagtattcctaccattcatagacatactaattgatagaaagtataataaagtaacgtaggcatgctgcaagagatgccacgtccaatttgtggtgacgtaggagaaagagaaatggagaaagagaatggaagcgggttgctcattagtaatcggctgaaagcagactgctcacgaactacaagacaatttgtgagagaaagaatgagccaagtattaaatgcatatcttgtatcatgggaacttattatatgattagacttttagttagctatatatatgacatgtcaacattataaagctcattgtgagctatatcgttaacattactctaattagggccatcgtggacatattgcatgtatacatattaaggttgtagcattcattttgatgaaggggtaaatgcaaccatattgattagggtccacatatgatatgatatatagatacacacacttaataggattgcaacatgcatgcttactagtgtttggaggagtggcacctgaaattaagttcaattttggtgtgcaatgtatagaaaaataatgtttgaaatgatggttatgttctccaacacattctcaaggaaaatgagtaaagcttaccaatgaaaccagggcattggacactatcaacattttgtcatcctgaactaggatacttacattatccctccatctaactacttgttcttgccctcgtgtatctccaactccatgtatccgcagtcggtagagttacctgctagaggcttggtgggtagtgaggaccactatactagggcatctcgcttttcccttcatttgacctcctttgtctccctcatctctagtttggtctagtgacatcgttcgtgctttggtgtttagtgccaattagtttagttgtgtgaataagtggctttagttgggttaagtcttagtattgatatgaagtcatactaaggagggtgtggcccctctagccgtgcgttttttgggctagaaggtgcactggtgcaacacatggctaatatatgaccatgatgttcaagtgcaatgagaatatgtcaagggaataaacagttttggattagtttttggactaatgattacataagtgtgtggtgcaacatatctcttggcttgtggtgcacatgtgtggagcctaaaaacgaccgatgacaatggataaggtcaaagtagggtccatgtttatggactacaagacatgaaagatggacgatgaggcttggattgagggattcgataagctagaggac

SEQ ID NO: 2879 - DNA, 1122 bp, Zea mays
  misc_feature (1)..(100): optimal_loci_128505_G1, chr3:217637378..217638499, Cluster 17
gttctttttagacttctatccgtattcgatttaatgataataaatatcgtgacgtacctgtcacttgcacccgtcgtcgtgaccacacggcgagcaagcctctcccagtcccaaccatgtgcttgaccacttaccaatcaggattcagggctacatctaaagatggcaacagaaaatttcccatcagcaaatagccaaatagctctatatcaccatctccacgaccaaaaatatttttctgcgccatagacgtgccgggctgccggcccatggcgcgggcgtacgggcgcggcccactgaccagtctaggacaccgttcaaaagcctttttttcccccagtggctgcagctagtggcacctcacatattactgtacaaaacaccaggcgctgctacagtacagccgcagaaaacgacatccaggtactcggcccaaggcgagggctgccagcccattgcatggcctgcgctgagtagcagtcgttttgattttgttctagatcaaactatttatactttaactaatatatatatatatatacataatattaaattattctaacttaaaagaattacgtgttatagaagttcaagtcatgatgaatctagaaagtttacttttataatgtaaaatcttctaaaacatctcgtataaccggtcaaaattgatagcaattgacttaagataaacctaaaacaactaattttatggatagagggagtactctcagtctttatagatatgagaatattttgtttttttagaacaaagattatggagattttagtgtctggattaaatctactggaaagataaatctaggtttttggagagatcgtctagagagaactaatcttgtataactgatcgccgcaaaagaacaaacgtacaatccatcttcctcggatgatatctttcataccgttctgccctaatctgtttaaacatggttctgctagaccaaattttaatcttatttggcatgatgcacatttgtagatctattcgctttctatacacgtttgttgtcatgatcatgcttttatttttggattaaattagtttttttaacgtgtaaagccgatactaaaagatgtcttcactatcttacgatcgttttg

SEQ ID NO: 2880 - DNA, 1377 bp, Zea mays
  misc_feature (1)..(100): optimal_loci_128508_G1, chr3:217640136..217641512, Cluster 17
ctttgcagttggcactccagagatcaatcaatagatcataggcaatcatggattaggctcgtcactcgatcagaaaatgcaacaacagaggctgcttgccacctccaaagtgggtgggtgtccggttacgctggaacgagactgagaactattctttgaagttggaatctcggtgatcatcaattcttatacaataaattaggtgattattccggctagaaaacgttatagggctatggttcgtgaatcaccgagctaatactaaacaaacatgtagagaccatttttttataaaggaagattatattaataacttcaagcacattgcatcgacgagatactagcccttgaaatttcttccacccttataaatacataaagttgatagtcatatatatattgtataaatatgtatacattatcttagcctttttatttgaaagattcctataaatgaaataaatatataactaattactacaatggatgtcactatatattatatttcgatttcgacgaaagacttcttttgtcgtagtggaactctttgtttttggatttatataacaacaccagacgttgttctaggattgccatttgccacggtagcatcaaataggaattcttccttcactttcattagctatcatttgccaaatagtcagtatagtaaatcaaacctctggacaaaatattactcatagaaaatatgtagtgcatgtttccatacgcacttcaacatccttttgtaactgtatcattgctacctacgaatgtgtgaatgaattcacaaacatgtttattcacaaaaaatcattgccttgcccttgttggcaagactaaaagggtaaaagttataaagtattattagcaaatgacatgcgagatatgcagatccatacatatatacaaaaaaattggcttgagcataagtttttttcttttagaccaagattatttctgtggaagatcctacatacccttgaacaagagaaggaatggtgtttggtccatggctgaataaaagcaacagttatatagttatgttggaatgccatcaattactcgttaagaatgtccacggcctcttgatagtataagactcgattcctcacagagtgtagcacgtgcatagtgccatttttcatcatgattataagcagtatctatctggtggaagctaattaaatagttataaacatggataacgaattggagtggaaatttaaataggaaaaaggtatagggaactagataaggcactaacttaaagttgtaaggtataagtatgtatcgcttagatagaacgttatgtcttatttgaaataaaagactataaaaaaactgatatgacgctgcatgctatgggtaggagcg

SEQ ID NO: 2881 - DNA, 1066 bp, Zea mays
  misc_feature (1)..(100): optimal_loci_129413_G1, chr3:222612050..222613115, Cluster 17
gacgcacgactcaagatctagacttcggattggttatcattagatctatgttattttagttttttgtagttggctatgtacattaggaagagggcggaagttctataccaaggatttgtatcgttttgatgtaatgacttggtatcttcaatataagcttcctttatctaaaaacccctctacccatcaggtaagaagagtagtatgagtatatgttgctcccacatataaccgcaagtattttatatgtatctatccatatatgttgttagatttaatatagacatgacttatattttactaaataaaacaaattctagttacatattaaatatctggagccatgagactcttttggatactcctagactcttttgagccccttaggttcgttcaaaggctctcttagggctaattttgaatatcaagggacgtcctccaccatggatcccctctaattcccttatcaccaaacgagcccttagggatcttgccgtcttagaaccatttgggggccttaggttcccttggggccatcaggatatcttgtgccctcgatgggcattagtagtgttgaggccctcgggacattcgaggcccttgaggccataggggtgttggagccattcaaggttgtcgtagaattatccataactgtcctatgtaggtgtatttgttttgtcacttggactagttaatggagaaaataatagtcaaattgatagagatgtaatatacctataatatatgtggtaatggatgtacattacgatgattactctatctttttgtcttcctacatgtcatacccaattattaaaacaaattgggctcgatatatgtgtgtccaagaagtctacacatacaacacagaaatagagtatatcaaaaaataatattctatagaaaaaacatatatttaacttttacttattagaatatagcataacgattactaaacttatcttcatagggagagtagactaggggtatatacgccttaacacttataaaacttttcagaaaattgactaggtccactatttgatacatatctatgattttt

SEQ ID NO: 2882 - DNA, 1232 bp, Zea mays
  misc_feature (1)..(100): optimal_loci_129662_G1, chr3:223672603..223673834, Cluster 17
tattatctgcatggactatatgtattaaagcttgtatgaaaaccaattttagaataagacgaaagctccattctgtggtagtgggctaaaaaatgttggcagtatatttgttggcttcattcaataatattcagaatatcactcctaaagtatagaagataattttagataacaaattctaaactatttttaaatcactccgacaatatatatattatatttctctccagtatatttgtatctggattgccctaaccatgtgtgttactctttattcttttcatatcctttcaccttcagattgacatatccatatgcgcgtgtttattttcgtccgattagattgattttcttttaacgtagggagttgatggaaagcagattttttcagtcctattaataaaatctcgattgtgtatgggttttagatacatggtaaaactcatataccaataaagccaacatattttaatttggtatggagagagtaataaacactattgccgctgcttcttttatcatcttgagagggtcaagatagcactcattggcgagcgtagtttgacatctgcgacttgtgaatgcagaaatacgaatagaatcattgcaagcttgcaactgctgagacaagtgtgaaataattaagtactgttctgcttctgcatcgactgtatcaaaactgattgcgtgataaaggaaccatcatggcggtgaatcatcaaattgggcaacttgcatgattattgtctgcacattgggtgcagaaaaggatggcgcataagtatatgccaatcaagtcacaggatcccttgatggaacagaaagcaaatagaatgtccagacaaaagataaccaaccaacgcatgaaactccctggctagccgtggatgaggaatcctactacacttgttgacaagcatatggatgaggaacattgaccacataaaattcctttcgttaaatcaacaaagccgtcgcttatgataaacccgctgataagataacgatgcgcggtttaatcgagaattttcagctaaataaattaaagcagcatatgctatagtgcagatcatctcatattctcatgcttgcaggttacagctggatcacacaacaattttgtatgtttggttgcccgcaccgcatcgttgattttacttgagattatgtttggttgcttgtacgtgagagttaccgtctgcatgagtagatacaaaataagctattttgat

SEQ ID NO: 2883 - DNA, 1061 bp, Zea mays
  misc_feature (1)..(100): optimal_loci_130452_G1, chr3:227483890..227484950, Cluster 17
tttgtgtcatattggcttaggtgttttctcacgggctatctagagtgacgatgcaagatgacaattaatggaccataggttagataaaaaagaagtataagtttttttttgtaaaagggacgactgtggaaactagaaaaacatcttggcttgttcggttgtcctacaaatgtaatatatagagacaaaatactgtagaagccgtagccaaattaaggttgtagcaaggcacaacgaacaagcctatgttttatagaagtagagaaggaagtaacaaacgattccctgtgttttaaataagtcactctaattttttaggcgcatagattttgatatacatctaaatctatattatgtctatataaaaattaatggttatgtatgtaaaaagtcgtaatgacttggaatttaaaataaaagtagaaaaacagcatgataccaacgtccatggtgaacttgtgctttactagaagccttggcaaggacttgattattacatcacacattttatcatccgactcgagtattgtagtgaaaataaatttaatagtaggtcatcgtgtattgtagcgaccacaatttcatcttcaaaataaattttgcatagtaacaaatccaacacaggcatttaacaggactagcacagttgcacagtctctcaggatacgacagaaggccaagaaagaagacttagcattatgtttaacacaaaaaaatatcttaaataaaggttactggtactactaacaaccatgtgaattatatttgtgctcataattaataaattatagttatattgatcatagaaaagttagtgcatattgtttatttattatattataccttaaagactgatttgatgacaaggaaattgtaagggatccatgagtgaggaaatctcctactattcaaaattgaatagcaagggattttctctcaatggaccgcctccaattttcttgtcaccaaatcagcccttaaagtggaagtccccctccgtgcatgcaacaactccctctcatgctgcgaattagggatgttgcagcgaacatcacaagaga

SEQ ID NO: 2884 - DNA, 1216 bp, Zea mays
  misc_feature (1)..(100): optimal_loci_130943_G1, chr3:230410163..230411378, Cluster 17
atgtcgcccttttgtctgcccgtccgtgtggtctagtttggtttagtgatgctaatacccattttgttacctcttagcctgccacaagaagcgagaataatttaaaacaaatgttgctcgggtattacgatggcttcctgggcacatggtaggcatttcatcgtcaataattttgtttatatcaagtaacaattacattaaacttaagatgaaacatgacatgtacttcaaattgcatggtacctacgaatactagctttcttaataaactgctaaatgccacatgtcaaataatgtgtggtaaataagcatttagaagttgaaattagtaggtgaaataacaacagccttagttgtcttcgagaacgtcaaaaggcatcagctataattaaatgcattatgtgctatcgatcttttaggatttttttactgttgttcgataaaaaagatacttttgttggcaggtcagaagtatatattaaaccattgttcctaacgacctgcatccatgaagtctttaatttaatctcagaagaagtcttcacaagggctaccttgtgtggaaatgacaacattcatgtatatatatcaaataattaagaaaagtttatcaacaaatgcaaatccattgccattaagcattcttgccattttcagtcttttatacaacaaatttagaaaactaatcttctttcattaattctagctacttttgtcatatgcataatagatattacttgatgtgtaatttttgtttatcttacttccaaaataacaattgtaggtgtgttgacatattcaaacctcaggagcaaaaattctgttgaagacttgaattacaggaaagaacattttgcagaaaaggaacttatctccataagaggtactgaatctccttacaaagcatgaatccagatattccttctccttagtggaactactaaggtaatctaatattctatttgttttgttgtgtaggtaagtcatattctatgtgctatgagatttgacaatagaacacacatttaccttgcttcaggtgaggtctttggtgggaaacgtttcatgaattaagccatacaaggctatgtttccacagcacagtcggacctggaaagttggaagagaatacccaagggctagcagtatcagcagttgattacatggtttgtctcttatctgacatctgtgtactgaactgttctgcttaattttt

SEQ ID NO: 2885 - DNA, 1173 bp, Zea mays
  misc_feature (1)..(100): optimal_loci_133945_G1, chr4:11832069..11833241, Cluster 17
gggagatcaatagcacatacaagtccattttttcacggtactaaagtcatacattgacgaaacacatttctctagtaaaaagtgacatttttaatgacgaattcaccgttccagggaaaatattaattccttggttcgaaaacaatcttaattttgtcattgtcattttcaatatacctttctctttttctactatatatttttcccttttctaatacatcttgatctctatttttatagatattttggtcttttgttatctacattggccttcgtccctggtttaaaacatcaattaatatatatatacattgtccctcatcaagtgtggcttgttcgagctgctaacatgagttggtcctgacaggttggatctcacagtattagactcaagacaactaaaactcactagacccatatggaatcatgaaatcgatgcatgtcccgcaaaaattatcaatgttaaccatataccctagaaacaatgagaagatgtgttagtttgttatatgtattgctatttcctattgtttaaataactttgagagtgcagaattaccacttggtctaggatcagaacaacccccaccacttgtgcctctgataagtagcgaggtcataggacatgtcttcatcgcctaacgactgaatgttggtgtagttcgcttatgtccattagcccttcatcttggaccatgtaacaccaaggtaccaagatatatattaccaaaatgggtgggatcaatggacatcttatgcacaaccatgttcaaatattagaactgagtcctcattatggtctcacataattcttccactagtccttagaggcacatacacaaacatggaatatcttctgagccttcctaacacttacacaaacctagttagcgcataaacaaattgactaagtgtaggaatctcatcttttactcaaactttcacagggatcttctattttgctcaaactaagtaatggaagcacttttctcacagaattgagttagagatcaaacaaaagtgctaaaacatagtattaggcatatgcaacttatctaagtacccaaaccttgtggttttaccattttacccaaagttgcactttcttgctccattttagctctttaggacttagtgccttcaaattgcattcaagtggaccagagctcatac

SEQ ID NO: 2886 - DNA, 1296 bp, Zea mays
  misc_feature (1)..(100): optimal_loci_136716_G1, chr4:25649045..25650340, Cluster 17
atgcaaactgtccataataacaaaatataaaatagttctatgcctttcgtggtagaaagctattttggctcaatataaaatagctccaatatcagttaatagctccaatacagtcaatataaaatagctccaatatcagttaatagctccaatatcagttgatattttataagaacagttctatgcctttcgtggttaacacatcagattttcgaaaatctgaatacagtcaaaatagctccaatatcagttaatataaaatagctccaatatcagttaatagctccaatatgcagtcaattttcaggcataaaagactatattaattgtgtatttaacccaattaatatctgtctcttcagttgtctttaaagctaatatatttaggattcagagacagtgttgtatggtttgagtattttagttgtctactcttttatggttcaatcggtgctaccagccttcacctatctgaattaatatatttagtatttaagttgattgcaggcaatagtaatctggttaacacatcagttaatattagctagctttctattttttctggaaactattgatgcttgaacagttccaatacagtcaaaatagctccaatatcagttaacacacaatataaaatagctccaataccctaccaataccctgacaagatttatgttgttgcccattgccctgcagcctaccctttcatccaagccttcttcataatgacgaggatgcgccggttcagaagcagcagtggtataaattataatgtcgaaaccattatttagttcacagaactttacatagatacatgttgagcgagacaggtactgaaattagaaacaacagtacaaggctacaagccaaaataggtatttgacaagaaaaaatggtgtacttgtatttaagaagaacactctgctgtagaatctgaatattagtctttggttttctcaaggcatagaacttttggatgacaaactcgaaaatctgcattgactgtattggagctattaactgatattggagctattttatattaactgatattggagctattttgactgtattcagattttcgaaaatctgatgtgttaaccacgaaaggcatagaactgttcttataaaatatcaactgatattggagctattaactgatattggagctattttatattgactgtattggagatattaactgatattggagctattttatattgagccaaaatagctttctaccacgaaaggcatagaactattttatattttgttattatggacagtttgcat

SEQ ID NO: 2887 - DNA, 1232 bp, Zea mays
  misc_feature (1)..(100): optimal_loci_136789_G1, chr4:26169391..26170622, Cluster 17
gtttgatttttccaacttcctaatcaaatgcaacactccaaagagccagcatacttcaatgtcaccagaaatagataattcaaatcaagtatccaaatttgtcatagtaagaattacacatatgtctatgccaatataaatcatataatagggttgctagtagcacaagagcaaatcctagtaattatagtttttgtatcttgaaatcgaaatgggtgaaacctatatatattcaaggaaaaagaaagcttatataagttcacaggcaggaatgtttctggtaatcagtaaggtactgtcatcaatgtttaagagactaaatgtgaaacttttagtttcagtgatataattctctaatgttttcctgtaagctagtgttcatgtgtattttattgtcaacctagcatgtttatgccagctgtgctatattgtctatcatcaaagatcttaatatttcaaacaactaaaagggaaacctgtcaagttacaaggtgcaaagccaaatacccaagcatgtgttgtttttattggagtacagtttgattcattgatcagaaaataggctatcgaacaactattgtaactacaagttactgtgaatgatcatccagctgagatacctccacatgggtttgcaatttacagacaattttgagctgtataattttgcgtgatcagatgggtgttgattgttattgtttcggccaagaaggaaagaaagaagccatgaattttggtcttgggcgactagcttaatttgcaggagtcctagataaacaaggctaaatatgctagcgtcgaaatgaactaataaatcttgcagaaggattggagagaaaaccgacatactgcctctgcaaccaagtcagctatggtaagatggtggcatgcgacaatgatttctaaagttttagacatgaatttgtcttgcagaaggattggagagaaaagcaggatgagttcaagaaaaaggtaaggcatcttaggctcgcctgctgctgctgttgtgatgaagactattgtggttatgactatagccttgtagggtagctttcagaagcgtatgagtaagcttgaagaaatccggcaaggtatggaactaccttttggttgtttctgagtcgtgttatttctgttctcattttgagtaacacacctaactgattgctcttttggaaagaaattattgtttacatgtatgccatgcgttgtaattactagaaaaagaggca

SEQ ID NO: 2888 - DNA, 1203 bp, Zea mays
  misc_feature (1)..(100): optimal_loci_145828_G1, chr4:82560970..82562172, Cluster 17
cccacattaggttattaatagagtagtatagatgacaggtgggaatctccaaactaaagtatggacccttcctctgttctttcatgtatatgacaagtgggaatacatttaggatcccactccatgagctagttcaaatggatttggcattcagctgtcctaagcaaacataattttctttttggtttcttctaattaatggatggattggataatagaaactttctcaggagaaagaacaatcatctcgaggacaacaattgtgctctatgcaattcaggagttgagcaaacacaaatgaatactgaagaaagtagttattacttcttgttcaatgttttggaatcattgtaatagtgccatatttgataatagttatcaccctctttctcgttggaagtcacaacacaagaagtagcttgttacctaggtttgtatcaaggctaaataaaaatttaagggacatatgccatttcggctagagaagttctcttaagctagttgtttcttattgttccgataaaaaaaacaacctaggaatgctaacatttatggataagttttaattatttaaggatgggaacatagctttaaattccaaaataatgtgcatcatttttttcatgtagtcacgccctattacatatttcctaatgtacactattggtaaaatttcttttgtttgacagcatgatatcaaacctataattctcttagtttcactactacataattgattttgcgtgtataagccaaacattaagtgagataggcacaataggatgttgcctccgttaagtgtctgcttcaggtgatagataacagaggttaccatcgtataagttgtcagtcaccattaggctattcctagtgcacaatatcaaactcatttaatacatgccatgtagtataaaaagctgatgtgacatgttattaaagagggaagagaataaagcgacatcttcagggagatatcactttggcacgagatcatatgcattaaaatctgaaccatcaagtggcccaccattcatactctcatatacgactaatatttaattaccttgtaaggactacgaaataacacatgatactatacattgggacaactttatgttttatgataacgtatgatgtagtaactttggatattgtgacaaaaaacaatgggactacatgaattcaggtaattcccgtcgactc

SEQ ID NO: 2889 - DNA, 1175 bp, Zea mays
  misc_feature (1)..(100): optimal_loci_14956_G1, chr1:82588888..82590062, Cluster 17
atcaacccactcctcatgtatatactaattattagcttatgaggaatggagtggtgatagatcaacccattctattccacaaaccaaataaaaaagtgaggagtgagaagaagatggatcacttcattcctcaaaccaaacacactattaggtgacaacaaccaccaagagtaataatgaaaccacaacccaatcagtcactagtgtcactaggtataagaactcaatgcaaatacactagaatcactcctagtctcaatttggatgaagcactagatagagaaatgactggtaggtgtttgtagaagctcacaggggtgtatgaccagttagagagtgaagagagatggccacaacccagccaccatctatttataacaccttcaagcgaaactagatgttgggctgcttatttggttgaacatgtgaccatggatcctcaattgtccatcggattaggagcaccaaagtaagtgctatggataaatatcctatagcctatactctggtgccctgctcgctcaatctgatgccatgttgcacgcatgttgtcagatagaaatagttgttggttgaggttggctagtgtaatgcatactctgatgcatttgaatcaatgaccatcataactcattcagatggaacacaaagaggttctagagccacactttggtgatcatattgtaccagcggtctacatagaaccaatttgatactacatttgaaagtcccttgtgttgacaggtggggatatctaagtgaaaacacgcttatatgcgctaatgtctctcaatccaatgccatcggatcaagggaaaccactctgatgcttacacaaagcctgtctaaagagggtttcgtcaaatcagattgtgttggtgctgagaataagtgtgttagatgcctaaccataggtttagttagcacattgttgcactctacatagcttatattcaattgcacccctttaacacaatctgatggtgcattagagagcattttgagcttagtttgatccaaaatgtgccaaatccaaatatgtttccaatacgtgtgtaaatgagttagaattttcacaaagttttcaaagttttttcaggttctcaccaggtcaaaagcatatgtgatgaattgatccacctattgccacttagataattattttggatttatag

SEQ ID NO: 2890 - DNA, 1125 bp, Zea mays
  misc_feature (1)..(100): optimal_loci_155807_G1, chr4:151411325..151412449, Cluster 17
taactacgcgtgaagcaaacatcaagcgtcaccaggaagagctccaagcttgtgagacgaacatcaagaacaagagtgaaatgtataaggatgcaacctattcatcttttgggtgcgagagaaaaaacacccacactatacaccaagtacacaaaatataatagacctagcgagttatattccctaacgcatgttaggactagtggtagatttctcatagttccacacatgctattataagttgtgtttgttacatttctctaaggcatgttaggattagtgctaagtctactatttagctttatatatctagagttccatacataccatatattgttccatgcaatatccatgtaggactgagttcatcaaggcatctatagttttaaattatccaaagatcgagcaagaatacaatagctagttcttattttagtttctaagaacatgtgtaacaattgtgaagcaaaccattaaatgcattaaaaataaaatatattgtaacatagtacaattattcttacaacgaacaaagctaaagggatatatatgtgtgtgagagaacaaacttgcttaaacaagttgatgacatatggcaggtaagtcggcgtaacatgccacaatactgagctacctaccatatcatagctatgtccttcgtttggtatcattgttcacgacgccgagacatgttacctcaacaccgtgaatcatgacttcgaactttgggtcttgaaaataaaataaaatacacaaagctttaaatataacaaattctcgtgtgtttattggttttgtcttgcaatttgttcttcacctttcctccctagtcttatacttgcttgcactaaacttctattccatcgtgttactaagtccaattctggcatttatatttactagcaaccttgtgcaagtattgtgtttatactaacccgaactatcacatcttgttctaagcacttaacatcataacttcggattaaaattgtattgtgttttgagttttcaaatgtcacatattcactccctctaggtatctgtagtttttaaattgtccaaagatcgggcaagaatgcaatgaccagttcttatttttagtttctaaaacatgcgttataattg

SEQ ID NO: 2891 - DNA, 1224 bp, Zea mays
  misc_feature (1)..(100): optimal_loci_16030_G1, chr1:88854651..88855874, Cluster 17
gcaaggttggtatcgattgaccggtaccaactgatgcaatggcgttgcgaccactgccgaccaggcgtggtcggtattaccgtctggtgtctacatgacagtatgtgatttgtccattcaatttcaaccttttaaatttaaaaaatccttaaaaagtctctaattcacagataaatagatggaggtccttccctttattcacacgcttttatctctaattctcggcccatctcctttattcacacacttccatctctaattagggtctagggtctttcgaacctccatttccatatgggtccgaggtggagtcccaactacaaaactttcgcctccaattctcaagttttctccttcattcacacacttccatcctctattagggtttaaactcttctaaacctacatttctatatggatccgatgtggagtcccaactacgaaactttcatggattttctcaacgagcaatctctgtaacgtcttgaactttggaagcagtgtgcatagtcctataagaaactgacaaagagagtcaaaaatctcttatcgaactccaaatcctctagtgctcacatatgagggatcgttgtcttgctcagttcattgtctgtgacttgctatctctctgaacaaatttttagcaacaacatttggcttaggttttggtatcattattttacactctggttcgagatggtgtctaaagggtccaactctctgaaaacatcttaaaacatgttgtaagcggctcaaggtggattccatgcttggttctgttggaatcatccaatgctcggggatgccattctgtacatggttatgtaacttagatggtttaccagttccatgacttttagccaacataagaacacaatgtaggacaatagaaaccagttcttagatatgatcgcaatcgccgcactacataagaactttatgcttttattgtttctaaaatttgtcatattttttaactttgtttatttcgtgtaattttattttttaaaaactagctatgtatttttagtgttttccatattttttgtactttattgaattaagaatcgtgtttcattgcacatatgaatatgtaaaataaaagttgatgtgccattgatgtggttgtagattgatggtaaaaactacactagaaagttggggtagataaagcctagtactaatagatatagactggtcgctagtgaggtagcggtagatatt

SEQ ID NO: 2892 - DNA, 1056 bp, Zea mays
  misc_feature (1)..(100): optimal_loci_161340_G1, chr4:183931224..183932279, Cluster 17
aaaagtttcaaacatccaaacgcgcgctactacacacatactgaaaaataactcagagctgtcaaagttagacatgtgataatcggcttcaaatgcaaaaaaaatttaaataaagcgtcacttggagaggaagcttagccatatagcatcttataaagctagagttgtcacttgaataatataatgctagagcctacgactagacagctttagttgtgcctaaccatagcatccgatctctgtagttcgttgacaagaatgattggatctctcaccattttgttctgcttactctagcggttcagcatatgtttattgcttagtattccaacgtgttgttgattcgtcctgctggtgtagctagctaggatcgagtgcagagcaagttttccacccgaggggtacatgtatgcttggaacaacatatgattggaaaagttcgcgtcgacgcactgggtccggttcgttggacttattctgctgccattgtcggtttcaaactgcaaatactatgcctttatttactcaaataattcctaattaatttacagatataatgtagcaattatcatcttctgttgttgatttatcctcatgtgatagcaattgccctccaaaccgatcgagctgcttctagaaatttttttgtgaagctaggtggttttcactgtttagctatatatatataaatgctcctgtatttagatgttgtttagaatggctccaagttctagctctagtgcagatatgtagtttgtaatatcaatttaattagttttaaaaatatttttcatctaaataataattaaaatgatttttctaaatattttctaaaggcttatagctctagtttcacgattttctggagcacttaatgacctactccacaaaattttctggagctgaaactataccaaacatgactttggaggcggctctattttcaaaccgtctttagaaaccgatttgtaaagttgcatctaaaattagaagttgtacaaaatttgagattttcaaacgatgtccaacaaaaaacgatcaaacccgaagttctta

SEQ ID NO: 2893 - DNA, 1247 bp, Zea mays
  misc_feature (1)..(100): optimal_loci_162728_G1, chr4:190952237..190953483, Cluster 17
gtgggtgatcatagtaacctcatagtcaacattttggtcctcatgatgattgtcacgatcaaggggtggaagggcacagcatgcacgagcagggcctcttgttcgagattatgctcgcgctggagagcacattagcctcatgcatgcactctatgcagatgcggcagtggtgatcgcaacatcatctttagtggtgcggatggtggcatcgatgcatacctatgcatcaaccaaggctgcgaactccacttcttacttttgggcttcttgagagtcagcttcttgctcaatagcagaggccggtggtggtgagctcaaagtcgaaggaaggcataatagcgacagctactgtaggagtgaaagcggtatatgtcaaagaactaagaaggtgatatataccatattagagaaaatatactacataaattatagttgtattgcattgagatctatggagtgattatatacattgcataggactaacaccttaagatactaggcaatagggtacaattcatatctacgtatatacaacgctaggtagcttggttgacaagagaagaaccctgcccaactatagtaacaaggtccaatcgaaggtccaatagaattgtacaggtaatcctaatgttcctcattccacatggacagaagtgacaattgtacaacccaaaatctacaattttattacttccaaataaaatgaaacccatcagatgaagtttgaactgaatttgaatcttaaaaggtgtagcacaaattggccaactaataaagccatgaaatcaccagctcccttaatatgatcaccaaatcattatggaactgaagattataagtaaaagatagaatttttagttcttaccttacttaccatgtggttgtaaagaaaatatatctggtatacatagagcggcggaggacgcatagaatttgaggtatcgcagattttgtacataactatatgtacaaatccatatatataggttctagttcacaagaaacaatttaaaataaagcagtaatttaaagtatgtagcagcaaaacaaatgtaaataaggacattgaaacataccttaacaaaagaagatgaattcaccattattgctatcgataatgatataagttacaaaaaatattggacaatgcaccaataaaaatctgttaaataaaaaataaaaatgtgttaataatgaaattttgataaaagtaattaaaacaaaacaagagtaattaagagatatac

SEQ ID NO: 2894 - DNA, 1193 bp, Zea mays
  misc_feature (1)..(100): optimal_loci_16396_G1, chr1:90935929..90937121, Cluster 17
gtgaatttagtataattattaatgatcaaaatcaaatagagaatatatatgtgtgcgctagttggcactagccttccccagcgcgcctcctctaaccgagcggcccagcggccaattgaactggccaaaatttctacatttatttaatatggaccaagcacatgtacgttatccttccctattatgttaccagagtcagttatgcgtagttatcagggtcagtcattgtattgtatcaggatcaatcattgtacttttatcagtataggtcattgcattttgttgtagttatcagggttaatcattgtatttttttatcagtctttatatttatcagggttagtcattgtattatcagagttagttattatatttttattaagttagttattgtattttttatcaaggttggtcaccgtatttatcagtgatcttattatgattaaataaaaatttaaaatatgtagaatgagtggcctagtttaattaaaaaatcttataaatataaatataaaatcgttttagtgattaaatcttttaattaaaagatacgacggaaatacaaactaaaaagacaaatgagatgagagagactgagagaggtggggactgggagtctgggagagagctactagcgcgtaaaacaacagcttcgcatcattagctcacgtatcaatattccgtgtgtgtgtgtgtgtgtgtcagacgcaccatgtgtcaacatgtccagtgtcgggctctgtcgcagtactggctacgtgacgcacatatgcgtggaagctttcttctcaacctgcaggaagctagcaaaagctggggctaccccaccccgtgttttacagcgagtaataatcaatgggcctgaacaattcaccgtacgagaaggtaccacacgcccggccggccggcctctgtcatcgtacgaaccggcaccggtgaccgatctttttttaaccgaaaggcagcagaattggtcgaccgaaattatagtactacggagaactacctcggtcgttcccaaaaaagatacaattgcagatttgaaggacataaaacatatatgtatgactataaaatttaaggaccatgtggcgatcagacaggctaaatggaaaccactaaaatttatatgttcgagaacaccgtaacttgatcccaatttcaaacacaaatccgaggactccaaaaacgga

SEQ ID NO: 2895 - DNA, 1206 bp, Zea mays
  misc_feature (1)..(100): optimal_loci_163976_G1, chr4:196935644..196936849, Cluster 17
gaccccacttaggagaaaatgggaatataatttcttttgccattagaataatgggaggtgcaaaccccttccttctcctttctctagacttgcatgttccatgagatgcaacaacaatttcatcaacattatgaaagcacatgtggttattctataatgtctttttgcagaaactaactagctaagaaataagacaaacattgtttacctgtaactctttgaatctaagaaacgcaaaactgatataatgtgtgttcacatattggtaagtcgtaaaatcaaaaagaacttatgcctccatgccaatgtgtcatgacattgaaagaaaggccctagagaagtggaggtcctaggtggctgttggctaggtggatggactagtgccaacagttcaactgtcaccaccgccattagcacttgactagaaccattgctagagtatcagttaaggttgataccgtgtgctgaataagagctactagtaatatagtagtatgcagattatgtccaacataaaaaacaacaaccaactagccatgagacaacagaaaccactccaactaatcatcatcccctctcttcttctaaattgagtaactctagtcttcaaaacgaacaacaaaagtttcaacatctagccaaaagaacatttctcagctgctacagctaacacaaaaaaattgtcattgcagtactgataaaggattcagtgtaaaacaaaacctattaatgaaatagagctagtctagaattaacacatccgatggccacatcacaagtttcacatgcacacctaccatcctacccaaacagtcaagacccaaacaattttttcacaaatcactaccaaatgttgctaatgctagtgagttcataactaacaagtgagctcatggaaacaagtatgtaaaggaataggataacgaaataaacaacatgtatctagtggttgcttggaagaacataccaaatttgctcagaccatttattgaggccatgcatacagttataaaaaagacattataaaatttaatcatgcacttatatacctaacagcactagtaaaagtatgatcaaacaaacacaaaatagatggtgcatgtcaaccatgacaggactgctgaccaattttctgttgaggtttgctgccgtcaaaccaactttgttgcctgaataaaaaacataatttctaacatgtttaatact

SEQ ID NO: 2896 - DNA, 1282 bp, Zea mays
  misc_feature (1)..(100): optimal_loci_168819_G1, chr4:223070385..223071666, Cluster 17
gtagcatgtcaagcatattaagttgatatcaaaggtttgtatataactgtcacagttgacctttaattttgcacactccatttttttgttctgtgttgaaaccatagatgcagaacaacgctttccttgcatctctcgtatgaagccttcccatcttatttttttcgtgtgcacaatatgataaccaacctttgccatgtaacacatggagtagtgtatgtactttttttagcaactcccaggcattgtatttaaatggcaatctttcttgcatcctagtttaatccactgccgttaaactttatataataatacagctcgatttatttatcacaatttgatgttgatttatttatcataatacaagactagattttcacgttagaaacgcatatatctaccccaaacttgtgctctacattttgctcgtcttcttaggtatcattgggctccaaggctaagctctgtggccaacaacaaaatacggcaaataaaattagccacaaatcttatggaatgccagatagagaaacaatatgttttctttgtgtaacaaccactatttatttcattcaaataaaatttaactgtgaaaatttactatgcataattttgtgatgatggtaaaacagagttgcatattttcttggttgtcattagttttcttagatcaacataagatcacaggtacacagtgtagctattcaaatagtgggaagagcttgagcaaaacattgtacaaaaaaatggaaggcacgatggacatgtattgaaacgaatttatcatgagctctgcataggtagatgttcttgcaaggccttttggttttattatggtagataagaacatagcacaagagtattagagtacttattcttgtaatgcaagcataaaagtatcagtgtactgtggtacaacacctgcctgtaggaaaacatggcatgacatcaaagatcaagtaatgtcaccctttgcaggcttcgtgctccagaacagaagcacatctcccatctttggtttaacagaaaggccaccctttgcacattcagacaactcattataaaatggtgacgagatactgtttgttatcgacgcagggaacacaacctcaccaccatcttcaacatccaaatatttgataatggcagtttagcctccttgctggaggcaagtgaggttgccatttgccataggtgttgtagtagttttgcctcaattatattttcattgcttgtcctaggatatcctgttctgtacaaattcttatcttttgatctagaa

SEQ ID NO: 2897 - DNA, 1118 bp, Zea mays
  misc_feature (1)..(100): optimal_loci_171803_G1, chr4:237465622..237466739, Cluster 17
tcttattttgcaattttttattgtaatacttgtaataaaagggagggctatcactagttagttaaaaaaatagtctaaagtatctctggtgcatctaaattagaagaataaaagatgaattgaggcgatgtttggtttagctcatgtcacatcgaacattcactaagcttcgaaccatggtgcatctaaatttgaatgcatatacgagtattaaaaatgaacgccgtaccacattcactaagcttcgaaccatggtctttatggagaaaagcactcttctctaagcattacatctcaagttggtttgtgttatacaaagaaacaatatataatatatagaaatcgtagtgatgcacgagtaacaaactagtataaaactatatttgtcttggcctaggtacatcctagagaccttaatagtggcataagaatgtctaggtcacgatagttctagtccctccaaaagacgtgaaaccagtgagctatatcacaaaaaatggtgaaaatatgaatacctatctgagagcatcggatgtcaaaaatctataatagaaagtgggcataagaaaaaaagatatgtggttgaacacatagatttctatacttgacatgccagaacaaacaaaaataacagtaatcacaaaccaaaaacaacgaaaaaaactcatgaccccgcaaatttaagattatcatgggtgtagcaaatgcaaataacactttatttgtgagtacaaactagctagaaaaatgttgtctcaacctaggtacaccctataggacttaatagtggcataagtatgtttgggactcggtagttctaggcctccaaaaaaacgaaaacctatgagctatagctcacaaaaagtaaaagcttgaaatctattgcgagagcattggatgtcaaaaaattatactaaaagtgagtgatagaaaaataacatatagttgagtgactagatcgccatatttgacatattaaaacaaacaaaaacactaggatcataaacccaaaatagcgaagaataactcatgaccccgagagtttgagctccccacggtgtagtaaatccaaagaactctttgcttgtgagtacaaactagctagaaaaatgttgtct

SEQ ID NO: 2898 - DNA, 1239 bp, Zea mays
  misc_feature (1)..(100): optimal_loci_173764_G1, chr5:8158127..8159365, Cluster 17
  modified_base (43)..(43): a, c, g, or t
  modified_base (44)..(44): a, c, g, or t
  modified_base (45)..(45): a, c, g, or t
  modified_base (46)..(46): a, c, g, or t
  modified_base (47)..(47): a, c, g, or t
  modified_base (48)..(48): a, c, g, or t
  modified_base (49)..(49): a, c, g, or t
  modified_base (50)..(50): a, c, g, or t
  modified_base (51)..(51): a, c, g, or t
  modified_base (52)..(52): a, c, g, or t
  modified_base (53)..(53): a, c, g, or t
  modified_base (54)..(54): a, c, g, or t
  modified_base (55)..(55): a, c, g, or t
  modified_base (56)..(56): a, c, g, or t
  modified_base (57)..(57): a, c, g, or t
  modified_base (58)..(58): a, c, g, or t
  modified_base (59)..(59): a, c, g, or t
  modified_base (60)..(60): a, c, g, or t
  modified_base (61)..(61): a, c, g, or t
  modified_base (62)..(62): a, c, g, or t
  modified_base (63)..(63): a, c, g, or t
  modified_base (64)..(64): a, c, g, or t
  modified_base (65)..(65): a, c, g, or t
  modified_base (66)..(66): a, c, g, or t
  modified_base (67)..(67): a, c, g, or t
  modified_base (68)..(68): a, c, g, or t
  modified_base (69)..(69): a, c, g, or t
  modified_base (70)..(70): a, c, g, or t
  modified_base (71)..(71): a, c, g, or t
  modified_base (72)..(72): a, c, g, or t
  modified_base (73)..(73): a, c, g, or t
  modified_base (74)..(74): a, c, g, or t
  modified_base (75)..(75): a, c, g, or t
  modified_base (76)..(76): a, c, g, or t
  modified_base (77)..(77): a, c, g, or t
  modified_base (78)..(78): a, c, g, or t
  modified_base (79)..(79): a, c, g, or t
  modified_base (80)..(80): a, c, g, or t
  modified_base (81)..(81): a, c, g, or t
  modified_base (82)..(82): a, c, g, or t
  modified_base (83)..(83): a, c, g, or t
  modified_base (84)..(84): a, c, g, or t
  modified_base (85)..(85): a, c, g, or t
  modified_base (86)..(86): a, c, g, or t
  modified_base (87)..(87): a, c, g, or t
  modified_base (88)..(88): a, c, g, or t
  modified_base (89)..(89): a, c, g, or t
  modified_base (90)..(90): a, c, g, or t
  modified_base (91)..(91): a, c, g, or t
  modified_base (92)..(92): a, c, g, or t
  modified_base (93)..(93): a, c, g, or t
  modified_base (94)..(94): a, c, g, or t
  modified_base (95)..(95): a, c, g, or t
  modified_base (96)..(96): a, c, g, or t
  modified_base (97)..(97): a, c, g, or t
  modified_base (98)..(98): a, c, g, or t
  modified_base (99)..(99): a, c, g, or t
  modified_base (100)..(100): a, c, g, or t
  modified_base (101)..(101): a, c, g, or t
  misc_feature (101)..(142): n is a, c, g, or t
  modified_base (102)..(102): a, c, g, or t
  modified_base (103)..(103): a, c, g, or t
  modified_base (104)..(104): a, c, g, or t
  modified_base (105)..(105): a, c, g, or t
  modified_base (106)..(106): a, c, g, or t
  modified_base (107)..(107): a, c, g, or t
  modified_base (108)..(108): a, c, g, or t
  modified_base (109)..(109): a, c, g, or t
  modified_base (110)..(110): a, c, g, or t
  modified_base (111)..(111): a, c, g, or t
  modified_base (112)..(112): a, c, g, or t
  modified_base (113)..(113): a, c, g, or t
  modified_base (114)..(114): a, c, g, or t
  modified_base (115)..(115): a, c, g, or t
  modified_base (116)..(116): a, c, g, or t
  modified_base (117)..(117): a, c, g, or t
  modified_base (118)..(118): a, c, g, or t
  modified_base (119)..(119): a, c, g, or t
  modified_base (120)..(120): a, c, g, or t
  modified_base (121)..(121): a, c, g, or t
  modified_base (122)..(122): a, c, g, or t
  modified_base (123)..(123): a, c, g, or t
  modified_base (124)..(124): a, c, g, or t
  modified_base (125)..(125): a, c, g, or t
  modified_base (126)..(126): a, c, g, or t
  modified_base (127)..(127): a, c, g, or t
  modified_base (128)..(128): a, c, g, or t
  modified_base (129)..(129): a, c, g, or t
  modified_base (130)..(130): a, c, g, or t
  modified_base (131)..(131): a, c, g, or t
  modified_base (132)..(132): a, c, g, or t
  modified_base (133)..(133): a, c, g, or t
  modified_base (134)..(134): a, c, g, or t
  modified_base (135)..(135): a, c, g, or t
  modified_base (136)..(136): a, c, g, or t
  modified_base (137)..(137): a, c, g, or t
  modified_base (138)..(138): a, c, g, or t
  modified_base (139)..(139): a, c, g, or t
  modified_base (140)..(140): a, c, g, or t
  modified_base (141)..(141): a, c, g, or t
  modified_base (142)..(142): a, c, g, or t
  modified_base (976)..(976): a, c, g, or t
  misc_feature (976)..(1075): n is a, c, g, or t
  modified_base (977)..(977): a, c, g, or t
  modified_base (978)..(978): a, c, g, or t
  modified_base (979)..(979): a, c, g, or t
  modified_base (980)..(980): a, c, g, or t
  modified_base (981)..(981): a, c, g, or t
  modified_base (982)..(982): a, c, g, or t
  modified_base (983)..(983): a, c, g, or t
  modified_base (984)..(984): a, c, g, or t
  modified_base (985)..(985): a, c, g, or t
  modified_base (986)..(986): a, c, g, or t
  modified_base (987)..(987): a, c, g, or t
  modified_base (988)..(988): a, c, g, or t
  modified_base (989)..(989): a, c, g, or t
  modified_base (990)..(990): a, c, g, or t
  modified_base (991)..(991): a, c, g, or t
  modified_base (992)..(992): a, c, g, or t
  modified_base (993)..(993): a, c, g, or t
  modified_base (994)..(994): a, c, g, or t
  modified_base (995)..(995): a, c, g, or t
  modified_base (996)..(996): a, c, g, or t
  modified_base (997)..(997): a, c, g, or t
  modified_base (998)..(998): a, c, g, or t
  modified_base (999)..(999): a, c, g, or t
  modified_base (1000)..(1000): a, c, g, or t
  modified_base (1001)..(1001): a, c, g, or t
  modified_base (1002)..(1002): a, c, g, or t
  modified_base (1003)..(1003): a, c, g, or t
  modified_base (1004)..(1004): a, c, g, or t
  modified_base (1005)..(1005): a, c, g, or t
  modified_base (1006)..(1006): a, c, g, or t
  modified_base (1007)..(1007): a, c, g, or t
  modified_base (1008)..(1008): a, c, g, or t
  modified_base (1009)..(1009): a, c, g, or t
  modified_base (1010)..(1010): a, c, g, or t
  modified_base (1011)..(1011): a, c, g, or t
  modified_base (1012)..(1012): a, c, g, or t
  modified_base (1013)..(1013): a, c, g, or t
  modified_base (1014)..(1014): a, c, g, or t
  modified_base (1015)..(1015): a, c, g, or t
  modified_base (1016)..(1016): a, c, g, or t
  modified_base (1017)..(1017): a, c, g, or t
  modified_base (1018)..(1018): a, c, g, or t
  modified_base (1019)..(1019): a, c, g, or t
  modified_base (1020)..(1020): a, c, g, or t
  modified_base (1021)..(1021): a, c, g, or t
  modified_base (1022)..(1022): a, c, g, or t
  modified_base (1023)..(1023): a, c, g, or t
  modified_base (1024)..(1024): a, c, g, or t
  modified_base (1025)..(1025): a, c, g, or t
  modified_base (1026)..(1026): a, c, g, or t
  modified_base (1027)..(1027): a, c, g, or t
  modified_base (1028)..(1028): a, c, g, or t
  modified_base (1029)..(1029): a, c, g, or t
  modified_base (1030)..(1030): a, c, g, or t
  modified_base (1031)..(1031): a, c, g, or t
  modified_base (1032)..(1032): a, c, g, or t
  modified_base (1033)..(1033): a, c, g, or t
  modified_base (1034)..(1034): a, c, g, or t
  modified_base (1035)..(1035): a, c, g, or t
  modified_base (1036)..(1036): a, c, g, or t
  modified_base (1037)..(1037): a, c, g, or t
  modified_base (1038)..(1038): a, c, g, or t
  modified_base (1039)..(1039): a, c, g, or t
  modified_base (1040)..(1040): a, c, g, or t
  modified_base (1041)..(1041): a, c, g, or t
  modified_base (1042)..(1042): a, c, g, or t
  modified_base (1043)..(1043): a, c, g, or t
  modified_base (1044)..(1044): a, c, g, or t
  modified_base (1045)..(1045): a, c, g, or t
  modified_base (1046)..(1046): a, c, g, or t
  modified_base (1047)..(1047): a, c, g, or t
  modified_base (1048)..(1048): a, c, g, or t
  modified_base (1049)..(1049): a, c, g, or t
  modified_base (1050)..(1050): a, c, g, or t
  modified_base (1051)..(1051): a, c, g, or t
  modified_base (1052)..(1052): a, c, g, or t
  modified_base (1053)..(1053): a, c, g, or t
  modified_base (1054)..(1054): a, c, g, or t
  modified_base (1055)..(1055): a, c, g, or t
  modified_base (1056)..(1056): a, c, g, or t
  modified_base (1057)..(1057): a, c, g, or t
  modified_base (1058)..(1058): a, c, g, or t
  modified_base (1059)..(1059): a, c, g, or t
  modified_base (1060)..(1060): a, c, g, or t
  modified_base (1061)..(1061): a, c, g, or t
  modified_base (1062)..(1062): a, c, g, or t
  modified_base (1063)..(1063): a, c, g, or t
  modified_base (1064)..(1064): a, c, g, or t
  modified_base (1065)..(1065): a, c, g, or t
  modified_base (1066)..(1066): a, c, g, or t
  modified_base (1067)..(1067): a, c, g, or t
  modified_base (1068)..(1068): a, c, g, or t
  modified_base (1069)..(1069): a, c, g, or t
  modified_base (1070)..(1070): a, c, g, or t
  modified_base (1071)..(1071): a, c, g, or t
  modified_base (1072)..(1072): a, c, g, or t
  modified_base (1073)..(1073): a, c, g, or t
  modified_base (1074)..(1074): a, c, g, or t
  modified_base (1075)..(1075): a, c, g, or t
aaagttagagacaaacgaattcaagctgattacttccgatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtatggtcctgggcagaaaaaaaatattaattttttctcccaaacccaaaaggggagaagccccccaatatttatgttgtttgtgtaacaccccaccccacccccccccaacaaaaattgtttttaattggattgggaccgaaaagcggttttaacccctcccaatgtggttaaaaccagaaacggttagaatccatcgcctggggggggggggaaactaattaaaaaatgatgtaaaaatttggatcttaagctagcaatatgtaattttaataattaataattaaaaattaaataatttaccccacacatcaaattaaaataagtagagccttataactctcttcgttcaaaatgtcaataattactctagtaaattgagcagaaatcatcgacaaaggggggggacagacaataaaactattacctcatacaggtaagcccataggtagaatcatgtgttgccgacacacacaacgaacctatccgttctagtccctccgctcgtcatacaaacatttaccttattcatgtttaaaagcatcatactaagtcactggccttccgtgccttacacaaatccctgcggcccaatttgggggggatagaaacacacccaaaaacccaaagaaacttggccattggagggtcgtcgaatcatcccctgtgggggggataggagctcacccatcaatttaggactgaggaaggccgcgtatgtttaataccacgaataaaggcggtcaaaactggtgggttagtagatcatgcacgcctgtgtagtacagccgcaaatagcgctcattcatcaaaaagtagcgcacaccctgccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggattctagagattcgtccatcagctacatgatgtaaggaattgtgtagtctgtctactatgttcagtcatatttgttcatgtgctgctgttcctagtgaaacagttgatgagaaccttttaatataactgtgctcatataaatgcttcttctcttgttatgtt

SEQ ID NO: 2899 - DNA, 1398 bp, Zea mays
  misc_feature (1)..(100): optimal_loci_174085_G1, chr5:10207537..10208934, Cluster 17
ctcccgcgctgtgtcggtgtggtgtacacaggtagtagtagaatgggttgcagccgcgatgcccccgatcgatgtcgccgcggcgcgtccttggcatgcctttctgttcgaccccggtggtgtcactgtcacgtcccagatcttaatcagtttttgtaaacaacgtttcgggataacctatgcatgtaattgttaaatgtcttccaccgcttctgaggttggtgctgctgctacccatatggtattccaatgcctggtcttgaaagttcgccacttgttgttctctttctaaccgtgtcatcaaattgactctcttctttcttccatccatgtcgctatgtacgtattgttattttcccagcccaacccaccaactggttgaacccgtctttacaacaagaatctgtggatttgctgcacggccacaggtatatacacataaaggtacaaacaagttcgcatgcataaaacatattggtttggattaaaattaaacctttagatttcaaatatcacattcgggatgaaaaaaaactgtatcgaaattgactataatttattgcagatttcaatgcaacaaatggctaattattggtaccaattagtatcaactgaacaataagcgagagctccacgtcagagtcatgccctaaaaataaaccttttcgtttacatctttaaattttagtgaaaattatcataaatgcattggatattggtgatgacgaccaatgtatggctatttccccctcttattaaacacgtgacaacgcgagcgagctgttaaaatgaaatggaaccgaatagtatactgaggggggcataatagtttggagcagacttggaagtctctcgatttttttaggctatcttccgaacctttagaggtaattgctagtcagctaataagttaggtatagtcaacaattacttgatcattagcgggctcctctaaccctctcacccaattttaactaataactattagttttagaggcagccccttagtggaataaaagaaaatttgatcgttcatattgacacatagggaattgcacttaaataatatggttctgatttatccatactttggttgggctcctttagtccctctacttttagtcattgaacttggctatctagtttactactggctatccattgtgctagtctaattttgaagcagtaaattattatcagcctatcaatttatcctccaaactaataaggccccatttggttcctttagcccatggactaaagtttagttccttactatgtttggttccagagaataaaactattcaaaacacaataaatgaatcataagaggactaaaatacccatagcattctcacgctattagtgcaactgaagtaaaaagtgaaatttgcatgg

SEQ ID NO: 2900 - DNA, 1277 bp, Zea mays
  misc_feature (1)..(100): optimal_loci_175820_G1, chr5:19912218..19913494, Cluster 17
tggtgacggttgcgctgccgctctcctccacggcacacgccctgcaatcgccacacgattgcgttgcgcttgcttcgctacgctttttgactcggcaaggggaagggatccgattcgtttcgcgtcctccttcctgatcccatccacgccagaggattcgaatcgtgactacctcggtggctctcgcggggacggtggtgggctttcccagattcgcagcaattttgtggccttggctttctgccgttcgccgctccaaattttcaatgctccggtgctttaggatagtttatatttatagtagaggcagagatacacgtatcgattactctgtatgtattgccatcggtctttatctattgtaacgcccaatggacaacctttaccactgtccactatcctgctaagtcaattttttacaaaatcttatttaaaatgaaacgcagcgttttttattgaaacaaaaattcatctgagtatatataaataaataagcaaataaaaattatatagtttataaaaacaaataaaattgcatagtttataaattataaatcgacatgattcattaaacataaaaaactacatgatattttttaaaactaaaagttacatattaacaaaaaaaaattgaatttttaaaaaatcaattctttaaaaatatagatgtcaagataatattaaccgatttaaaaactacgtggcaccagtttactgaggagagacatgtgtgccaacaagttgtgctcgttgttgacatgttgtgctggccagtggccacctgccagctcacaccgagacaaaataatctcgtcttagtttagttttttcggatagaatgacgttatatctttatttcgtggaaacatattagatatagtcgtatttgtaacagtatatccaagacataagaatggtttaggagaagtttttttaaaaaaagcgtacaaagaaaaataggagagttattttggaaaaaaaaaatgttttaaaagagaccctctcatctctatccttgactttttgttatatggttgtactgttacatctgatatgttctcttatctggttaagaaatcatggacatccctaatttatgtttagtaagagccatgggtagcagatgatggatgaaatttgttgctcagtcagacaacgtttattggtatctatatatagcaagagaaaatattgctagtgaacgatgtatttagaaagggtatcacactaagatcaattccaaaagctcccttgaatcaacccaaaaatcagattta

SEQ ID NO: 2901 - DNA, 1125 bp, Zea mays
  misc_feature (1)..(100): optimal_loci_177554_G1, chr5:28627193..28628317, Cluster 17
atactgattcggtttttcttggtagcatatggggcgaaggccagtttaatctgccattagctatgtacctgagacacatttgttcacggtgaagtaaatgtattttaaggaccttcggcagagcagacctctaacatagtatatttcaaagacgtcctcttgctcgtacggtttgtctagtgatgtgtaactcgactactcgagacattttttgttgttcagttcgacaccaccatgcgctgtaaagggaagaagtcgctcgtcttgagttggtgtcaacattttgaaagactgacattagtacgtacccacctaataagcactagatcagagaaacacactggagtaaaatgtaaaagaaatggtctcagtcaatccaagtccaagcacaccgaacatctacccaaggagaggcggataaaaaaatgcatggatgcacgcatgcaatcctcgttcaaaggcatggcacggcgtgaactctctcgtcttcaccgagcttttgaaaagcccggccggccggcccctcggctgcaatcttccacagcaactagtagccgaaaagtagtatagctagctcctagtagcaacaaaagtccaacaagatctgtgtttccttgcaccttccaccagaaacgtacgctgcaaaatcacacgtgttggggaaaaaaagaactataaagtgttacatagtccaacaacttgcacgagggactgcatgtaaatacaattgtgtccagctgcttggttctgcccatgctggtcatcaagtaaatgtttatggtcagcggtgctagctagtctgctaatttatacatttaggataagtttcaatgcactagaactaatagatagctaggtagctaaaaaattgctagtgaaattagcttagctaacttcgttgattttggccgttgaatcagctaatgaactattgatgagtagttaaaggtgtagctaatagttctgaactattagctagacgtgtttgaatacatctagctaaaaataactagctaataactgaaccattagctagattgtttgaacgtcatccgctaattttggtatctaattattagctggactgaatcagctaataaactatatatcgagtagttaaaggtg

SEQ ID NO: 2902 - DNA, 1356 bp, Zea mays
  misc_feature (1)..(100): optimal_loci_197410_G1, chr5:158876725..158878080, Cluster 17
tgttagagttatatttgcaattaaagctatcgcacaaatatttttatgacgtcacaatatttattatacttaatacgttgttatatgagcatttttatgatgttgcaacatcttttatgacacagtaatgctttttaagaattaagagaagtgagttttgcaacgataattttttatatgtgaaagtactaaaattatgttctaagtttttgttgattcattatgaaggtactccattttcatatacttattgactctagagaggtagatctcggagatcaagatcatcatcctcctaacaatttagcgctatcagtcgtcgccagtcagagcatgagttggaggttacaaggttgcgtgaggagctaaggcaatgaaacaaattccaaatagaataacaataatactatgctttgttcatatcataacaacagaccatgattcatgtaaggctagtttctaattgttgccattctaagtatttaagaatgctcaacgcgttgatgcattgcacttgccggcaacgttgcatcagtaggggatgaacattatctttctacaatttcaacttccaccattactgcaatgggacgggtaccattaggaccttgtgcagtccatgcaagctatacattttaagtacattgattctagcaaaatctagctgaactagtcaaacatagtattctttcttcataaagtctaaacttagtttgagcaaactaagtttgatcaattggcctcttgcttgatgaattttagaaaaacctactcaaactagtgacacgtagagcgttatttttaattttggctaattataactaagttttgacatttatcctcctacttgatgtattttagtaaaatttactcaaactagcaaaatatagtatattgaatctaagcttgaccaattcaaactaagcttgctcatttgacttcatttatacattacacacagggatccctaacacaagggccttagatttaccatactccactagcgcgaatacaacacctggagagtaaatgtgttcagtgcttgttattttcgtaaaatttttcgatctttctatgtcaacgattaatcgttgctaatagcacattttggcctatgtagttgggctcgaaggatgctagaattgcatttataaatttagttttcggtaacccttttagaggtagcgagcaaaactccaataattcgagcgacaactatcgaagattcctttttcatataatacttatgattgtggtgatttgacttaaactatggatgtttatgtggttgtttatgcctatgttgtacaagctataaattaaatggtacttgaatcattttttgtgttgtgaatg

SEQ ID NO: 2903 - DNA, 1368 bp, Zea mays
  misc_feature (1)..(100): optimal_loci_198424_G1, chr5:164865790..164867157, Cluster 17
attgaattcaacttttggaagaaccttattgtgacttagacaaacatatttagagtataaatcaattgactaagtatgaaaaggttacctcttttccattcttctgcagcacagaacatatctaaaacataggagtaacacaaactaaagatcaaagtaaacatatctaagcaagcacatagctagcagagacccataccactacctcttccgtgaaattatgaccggagtactgccggctgatggctagcaaagcacgtagctagcagagacctacagccggcctaggttaggagtgacgaccgatccgcgtacgggcgtgtccgcacgctggtcctcccggttcgttggaacgaacgcgaaccaaacggctctgcccggcccaaattgattgcacatggcagtgtccatgcaaccatcgatcgccaattaacgcgtgtgttaattactacgacgggcaaaaaccatcggtcgaagccattatttatttgaatgcaacttaaataatttgctaaacacaggaatatatccagcgatggaagacgtcggactcggatcaagtacatgcacgaatttcgaacggacaaaattaagcacataaatggcaaatgatttctacgcttacgaccgtacgtgtacgtgtggtctggtgtggagtttgtgttcgtcgggtgcgtgccacgtcccgcaccaaaatttaatgtcccccgggtgagcagttgcaccttggtcctttgcctatttacttcgagctaattaaggtaggtagatgtatattttttttggcggcaaacaaatggaaagttgccaaaccgagggtattttctaatctagaccatctaatctcagatgggacgaaaagtaaactgagtaaaggcaccaagcctatcaagcaatttgggtgtttctatttctacaagcacgttcttcttttccttcccttttcccgaaattagcatcttctacgctttgaaaacgagaccacacggcacaagaaagatcttcttaatctaatagcagtaggtattcagtgaatatcaatgaaacttgagaccacacaactctttattcaatatatttaattaagttctacaatctatttaaatctataagttttactgtaatgaatattacgcattgtaacgggacatgagaatatatatggtttaggatttttttctctatattttttttgaagatggaaccaatttaaatattttaattttattattgtttcatgcaaaaaaaatattttgaatatctttttggagtttagatttttattctatataaattaatttttatataactaatgtcactaatttaatatatcagattgagttaatttcatttaagatgaccattgat

SEQ ID NO: 2904 - DNA, 1333 bp, Zea mays
  misc_feature (1)..(100): optimal_loci_201386_G1, chr5:181879452..181880784, Cluster 17
gtggcaacattagagtagggtgggcttaagccccctgccgttttcgaaccgtagtctcataaagccttctctaaaattacattctatatttttcattatgtattttatgatttatatcgtttatattttaatataagactactttaaactgttatattggtttattataagtggtttagtgagattatggcgttgtttagttcaatctcttttattttttttctagctttgtcttggtggacataactaaccttgataaatgtggctagcaaaaaaatgtgattataaaatttagagccacactttattacacttaagtaatcttgtcatgcgatatgtggagttcaaaagaatcttgtctaagggatcgtttgggataactcccttctttgaagagaatcactccgagttagtgaaccacttaaaatatcaattgattcatgtgggcttgtggggattaggagacaatcatttcttcatttatattaggagttgtgagctaaaaaaacatgtttcaccgtgctccatgttatattcaggtgggatcagaagagaaccacttctcatcatctcctaaccctgctccatcatatgaatacactgaaatcactctatcgagaatcaagtagcagagttgaagaatcatggagcaactcccaaatcatgcctcagactatctactattcattaaacaacaatgtgaaagaggttgtcctctcctcgtcgctcctaaatttgtatccggatgtgtactaacactttatcacacctaagaaatcttgtcctatggcacatgcagcccaaaaagatcttgcctaaggggccgtttgggaaagcttcaacttcttttgagataattactcctaaccaaccaaaacaatcaaatgtatcaattgattcaggtggggatcaatagatatttatttctccatttacaccaggagttagaatctaaaataatatattccattctgctccctgttatattcaaatgagaatgaggagagaatcacttctcatcagctccatgtgttgtagggcgttgtcggctcaggctcgctccaaccgagccccctttccctccctaaactcaagtgatggaagggctccaatgtcccccctccttgtcccccaataatcacttgtcagctcttttcactcttagagctgatttggtcataaagaaatggagggagttcatgaggagaaatctccttattattcaattttgaatagcaagggaattgctttctatagattccctacatttctttagtcagcaaagcagcctttgaacgggatctctaatctctccattcatcgattagtgata

SEQ ID NO: 2905 - DNA, 1160 bp, Zea mays
  misc_feature (1)..(100): optimal_loci_207084_G1, chr5:213062524..213063683, Cluster 17
caagtgtattcgttcccactccacgcatattcgcctccaccattacgtttcaatatgtgaaccaaacgacacctaggtaacggatacctggaatttaagaatacatatacgtatacatatacatgacacatgtgtcgtatgcatattatattgactactagcttatttaatactgcatccgtttatagatatatgacacaattggttttttaatgagttattatttatttattatttatttgttttatcatttaaggatttaaggtagtttatgtttgacttaatatttgacattttcaataaatattttgaatatgacaagtggtcaaaattttcgaaaaaagtcaagtagcatatatttgtgaacggagatagtatataatttatgttctacaacaatatactatcaaactacaaaatataatatttctatacataaccgaataaaatattttttataaataactggatacttttttaacagttaactgagtaaagtgtcatttttatggagggcgatgggcaacaagtcgccgtgtagctgcagtgcaaaggtgcccttcgcgtcgccttgtctactcctccccaacctgtatacgggatcttcctcggcatcaagatcgtcattacctaccgtgccaatggccatcgccgcccagtgcgcgcacttctgtcaggtcgtacccgtttggtagctgccaaccatcttcgtgttttttctctattctctttaattgttgtgttttcaaatgcctgtgcagatgcagaacacatacgatcggtgtgatggatcattttaaatatttttcttcttcttggatctgatttaggtggcttaccaattgatgggtatatatacgctggtgaacaaggaatcgatgggtatcaaaattattaaaatggcgtcgggatataaaaaaaccttgggccttcgggcctactagtcagaaggggtgtgaacaacttaggtagaccacggctgatcccttcaaagatctcaaaaggtagacctcgagccgaccctcatggggccgaatggatacgagcatgagagttggctgagctggaccatgacgcatacggtatgattggttgccggcagcctctgcgcctggcttgcacgggtgtgcaccggttgagacgctcatatttggtttctt

SEQ ID NO: 2906 - DNA, 1135 bp, Zea mays
  misc_feature (1)..(100): optimal_loci_221040_G1, chr6:86614868..86616002, Cluster 17
cttaagatacaacttttctctccctcctattaaataccttgtcacatcaaaaaaaacctaagtggcatcacattaatgtgtatgatactgtccactgagaattttagatactaaactttagttcctcctaagaaatatagatactaaactttagtccctacaaatcttatttaatttaaaaaatctgttttagtgacttagtcatctcgttgggtattttagaactaaaagtgactaaacattagacactaaagtttaggacgtggaaaccaaacaccaccttaggaataatgtacagatcttctcttaacgctgcaactacggcacacagatctagctctgcatgcgtgttggtatatcttaaatttcttaatggaagcacagaaacagttgtatgattgtatctaactggccttctcagtcaaatctgaacgggtcaacctgcacaggggcctaatctagagtcaaatttcgaagaaagagcaagcaagcaagaacaagaaagctggatacataccgaggcagatcacgaggcgtacgtactcaacaattttacctgccaagccaagccaagccatgcacggcgcagtcgtcggcgctgcaaggattaggatttttttaatatatccaccgtacccctgtgctgcatgcatgcatcagcgtgtgctgaatccgatgtgcctgcaccaactgaatttgcagatcatcagcaggcagggacgaccgtgagagatcttgcatggacccagtttcagaaagcgaggagtgacgatgccgccttcgatctgcagtttcagcagggaccatcacacgcgcgtacgtaaacgcgacacgtagcaagtgctacatgaggctccaatgggccttcgacacgtcgcggtatgccagtattatgctatatactaatgtatattagcaaaagtagtctcgtacagtgtgcataagcaaccgctcttcttatttaaatacaattcgaaatcatatgtaccatcccaactcattgcatccttttaaatcgataactaccctcttctttctctcatctcctctaggctctagctcaagctattgtataaaagaataatactacctctttctctcgtttctcatctctcgatcggcatctttactatag

SEQ ID NO: 2907 - DNA, 1173 bp, Zea mays
  misc_feature (1)..(100): optimal_loci_224216_G1, chr6:104778142..104779314, Cluster 17
acatcaacaccatatgtggacatattcagcaaattgcaaccagtattgacactgttctagtgttaagagttaaaaggactgttgcaaatattggggactcatatgcataattgtattgaggctcgatataaacacaaagtgaaacctcaagacactaaaagttttgaatattatgccttaacgatccctctcaaatgcaacatgaatgaagtgtaatttaggagagctagcaaaactaaacttgaaaagaaaatgaaactaattaatacatccaaaatcaaatatgacatcaaagcatccaaaataaatgttggagcggtattggatgactgtattgatgccatataaggagtatccacatagtacatgggagactaatggagggaaatcctagaatacaagattacactaatacctttgactattacaccttatcaatgaccacactattggctacttgtataaaaaatttacaatggacaccaatctacttgagttaatcgattcaaagagagaactcacagttagcaacaacgatatgaatagaccaaggcaatgcatagatcaccgtctatccaaaagtttatgcaaacacctactctttcgacttacattttaacaaaagaataaatttgttgcgtcttcgccccaataattggacccatcatttagattgaaatttgcatgtgtaaaatttagaaagataaaataacaaataggaccacaagtgttagctagcttctttattttatcaaagctagacaaaaaaaagtagtatatcaaaccttttttcgctttgtgtgtgtgtgaaataaactaaagggcataaaattgtaatactcgatacatatgaatacatggtgtcacgggagaacaacactaacgttgaagatttttatggcaacaagtgttaatattgaccaaacaatgtttatgtaggacatttttaaacatcaagccaacttgaggtatccattgttattagttatgtcaaaatctacaaatgactcacaaagactaaagtttaaatgcagcaatcctgagtaacgtctttattcaactgattgacaagctgaccatgggattaaaaacttcataaaatcgcaggtgagtgaccataactcatgagcaaaggttatctcgcatggtccctcacacccttgtcctataccc

SEQ ID NO: 2908 - DNA, 1211 bp, Zea mays
  misc_feature (1)..(100): optimal_loci_224253_G1, chr6:105074866..105076076, Cluster 17
tggcaacaaaaaaataataagcaaaagctaaagctgagagaaaaatgtatatgcgaaacaatataataggttaatttgtgcgattttatgttataaatcagccgtcaactttatatatttattataggactgatgttcttaccggttacgcaaacctaatataattcggctatagcatcaacggcaccacccggccgccacttcgtttgtttattccgagcctgactcttgccatacgcatgcatgtacaattgtacatggtattcatttgtccgtatctgcctttatgtttagtagccgtaccatgtcgggctaccagtaggcactcaattcctctttgaggagaatcacttatctaaataataaaccaactcattgctcaatccaaacatccttccacgtgaatatgttgtatatatacgtcacattaggattccatcacacttcggactctaggctatttattccttccagttcaaagtcacggagatatactcgtgtcatggttagttgttgcttaccaccgtcaccgtgtatatatataggactcaaccaaataaaggcaatttacaaaaatattcacggccggccagctcatctaagttcacacaatttctatttgttggttctggccgaaccaattagctaggctctagagtgaattaaaatttggtcattaacatgcaatctctcaatccatatatattagagtgaattaggatagagttaaaccctaaactctaattcaagtatcaagctctataacgatatagtatgagcggaaaaatattagtatcaaaccaggcctcacgaggaagttctgcagtaaataagctaataattactatatgttataatctgaattcgtacgaacgagcgagacatacggttaatcagaatgtgacagcacggtgtccagtcgcttggaaaaaaaaaacacggcgggaacctttttgatatatagtgcaatgggccggtgcggcagttggcagttgctgccggctgccgctgtcaacactcaacacaaccaccaccgtccacactgggacttcccgtgctgctacctttctttttctcgccttatattgatgtgtttaaactttccaaaaggctccctacagacataggtttttgggttttttttcgaacaaacacgttaaccaacataagatcgggaggaattcgtagagttcaagctgtaacaaatggtg

SEQ ID NO: 2909 - DNA, 1208 bp, Zea mays
  misc_feature (1)..(100): optimal_loci_225516_G1, chr6:111177177..111178384, Cluster 17
ttaaagggttgtttagatcccatgtgctaaactttagtggggtgctaaagtttagccctctcaaatagagactaaagtttatcatatggatagtgtttggatgcaagtgctaaagtttagcacatggatatagaaagacatccatacccctaattaatccatacatctaattaatgtggggtagggagagagtgtgagatgaggagggtagaagatgtcttttcctcaccaggccacttttagctcactttagcacaccttaaagaaattaaaatgttaatgagtgctgaagtttagcacttcaattttacaaacttttaaaactcttgtttagatctttaaatgctaaagtttaggtaaaaatatagtgctaaactttagcatcttagatccaaagaggtcctaagtccaactaaacgtgagataggtatagttttagcctcatctgactcgatcttacggattaccatgggattaaatccctatatgaatatcgaagacgaagagagctgagattttttgttggcgttcctctgagtgtcctctaatagtgatggcaagttgttttttcactgcttcctcgtactctcccttgtaaaataatacttcaaacgctaatatttccttaccgacctaatcgacgaggttgaggtcctattacctttacttcatcaactaggtgtggtgatagttgtgtagaccatgaggtgaagctagtctaccaaaaaatgatggaacaacattcgtctggtcgtcaatctgatcgatgtccacaagtctagtccgatgctatgcccggcatctctaggatcttgttccttcgtgttgcaggtgttaggctggttgcagtggtattgtccacttaattcattatcgttaatgttattgtcacatcaatagccgtctaggcttttgtcttagtctcaccaatgatcaaaactttccggccaacgaacacatcagcatttctcttctagacttaaccatttcgtaccctttatttcaaacacgtaaaatgggcaaccaaatatttttaattaaatttaaaacactcgtgaattacatggtaattttaaaaaagttacatgctattttaaaaataaaaattattaataattaaaataaaactacataactctaaccggtgtcaccatgacgtctccagacatgttgaatgaacttttattggacttcagtgtaaattggtg

SEQ ID NO: 2910 - DNA, 1155 bp, Zea mays
  misc_feature (1)..(100): optimal_loci_226575_G1, chr6:117440126..117441280, Cluster 17
atcgagccaacgtcccaacgcccatcggccgtcgtcccgcccgaggactccgcaccgatcacaaattgttggcctggcccagtacgttcttcgagtgttacggtgatgaggcaaggggtgtcctcgatcgatttgcatgaatgtctcaaacggttaagtggagtctagatgtggcggcacaatatcagaagcagtgttttaaatagaagcagtgttttaaatagcgagataagaaatttattctcagaattttcaaaagtgtaaagatcggaatataacagaatatatcggactaattagactaacttttcgctgctaaaaaggttatatcaagatatatcgaccgctattaccagctatttaaaaccttgatcagaagtagccaaaacagtgtttgagagtatcttacttgagcacagtagatgaactttgcagtataaatcaggctattccgtcagcagctgttggaactagattatcgatcgagctctcctattagagtaggtaattaggctctagaattttcaattactttgagggccaaaaattttcatcagtgctaaaataaaaccgcctaaaaatattgtcttttttggctcgggatgtaaacctcttaggaaacgcatattactgacccgctaaacactaatccggcaaggtaattgcttattttcataagtactagtccaaattagcacgggtaatgaatgacgaatcgaggatttaaagttagtgtggtccaatcttataaaaatcaaaataaatagatgatttacacttaggtccaacaacatttgagaatcaaataaatcaaaatcatctatatactttagtagggtcaaaatcagagggtgggccagtgcccacactgtacaccctctagatccgtcattgcaggtaattgctcattttatggagtgttaattcaaacaaccaaggtaattgtttattttattgagtgtcattggtcacttgcttctgattcctaagagaacttaaaaacaagtcaacgcaaatgaaataactcttcctttactctttaataaaccttccataggaaaattaattaaaggatgcaggctaaaaagatgagtaataacaatgtaccgttaaaacatggaataacgattcgtttaaacacatattactctttct

SEQ ID NO: 2911 - DNA, 1054 bp, Zea mays
  misc_feature (1)..(100): optimal_loci_227419_G1, chr6:121797472..121798525, Cluster 17
tgtggggagcacaacaacggtgaaaatcgtgcaaccaggaaaactgatgctttaatatagtagatagaagagaacagatagagatttgttctagatctatgaaatataagttttaattagagtagactttgtatgccatatttttatataatatatgtattttgttcattttattcaaaaaaacagtacatttttaacgcaaatgcaatatttgatataaatattaatgagcattcatcattgacatataaaatagataattaattaatttatatctatgacaacgtttcaacaatgttataattagcacgcataaaaataagtcggggattagatgacgactactcttcctttttattctagtttaaagcacagcaagagccatcaccaagttctctctttccatcttgttggttgacggagttttgacgtttttgctttgtgatgcagcaacttggaaagaaaaaaaaaattgtccagcagcaccaacagtgagtaaagcactttctttcgcctaggacggcagtgcccacagtcaggcgtcacgcccacagctaggcacgactacgagagccctcccccggatctaataagtccagcggtggtaacgatcatggggccaaacctagctatttgcaaatgtgactccagtcgctagggaagcaggatgttttttctttcttggttgctcgagtggagaagatacaggaaatagaaataaaacggtatgttggatgggtacgtgtaactagtggcattaatgggtaattatcactaaactccatgatgaggtataaaatagggtttcatagaagaccatgaatttggccacatatccaccgttttggtaaattcatattttatgaagctagaccatttggataaaaattttgtggagtaaaactgtttctgttagatatagagctagtggagctctatcaaacaaacccttgatttttttcatattcacaatcgatgagggctcgaacactaactttacagtcaaccctaaaattttgtcatagtgaagataaaaactttactttttttacat

SEQ ID NO: 2912 - DNA, 1010 bp, Zea mays
  misc_feature (1)..(100): optimal_loci_227752_G1, chr6:123794083..123795092, Cluster 17
aacttcgccgcacggagcaataagttgtcatagagaatctacaaaaggcactaagggcacaaaacgagtacaatatgaggtaggaagtgtactacatatagcatcaaggatactttgctaactacacctatcagcaataaaattacattattgtaattatgattttagaatatttatcattttaaccatttagcactactaactaattgcttttataatcaatgttacaaccacagaatatttagacaaaaatcttgccatagtagcagttgccgtcactaccaccgatgttgccacaattctatcctttaggacctcctagagctaaggttcaatgaactttctaaaattccaagcagtttaactctcagattctatacacatttagtcaacctaggtaaacttattaaattatagcttcatttatataaatttagtgaatgaaactatacttgtgctattctaggtgaacatatttaatcctatctttttaatctatttcaacctgtatattctagtgatctatagtaaatttgacaaaattataccaaaacatctattggtggtaccaacatcacaaggttagtttgctacaacttaataactgcatttattttgttaattataatgctataagtgctaatatattctctaacagtgggctttattcttaattaaaggttgactaggctgttgactttggcaattaacacattcgcttccaacggtagcagacacagctccaatgacccttagtttccttaggtgagacttatcatgttcgcttgatttaccgatgagtttattaataatactggaatattgttgattatgatggtagtatgtgtgcatttggttatttcaatatgatgtatgaatattgaatgatattcgtatgtgtatgtgttgttcaatgttaaattgatgaaatgtgaattgtatatgggcatacaattggtatgtgatctatatacggatgtacatggaaattatgctttcttataatgatt

SEQ ID NO: 2913 - DNA, 1186 bp, Zea mays
  misc_feature (1)..(100): optimal_loci_228690_G1, chr6:128551694..128552879, Cluster 17
agcctagtttagtgctaacctagcaatcatgtggccctacacttgggagatgaagtcttatgctagttaagccccaaggtcgtaagagttagaggccttacataggagccccttggcactcgctaagacaccttcgaggtaggatggccatagagggcatgaccccagcaacatgtctgtccccaaccatgtcggtcacatgtggcgcttagcaattaaaataaggctttcgtccatcgtatttattacgagaggccacatagcagtccaaatgcatcattgtaaccacaacttaggccacaggtatgcccacaagtactatttagtgctacaccttcaacatgtagcactatgtcatactcgatgttgtggtcacacatacctaccgttgtgtcatgcaaaccgttgtggaactttcgaggcacgctccaaatatggtataactcctttgataaaatataagtaattgaacctctactatattgggcccactatccatgcgaggatgtaaccctctcctcctttaagctattaaaatgaggtatagagtagcatagaaagggtcggagaaaatgttcacgttcgacctttagaagctagccagggtttactaaaccgtttaacgcaaaacgccatccaccagtaatgggaaactagagaaaaactgatgaaactcgctaaaaaacaattgctttccattttcaaattaaaaatatgtttttagatttaccagccgatttttggcattcctcgagcggtttttgacatttctcatgtggtttttgccatttctaggatggttttaggttttcttggttaattttggtgcagatgttttcaaagttgaaaaaatgaaattcggcgagaaattgcgtttttcgacgaaattcgttgtttttaccgaaaatgattaatggtttttaaaaaataaaaaatataagatatacaagaataccagaaaaaatgtttagttttctatcatagttttctgataattttttcaattttttaacttttaaaagaaaagtttttaaaaagtagccaaggaatcgatcacagactggactgatattggaaaattggcccaaaaaccacaggttttcaagcagttttcctaaccctagagctagcacatagaaagagctcttacttgagtttgagctctctcactcaagtcgatagtaga

SEQ ID NO: 2914 - DNA, 1299 bp, Zea mays
  misc_feature (1)..(100): optimal_loci_228716_G1, chr6:128632622..128633920, Cluster 17
tcaaaagtggcaacaacagtcacacgagggccaattccatgctaaattttgtatgctactacagcaaagactagctaacgtgttaaccttatatacagacgtggattttcccgacatatcacagtggggaatgcactatattgaaacatcatatcaaaaggggcctttcttcgtgatgcccttcatggaattttacaacagagttgaatgagaatttgaaatcgtcatcaattttgtaagtaaaacaaacaattctttcagtaaccatgtaatatatataatttttttggtttataatatggtaatttggatgtattcacatatgaagatgcaaccagctctgatgtgactttggtgtaatcagcacggtggatgcaaaagacagtctttatttctttttgtacggtgtaatgtaattaatttggatgataggtactatgcgtactgtgacattgtgctcctctgctactatgtttctggttttctatttactgttaagtaacactcagtaattaatgaatatatagcttctactattatgcattatatatattccagtaatagttttttattactgagtcatgtgagtaatagttagtaattattttactactcatagcacttagcaattgtatgactgggtcttgtcagtagattttcatttatattacatctcagtaactgtattgttgagtcaggtcgttttttaaaaaaaaatagcacttagaaattttattactgagtcatatcggcaacagttttttaataaaatgctctcagtaattgtattactaaagtcatatcagtggtagtttctaataaaatgatctcattaattgtatttctgtgccatgccagtagttttttaaaaagcaacactcagtaattttattactgaatgaatccatgtcaacagtaggtttttaatacaatgctctcagtatttgtattactgagtcatgttagcaagtttttttaaaaaaatagctctcgataattgtattactgaatcagttcaacagtagtttttcataaaatgctctcagtaattgtattactaagtcatgtcagtagttttttaaatagcactcagtaattttattactgtagcaagtcagcagcagtttttaataaaatgctctcattaattgtattgctgagtcatgtcagtagtttttttaaaatcactcaataattttattactgaagtcatctcggcagtccttactttttcaagataagcaatcagtaaattactgacgaatctagaacgacgtgggtggtacattgttagttgtt

SEQ ID NO: 2915 - DNA, 1082 bp, Zea mays
  misc_feature (1)..(100): optimal_loci_228793_G1, chr6:129101048..129102129, Cluster 17
ctcatatgacttaggatggggggaagaggaaacaagggtgggtgaaagttgcagccaaacgccataaaatttcctctaccgaaggtgctcgtgctagtatagagaaattataagcctgctcataatgtgcctagaatttacaaggtgcttgtggaatccaaaaaaattgtccctaatgcatggcactgttcccctatttatggtagtaaggtacaactttgtatgaaattagaagcatgtccataacgtttacacacatgaatcttaaatcacatgagggtaatgcggtcatttcttccctaaacgagctcccaggttcttctctcccttttctgcttcatacgccaatgcccgcagaatcgagctaatcaaagctatcttcttcggttcatgtcaccatggtgattttgcgaagctgaagcttcatagctttgaccttgctttgcatgttgcttctaacgaagcttcacttcttagtaaggtacctgaaccatttcttttaatttgctaatataggatttcaaggatcttcaacaatataggcccccaatataactcataactaactataataaacaactatatgcactataataagtatactactctcgtcttaaataggaatgaacacttgtgatgtacacctctactatatttatgttggaggttatctctttgcgtcgtcttctccatctagcacaacaaatgaaatagaagtccaaaaatgagcattgtgctagggtttgaattgtcaccgtccccctcccacataaacaaaataatagatattgtaaatattctgaatatagaaaccataataacacatgggcaactgactagtttttatacacatgagagaaggggcctttgaggagtacatatactaaacgatgatgactgtagatcttgattaatatcatctgttgatcttgttatttgtgcttcttcttcttgattgatgatgtggctaatcactagattgatgacttagcgaagatcaccaccgttaatttctcaacacttccccttgatcgagtccatcttatgagatcatcaatgaagctatatatttacattgctaa

SEQ ID NO: 2916 - DNA, 1381 bp, Zea mays
  misc_feature (1)..(100): optimal_loci_229019_G1, chr6:129916926..129918306, Cluster 17
ttgtttagatcctaagcacaaatatggcactggtggtcatatctacaaggctaaatgcaaggtaaattgtattatcatttgtttccagtgacaactgcatataacttgtttatacatgaagctaccctagagtagcaccaagtgacatcgaggtttacattgttggatatcatggcactcactcttcaaatctagagcaactacgcagtcaatcatgcatagattgtctagtgagttcaaaacactttttatttttttgtaccaaatttcattgttatcttacttgtgtcaaatctagagaaacaatgttttttactgtagacacaataaggttaggaaatagacaataggttagataggattgtaattggcaagtgctaccagatgatccttgtgtcgtgcatgctagtggaggtgaaaaaaatccatacatggtatgatattgtattttctaaaattctacaatgcaagtacgagtttgatgttctaaattgcttgtgctatgggtactccatgtttaatggagtgattgactccaggtaagttagatcatagaaaggagcatcttcatcgcaaaggtctagaggtagtagttgacgaagtaatgtacaagtggagttcctttgaattcaagaagcaatgaagttgtgtatcgagcgggagaggaaacatcaagagtatgatcgatggaattagaactattagtggtagcatgacaagtacttcacctttatagcacaacagccagcaatgtttcaagtaagttcgacagatcttgtattgtcatttctagattttcacatatttcattctgttttttctattttattcataaaacatgttgtagtagatgggagtagacatcagttttcccatgttcagatgttgctaccaccacaattgtgtcctcttccatcgatgctttggtctcaggttatcacatctttagcaaacttacatcaattataatgacaatgagccaattgagtttacttctaaaaatccagttatcttaattgtaatgaaaattagccaattagtttaattctaaaaaacccacttagctcaattctataaaaaatagttaatttagcaaaattagttaacttagctcaattctagggaaaataatcaatctagttcaactataacgaaatttagtcattgtagcgcaatttagtcagtctagcttaaactctagcaaaacttagtcaacttaaataaattatatctagttgtacactgtgtgacttaattacaactaattataatatgcatagtttttagacttctccaaaattactagcacctaaagatattgacgtcgaggggtctgactcatttatcaaccaactatttaactatactttagtaattacta

SEQ ID NO: 2917 - DNA, 1200 bp, Zea mays
  misc_feature (1)..(100): optimal_loci_229512_G1, chr6:132072602..132073801, Cluster 17
ctgaattaggttgaggttttaactatctagatgaagacgttgatttggcacgggagcacgtgcctgcgcaccgtggcctgccgaggcgacggcctcgctgtctggcgcatctgctgagacggcctcggaacgggctgtgtacgtgccctaaagtgactaatcacaacccaatcacttgtttaacgagctatggggcagaatataatgattacgacgcacacagttcaagggctaatgagtccgccgctctcctgtttggtccttgcagagcctgcatgcttctgttcttactttggatcgaagatatcattagacagagttgtcaaatagctggttaggtctagcacagcaaaaggagctttagataagattctattgtgaagcaccaagtgtgtaatcatgagtgactgcagcttttggatttggagtactgtagtatttattggccaacacttgtgcttcgacaacagcctctcgtctcgctttgtggggtactagtgttttttagcacttggggtggtgtggttactggcgacctgtcagtgttagtatatggcatgttcatgtcaaaaattaggtgcagaattgaacattttgaccgtatcagctaactggattgcgtccttccgcacgatagttttgtgacggacttcaattctgaaaggaaattaaaatacatttcctaaaacataagagaaaaggttgtataaaataataaaagaaggttttttttaaggtggtggtcttagttttgccagtgttcttatttttatctttagtcgtgtttttttattagttttgttcttacagggctatagagcagaaggacgtgaaattaagatgaaatacagttttcgagaagttgcttttttgtaaatactattttatagtctaatctatcaattaatacatagaagctactttaaatgagtactaaaataacaaatgacccgtgatgatggcatatgtcttaggtgtgcatacatggtatcgtacaaaatacgttagtggcatacaacataaggatgtaatcattattttgaggagaaggcaacataagcagtaaagttgtgtgcgacggtaggtatagattattttgatatgtaaaaagtagcagcaattatgagcatataataatttggaaagattttctatggacttagaaaacactgtagaaagtagtacgaattacattattca

SEQ ID NO: 2918 - DNA, 1158 bp, Zea mays
  misc_feature (1)..(100): optimal_loci_230971_G1, chr6:138852347..138853504, Cluster 17
ctcggtgtgatttgatcgtttcttccgactttaacgcccagataggtctaaagaatcattagcctccatatatgcacgatgcacaaggtttaatcaatcagcatgtgaatatgtatcacacttcacaccacatccctctcacagaatataattcatgacgatccgtcgggaatataattatttggtttaccagatatatgtaccatattacgaacgttgccaagatcaagattcttcattggcaggaattcttcataatcacaactgatgctttattatacatgacgattgtcgattcggaacgaaattggaataatgtcatcctggatattttatcaacttagccgatcataataattactagtattattgtttgtgagatggagcgtggacctttgttataatcatcaattaagctggagaataacaaccctaatctcaaccactatccagcttggtagctggacccgcctcagcggctaagcagattaattaatcatttcttaaacaattgtgcgaataacagtacaattgaacagagaaattgctttaaatagctctggtgaaaggttgagaaatacgtcttcaattaggggcccataaagtaatgagcaaattcaagggaaaatctaaggatccacgtccgatctctttttaatgtcgatctctaatgttaatctcaatacaagctctataaagttttaatggtacttaatatgcacatgacactatattaatgaaaaaaggggaaacgagagtacgtactatttcggatcaccgtacaactctagaaaatttgatagacatgatggagctgaggtactatggaaaatcatggagatgcacctatgaaactttcaaagatattttgataagttattttatttatcatttagattaaaatattttcaactttttaaatttatatcatagactatagctccatgctggatttagaatctagagcagataaaattgttttgtgctatttttaaatttataggtgtattagaaactaagggtgtgtttgaatcagatttgctgccaaaaaactggaatcccaacgaaacaggtacaacaacataatagactatgaaaatatatagattttctagatcaatttagaattgtctcgtattcaagattttgcatgttata

SEQ ID NO: 2919 - DNA, 1327 bp, Zea mays
  misc_feature (1)..(100): optimal_loci_231905_G1, chr6:142766999..142768325, Cluster 17
catctcacgaaatttgacgtggtcgtccaactcgtccggtccagagcgcttacagccagtgccgtactacgtacgtgccaagtatgactatatatgtttagaaaacttcgctaaatttggtagatagatcattagacgttctagaaaattattaagttagagctctacgtttctagaaaacatttggataagttattttatttattatttatatttaaaataattttaaaactttttaattgatattataaataaacatttggataaattcttttatttattatttatatttaaaatatttttaaaactttttaattgatattataaattacaactctatactggatttgcaacctagagtatatatatgacaacgacatgtctacgtaggccagtagtacgcagcgtagatgaaatacaaactgatggtacggcgcaggacacgtaacttgattcgatcgacgaccaacggctttgccttgcacatgagcaccgctgctgacctacgagcttaccgctttgtctatcagatgcatgcacgtacgtaccggtgaggtcaagtttcatcggggacgggggaaaaagttgctgcgttcttcagaagatagctgaataacctccctttgaaattttgaatgaatgaatatgcgatggtcagcgccgacatcgataatcctataaactatagctggagtgctgattaatgtgtgccaccagaaaatatatatgtcatcatcaagaaactacgcgacaatctttaattttatttctgaagcatgcatgatgcatgcatgtcggctgactgactgactgggtgcacgctactgcaaaaggagattcaccggttaaggaagcggcgaagcgcttgatggttgaccggccgcctctattcaattacgtttgatgaggcaaaatagttataccaagctatggcaaatttcggtcagccatggccatgcgtggacatggacatgttttattactttattttagattcaaaagtaagttatattatataacgtaactattctaggtaagcatatgtgctactatcaagcatgtgttaagcaatgaaagtatctcatttccaccgctttcattccttcaccactagcatattacatttgttactacaatgggagtgatatgacaagtgtatctatatccgatgagagcatcaactacaatcgatgtacatataaccaaaaaaggtacaaataaacaaccatatacttttcaaagagaatgtacaaggcaaccattcctaacatacgaccaaggcttaaaatgtcttgaccacatcggcgaaccaaccataggaggctta

SEQ ID NO: 2920 - DNA, 1064 bp, Zea mays
  misc_feature (1)..(100): optimal_loci_232205_G1, chr6:144662010..144663073, Cluster 17
tacctccaaggaaaatgaattaacgcaaactgcaaacgtataaaagttgctatttatatttatacaaataatttgcttggtggtacatttattgaatactcgatacaaattttatacttgggtttccttctaatagaagttactttcttcttatgttgatatgtgttccttatttcttgtctgtttctgttggtatgtatcaatttactgattccttaaataaagcatcaacctaccgatcttggttcttgaaaaggaacattatctttttataggagccataaaaaatatgctattgtattgtagaacattcagcacactacagaactgtttcatatttttcagatttggttgatgcttaaatggtcagtgaactctttctttgtaacttgtaaccttatcccgtgtcgtcacattataatcctcaaagagtgcatgctaattctcacttctcacttccttttccatagtgatcagttgcgtatgcgcttttcttttgctactttttgtgaagattattaacctatcttgtgaactgcattttatgaagatcgtaacgagtgatgataatatcttacatactgtccgacagcacatatgtaattggaagttccatcttaacactttgtattaacttagagttagctgatagaagttttatatctccttttgggtatcaggtatcaagcttttgttactaaaggcacttgtgataactgataagttgctctgctactgtagactacatgcaaaattcctgtcattgaaaatctgcatttaatttcttatacaattcagtacaggcgatttaatgcagattctaacatgatgtatcaacctcattgaggtcgaatatcgaagttacaaattcagtggctgtctgtactatgatttatggagacattaatatagtatatgtctgtgcgtttagtaaaagatgacgtgattgcatattttataacatgcatttttggattttttatttcagtaatctcttgtttatttctttttacttgatttatggtctattggttggttgcattgacatctgcttttctcctcag

SEQ ID NO: 2921 - DNA, 1269 bp, Zea mays
  misc_feature (1)..(100): optimal_loci_232295_G1, chr6:145252553..145253821, Cluster 17
ttggctcaatgattagtggaaccgaccccaatgatgattagtggaaccgaccccaatgattttgttgtctggcttcgcccttggccttatgtattcttgtggtatgggttgttatactttgtgacagttttactccaataattcagcttgctaataatgccagcataggataatctgaggtcataagctaggatagtagcaaggacaagccacaacagcgtgaattgtgataaacaggtgcaacagccagagtcccaagtcacaatgcgcgaacaagtctataatgcaggaccaaatgcacaatacagcggcaccaatcacttttgactctttgaccaaatgccaaaagaaagtagaagaatccactgaaacatccctttctacaagctgttataatcagcactacaacagccacaccccaggacgtaagtttgcagatggcttcaggcagtggaagattgggcggctgtagacaactccaatggtggtaaacacagtcggggtttgaagtggaaagaaactggtattcaaatcagatcgggacaccaggttcctgccggcggcatgccaatctctctcagatcgcactgctagcagactagcagaggccggaggctgaagatactgagacaaatacaactagttttggcagagagtcaggtgaagatcaactcataaggctatctctagcggtatttctatttcacttactatatcaatctttatttcaaatttcactatataaatagtgcagtacgaaatagtgttttgcgcggctcaaatgtacactcgacataggacagtttcagcctacgtccttaacgttagaccgaaccaggctttgcgagatgtttaatgctagcctgcccagccttatggaccaaatatacacgtgcaatccttggcacttattattgtaccaaaagacatcaaagtcgttctcttttatcaggccatggaagtaattattcaaacttttgttcctctcaagatagtaaatcaaactttgtaaaaaaaatttaaaacttaatttgttggactgaaaacttataccgatctttagctagttcttatacaataatacaactcaccttattaccttagacaattgcattttcttactgattcttcaattttcttgaattttgtgttgtgtcatgtggtgacagacctacattgtcggcggatgacgacgacgtgacgttgcatttgggctctctatccgtttcatgatgattgattgtgcgaaacatgacgacaaaagtgatg

SEQ ID NO: 2922 - DNA, 1345 bp, Zea mays
  misc_feature (1)..(100): optimal_loci_233131_G1, chr6:148811114..148812458, Cluster 17
taggtagtaggtatttaagatctagaaaatggaagtgtcaacgctgaattgggtaacagatcaagaagaactagatcgtttgaaccgatacgaaccgaagaacgcaatgcacatatttcatttacatggtgaataatagagaggtttatgagaaaaccactataggataactaatctcacttacacgatgaaggagagctagtttccgtgcaaaatagcaaaggaaccatcgaaactcaaccataaaggaccccattagtgtaagaatttcaccatatgctttaggtcgaccgtcgagcctagagctctatccttggttagcagattatgaatcgataaacaacaatatggtggttagaagagagatagtagattagtttttgtttaactaaatgttagatatctcaatcagtcgtgattctctcatatgtagagagggggtggtcttatgccaagaggtaacaactccaaaatgagtatagaaagtttcccatataaaaaccaattcggaaataaattgatacagaattgaatccagacaaagttagctagactagttttatggggccaaaaactacagccagcctcacaaaagtcgtcctggccagtttctaggggtgacctagttgacttcgggtccaacatgagcaagattggttcgtggcctagctagcttccatatctagacacttttaagtgtcaacatgtacctccctatttttatgtgaaaaatgcatagaccaaaaatcataagaacactaaatattaacgttgtccaacttatcagctacctagcatctaaggaatatacaagtattgaccattacttggaaatcactctaggccttttgccaaaggcatgaaaattatttatttaaatgtattctattgattgtgtaatgaaaatagaatgatgcccatttaatgttaggttttatttttttatgatcaacataaccttttgactaacattatttactatttttctttggatatagtttcaagtatgcgaagtagccttagactaaggcaaagtggtgattcaaatgatcagcgcgttaagaaagacatattgaagaactactagaacatcatgcagaagtccaagacacaagatgaaactaagtcagataagaagatcgcaaattaacaaagagaagaaggcttttagttggccttaaactgaggcgtcatactatctataggtgtcagactatataccgagctatggaactaagtgatttgttcgttttcttttgatttgctacttgctctcctcacggatggtgcaatagccaactgacagatcaagaaaggaataagagaagccaaaacgaggaacaac

SEQ ID NO: 2923 - DNA, 1311 bp, Zea mays
  misc_feature (1)..(100): optimal_loci_233278_G1, chr6:149319721..149321031, Cluster 17
atttgacgtctcccgaacgagtgctaaaatttagcgtgcagtttactagatgttgttggagttaaaaagaagtctgacgtccgctatattcaaggtaccggatcctttaccggaccttgctggacacagccttaggaccatacggggctgcttggattacttgatgaggtctgtgtcaacttgccgagctaggaacttgccctggccgaagtgagtgtttgattgtattgctcatatcatccaccgaggaatcatgctcccgatacccgtcaataggaatgtaaatgatatggaattaaggataatgttcgtctgtattcgtatttgatctgtttaagaggactaagatccgttctatattcgagttcaagtattcagtattcgatccgtatccgatctatatctatattcacatactcaaagttgaatattcaaaatgtcggcattcatttaaattttttcgaaacaattcgataacattcgtatttgatctaaatctgaaaaaatataaaaacaaatatagaatgactagacgagtaatatctatctgtattcgatctaattacatcctaacccgtcaagacatattctagatatactattatgataaataatttatatactaaagcaacttgttttatatgtttacaataaaatttgtttgatattttctgatttaccataagtttttataagttttttgttttaaaatttcaaagataaaattcccccagaaaacaaaaccctgtcgttgtcgcaagttggcccagcgtttaggcccccgctggaggataggtcggcccaacgcgacgaagcctagggcgcgagcaacaaatgaaaaaaaaaccctggcgttttggcctactaacacgtggtccattgcaccgttccacggagttaggttataaacgatatggatattatctgttcatattcaaattcgatccgtctaaagaagttgagatctcatctgtatctaaatcagggtacttaatatttaatttgtatctatatttttaaagttagatatttaatatgtcgatatctatttaaatcttatccgatacactttgataatatctgcatctgatccgaatctgaagagaaaatatggaaacaaatatgaaacaactaatatccatatgtatccgatccaattacaaccccacactgagtcgtctacttcacactcgaaccctcatatatttctctatctttgcaatctcgagtacgtgtaaatctttttatctctatttcttctctactcctttaaagcacgagtttcgtgcatcgtgtatcatgcgtcataga

SEQ ID NO: 2924 - DNA, 1206 bp, Zea mays
  misc_feature (1)..(100): optimal_loci_235141_G1, chr6:157799193..157800398, Cluster 17
ctccaatttccagctccagtatagagttgtagtttataatatcaatttaaatagttttaaaatatttttaatctaaataataaataaaataacttatttaaatgtcttctagaagtttacaactctagctccacgattttttggaacacctaatgatctgctccaccaactccaccaaattttctggagctggagctattccaatagggtaagggagaggggaaaatgaaggaggtggtacattcgggtgccgttagatgccgccttttgcataagtgttagtggtacagtgtatgtatattttgggaaaaaagaaagtatcttatacttcctaaattaaagtcgtattactttcaaagccattcaaattaccatacattagtttggagtgattttaaaagggggtttcttagttaaatattctaataacacttaaaccataaaaaactctaagcttttaaaaaatcctgaaaaatgtatgttgaaatatggcaggcctaaattaaatatttagagctcaccaaaatctctctatccttaaaatatttagagctccaaaagctccaggaaatagaaaaatatctagagaaatatagaaaattcccaaaacagtacaatcgatgtataatttttcgatatatcaatgtgctccattttgtgagactagcaaagtttctaaacattactacagtttttcatttatgtttaaatatataatataaaataaaaatacatgtgtgttttgttgattgagtggatgtgtatatggatttaaagtcaacaaccatagttttaatccttatttagcatttttattatttgaatataagagagcacaataacactgaaaaccgtagaaccatataaactagtgcttagggcttatttggtagagttttactttaagaatttcaatttcggttttttagtttaacataaaacagcttcaataaatttgttgaggtggattcaaagactatttggcttgcataaaaactccggcttctataatacaataaatttgtgcgagtttctttcattacctttgatacttagtggactatgatgggctcttggttcgtgggctactggaacacgagcttttgatataccatcaaaacaaacaggtatatctgtcatgttatttgtatatattatattattccctcattacgatgggatataaacacacgtatatgtattata

SEQ ID NO: 2925 - DNA, 1042 bp, Zea mays
  misc_feature (1)..(100): optimal_loci_238164_G1, chr7:5260587..5261628, Cluster 17
tatgtctcataccagtagcgtggaatgtaggatgatatatgatccgtttaactattttttttcagaagcggctgttagccaaatagtttttgtgatttcctcgcaatctatatctcatacaagttttttcacaatctgcagcttacaagaactttttcttaaaaaaaccatgacacaaccaaacacgattttatatacatgtatgattccgcagatcgctgaggttcaggtgtccagatcgtgcgtccaagtgtctctgcagccagccagagaaacgtacgatcggtaaacgattgacatgatacgatacggtatccaggttagttgaagatactgccgatggatcagggatcgaatcatcatccgttggaacttggtaggatatgtataactagcaatgtaacacatatagcggcattctgaatgcacgcacgcgcagactgttttcggtggatcgtgtaaaataacagacgcaaaactatgtagatgacactgtctgtagagtagagtttaaaataggggataagataaaggttgagatatgagatctaatgtagatggcctaattaaagccatgtttggatttaatttgttctagctaaattttagccaggtaaaagtatcatctagctaaagtttagctagtagctggatgtttggttctcttaactactagcagctggatgtctagttctcgaggtaattagcagtaagagacgacctcaagacgttccgttccctagactagataatggactagctaatacaagctaaaggatataaacaaaaggacatgagtactattttgatttagcgtgaccagtgaaaatcatgatacatggatcagttatctctagcattagctagctctgtgtggtcgagaagataacaaaatctaagctctagctaaagttcatctaatctgttagttggtctgtttggttaaaagatagttaaagttgcgcaaataatgattatatatctatctaggtcgaggtgaagatcgatgtcccttgatgcatcacaagcacacccactctac

SEQ ID NO: 2926 - DNA, 1023 bp, Zea mays
  misc_feature (1)..(100): optimal_loci_240394_G1, chr7:17691571..17692593, Cluster 17
ttgaggcttgccatacttggctcccctcattcctatatgtaaacactgcctctcactatgcaatgcattccattcttcccaaaatcactctctttcacataccaaaatctaaaatccaaaatatcttataatttagatgaaggtattaataaattcaaaactagtacgacacatttatcaactaagaaacactacaagcacactatccaatacacataggaaaaaatcaattttcatatttaggggaagcgggtagtttcttccccgttttttttttttttgtcgggtccctaatcggatcattcgcacctgtatgccctagcactgctagatgtgccgctgctgcagtctctgctgacccatcagtgtcaggtttgcttaagacgggtagtggccggtcttcactgcaatgtcgtacatgactacatgagcagcctcagcctcgctcaaccagttgaaattgctaatgaatctagaagaataccacaacaggagatctatacaatcccatattatcatcatcagactcatctaggtgaagaccaaagagtagttattgagaaagtagacgattcaatgtctttaatgagacaatagctagcggatgacaattcagatatgtggattttgactatgcaaggagaccttaaacctatgagtaataactaagattcgcttccagactaaaaacctatctctcaagtacaattagcgttatattggttgatcatctaaatttcccgctgcatcccatcccttctagccctcaggtataattggcattgcattcgtagtcactccaaccctttgtcaatttatagctagtcacattaaggaaatgttccagaacggacttataaagcgaactctctagccattgagagagagctagaacttatagggcgagctcaaaagccatgctgggagatgagccgagagttttataccaccaaggattttggtttgatgtagtgttcaatgctacatgttttagccttgtgcgcttttattacacatcgctta

SEQ ID NO: 2927 - DNA, 1042 bp, Zea mays
  misc_feature (1)..(100): optimal_loci_256427_G1, chr7:120345894..120346935, Cluster 17
tgtcatataatgtataacgacaaccataaactagtcatcaaaacgaccgatactattaactccaagacataaaaatattcgttactagtaacttatcattcatcaatccatgacagctatctccaccttatcctcttataatttcccttacaattttattaagtattagatcagacaaatagatttcactccaaatattctaacaatgtatatcccagccatcatggcagcgttacttttgttttatgcaagtgtacagtccaacatggagcatctcgttcgatgcattgtatatgtgtgtgcatgattgatccctgaccaccgcagacatataacaagtacacattaatttctgtggcgctcctggttgccatggcatgacgcatgccaaaactaagtttttgtttttttttaataaagaaaacgccgagggtgacgcacggatacggacacggagattgtgcacccaagttggctaactgcaaattgatctgagaaaagcgtaaaatgtggttgggccggcgtacgtacgtgatgaactgcaaaagtttggtgactcaccatggtttatatatgtggccgtgtccgtggccgtctccaagggatgggcatgggctatatataaacctggtgccatattgaagtttattgccaccatgacacgacggttggatggggctagtgcagtgtactaattacaacttacaagtattgcaagatgatgagatactaaacagtgctaccaaatcttggagctctaagtcagatgcatgtatgcatgcatgggtgtactatttttttagtcaaagtcaattgcttgggatgtagtagtatcccttcacggaaatgtaattgggggcggtggggatagttcttcggaaagcttaaaagaaaacatacacggagttcaagaactcctccttaggccttttcctttacacagggatcaaaagagattagacgaattgaatctattcctattcaattttgattaatctcctctaaatcttttaaaacccttaaaaaccgaacacgctattag

SEQ ID NO: 2928 - DNA, 1046 bp, Zea mays
  misc_feature (1)..(100): optimal_loci_261708_G1, chr7:149626786..149627831, Cluster 17
tcctgcaaggttattggagacaggaaaaggaatctataatgtgtatttaaacttctcatattttgaggtaataactacattggtcctctagtaattcggtaaaatccaaatccaaactaaagtagagactaagctcgaatatgagtctaggtcgtagttgagactagagtcgaaccgagtctaagtcgtggccgaagatggtgtcaaatccgagtcgagttgaatctgagtccaagacatagatgaagatggattcaaatctgattccaagtcataaacgattttggagttgaatccgagtacaagtagaagatgaagttggagtcgaatgtaagtccaactagaagtaaaagctggagacgaatttgattccatgtagaatacgaagtaggactcaaaattaagtttagttagaagacatagttggagtcgaattcgagtccaagtagaagataaagttggaatcaattccgagtccaaatagaagatgaaggtgaagttgaatccgagttcaagttgaagacgaagctagagttgaatcgagtccaaatagaagtcgaaattgtagtcaaatttgcggcgaaccgcaaggcgccaaacttgaattcatcttctaatgcaaaagttcatggttgtcatcaactcttggttgatctgcacaagttcttctacctggtgtgtcaaatgttgaaacttattcgatagtacatttatgaggtaggtcatgagatcaaaaaattgaagacaaaagcacaggagacaaaaagatttagatatgtccagactctcgccatggataatattttgcatcatgtatatggtgaatctgttattgtatgttacgatatgagatatgctatgtccttgagggctcccatgtccctcctttagcagtcatatctcctattttgataatttttttcatgcttgtgcttctgaaatttcctcatgatagacctccttctgatcatgaagaccgagtcaattagatatccctggtatatgttattaatatacttgtacatgtgggccggcctgggccggca

SEQ ID NO: 2929 - DNA, 1268 bp, Zea mays
  misc_feature (1)..(100): optimal_loci_261928_G1, chr7:150875749..150877016, Cluster 17
cccatgacaccgactaaagtttaatctgtatcatatcaaatatttgaatatcaattatgagggttaaatataaatttagttaaatttaataaaacaatctcgtcttttgatcttcgtctatgttattagttttatatttaaattatatttaatactcgtaattatcattttaacactcgaaagcctaaactaaacattcgagaggctaaactttagtagagagtaaccgaaatatttagaataattttgggagtcgaaaaattagagagaattagagggactaaatttttctggttatttaactctgtttatttaaaattaaataacgagatattttaggctctccaatcctctccgtatttgtttcttgcaaaatagtcgatcatccatacccctatccctatacctctcagctttggcttcccccgccgcctgctgggtcgcagatgagctcctccagtccgctcccctgcgctgcagagacaagccttgctgggttggaggcggctcctcatccactcccccgcactgcggtcggtcggaagcgctcccatccactccgtatctgacttccacccatcgctccgtcggaggcgcctctcgagggtgacgtgaggcgtgtgagctctcccgtttgcttcccgccctggctcaatcggaggacggtggtgcgctcgaggtcataggagatcgaacagatggtgatttgacgaaggacacgaaggttattttacactcccgattgctataatgatcaggattgtcactttgtcagacatttctgattctatatcctggaaattgtttggagttttggactacggcttataagaaaactatgattacattaaatccgaattttgtataagcggtcgcaaacgtgccttagacttcctctgatttttgtaagaacaccttcaacaatcaacaataaaattaacttgctaactcatgaatcatgattcttttaaaaaatgaaattagagtaacttaacatactagtatatgtaactctctattctaaattaagagacattttgagtattctagatacatagtttttgctatacagatatacatgtcaagcgaatgcaaacgctatttccacttcacaagttaaacataaagttaagtatattttcactcattacggtaaagatgatcacatagtacatttttgctttagactagctaaacaacaaagaacagaaagtgccatgactgtctaatttcagaagggcttttatttctcttgagactgtggcatt

SEQ ID NO: 2930 - DNA, 1153 bp, Zea mays
  misc_feature (1)..(100): optimal_loci_262354_G1, chr7:153583499..153584651, Cluster 17
acttaaaccttttcaataatgacattgaccttctgaaataccttctggtttatcctgttagtgtcgaccttagctataattattattttttgcagaactggcggtgcaaagaatatctatcactgtgacagatgtggtatggttgtttccagctaagtattctgttcattttgtcgatcaagaattaatcatattcttctgatggttttaggacggatattcatggatctgatgcttttactttaggatttcttgctttcgaatctgattctgtatagcatgtcagcccttgcgttgaaggactgcagcacggcgtctctggccttacgcgccagcccaagccttgcgcgcgagcgcaccaccgccaccatcggagaagaagggcctacccacttgtagagaaaaattatgaattctataatgtttcatggccatatgaatctttaaaattctacttgctgactcaaatgtcattccatgctattaaaccaacagtgtcgattggcacatccggggcaaactttcacaaaagacgttgaagcgacctcctcatttaacgaggtagcttccactaaacgacatcttttgcattcttgtcagcaagtagtcgttggcattcactacagggcagcttaaacaaagctttgtcagtaaatagaactacgtcttcatatcaggcaaaggaggacgcaaggcgaaattaaactgattgatgaacgtatgtgaatatttagatgttggaatcatcatgttccgttcaggttggatcacacgcatccaaagctctcaacaatgcattggttgtctgtcttcaggatccaatgcgtcaactgcatcctgattttatttttttttatttctgcttgtacagttttttttggcatccttaattttagcagttccttgaacagtcagcacaaactggcaaatcaaggtccaatgtaatgtaggattcaaaccgtacgacaacaatgtaaaatgatgctttctaatagcagataattgattgttaaaacaaaaaaaattgtgagatattgagatcgatgataatatatttgtttcgttttcatgtaatcattatatactaatattttatcaaataatttgtatatcattgtaacacacgggtattgtgctagtatttatttaaaat

SEQ ID NO: 2931 - DNA, 1381 bp, Zea mays
  misc_feature (1)..(100): optimal_loci_262405_G1, chr7:153836246..153837626, Cluster 17
ctttattaatagaaacgtgcacaatctcgtgccgttcgttcaaaaaaaaaaactttaacttagtagggaaaacttcatggcccgcatgtcaaaaggtcgatctcccagaaggagactaaaccacgagtgcttattggaggagcacgatgtttcaacggcataatcattctatcttgctgggaagaaaaggccatgtgcaagatgctgcgaaccatataatctgatgatatatcaggtcgtctgatcagcgtcgaaaagatctggacatggatcatcttgctctgctgcagagcagtaagaactgcacacagcacactctaatctcagccctgtccccaaaaggttctagaataaataaataaataaaggcacgcgtttctcttccagcaagaagtttcttgtcctatataagtggatggataggactctgatttatcagtcacactcacacctcaggtcaaggctcaagacgtttgatcttcaccattgaaatgtaaaagtatggttgcaaataagcacaggagaccttaattacaggaaatgaaaaaaaagataaaagagaaaaataaggacaggacgagtgtgtgctgtcgctttagcaactattattatgacagatcccaatcctatgtacttgcatctctttcaagtatattgatctgtccagtatgtacatgtgcagtctttacgtaccacgtgttgagagttgagacccgggagacacagattatgcgcagctgcagtgccgtttcactcatctaggggggggggggggggacatgaatctattcttgtttccttggctcttttccttatcagagatggatagagaagaatgtctgtttgtcacctgatgagtgctgtattggtcttatccaaggcttgatcgggagatcgaactagacctctcgcatcctgatcacaggtacattgtaacctctttcacatcacatagataaatagggaacgttcatccgtatcttctcgccctatacacatactcatattcaaaattcactctgcgaacagtacagtatacagtttagaacaatacaaaatagtgattttggataaacttttggtagactgacggtctaatgccataaacctaaacaatatcttctcttagtatgacctctcatctatttatattatgatttatgaatattttaacttacatcccaaatttaagacttattatttaagttttttaattcaacctttaaatttaaaatttactgtgcaatttgatataaaaattgtttctaaattgttaaatagtttgattgaatatatatgaaaattttagatggcataccttataataaaattttagacccgccactggtcgctatcgacagtatcgtcgacagacttcttc

SEQ ID NO: 2932 - DNA, 1346 bp, Zea mays
  misc_feature (1)..(100): optimal_loci_263398_G1, chr7:158452148..158453493, Cluster 17
ctgaaggtattattaccttagccgagtgctagcaggtgcaataagggtaaaatgacccaagaaagagttgaagtagctttaaaaacaaataaacaacataagcctatactaattttgaaaccctcactagcatggtgacacataagagtataagactacatcaaaagcacattagtgagtacttagggatattatactaaaataaccttaacaaggttcgactaagaataatgcccttaagttcaagaagtaaacctatgttacgcacattttaaacttataatcttagttgccatccaaagagaacttacacacaacaaactaaggaagacataatgtaagaacaagaaataagacaaccggattttccccatagtaatgaattgttgccacaaccccctaaaccacattagagcactaagagtcaccaagacttggttacctcatatgtactagtgaatgtacattctccacttcgaaatggtggccttcaaaactacaaacaccttttggtggctcctcaataagaactccatcttgggaggtcaccatgtcatccatcgaaccatataggccatagtattaagacctcggctccatctaaaagaaacccaactagtaacattggttgaactcaaggtttatttagctctcatttaatcttatagtgtgacaactaggattgttggttaaagtatgattaggatagatttacattgttttcttaagaacccttctcttagtgtgtgtttatgtcgaaatgactcctagatcatacactagcaagggctagcatacccatggttccaaataaccttgatgacaacaagaacataatggatcaatgaaaccaactgaaagatcggctaagccgaagttgagcccgttcttcgtttgatagactcccaatcaccttctggatagatccatgaggaaggagcatattaaggttctctaaggtcagcaaggccacctggaatgctcaaatctcgctaggacacatgacgaacaaaatgttagagagaaagtatgataaaagggggggggggtaaatattgtatattttgacgattgaaagttgggatcttaatcaattgttatcctcttataaagaggtagggggtgatcttatcctagtagaaaacaagtccaaaatgtgttctgcaagttttccacatcgaaataaatccaaaaaatgatttggaaactaaaccaacttggactcaggcgaaaagtcggcttagttaattaaggagtcggctaagatggttttcttaggcttgggcactatggtcgagagcataggggtagtcggcttagccgactaggggagccaaaaaagacat

SEQ ID NO: 2933 - DNA, 1198 bp, Zea mays
  misc_feature (1)..(100): optimal_loci_263955_G1, chr7:161272714..161273911, Cluster 17
ctttaatcgtttcctagatccgttactagtaatagatgttttattggtctgtttatatacataattaaaatgttgaaaaactatccagacaactatcattagctaagaaatagaactaatccatcaactaccaaccagcccagaaagaaaaactaatcaatcaataaaaaatggaacaaataaaccgagctagattatgcagcagtttatatagtacatggcatgtagactcataagtttataacccatcatcacttatttctagtactattgaccataaatccataaaactataactcagaaggccattctcaatgatagtttcatagaagttttattctcattaaatgatgtgacatgtcatcaatttgaatgatgcgacaagcaattaaccaaggaagaaatgaaatgagtttcatgaaaccatgtaaaaaatgttacatatgcatactgtgtcttgcatgttatgtagaatattgtaccgaatgaacctatccactgtgagagacggtttcaatcaagattttatttctttcatgtttacatggcatcttagaagcacagatataaaacctaccactataaatggactaacaagaacaaataaaatgttgattcatgtaacatcgtgtgttgcatagctcatttactaacatccaaacatgaagagagtgcttccacattcccatctattagttatatgatataagaaacagtgtcacatgcccgaaccacattcatgccttgtagcttgtttgcacaaggcgtcatttgatagccatcatcctctaccaacgaccaaaaggattcacctaagaataccatttttggataatgttcatgaaattctggcagctaaaattgatgtagtgtggcgaaagctagcaatcctctcttcattgtactggttagttagctcggaatttggttactttattcgtctaactaaactttagtgactaaagtactatgtttggttacagtgactaaacctaactaaagagcattaattagtacgaataatgactgtattacccctattaattggtgtctgctgcacggagaaagaggagatgacaagtgaggtaaaaaaatcctactttagtccattttagtcaccccttagtgattaaagaactaaagtttagtcacctcaaataaaacggggtcgtaatgtaatacaagagagtaagatact

SEQ ID NO: 2934 - DNA, 1247 bp, Zea mays
  misc_feature (1)..(100): optimal_loci_264359_G1, chr7:163504241..163505487, Cluster 17
gacgacactacggatatggtttccatatgtgcgatggtttgataggtgtgctatcaccatgagttaggcaatagacacactcaacacaactgttcaatacttgcagtgacactatagccacgtgtgggcatggcagtgtaatgaaaggtattataaggcataaattgctataccggttatcaaccatgctacccaatggtgtggacttcagtgtctattgatatgataaggcatacttggctttatgctagatgcatccgctgtagtggtaggacatcctaacacagtgctatgatcgaaaatatggtgctacatatgactccacgactaagataaggttgagtagttgggtcacaactgattgagggccatagcacattcaatatgtaatcctcctccactggtctatgaaatgaaggaccaaagcaacatgaactggagagggcaatatatcacaatagatcatgaggcatcgacacaaacaactagagataaaaaccgagctagatccacaatcgcctaagggcagacataaaggtgaactagggactgttaggctagaactctcatcgaaaccaattggaaagtgaaagctagaaggtcatgaggtttagttgatacttgagcttctaatattcttcacacttgtgctcatctatctaccactctcgagacaacataggatattacacacactatggcccaaacctacataaaactgcacttgtgctggtaccctagttgcacctagattcaacatatagtgtgcttacgccttgctttttctaaaactctcctcatttctttttctttttgagtactcctatacacccgtgtcatatcttgacaataaaaagtaactaaactggaaatataatatgatgtgttgtatgtaagatataactttaatacaatgtcttgtattctaacaacatatctatgtcatgtttatattttcagtgtgatatgaattaattattttaattcttgagagcttacaaggaacaatagcttgatatatgtgttagaaatatcactctagacataaacatatggcaccggagtatcgtcggctagatgattgatgacttagaattagtgcgggttcaaccgaatgggcattagattgaggtttgtagtccagggacaattgattgggcatagggattatttcacctttaagctcgttgtaaatgagaacaacgatgaggacgatgacttttttgctgatatatcgtccctgacaa

SEQ ID NO: 2935 - DNA, 1140 bp, Zea mays
  misc_feature (1)..(100): optimal_loci_264597_G1, chr7:164793573..164794712, Cluster 17
gaaaatttataaaataggaaattcaattatattgaaatccacaataaatatatgatatatatatatatatatatgttttagtgtaatgttttttacaactttatatctacttttaattaattcatacttgcattttctttggttcaattgtgataaagtttttatggtactctagtcattggatgcttgatatgtagtaaacatttcatggtcattaaattgtactagcatatagcggcgttgagaggaggggttgacggcgacagcggcgtgggtgagggggatgagtaggagcagcggggtcgcagggaagagatgagagattatcaaaataatattgttcattggatttgagtgagtaccggatagagggttatctagtggtcttaaccattagttttgatggtgtgttaagtcttgatgtaatttattttgtggatttagtggatgtcatgggtatatggatgatttggttgagtgggttttgcgaagtttaaatttgtggattatatagtggtatagatatggctgagttatatatttatctaaatttatctattgatctatctaggtttaactagttaaaactataagttagtcatacataatctaacaagtatggttgttttctacatctcaaacatataattattagcccaccatagtttcactataattggaccatagaagttagatctatagattaattatagaaagcatatatctaaagttatagtaaaaattttataccaaaacgcacgctacaacacatatgttatctagatggtagaggagaggaactacttcgctctagtgaatgaaaaccatctcaagtcagggttgtattgagtcatttcacacaatattctcgggatcttattgggcacttccttacggctaccgtaatgaatctctagggctagctccttcgcatgccacacctttttgtagttgggagtgtaaagtatgaagtcaagtatggaccaaataagcaatggcaccaaaatgttaatatcctcgcccatgagggccaatatgtgatgggccaattaacgtgcctaacaatttttttgtctgtcttattttattagcaagtgtggggttgagccactttccttatctccaatttgccatcactaa

SEQ ID NO: 2936 - DNA, 1144 bp, Zea mays
  misc_feature (1)..(100): optimal_loci_264619_G1, chr7:165049522..165050665, Cluster 17
atagatacagaacatcgctatgatatgcaaaatccgtgtagcaaaatatcattataacattaatagcatattgacgatataaatatgtaatattattataaatatgccgactcaaatagaatgaactgatgtcgaacaaacattttaataccgcacaaattatttctaaagattccatatagaatttttaatgatagaaaatatgtcgacaaccgtacactaatctaatcttttttatgatattgataagtctttgttgtatgtttgtagggatggtacatcagtttctcgaaaacttgatttgatccttcatgtatttatacatgtatttgccattgttagggctgcaagaaacaaaataatcagataatggtatcatcctaattttgttggcaataaataagcaataattactggatacaacggacaagtaacccatgaacataataggcatatcaatgagaaaatgaatgaaaaatcacaaaaattctgaaaattattgtatacatatgaatatataagtatgtaccttcacaattattgccatgattccccatcttatttgtacaagcagtaaactcattataagagccatggtgtgcaacctataacccttaaagtgattatattataataatacacataaacgtctaacgatttggaccaaaaggattaaaaatggagacacctctatgtctgtaaagcttctcccgggtgtcctgtggtcgtttggctgatgcattgcagaaacataaaaatggacctattagtcgctctatcctgacaatacacgatccatggaccaaaaatactatgtagcaaatatctgaaatctgtgaacaaaaaaatactatgtagcaaagatctgaagttttttgcagcttataacttgtaaattgttctgatcgtaaatgttctactcaaattgaccgtgcaacaaaatatctcggtcctcaacgacacaatgagatactaaatccagagctaaaaatcagaatagagtttgctcagcaacctgcattttgacaacttttagtttggtcatcagcaacaagtaacatgcaccagtacatgggagacaacaaacaacatgtagcagtttgcttacatggagcatgcaaacttcaaattgaactgaataaat

SEQ ID NO: 2937 - DNA, 1188 bp, Zea mays
  misc_feature (1)..(100): optimal_loci_268771_G1, chr8:10384347..10385534, Cluster 17
cctcttgacgagacagatcggcctacggactttttatccttgtcgtttctttgctgtcgtttaatttcaaccggccaaattcattaacctatataaatttatatagcagaagatttagtcctcttaaatccgctcaatccacctataatcgaataagctctaacggtaacagacattgctaccaactaccgttggttcaaaagaagtattttctatattaaaaaaaaagtgaatgatcgtcttgctcagatggtttggcagcattccttagtttttaagtctgattttctgtaccgtaaatttcatgccggagttaaaaaaacctcttcgtttgtcaaacttcaaatcacagtttaagggtctgattttggttatagtcaatggctatgatacctttgtgtatggataaagtaaaggtttataaattttctcaacctctataaaggttcatttttaatgtaatattcaggattgtcttatttaaagaaggaaagtagaaggaatggcactgcgtactcttcctgctaatcagtggtagattcagaattttactatatagtataccacctaaaatttatacatgcattcggttaaactagttatagttcagtggccgttttaaattttaaacataatttgatatacatgcactaaactacacggtaattcttgaagttgaagactaattaaaaaatgaaaatattaaatcttgaatttataaaatttaatttaaaatagttacaaattctgatataaaacagatgaaaatgcatactgatatagacaaaaaaaggtattaatgtgactttttacttgagaccttttaagactggctccaaccggacaactaagggcttgtccggttacaccaatccagaaggttttgactaggaatcctcttatggattggtgtaaccgaacatgacctaaaggggcagccaaaggtaaaatagatggcttataggcagtggcggagttagaccaccttagcccaaaacacattaaactatatatattatgtaaaaaatattaggcataaaaatattgctcttaagcaatagctttattttatttacttgacgtgaccaccacgacaacacaaacacatcacaacaacatgtgaaattgggctcctacgcctgcagccacaccagatgactatctagttctagaacaagcatgcacgat

SEQ ID NO: 2938 - DNA, 1047 bp, Zea mays
  misc_feature (1)..(100): optimal_loci_271544_G1, chr8:26733721..26734767, Cluster 17
ccgaagtggaacacaacaaaatagtagcacaactgaaaacagggaaaggtaagatgtaatattttttgtatgtcaaaaacctaaatcaattttcaatcaccgacctgagcaaaaacagatttatatgatacagaacggttttctcccgcggatggaaatccttgaatttcccaaaagtcatgtatgatgtttcactgcagttttacaaacatttttctgtccctttacaacatagaagttgttttttgtttttattttatctctactattttgcagatattatgctttgttctgcaacttatcaacaacactataaaatatagtacatgcttcctagaaaacacttgccttgttagccctgtaagactaatgttccagagtaattcacgaccttcatgctctgttgactttttttggtaagcttcatagagaagcatgctactgaatttcaaagcaagcaccaagcagatagcttaaggaaaaagttgctacacgactgcaacacatacatacatcttatactacaatacaatggcatgtcagctgagagttattgaaaaataccacatgcccatttgtaaaccacggaaaacatagcctacatgaactttatcactcaacaacccatttgtaaaccatgaaaaaactgaactgtaacctaacaaccttactaaacagaaatttggaattatgtctttatgaaacgaccactgatgcagtaaagttcctcatgatataagtaggcaaccctaaagctattattcgactatacatcccaacttaagttactatagaaaagcaagcaacttttagcaaacattacaatatgaaaaaatggaagtaatttttagagaaaaaactgagatatatgctaacaaaaaagcagacatcaaattacctgatctttctccaataactgctttcagctatgcatttccacgagagcccttgctgaacaataagacagggcaatccgataattcaaccccccaagccatatgatccggctacaattcgcagttaagtgtataggctattaaacagcga

SEQ ID NO: 2939 - DNA, 1362 bp, Zea mays
  misc_feature (1)..(100): optimal_loci_27185_G1, chr1:164650434..164651795, Cluster 17
tcgtcaatcttgcatgtacgaagctaaagtcggttatatttagaccctatttgggatagttctagcttcagaaaatttggtggagcagctcagtaagtactctagaaaatcgtggagaaacatttagataattcatttcgtttattatttagtataaatttatttttaaaactatttaaattgattttataaactacatctctgcattgaagctataacctggagtcatcctaaacacctcttaatagttagctaatttggtctaactagtaaaacaattgttagctagattatcagcgcgctaacaattagctaaattattaactaggtatgtttggatctaaagatctatagtagctaacaattatctccttgaatctatttaatttcttttggatctaaacagagccttacattatgccaagagtaatctatcagaataattttgaaatgttgataataattttttaagagggcgtgaataggaaaggagatacactagggcttatgcaagaacatagtgaagggagtctcttttccttaatctggtcaggttgctcgataatcttcgattacttttcaatgcatcaaatatccaaaggcatgcagaacactaggatgcttatgacgacgatgaggggttgtttacatatcatagttttgactttccacagaaactccaaaaatcgtctagaattgagccttttatcttaaaaatacttattagttttagcaatgccatgtttcggaaaactagatttgtaacatcagaacatctcaaatctttccaaaaccgcgatgctaaaactccaaaataatactctacatcgttgatcacttctcttagaaatggtgtggcgaactcaaacatcttgttatcgatgcccaataaagcccctatggctggtcagtaatcttattagacatttttccttctatcctcttatagtgtgtcgcaaactcaaatatcttggcattatgcctaatcaagccctatggctggttataggtcctatatatctgataacatagaaagtgtcgatttttctatctgtcgatttctctatccgtctcttggcttgttgtcctactctcacctctaggggcatacacaaaattcgatgattaattcacaaactcaaattatttagaccctaatctgaaatctagatcacaatttcatatagtaaccttagatacccaaattaatttagatagttttttattgatcctgctacccaaattacccataatacttgaaatttatgtgtgatgtgtatgagtgcatatgtttatgtgcttcaacaggttgtcagagacatatgttattcgatactttggtatttactagccaatgattaa

SEQ ID NO: 2940 - DNA, 1024 bp, Zea mays
  misc_feature (1)..(100): optimal_loci_278767_G1, chr8:79054667..79055690, Cluster 17
agctacagctacaactcggagctatactaacaaataacaactacacgagcaaagtataagtcttggaggtttgattgcctgtcgactacatatgttcttgctaggtgcctctcatggtgattgattcacgcacgactaacaaactactcaagtttgaccttcaacttaggtgtcgcaagagtccaatcaaccaagaactctgcaacttggatgtcaatttgtttagccttctgtgtcatccaccaccgtgtcagtcttttgacttttctctagtccctcagttcaagccttgacgttcgtgttttaccgttcctagttcatcaccatgaatctgcttgacatttatcttccccatcggttatctatgagctccacattgtaagtcaaaagatatgttacacacactcgtgctaaagttgtcccataaacttaaccactgtaagaatgtgtcaactatgtactcgcagatatataaacaattccatcaatgcataactcaaggaatgaaatgcaatgatgttgtagtagactttgtaagcagacaaatgtatcatcattggtagaaccagaaatgccattgaaacgacttgctaattcttccccaccagatgatagggactgcagctaggattgagccgtcatggcccgtccctatcatccacgtacatccaatataatcgttgccgtgtacagttaatttgtttagtttttactagtattacttattagtgctgctgcatgctacagtgtaatcgacgacatcgctctccattcgatggggcaaccgatcgaagcgtcattaccagctgcagcaccacacactgggctggatacatgcatgcatccaattcacgtcatcaagcaagtggtggtcagctgaagtgtatttatatttgcggcgggcagtgatttcattttaccgcacaaacaaactatatctccctccggtcgtagtagatatattaggcagttgatcgtgctacggtttttatataccatataaatagatattaagatatttatt

SEQ ID NO: 2941 - DNA, 1273 bp, Zea mays
  misc_feature (1)..(100): optimal_loci_280614_G1, chr8:90720621..90721893, Cluster 17
tcaaatatattcaacactaatcaaatataaaaaaatacaaacatttataaaacataataacgtcattagataaatcactagaatctatttgttataataaatttatttaaagatataaatattattagtatatttttttgtaaatcaaataaatcttttgctcactgctaatattagtctgactgaagagacaaaatcagaactgcagccttctttacaatatatacaaggcatgtgtactgttcattcttgttacaaatcctcctccgaaataatctttcgtcttcttggttgaaccgatggcttaacactacacacggttttcttcatcatcagacgcttgtgcgtgcgtcggttggaaacggaaacggaaacggagtacagtatatcttgggtgtttgaagcgattggtgcgcagtgcactgcagtgattttggacagtatcttgtgcatccacagcctgactttttgtacagtgctgcacctgcctgggcgccgcgccgacggacaagtcgagtaggcagcacacaaacacatgcatggtctgttcctgcctgcagctgaagctgcatatcttggatgatctgcttcttaggcagttgctttgctttggggcctgtgcatgctgtgcaacacatcacctgatcaaataactgtcgtccaatcatgatggtcccatgtatcttctgaacagatagattgtcgtgaagttgcgatgcaggttcctcgtcgcccctggtgtacaattatcgatcgagcgaggtaggttgccatccaccctcctgacaggcaatcatcgcgcgcgattctgtcccgtgctttaatttgcaactgtttggccggttgatgttcggattcgttctcgactgtcgtgtttgtcagattctgtttgtgttcgattgtaatgataagacgaaatagaatgtgacgatcccttagatttagattaattacgttgtttgattcagggtcaattaaggtttcaaacagtactattctagtgtcattctcagttgtctgttaaatttgacggacaagagtggactatcctaaagtaagctgcaaagatactaactccatcatggcaggttaggagcgaagcaggttggcatgttgggtgcgtcatggtcatggtccgaaagatgtccaccaaaaacccacacatctccgatcccacaacaaaaacatgcagcgaagaaacagtccaggtccagagccatcttgaagtgatcagcgaaaacttggaccctataacaaggataaaatgcaacta

SEQ ID NO: 2942 - DNA, 1268 bp, Zea mays
  misc_feature (1)..(100): optimal_loci_282339_G1, chr8:100950499..100951766, Cluster 17
ttgggtccatgaaatttagattgtagctgttttatgcagtgcaatagaagtgttatctacctctattcgcttcaatatttctaacataagagaatgcgtcataattggttgagttggagtatccagctccaacctagacttgttctgtacgttacccattaattcttttcagttgtcctcctcatcgccttggccatcatgttgttttcatctgcaactgtagtactgtcagcagcaggacagttagtcctagaactacgacgaagacaagttggaggaacagaatcacatagttggaaggaaaaggtataccagatgatggactagaatctgtagagtgtacgttatcattttgtaccatctctaaatcttggtctagcccttggtcagctgaatggcatgcattagtcgttcttgatacataactagagttttcacatggaattatcgaacaattctcccctacatccgattttccacaacaatatttttttttgcatcagaatcaaccatcttcgagccattcagatgctgtgccttgtctcccatgtcgctgcctgctaactgtggatcgttcagtgaactcagcggtccactagcaaacacaactaactgtgattgctgcacagcctacaaaagagaaaaatccggtggatacccatacttgtgagcagattgcctggttaaacttgcacaaaaatcctctgcaccagggggtggtttggtcattccaacagaaaatgctagcagtattatttctgcaagctgtttgtatgggtacaacaccctcttccacatgccctgaagataggggataagaattactagtccctttcatctttttggtcacttgatcttcatcctcttccattctgtcttcctctccattggcattgtcatccctgtcaaactaattttcagaagtcgggatattagactttggctcaaaattttcaggttccaatgagaaggtaatattgtaaccttccctgccaactatgcaggtagtaattggtagtagatccttgttcattattcccactctgatgcgaataatatccttctgtcggtacgtgagcatatcaacttcctcggtgtgtccaatcactgaacctagtgcccaaaacactaatgaggtctttggtttgaagaaaaaatccatcctatatgaggtggtacaacttgagtccatttcacaaatttagtggaatggtctcattcgtcgcattattactaattattagcttatgagtaatgaaatggtgatg

SEQ ID NO: 2943 - DNA, 1219 bp, Zea mays
  misc_feature (1)..(100): optimal_loci_284284_G1, chr8:111174204..111175422, Cluster 17
cataggagatcagacaatgattgcattctatagccttattatataggctagccctctacaaagcaagcatgcacaaccaaagatcgctgcagtttccttaatgtcaaaagtggacgcgagcacgaaaacgatggatggggatagggttgcttggcaacgcacttggattattgtggaccaagcaactctacctatataagcattggtgaaaatatggtaaaaaagttatgttattttagtccaatcatccgttcttatgtataagcattgatgctgcaacaatagattacattatatccctaatcaagcaagtatgcattacaatagatgttctggattaattaaggtcctctttggtttctttactcgttctcctaaacttcaaagactaaaaacctaagtctctagaatattctgtttagttcttgggactaaaacggactaaaaacattaactattgtatataaagataagattgtctataattagtgcaagtgatcagttttgggagggacatgagagactaaatagtaaatagggaaagcatccggtgaaagtttagtcatctttagtcactcctttggtgaccaacggattaaagttcaggaggccttttttagtcaccctgtttaatagattaggaaatgagaaacaaacataagcctaaagtggacaagtttggttaggggtcctagtatattgtgtataaattttggcaaattgtgtctatcaatatataaaagtactcagagctaaatcatgcccgccgttgcaacaaatgtcggcatataaaaataagtcgacgacacgagggccatgatgctaaaaaagtgtggtgcttataattgtgacaatgaactagtaaaaagctaaaaaaacaatgacataactaaaccgtgacgtggtatgttatggtcacgaactcacgaacggtctaatgaaaagactagtactcacttcgttccctatcttaaagtaaccaagatttgttctaaattaaagtttcgaaactttaaccaataatatctaaaaataattatttttaaattaaaaatatatattgtgttagatgttttaataataaatataatatttttatttagtcaatgtttataaatattttgttattaatggttaaagtttcaaaactttgactaagcacaaatcttcgtgaccctcaccctgggaggagtagctgctaagaggtcattttagttct

SEQ ID NO: 2944 - DNA, 1178 bp, Zea mays
  misc_feature (1)..(100): optimal_loci_286900_G1, chr8:125384631..125385808, Cluster 17
ggtgatgtatctaatctacaaatcctgaaaaacatacataggctagaaaaaaatcttatatttacaataggtatatacatgtgcgttgctacggaatcaatatggtaaagaattaagtctacacaaccccttgacttttagagactgtctactttactctttcacctttaaaatcggttgtttaacctctcatctttacaaaactagataaatatctttctggacagttttagttggtagttttggtaatataacactagtttaagcgacatcgttctatctttttcagttcgtcatctaataatatctaaaatttatatgatttaaaaaatcagcaattaaatattatatctgatctatttttctaaaatattaagagtagttgctaaattattaaaaattaaaaactacataaaaatggcttattgtttttgtccccgattcatttcttatcttcttagtctaaaacttttactagagcttaataatattataactaaactaatattttttattttattaagcaagttaagtagtctttcttctaattattaacaaaataaattttacatttgtttttttagaaacaactaccaaacaataataaaaagatcttcaatttttatataaatcttctcttaaataaattaatatacacaaaattatttctagaattttctaagaacttctggacccataatttacataatttttttgacaacacaccagaggttactcttaatatgagtgatgcacgagcatagttaacataacttttgagtactcatggtgctcaagattttttcttttttgcgtgacccacaacgctttcttagtttgttttttatcactcatctttgtatatcatgctctttctctttccctattacagtgtcttgtatcgacatgtcctcctaaacctgtatatttttccctttttaaaccttgttgagaggttgaagacattttattattagatatatcttcaacaatgttgctagacaattctcttaatggaggacgaacatcgttatttttgaatgtgttcatctacatcttttcaatcagccaccaaacccgtgtagaaaagattagtcctcttcagactgcttgagagagagagagaaaagtcttctagagagggaggcggatcgcggatggcggcgttaggcgatatg

SEQ ID NO: 2945 - DNA, 1195 bp, Zea mays
  misc_feature (1)..(100): optimal_loci_287666_G1, chr8:129771745..129772939, Cluster 17
atatataatagacttaccttgaaagtgaatttctagagacggaattatgaccttgtggtctctagatgatttcgagagatggtagatcaagaggcatacctttgagtataaagaatcagtgttttttgaaattgttttttagtaacgtggataagattattagttgcttatgtgtcgagtgaaccgataatagtccacttgtatacaatactctcctctctcattccacttccacttcccgtgataccactcccgtgatagactgattttgtaaccctactcctatactgactttgtaaccgttccataatatatagacacattagtagttagttgctcgtgtattgctatggtttatatatgtgatatacagtttctttgtacaacagaaaccaatatgggatgtaatggtttagaggtgagtgctcttttcgtagagatcacgatttgaatcctacaagctacacttttttatattttatttcgctggcgcgtaggcggggatttaagacgaaactactcctttatattagcaaggataaggattctcttgtattggatccttttgtttgcatcatttttcttgtttctaaccccccttatttaagtatttatctgttttttaaaaatcatttttaatttcaacctttaacgtaaacacattaaatacgatatacgttgttagctttatttatttaataatagcttggacgcgttatagcaaaatatgtgtaagagtacctcttgtgttaagtttacgttatgacaatggtcgtttatttatcatcgtgtgaaggggcgctctattttccttctcctattgatgtgctggtaatttctaggcacctagctaaaaggatgaacacggaggggcccttttgttgatataaaactaagataatactacctgcgtcccacacacaaaaaaaaagtcattttggttttgtcatcttaagtttcaataagtttattacaaaaatgatattaatatttatgatgccttataaatattattcgattgttggcatgtgatatattcgcataggaaacatagttgtcgtcataaacaccttctctctaaaggttttgtcgatataaaaatattttgacttcgtatgaaaccaaaacacgccagtctatgcgagagagatatatagtgtagaagacagtttttttatcatatcttgctacttat

SEQ ID NO: 2946 - DNA, 1113 bp, Zea mays
  misc_feature (1)..(100): optimal_loci_288425_G1, chr8:133455621..133456733, Cluster 17
ttactatttagctcttttggatcaaacaaatccagctagtaatattaaactaacaattgtctcactgtaatattgaactaagccaactaaaacttagctaattaatattaactgtattagctagctagctaactgttagtaactaatgggttaaaataggtttaagagcttgcttggatttccacgtctaaaatttattagttggctatatatagttgaggtctaaaactttagattactttagctcacttacgtggcttgaagtttagtgagatgatgtaaactttagataccgctttagatcttttatttagaattttaagagttaaagagacctaaaatttagtggctagattttgaattgtaggatccatgcctaaaaatctttttcccctctatgtactagtccatatatgtgttactggtcacatataaataaaataatatgtttgttaatagatatttcctcaaataatcctctttagtgcctgcattgttgcagccaagctatggcctaacgtctatcacgaaagtccctttccccagtatcttgttgtgaacattgtgctttcaaatgtgtatcgtgtcattcccaaaaatggtccaatattggagtgtacaatcccagaataatccaccacgtggtataggctacctagctgcattgtatacgtattaccgatcgagacagagaggcagacggatgaaactggccaagagaaaccgagggcatcgaccgatcctagctacacgtcagccggtgcatgcacatgcatgcgtatatatcgatgcatgtacacccacgttcagtcccaacaaaactgcagtcaaacactcgaactcacggatcggatccatcattattatgttaataccggttgctcttgctcacatgttaaaaccccgtctcgtaattagtaaaatagtgtatatatagtctatcttggcgccgatctgtcaccaaacattatagatgtatcgtctgatgatgctctctgcggcagcacgaacgatctacgatctcgctgtagcatcacctttccctgcatcgtcgtgctctgcgatgacacatgatcgtcttcttcctcgcaggaacctagatctcgctcacta

SEQ ID NO: 2947 - DNA, 1091 bp, Zea mays
  misc_feature (1)..(100): optimal_loci_294799_G1, chr8:167006292..167007382, Cluster 17
acaccgaagtaattttttggtggcgacgtgatcccaaaaaatgaggggacggtgtcatccccgcctcatcctactttgacctcaaaccaaacacaccctaaacacatctttaacgaccgtgtgaggagttagtggagattcacaatattctctcttgagacattatgtaagattctaaatctgttcatcacatattcacatatactatttcctaagcataggggttcatgcttaataggatacttatcacataactttatttgaatctgaactttatttggatgtgcgttatttgtgcccatttctccacacgtttgtatctttggaaacaaattactgcagcatggtttgaacagtaatcgtttcaactgaaattttagtcaaaacaaggtacctcatttgagtagtttgttccgggaatttgtcatgccagttagcggtcaaattggctacttgatccatagtggaacgtagtcttgtgggacacctgccttcaaatgatgatctatgctattgtgtgtttctttcctctgaaaagaatacagtattcattaatttacatgtagctaggatcgtgagttcgtgacagatgtagttgccttcaaatacacaaataattgttagcacaattacacggtgacatgtcacttttgctagtaattgttgcagaaggctgacgtgtatcaagcacaatattttactttggtactcagttaatcttgtcccacctcttttggtttcatatgctgcagaaggacactcaagaccttaaaatcaaccactgatccacaaattaagacatatctgagacctgtgaggtaataatttcactgtttttaggatgttttcgcttctcggtttattttgtaacttgtgtagagtacagaatagcgtgaatttgtttattactgtggtgtattttgtactatccttcctagaaaatcgtcatctttagacattttgggttggacgttggagtattaaatgcttgttgcgttatgagtcttacggtttcctttagtcctgtctattcagatgcaatggctgatatccttccacgctctgagcttcgcaaccaaatgagcttcagc

SEQ ID NO: 2948 - DNA, 1373 bp, Zea mays
  misc_feature (1)..(100): optimal_loci_296257_G1, chr8:173824207..173825579, Cluster 17
gtaaagactgatacacaatcaatttttttcgtgcaatcaccatacaactaaacaattaaaagctgttattttttaaaaaaatatagtttgttatttagcgtatcaatatataaaactttattctattcaatacatctcttaatgaaaagtaaattaaaatttgaaatatcaataaagtatatttagaaattaatatttttagtagtttgattgcaagacgattatacggaaaaattgattctagctaatatataaaatctttcatgtagacggacaaagcgaggtttggacaccaatttgacgaatacatttagggtcaattcataatgtatattaccttttctttttaatacaagaatttattgatagtggccaaatagtactactccttcggtcctaatatataagttgtaactactttttattctagtcacatgatataaaatatgctctgtataaacatgtgttatatactgggacgtcatattgaaaactaaatatatttcttagtctttaaataaaatatggttacaccttatataatggaatgtctgacatagagagtacttgctaaatactaatgttgaagacgacaacacttatgtagcaattggttcaacttcttatacattaagtaaatgtagcggtattgtttgcatgagtcgttttttaggagaccgaacaaactaggctttagattggctccatcagaggcccctaagcctcctcaccctactaacatggtcctttagagcatgttcggtttcttatctctattaagttttaagcacttccaatcctcttcaatccccaaccgatcagcctttaggagacttctccaacggtttcataactctagggcccccatatgggagagataggaaacccccatatatggggagcactattatccttatatacgttaattatttgcaacactaaccatttttacgctccataacctaataataatatgtattatagtagtacaaatattatatgatttttgaacttcaaaactggtaaaaaatgttaaataacatagttataagtgtatataggagttggataggggaggaatatcttttagtgagaagtagtaaaaataatagataatacacgcaaatagagaaatatagaaagaatggttggagttagtctcacggctttggtagggtaacacagagtagtagtctaagccaaacaagactttagcactatttctgcactgagattggcttaagacatgtcatttttagattcatagtttaaacaattttaatatatgcctggatagattaattaggtagctctagtagcgtttatgaggtcgtgaatttaaatcactgtgagagtaaagatcgttgttagta

SEQ ID NO: 2949 - DNA, 1403 bp, Zea mays
  misc_feature (1)..(100): optimal_loci_31008_G1, chr1:190481176..190482578, Cluster 17
tgctacttcgacacctgctatagtgctatgagcctatgatggcatgtatgtgttgtattgtagctgctactgcgtctagatgctagattgctagtcatggtcactctgaaattttgggacgacaaccaacaagaacatgtcgtcaaaagtgatgaggtttaagatatggaattattggtcacctgttgtcgtcgtggttacaattaaacttgatgtgttgttgtggtcttgtggatgcttgcaagttacagtgtccattgacacgtgtcacatacacacacgaacattcaaagtataattgtgacacacagtcacacacaaacacaacacacatagatctaacaagacaaaaacctagggacaggaatagtgtccaatactcccacatgtattatatcttgtgcattaggcattcaggccaacccaatcatccttcctgggaaaaaagtgcctcatgtgcaatggatatagattcaatggtggaataaaacatgcaaactaagcattaacaaacatttcatcataaaatgtaaaattaatactagtatttttgtacaaacatattttagagtttttaacgaaatagttatttaatgagatttaaaaatgcaattagtcgattataagaatgttcaataattttgagcacccactccatttttttccaacatacaccatgaacaacttccgttcacgagtctatttagaggtgttaaagcatagaaataaaatcgattttcatcacataaatcaacgtaataaatcatgcgataattagtttttgatgttttgaagttttatctccgtatttgcagtcgtggtgcaaggcattcttagtgaaaagttccatatttatgtttccaaagtgccacataagcgcgaaacaaatgaagtcatagatgaaacttcctattgtgagtgcacatttttatttgacgtggtttcataggtaacatgcaagacacaacatgtctaggtaaccgtttatacctagtttcatctccatgaaactcatttcatctctctcataataaataggttgttatgtcaccagatttgaagatgtgtcacaatatttaatgataatgaaactcccaccgaaaatgtcctaaatgtagattgtttcgaattacttggcgtcatggcgtgggtttgtttcgagttctcacttgtgtggatttgacacactatcagatttaacctggtctctgatgtacttggtgttaactaacctatgatcaatggttataccataaagatgacttataatttagaacggaagggtactagccactaataatgtttcattaagataatagatatgaaatcaacaagaataaaaaaataaaaggaagatgaagaatattataagcagaaaatcccaaatctctactactctatat

SEQ ID NO: 2950 - DNA, 1266 bp, Zea mays
  misc_feature (1)..(100): optimal_loci_313001_G1, chr9:96020685..96021950, Cluster 17
tcgagccttatgaatcaccgcaccagctagaaaccatgatcatactattgacctttgtcatctcttatctattataacacttcagtacacaagtttatctcatgttacactcatctcagtgtcgcataagcttttctttcatagactttcagttaaaattaatcacaaaattatattaaaactaaaattcattcgtgtaggtaattaatcaaataaaatataaataaattataaaaaataaataaaaatatatgattcataaaccataagtaaaattatataattcatgaaccataaataaaaaaatacataatttataatacataagtaaaaatccataatttctgaagaaaattatataatttatatatatatatatatattttcctttaggcggtttaaaaatatgtatctggtatgtaaagtttggacaccacttagataaatctggcaggtaccaccggtccaggtcggtaccgactggaccgtccaacagaatggtcgatatggattggtctagctccaacacgatcgttacctacaagaccaactgtcggcagacccaccaatcgaccggtcgaacctactatcattagaaccgggtcaaccaataccgaccagttcacaagccacgtcataggtctatacaaacatgtgttggatctagcctaagtcaacgtcagttatagagatattttgcagatttaccaatttaagtttcaattggtctgccacatcagctaccaaccgtagtattaattgtgctttcaaccagcgacaacccttatctactacagtgctctagtgtacatcttttttcgtcaatctacaaccacttcagtgtcataacaacctttttatagacttttagtttacatgaaacacatcattttattaaatagatcttcttttacaatcttttaattgacatggaacataccgttatattaaaataaaaatacatatgattacataattaaacaaataaaattacacaattttaaaaagcaatttaaattacataagttaaaaaataaaaattacatgattaaataaaatctaattgcaatggtgtagaacctagatatgcttcattaaataattttagagttgatcatggaacaagctagtatggattaaggatgactgcaaagctcgtggcgtgggtgctttaggaatgatggttgttgctgcaatagaggactcaactatctcatagttgtccacatcgtattttcctgtaagctcgtccttaatgactatact

SEQ ID NO: 2951 - DNA, 1267 bp, Zea mays
  misc_feature (1)..(100): optimal_loci_314296_G1, chr9:102446265..102447531, Cluster 17
gaggattggaccaaggaggggatgagagtcgagaggactcagctgatctaacgaggaggctcaggacgggattgttttggcccacctaaaactttagttttttctatgcttaacattaggtataagaggttttaaaaaatttagaacatggcctactttgccccctagtgcatccgcccctggtgggagagagagatgaaggagacaaatgttacacacttctcattctatggtgaggcaaggctacaaaaagcataaagaaagagggaacaaattggctctcgtgtatagccaggctagtatggaaaatatgaatcaaaattgtcatataaaaccatctaggggtatcattatagatcttaagtggtataattttatttattacagttgagagtgttatagagtcaatctttgatatattagagggttatggtagattttgtagtatacttccatggcttacggtcatgttagcacacatgaaatatgcttcataagaaaacatgccttcaaatccacctgattatttagaaaattttaaatattttaagaatatgaatatctagttttatatgtgaggattaaagtatataagtgccaatagtacgggtggttatataatcaagcatatatataggttataatcacaaaaatcaacttgtgagttaaagaaagcctacataactataacatcaacacaatgctagggtttggtctatggactgtgtcccggtgataagagagagactaggatgaaaatgaaccatagaagcattcaaaagaatggaaccagaaaaattgaagcaaggtcttccattcttgctcttcgttcgcaaaagcaaatcttctcacatcttattgatcatcaacaacaaccatgggaacctactggtgagagcatcctcgccttctcatgcttggtcactaaggggaatggggtgtgatagttggtattcatcggcattgatctaggtatatttgcttgtgttcagttcatcgcttttgatcctaacccttccctcgatatcgagtttgttcagttggttgtgtttttgttatatcaaagaacttgatttgataaaaaaattaccatgacgtaaaacaccccaaggaattcaaggatgggcacagtttccatggatttttgcaccatgtacctcgagatagcaaagaggtgggttcaaggcagatgcagcattcgcggacccgtatccgaaacccgccaccaaaactcaccttgtccccaaaccctgatgtgggttaaaac

SEQ ID NO: 2952 - DNA, 1130 bp, Zea mays
  misc_feature (1)..(100): optimal_loci_322046_G1, chr9:143783765..143784894, Cluster 17
ccatatatgccaccactataggaaatggacattagtcccgcgccacggtacttcactacatttttttacgtatttatgttattgtcttggttttactcgaagtcaaatatttatattttaaaccatatatcttaaaaatataaaattttaaaataagatttatgcttttagatttactataaaatacttttataacatgtaaattcgtatgttatgaaattacaaggatttttaaaatagatggtcaatgattatgatgattgacttaggataaaactaatgtgtcatgtacaaaacagaggtatgcaagccatctatatcattttaatttaatttaatttaattttttaattcatctagcaatgtttgggatatcttctgtcttcttggtaaattgaaaaggagtataggttaaaaaacatgccaaatagatgttatcaacgttagagggcgccataagagtatcttcactagttccaagaagtccctaaaactaatttagtgtgttattaacaaaatcatgctccaacaatttcttagatgaggtctttcaaatatatcaacttcctcaatattcctatttaatcctcagacttagagggctgtttagcattcccaataatctatttcgccgtaaaattacttgtccgctatcgaatttgtgctcatgtacaagtgatacactttgaataatttgagttacggaaaggatcatcattctcatttgacaatactgaagatgatatataaaaaatagaaaatattcaatcatgattcgcatgaacggaaataataataaatagaagaataatgattattgaacttcatcgtacaaatgagatcgaatttaaagttgcaagtaataattagaaaagttgagttaatataatttaaaaatatttgaacaacctaagaatttaaaactattgaaagctaaagttgttttggttcctaatctctactactctataagacactaacgagggcgtccaccaccaccgtggctccgctcccgtgattcgcgtgccccgcctgctcccgcatccgtcatagcgatgcccgcccgtgcgcccgccccgtccccgtgacgcacgccgcggtacccccgcccgctcgtgatgccccagcat

SEQ ID NO: 2953 - DNA, 1002 bp, Zea mays
  misc_feature (1)..(100): optimal_loci_322310_G1, chr9:145070270..145071271, Cluster 17
gtttaaccgaataaaaaaaattaagtagtcatggattattttggggcatggattgaggcatggatttaattccaatcaatgctaatccagagcgggattggtataaacgaacaaagccttacatttttttccccgaacgcctagcactagagttaaattctgaaaaatacgagccaatgaaagaacgacaacgataaattctaagaatgtaaacaaccgtgtcaaaccaaatgcttgaacgattgaatccagtagacgtggtccaccttaatatacccaattagtcgagctgtgctaaattcatatctcctttaccttcctaagctatcatcgtgatatgattttttctacttcaaactttacaatggaacatcccactcgtttataaactctcaaaatccattaaattaactttttttcactgtgtttgatggtggtttcatcttctttttatttaaaaatacaataaatatcttataaaaaatctagactacaaatatgtctaagattccgatcaatgtctaaacaatatcttataaaaaatacaataaatatcttataaaaaactagaaaaatattttgaaaacaaatctagaactacctaaaaatatccgatcaatgtctaaacacgtttcgaaaagttcctgtaacaacaaatgattgcatccaatgtttctttcatgcttgctgcatctcatatttttgcattcaacgttttgggaatttttttatgtttacaaatattgtttctattttactagatctgattttaaggctgttaatatattttcacgagctctaaatactagatctattttactatctgtaagattttcttagaattcttaaagtcttagagacatgttttgtggtttaaaaaaccttatcgggtatttaattgggttttaactgtaaaagaagaaaccgtccctaaaaacacaaatgaggcccctctcgtcaaattgaaatttgtgtggaaattgttgttttttgaaatgaaat

SEQ ID NO: 2954 - DNA, 1397 bp, Zea mays
  misc_feature (1)..(100): optimal_loci_322928_G1, chr9:148218037..148219433, Cluster 17
aatgccagcattagtgctttccatatttccaccgctaactattgtcatggttggagcttcatttgtggtacctggacccactagtgtgtgtgacgagagcctcccaaaagcttagtcgttgatgatggagctatcatacccacctactccatcaccatcacttcttagtcttgggcctctaataaaaaagagggattgctcaaatgcaagaatgtatattcttcatctaacgacgacaaaggaacatcatctcaaggtgataactgatgcgactcttatgtctgcttcgataagggagctatataagtcttgttacctagaggtgttgcctttaggggtcggttgtatcgttatggtcactacttatcttagatttcatagacgtccgattattatctatttatatgtattttttttgacctgtgaactttgtttgatgcatgtgagattagttttgtagggattttgccggtcttggtaaatttagggaaacaacactctatccgtcttaaaatacaatgtttgatgactttctaacatttatgttaaaatgtaaggcgtgttgatcatgactatttttctggcaaagttttttaatgagaaaatcataatttgagtagaaattttctggtaagtattcccttcaacttattattatttttggaatgtgtaacattacatgacggcgggagtacattgtagtatgttttcctctcgatgtattgtcctctcctccatgatggacgtctcaacgttggcccactttgttcgccacgtagctcctgtggatgataatgatcacgttatcgtctgaaattctgaatatcacgccctaatctatgattgacgtgatgggacggcgggcccatcacggctcgtccagtgcttgcaagtgatcgtcactggtcaggcaggaaaacaacccatcaaattaggtgagatgggtgtcaatcacacgaaccaacttcttcatatctggttatcatcatcattgtgtttatagtcaaacggaaatatacgagggtctccacttttgcatgattcatcaatcttcttccttatctatatactagacacggttgttacggcctgaagtaaccaaaacagggcaacaatcaacaaccatcttgagctacggtagaaaataacaaacataaagttataatacaagatatcatgcattgaatttgagtacaagcacatataaatctaccaaaaaggtttgttacaagaaaaaaaacttgatgcaactcacaggtgaatcaacaatagtgcacgtcaaatcagaattagaaaagatcaagagtttatattttggatcacaatgcctttgaaagtggagctatggcaggttgatctacaagctgaaaagaaaagaacttcacttctagttttat

SEQ ID NO: 2955 - DNA, 1399 bp, Zea mays
  misc_feature (1)..(100): optimal_loci_324982_G1, chr10:2425841..2427239, Cluster 17
  modified_base (687)..(687): a, c, g, or t
  misc_feature (687)..(786): n is a, c, g, or t
  modified_base (688)..(688): a, c, g, or t
  modified_base (689)..(689): a, c, g, or t
  modified_base (690)..(690): a, c, g, or t
  modified_base (691)..(691): a, c, g, or t
  modified_base (692)..(692): a, c, g, or t
  modified_base (693)..(693): a, c, g, or t
  modified_base (694)..(694): a, c, g, or t
  modified_base (695)..(695): a, c, g, or t
  modified_base (696)..(696): a, c, g, or t
  modified_base (697)..(697): a, c, g, or t
  modified_base (698)..(698): a, c, g, or t
  modified_base (699)..(699): a, c, g, or t
  modified_base (700)..(700): a, c, g, or t
  modified_base (701)..(701): a, c, g, or t
  modified_base (702)..(702): a, c, g, or t
  modified_base (703)..(703): a, c, g, or t
  modified_base (704)..(704): a, c, g, or t
  modified_base (705)..(705): a, c, g, or t
  modified_base (706)..(706): a, c, g, or t
  modified_base (707)..(707): a, c, g, or t
  modified_base (708)..(708): a, c, g, or t
  modified_base (709)..(709): a, c, g, or t
  modified_base (710)..(710): a, c, g, or t
  modified_base (711)..(711): a, c, g, or t
  modified_base (712)..(712): a, c, g, or t
  modified_base (713)..(713): a, c, g, or t
  modified_base (714)..(714): a, c, g, or t
  modified_base (715)..(715): a, c, g, or t
  modified_base (716)..(716): a, c, g, or t
  modified_base (717)..(717): a, c, g, or t
  modified_base (718)..(718): a, c, g, or t
  modified_base (719)..(719): a, c, g, or t
  modified_base (720)..(720): a, c, g, or t
  modified_base (721)..(721): a, c, g, or t
  modified_base (722)..(722): a, c, g, or t
  modified_base (723)..(723): a, c, g, or t
  modified_base (724)..(724): a, c, g, or t
  modified_base (725)..(725): a, c, g, or t
  modified_base (726)..(726): a, c, g, or t
  modified_base (727)..(727): a, c, g, or t
  modified_base (728)..(728): a, c, g, or t
  modified_base (729)..(729): a, c, g, or t
  modified_base (730)..(730): a, c, g, or t
  modified_base (731)..(731): a, c, g, or t
  modified_base (732)..(732): a, c, g, or t
  modified_base (733)..(733): a, c, g, or t
  modified_base (734)..(734): a, c, g, or t
  modified_base (735)..(735): a, c, g, or t
  modified_base (736)..(736): a, c, g, or t
  modified_base (737)..(737): a, c, g, or t
  modified_base (738)..(738): a, c, g, or t
  modified_base (739)..(739): a, c, g, or t
  modified_base (740)..(740): a, c, g, or t
  modified_base (741)..(741): a, c, g, or t
  modified_base (742)..(742): a, c, g, or t
  modified_base (743)..(743): a, c, g, or t
  modified_base (744)..(744): a, c, g, or t
  modified_base (745)..(745): a, c, g, or t
  modified_base (746)..(746): a, c, g, or t
  modified_base (747)..(747): a, c, g, or t
  modified_base (748)..(748): a, c, g, or t
  modified_base (749)..(749): a, c, g, or t
  modified_base (750)..(750): a, c, g, or t
  modified_base (751)..(751): a, c, g, or t
  modified_base (752)..(752): a, c, g, or t
  modified_base (753)..(753): a, c, g, or t
  modified_base (754)..(754): a, c, g, or t
  modified_base (755)..(755): a, c, g, or t
  modified_base (756)..(756): a, c, g, or t
  modified_base (757)..(757): a, c, g, or t
  modified_base (758)..(758): a, c, g, or t
  modified_base (759)..(759): a, c, g, or t
  modified_base (760)..(760): a, c, g, or t
  modified_base (761)..(761): a, c, g, or t
  modified_base (762)..(762): a, c, g, or t
  modified_base (763)..(763): a, c, g, or t
  modified_base (764)..(764): a, c, g, or t
  modified_base (765)..(765): a, c, g, or t
  modified_base (766)..(766): a, c, g, or t
  modified_base (767)..(767): a, c, g, or t
  modified_base (768)..(768): a, c, g, or t
  modified_base (769)..(769): a, c, g, or t
  modified_base (770)..(770): a, c, g, or t
  modified_base (771)..(771): a, c, g, or t
  modified_base (772)..(772): a, c, g, or t
  modified_base (773)..(773): a, c, g, or t
  modified_base (774)..(774): a, c, g, or t
  modified_base (775)..(775): a, c, g, or t
  modified_base (776)..(776): a, c, g, or t
  modified_base (777)..(777): a, c, g, or t
  modified_base (778)..(778): a, c, g, or t
  modified_base (779)..(779): a, c, g, or t
  modified_base (780)..(780): a, c, g, or t
  modified_base (781)..(781): a, c, g, or t
  modified_base (782)..(782): a, c, g, or t
  modified_base (783)..(783): a, c, g, or t
  modified_base (784)..(784): a, c, g, or t
  modified_base (785)..(785): a, c, g, or t
  modified_base (786)..(786): a, c, g, or t
agcctatagagagagatctgctttcctatacaaagtatttctttttaatcagtgctcctgatttttcccctttcctatgggatcatccccactattccccccccccccctaaacctggaccattagaaaagatatcagagagtgagaccggtggcctaatatttctacaggtcgaaaacgcccctgaatgtgttcgtcgctgtattggtgactacaatgagttcaatgagtctgctcttaaaaaaatggccaaaaaaagttcgatcacggactttacctgtttgtttatatacaaatatacaagaaaataatataagtctgctctttaaaaaatggcctgaaaaagtttgatcacacagactttatatttttgtaataaaacaacatgagttttctcttttagtttaaaaacaaaaaatatccgacctgccggattcgaaccagcgacctaaggattgatctgctcaaactacagtcctccgctctaccaactgagctaaggtcggtttttgtttacaatggtgcacccgtttattattagtcactatgaaccatgtttagtctgtacttcattgaaatctcacggtgggtgttacattttccgttcttgatatgggggctactccttccataataaattttggttgcatttagttctttctaaatttatttactagctttgtagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatccatcgtccatcaatgttattttgtctaccaaatcatgcaacaggtgtacaattgaggtttcattttcgtttcaattgtgtccatacattgcatgtgtttcgccatatgggtaaataactaacaatggaggtacatatcctcggtatattagacactaccctatgtatacgagaatgtatattaggtaaagtgacaatataactgatataagtaatacattgcatgtgattcgcgatatgggtaaataactagctatagaggtatatatcctcgatatattagacactaccctatgtatatgggaatgtatattagctaaagtgacaatataactgatataagtaaacacatgtatatgttactaccgtatgtttcaaatacaggttataatttatagcgtctgatccaaaatggaacgtgttactccaaacagcacaaaaaagagaagtgtcttcgtactctaaatacatacatcacttgggtctaagagggaaaaaaatattatcacccatagattattatgctcattataaattcgtcgtggcagaacaaatcagttgatgttgcgccccacgacagaacaaatcagttgatgttgcgccccacctg

SEQ ID NO: 2956 - DNA, 1145 bp, Zea mays
  misc_feature (1)..(100): optimal_loci_326763_G1, chr10:11819445..11820589, Cluster 17
agattaaagaaattagtgctctaacgttattttgtgtaatacattatcgacaaattactatagatcacaaaaacttgggtatccaatgaatacccatgaaaccccctgggcccgccactgtttcatgtggaaattggaaatcttttttgtgtgctattgcaaaacgaccttgggttttcatttacagtctacaggtgtcgggtcaaagactcaaagatgttggtgctcttggcttagctaaacaaggagcctcttagagcaagcataatgatttagatacggttctactcacataactcacataaatcagtagtgtcttgagggttctgatgaataagatacaagatatattggtttgtataaacaaatttttaagtctatctagtgcttgaaaaaccgcaacatatagtatctagattatgcatgttttatgatagtcggtaaaagaaaccgtaagttaaatattaaatatataacatgtatcatgagagagttattaaatgactatacttttaatataaactcgttgtggactatattattaatcttggtcccctaataattccgacttgtccaggtgtcctacctagtaaactggtgaccactggttctaggtaggaaacgtgaaccagatttgctggcacaaatgcagcaattgaaaagtgagtccaaagtaaaccgtggaccaacgcatgaaaagggtgaacgcgttggaaatgccgaaggagcttgaccgaacgagtatataggctttggcttgcgtgaaaatattccgtggaaatgctcatttctgtcaaatctagcgctcgtcattaggccattttcaaaacaagactctaaactaagatgtttaaaactttgatgaaatagtttcacgtaatatatagtttcatctttgttgtttatacgtaagacacatgattttatttccacgaaaccattttacacctcttatcattaatacattgaaacgttgacattacaacctatttaatcttcataaagctcccgctaaaaatagactaggggctattttaatgtgagttatatctgtattactaaatagttttctatatagtcatttttataatataataacgtatttaaagagaaatgaaagaatcaaaatacctagaggggtaaac

SEQ ID NO: 2957 - DNA, 1149 bp, Zea mays
  misc_feature (1)..(100): optimal_loci_327263_G1, chr10:14757699..14758847, Cluster 17
ctattttatgagggcaggagtaatatacaaagtcatgaatgaatacatgccgttttgacgccatgaatcaagatatcattgaaatgagctgtccaaacgtcaaccatttatagctgaaaacatcctttgctgatgctgcatcaatgatcattttaattaaccactctagtttgattccaacaatcgtgattaggaagaggaacgtacgtggaacactctctctcctctcgcattcgtcaagctacatgaaaaaacttgggcacagctagcgctttaaacttccgctttgaccatacttttacaatatgtgttcctataatctacataaattgtattcattctataaatatttttacttgattaactgtatcatggccttttgacggtattttactgtgagaaaaggacaattttatgaaaaatatatgtaaacattaaagaaaaagtttttttttcacacgacaccataaataattagtatcacatgtatgttacttaggagcacgcgtaaactttaatatgtttaattatatatgcttagtgttctaatcattgaattgatttgaaacgacgcaatatagaaaaataaaagctggcataaagctatgtatgtccactaaccgcagcgacgtgaggaaagtagaattagagaagcaaaggcattccgaatgatctatacatgccgacgaagatctactgttgttgagtcgcagttactggtgccgtgtacaaccatatttgatgctatattattcatttgaagcaacacatggggtgtttttaagctgcaaaaaatatttcatggtgaaaaactcggtaatacacataacaatgtttaaccagtggttagaacaacttaattttcatgtttaattacatgaccaaaaagaatattctaatttatcattaggttctactcaggagcaaaatcacaatcaaattaagaatgttatcttgctgttgttagaagatttaacctattacagtagaaagggccatcaataccgattgaaaatcggctattgtattgtattcatatttggtactagacaactaggactaaagacataaatctttagttttaatttcatggctgagtggtctttagtacatgtgtttgtggatcgagtactaaaggggaggggggtt

SEQ ID NO: 2958 - DNA, 1179 bp, Zea mays
  misc_feature (1)..(100): optimal_loci_329817_G1, chr10:29518354..29519532, Cluster 17
ccaatcccatcatcgtcctcttgtgacgtacgtgttcgttttgtatacaacttgccttttttcttttctttttcttgcatggtagatataagaggtacattttctttctcgtgggctgcggcgcgcgaataaaacacatcacacaagcatatgtatgattgatctgcatgtgcaatccgacagtataaggcatcttgaggaggtccaagtagttttggactttgcgtcacggatgaacaaccatatatcaggactggacggtgtagagacatgaaaagggcactttaccgtgactagtttggaagcgaaacctgaacaatataaagctgtttttaggctctctataacaggcttcctatcctcatcctaccgttttatctcattttcaattttaaacttaactctataaacaatatagtatatcgtgtaaaacattgttttgcataatcacatgcacgtagatctgctgagcgacgagcacaaccttaatgtggagggtgatatgtattaaccgttatacatcatgctacatcagttattaagcctactatcacttttgttatcaactatagttagtcatctactataatgttttaataaacaatatttagccttagcaagtaatcaccccatcgttatattgatttttcttttacaaactttaagttgacttaaactgcatcgttttattaaaagaaaaatgcattcgattatataattaagcaaataaaattacaaagtttataaataattgaaattatataacttaaacgtaaaattgaaattacataattcataaatagaactaataaactactatttctctttctcatcttcctcttacacctctttcgtcgcttatttctccctaatctaagttactctatcaacttttttgaaggccaaattatggggctttttcttgtctttgcccatgtccgcggcgaaacgctctagcaatttgttaaattgctcaaataatttagtttcgtcaatcctctcactaaccctatggaagcttctttaatattcctttctgcttagatgtggatggggactcattgttacatgttgttaggcccttccccttccattgaactttttccctatcacggtcaatagagcatagttcatctacactttcatgtgacaatgcgctatgctcaccgtccaagttgg

SEQ ID NO: 2959 - DNA, 1120 bp, Zea mays
  misc_feature (1)..(100): optimal_loci_33619_G1, chr1:205713399..205714518, Cluster 17
taatggttacaattttaaagtatcactagattcatcataagatagattttttatagtaaatttatttaaaaaaatataaatattaatgtcatttctataaatctagttacattttggattatttgactcgtatagagagagagaaggagatttttcttcttctaacggaaggagtagctacgatgtctcatcacattgttgcatgacactggtcatagcagactggtgtgcatgtgcttgtgtgctagctagtattgtatgagcctactactagcagttgtctttctgaactactgaactcccatcatataataaaaagtcattgcatgacatcttggtccgtgtattggtatataagtacgtacgtacgtgtgatacgtcattcaggaggtacgacactgtaaagttcttcgggactgccgtggtagatcgacggaagatttgcagcagggaatgtgttgtgtgggactgtaaatttcagattcttgataaaagataatctccaatattttattgggattatggggcagtgtgttagaatcatctagaatgcatgctaagttgttttagatgggatttttttgacagattttttcttctctatctgcattcttaaaatccatgtgaagccaaatgcacctagctagttcagactcggcattcgattttaactgacaattcaatttggttctccagttaggggcgaatttagagtgtttatcgggtcagccggcgcctataaaatttataatcgtttagcaaagcattattaaagttccaaaaaaatattatataatgaagctaatcttaatggctcagatgatatttttgactaaattcaccagtaggtttgacacaagaaaaagaaccgacaagttcggtgtccgtttctaccaaaaactgaataacccgtgatgtcatgtcagcagagaagataagagaagaagagagagcgacgagaactatgtagatgatgatgcatgtgtatatgaatgttgtatgtatatgtccttttatgaactgtgtgtatttaaatatgtggtttttctagtaaaagtatattatgggaaccttagttttctaagtgattttcattttttttaaaaaaagtagtttattt

SEQ ID NO: 2960 - DNA, 1012 bp, Zea mays
  misc_feature (1)..(100): optimal_loci_337041_G1, chr10:77461367..77462378, Cluster 17
cgcctaattagtaattatattactctctctgatcttgaatttagggggtgtttggaaacaaaatatttttgaagctttgaggtaaaaccatggtattggagaatatcatcgcattgtaaaaaaactctgttttgaatatttaaaactccactccaatcaaaagcatttttttgtttatgactacactttcacatgtatactaaataccttgtctccaaacatattaagagtaatgtaaaaaatactataattatattatgatattttaaaaccgtagtattctaaaatcatgattttgaaatactttttatttccaaacacgtccttaagttcatttggacggacgtaggtttcatagttgaggcggataatgcgtgacaatattgcgctgcccaccaagtatctagaggacccacaatgcatgatcacaacttcacaagcacatctcactgctagcgtcaggatcgcgcggctagtcggtctctgcggcggctgctccagtcgtctttagacttttgtttctgcaaattaataatttatacggactattatgtaatcgtgcctataaatcaatttggtaagcaagacagaaaatattagtcattttctacaaattgatttttaagagcggttcaaaatccaagcgttcatgaaaactgttacgtaagaatcacaaatgtaaccccaagagtaacaaaatattttattttaaaatttttaaatctagcagcatctacgtagtgtggttaggtaattgttattaagagcggttcaaaatctctaggggtatacccctacagcttacggaagatggaatctcttcgtatgtataaaggtagtactgtactccttttattttttgtcacaccaatttttctgatattaatcccatttaaaacctttaacttgataaaaatacgtattagggtagtacaatattgtatggttgttttgaaaaaaaaatcaagaaataataaataaatgttaaataattgagttatagtgtataggg

SEQ ID NO: 2961 - DNA, 1101 bp, Zea mays
  misc_feature (1)..(100): optimal_loci_33738_G1, chr1:206251665..206252765, Cluster 17
  modified_base (852)..(852): a, c, g, or t
  misc_feature (852)..(951): n is a, c, g, or t
  modified_base (853)..(853): a, c, g, or t
  modified_base (854)..(854): a, c, g, or t
  modified_base (855)..(855): a, c, g, or t
  modified_base (856)..(856): a, c, g, or t
  modified_base (857)..(857): a, c, g, or t
  modified_base (858)..(858): a, c, g, or t
  modified_base (859)..(859): a, c, g, or t
  modified_base (860)..(860): a, c, g, or t
  modified_base (861)..(861): a, c, g, or t
  modified_base (862)..(862): a, c, g, or t
  modified_base (863)..(863): a, c, g, or t
  modified_base (864)..(864): a, c, g, or t
  modified_base (865)..(865): a, c, g, or t
  modified_base (866)..(866): a, c, g, or t
  modified_base (867)..(867): a, c, g, or t
  modified_base (868)..(868): a, c, g, or t
  modified_base (869)..(869): a, c, g, or t
  modified_base (870)..(870): a, c, g, or t
  modified_base (871)..(871): a, c, g, or t
  modified_base (872)..(872): a, c, g, or t
  modified_base (873)..(873): a, c, g, or t
  modified_base (874)..(874): a, c, g, or t
  modified_base (875)..(875): a, c, g, or t
  modified_base (876)..(876): a, c, g, or t
  modified_base (877)..(877): a, c, g, or t
  modified_base (878)..(878): a, c, g, or t
  modified_base (879)..(879): a, c, g, or t
  modified_base (880)..(880): a, c, g, or t
  modified_base (881)..(881): a, c, g, or t
  modified_base (882)..(882): a, c, g, or t
  modified_base (883)..(883): a, c, g, or t
  modified_base (884)..(884): a, c, g, or t
  modified_base (885)..(885): a, c, g, or t
  modified_base (886)..(886): a, c, g, or t
  modified_base (887)..(887): a, c, g, or t
  modified_base (888)..(888): a, c, g, or t
  modified_base (889)..(889): a, c, g, or t
  modified_base (890)..(890): a, c, g, or t
  modified_base (891)..(891): a, c, g, or t
  modified_base (892)..(892): a, c, g, or t
  modified_base (893)..(893): a, c, g, or t
  modified_base (894)..(894): a, c, g, or t
  modified_base (895)..(895): a, c, g, or t
  modified_base (896)..(896): a, c, g, or t
  modified_base (897)..(897): a, c, g, or t
  modified_base (898)..(898): a, c, g, or t
  modified_base (899)..(899): a, c, g, or t
  modified_base (900)..(900): a, c, g, or t
  modified_base (901)..(901): a, c, g, or t
  modified_base (902)..(902): a, c, g, or t
  modified_base (903)..(903): a, c, g, or t
  modified_base (904)..(904): a, c, g, or t
  modified_base (905)..(905): a, c, g, or t
  modified_base (906)..(906): a, c, g, or t
  modified_base (907)..(907): a, c, g, or t
  modified_base (908)..(908): a, c, g, or t
  modified_base (909)..(909): a, c, g, or t
  modified_base (910)..(910): a, c, g, or t
  modified_base (911)..(911): a, c, g, or t
  modified_base (912)..(912): a, c, g, or t
  modified_base (913)..(913): a, c, g, or t
  modified_base (914)..(914): a, c, g, or t
  modified_base (915)..(915): a, c, g, or t
  modified_base (916)..(916): a, c, g, or t
  modified_base (917)..(917): a, c, g, or t
  modified_base (918)..(918): a, c, g, or t
  modified_base (919)..(919): a, c, g, or t
  modified_base (920)..(920): a, c, g, or t
  modified_base (921)..(921): a, c, g, or t
  modified_base (922)..(922): a, c, g, or t
  modified_base (923)..(923): a, c, g, or t
  modified_base (924)..(924): a, c, g, or t
  modified_base (925)..(925): a, c, g, or t
  modified_base (926)..(926): a, c, g, or t
  modified_base (927)..(927): a, c, g, or t
  modified_base (928)..(928): a, c, g, or t
  modified_base (929)..(929): a, c, g, or t
  modified_base (930)..(930): a, c, g, or t
  modified_base (931)..(931): a, c, g, or t
  modified_base (932)..(932): a, c, g, or t
  modified_base (933)..(933): a, c, g, or t
  modified_base (934)..(934): a, c, g, or t
  modified_base (935)..(935): a, c, g, or t
  modified_base (936)..(936): a, c, g, or t
  modified_base (937)..(937): a, c, g, or t
  modified_base (938)..(938): a, c, g, or t
  modified_base (939)..(939): a, c, g, or t
  modified_base (940)..(940): a, c, g, or t
  modified_base (941)..(941): a, c, g, or t
  modified_base (942)..(942): a, c, g, or t
  modified_base (943)..(943): a, c, g, or t
  modified_base (944)..(944): a, c, g, or t
  modified_base (945)..(945): a, c, g, or t
  modified_base (946)..(946): a, c, g, or t
  modified_base (947)..(947): a, c, g, or t
  modified_base (948)..(948): a, c, g, or t
  modified_base (949)..(949): a, c, g, or t
  modified_base (950)..(950): a, c, g, or t
  modified_base (951)..(951): a, c, g, or t
tagacgagactacattgctccctctttttgtatctcgtagactatgattgtattgtatctagggattactgatttaaatagccatatgttatatgcttgtaaccattgcatgggagtatgggcaaacactagggtcgctaagctctgggtatgctcctggtgtcatgaaactaagaatgaaacaatgtctctcaatgcaaaattttactttactattttatagattaacatatcaattaaatgctgcaatttaatgatcaatagaaattaataaaatatatgaagatgatacaaattatcctcaatggaggtttcacacggtttttaagactttggaaacgagtcgatatagtttcatccacataaaaccaattttatcccatgaaactcaaaccttttaaatgtcataaaaagctttgatgtggtacgctattaagaccttgttgatttccctcctagtagattatataagttagattatggtggaagcctaggaggttaaaatgtcaatttgtgatcacaaataagctaaaataaactagcatatatttatggtatcaaagcgatattttaccctcctcttccactgtaatataacttatataatttagtacggaaacaaacatactctaaatatgcatgaaaccaccataaaactaccactgataatagccttaaacagcttcgagccatggacatattcgttggaggagacaccaatgcatgggaaatccacccctttggatgattgaatcaaagggtttatttggatactcgatgaagtaaaaattgaaactaaattatatctcaatctacttcaatatatactaggtatatgcccgtgcgttgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacgttctagagattcgtctgactaaacccaaatctagtctctctgaagtttatacacatgcaataggaaaagtatctacaaagaggcaatcaccaggcatctctactctacaccgtcagaactcaaaagatgataaagggtacatcaaa

SEQ ID NO: 2962 - DNA, 1053 bp, Zea mays
  misc_feature (1)..(100): optimal_loci_340323_G1, chr10:95095835..95096887, Cluster 17
tcccccctatagcttcagcttcttcctgacttcatccttcgatcagcttcggttagatgacgacgacgaacatttttacctgaaacttgcttttctgtgatatcccgaacccgaaggccttcggcgataaaggccctcccacactatctttcatgctaaaactaatagtacttattagatacctttagggtttgtttgggagcaagtggaatgaaggggattgagggtgctagaatctctcactatttaaaattgaatagtggggtattctagccccttcaatcctctccattactcttcctcccaaacaagccctcaatgtttaatacttctaatataaatttgccaaacttcattgtttctacagataagaaaatgaaatctagcaggtcaagctgagcaagcggctaggccaaacatatgtggcggtctttgggtcgccgtttgtttctagtagtagtaataggccatgatgcaaggtaggaaaggcccatgggcttgacagcaaggaggaggccggaaatttgttttactgttgtttgggctctgatcatcaatttatatgctccaacgccaacgtacaaagaaaaccaaaaaaatatttaatttggtactttttcaatataaatactcggtcaaagaataacgtgatcataactcgcagttcagagatctatgaatggagcaagtgctaatattaaggaactgttgggataattaacaagactggtccatcaacacgtcattgtgcataggctagtaattttaggaaagtgttagaaaatcatgtagaaacttaaggcttgcagctaatgctttttatgttttcttttaaatttgttcatattctaaaatagtggtagttgtacaataccttttcattttcgtcaccaatcactcatgtacttttaaattgtattcatgttttttttttctgtctcgtgtgatgtgtctcattaaaaagttcaccttgaactctgtatttaacgtagcaacagatatgatcattgcttcgtcatatatgtttccatggtgttaatattgccacaaatc

SEQ ID NO: 2963 - DNA, 1118 bp, Zea mays
  misc_feature (1)..(100): optimal_loci_342566_G1, chr10:108105373..108106490, Cluster 17
actcacttgtacgttttggttgctgatatgtccaatcctttcaattgtgcacattagcgccaaagtacaaacaagtacataggcaaagtcggaccataaaaaacaaagtgttagaaaaatagaatacatctacataaatataggggtaataatagaggactgatatcaatgaagaggctaagtcagagcatgaaaaaagagcatcaaaataaaatataggcacataaatagaggcaatagcagaagactggtattaagcctaaacatcaaggttttaagcaataccaccatatgtaacataatccgtacaactaatgaatttaaatgtaagtaaggcttcggtgctataacagtagataactgaaatattcaaattttaagtagtatccacatatatgacataattcttacaactaatgaatgtaaatgtaaataggcattgggtgctataccattagataaacaaatgcatactacatagaaattaatatatggagcaaaccgaataggtattagcaacgtgaaagaagaaggaaactaacatttacatcggtagtgacagtcaacaaaatatttacctatttgtttttgtcgctgaaacttccgatgtttgttgatgtgcacgtgtaggacatacgtgaaacaactgcataaacaaatttgaggcattaaaaaaagcatcagaaatataacacacctacctagatagaggcaatagtggaggggaaatagtatgccaaaactttaagaaggcaatacaattagatgaaatgacataggtattccctaaatgcatccaaaagtagcatgtcgtgcaggaagcgcaaaaaataagaaatgttacggagaagtctatatttttaggacaatattgttagagtgcacttttttggggtgactagaaatatggttgggataagggtatgttgttgtgactctacatatattatcatatattagcgtttttgtaacttggggcagtgcatgcatacatagagcctttacattgtgttgttcctatactaataattatacatgatttccgaataaggaaggcaataaattataattgtatagaagaagttctctaacaaaactgaataggcgcttaaaaatgt

SEQ ID NO: 2964 - DNA, 1341 bp, Zea mays
  misc_feature (1)..(100): optimal_loci_34281_G1, chr1:208778933..208780273, Cluster 17
  modified_base (358)..(358): a, c, g, or t
  misc_feature (358)..(457): n is a, c, g, or t
  modified_base (359)..(359): a, c, g, or t
  modified_base (360)..(360): a, c, g, or t
  modified_base (361)..(361): a, c, g, or t
  modified_base (362)..(362): a, c, g, or t
  modified_base (363)..(363): a, c, g, or t
  modified_base (364)..(364): a, c, g, or t
  modified_base (365)..(365): a, c, g, or t
  modified_base (366)..(366): a, c, g, or t
  modified_base (367)..(367): a, c, g, or t
  modified_base (368)..(368): a, c, g, or t
  modified_base (369)..(369): a, c, g, or t
  modified_base (370)..(370): a, c, g, or t
  modified_base (371)..(371): a, c, g, or t
  modified_base (372)..(372): a, c, g, or t
  modified_base (373)..(373): a, c, g, or t
  modified_base (374)..(374): a, c, g, or t
  modified_base (375)..(375): a, c, g, or t
  modified_base (376)..(376): a, c, g, or t
  modified_base (377)..(377): a, c, g, or t
  modified_base (378)..(378): a, c, g, or t
  modified_base (379)..(379): a, c, g, or t
  modified_base (380)..(380): a, c, g, or t
  modified_base (381)..(381): a, c, g, or t
  modified_base (382)..(382): a, c, g, or t
  modified_base (383)..(383): a, c, g, or t
  modified_base (384)..(384): a, c, g, or t
  modified_base (385)..(385): a, c, g, or t
  modified_base (386)..(386): a, c, g, or t
  modified_base (387)..(387): a, c, g, or t
  modified_base (388)..(388): a, c, g, or t
  modified_base (389)..(389): a, c, g, or t
  modified_base (390)..(390): a, c, g, or t
  modified_base (391)..(391): a, c, g, or t
  modified_base (392)..(392): a, c, g, or t
  modified_base (393)..(393): a, c, g, or t
  modified_base (394)..(394): a, c, g, or t
  modified_base (395)..(395): a, c, g, or t
  modified_base (396)..(396): a, c, g, or t
  modified_base (397)..(397): a, c, g, or t
  modified_base (398)..(398): a, c, g, or t
  modified_base (399)..(399): a, c, g, or t
  modified_base (400)..(400): a, c, g, or t
  modified_base (401)..(401): a, c, g, or t
  modified_base (402)..(402): a, c, g, or t
  modified_base (403)..(403): a, c, g, or t
  modified_base (404)..(404): a, c, g, or t
  modified_base (405)..(405): a, c, g, or t
  modified_base (406)..(406): a, c, g, or t
  modified_base (407)..(407): a, c, g, or t
  modified_base (408)..(408): a, c, g, or t
  modified_base (409)..(409): a, c, g, or t
  modified_base (410)..(410): a, c, g, or t
  modified_base (411)..(411): a, c, g, or t
  modified_base (412)..(412): a, c, g, or t
  modified_base (413)..(413): a, c, g, or t
  modified_base (414)..(414): a, c, g, or t
  modified_base (415)..(415): a, c, g, or t
  modified_base (416)..(416): a, c, g, or t
  modified_base (417)..(417): a, c, g, or t
  modified_base (418)..(418): a, c, g, or t
  modified_base (419)..(419): a, c, g, or t
  modified_base (420)..(420): a, c, g, or t
  modified_base (421)..(421): a, c, g, or t
  modified_base (422)..(422): a, c, g, or t
  modified_base (423)..(423): a, c, g, or t
  modified_base (424)..(424): a, c, g, or t
  modified_base (425)..(425): a, c, g, or t
  modified_base (426)..(426): a, c, g, or t
  modified_base (427)..(427): a, c, g, or t
  modified_base (428)..(428): a, c, g, or t
  modified_base (429)..(429): a, c, g, or t
  modified_base (430)..(430): a, c, g, or t
  modified_base (431)..(431): a, c, g, or t
  modified_base (432)..(432): a, c, g, or t
  modified_base (433)..(433): a, c, g, or t
  modified_base (434)..(434): a, c, g, or t
  modified_base (435)..(435): a, c, g, or t
  modified_base (436)..(436): a, c, g, or t
  modified_base (437)..(437): a, c, g, or t
  modified_base (438)..(438): a, c, g, or t
  modified_base (439)..(439): a, c, g, or t
  modified_base (440)..(440): a, c, g, or t
  modified_base (441)..(441): a, c, g, or t
  modified_base (442)..(442): a, c, g, or t
  modified_base (443)..(443): a, c, g, or t
  modified_base (444)..(444): a, c, g, or t
  modified_base (445)..(445): a, c, g, or t
  modified_base (446)..(446): a, c, g, or t
  modified_base (447)..(447): a, c, g, or t
  modified_base (448)..(448): a, c, g, or t
  modified_base (449)..(449): a, c, g, or t
  modified_base (450)..(450): a, c, g, or t
  modified_base (451)..(451): a, c, g, or t
  modified_base (452)..(452): a, c, g, or t
  modified_base (453)..(453): a, c, g, or t
  modified_base (454)..(454): a, c, g, or t
  modified_base (455)..(455): a, c, g, or t
  modified_base (456)..(456): a, c, g, or t
  modified_base (457)..(457): a, c, g, or t
tacagattatatatttaaagtaatgggacatctgcgtaaatcacaagtggtttaggacattgtatgcataatattatacgccctctttagctgatgatggaatagtggatgcaaattataagagattataaactcctaacccagtggaggcaagcggctcctggatgagaagtgagctgcggctaactcgactaccaactttcggcttgtgtggggtcttaaaaggagtctgcattggcggggccgaaaaaattctccaccaatccctttaattgtccaaggaagtggataagctgacatggaggtgctaatcgccgcacctcttacatgagtaagatggtcgctgacacgtaaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaaagggtgatcttcgttaatgcaatttttgaagttttctgccctttgcatgtgtgcttataattaatagacgaaaagctttatttgtgcattatttatttgttatagaaaattaatatcatcctctgacctaaattataaattattttgattattttcctggatgcatggttttgctacacgtctagatatacgatatgcatgtctatatacatgataaaaattctgtgtaaaatgatatataaatcggaacgcggcgtggtgtggtgtttggtttactaatcgaatggcgtactacacagcgtaaggcacgtccacgtccctatatctgtgtacccgacgcatgtgccatcactcgctttttatttggaacggcatacatcagcacgactaaggatacctgccctattcgcttgctagcttatattagtgactagcttatattagtgaaaagcctgtgattttataatctcaaaaacccggtgtgcaaagcatgctctttttagtgttttcaaatcacttgtatgtctagtgtgtagttaataacattgcatgtagtaggtattttactccgtacgtaacccatatacatcagcgtgccacctgtgcactgatcagcagatttagttgcgcccaaaatgtcagtgacccatggagcgtacaccaaataaggccccgtttggtttgaatgactaaaaattagttcttttattttagtctctaaattatcaaacggtggaactaaatagggagtaaattgtttgtctctggtctctcaaatggtgactaaaaagaactaaactatattaattttactttgtatcccttatttatttcagttgtactgattgcggaagaattttacttttgatcttatgttttg

SEQ ID NO: 2965 - DNA, 1208 bp, Zea mays
  misc_feature (1)..(100): optimal_loci_349522_G1, chr10:145804354..145805561, Cluster 17
gagcactccagccttcgatgctacgacatgatgcagtccaggtcgatccccttgcagcacccgtgtttggatccatcgatggcctccctgcatccttcgaacaagctttgacaggtatgaagcttgacatctacttcaacttatttgccagtgaaaatcttggttgggactgtgaattgcttgtaccagattagttgaagtaaaaaattagtttaggatgtctgtttcttcactaatttatgttttctagtgtctgttaacaactgtctatgagtaatttatccaccaggaagttattcgtcaaccgaatcttgtcacagtatcaatcgaaagtaattttgctgcacaagatcctatgtatttatacatggctaatttttttttggtagcctagccatgcagaacatttaattgcatactgaaaataatctctacagattctaaatgaacatcagtgtgcctatatttatgtgtagtgtacaatatattatattttacatcagctacaagtatatttggttgttctttacctgataatacacgtaaaaacatgcttacttcaaggagatccatatcccattcagatttcatagcagccagacaactaaatcaataagccacacgatgaaccagcacaaatgacctttagcttttataccatgatctatccacttcatcacttcccatgaaaacctaacacagagatagttctctgggggacctccataaaaaaagagaataggcatatacaacttcctcaagtcagccatcacttcctcatagcgctatgaatatgcattaagctttcctgcttttgtaccagccaaacaatggtgtctcagatttctgtttatcttctatacagaattacagatgaatgcttatagaacttagtttttcttattcagtagcactgacaaaataatctagtcatttattgtgcaaatatctggtatgtcattgtgcagctttacttattttttgttcttttggatgtgaacttcaataatgatcatttggcatgccattatgatcccttgaaggttgtattgttttttaccctatcgctgtatcttatgatttatgatgtaggaccaatttgatgaagcttcgttctgattataaagatgaatttgtcacaaagcatggtttcaaattgggtcttatgtcttgctttgtcaagtttcttagtcttatgtgtaacaaag

SEQ ID NO: 2966 - DNA, 1366 bp, Zea mays
  misc_feature (1)..(100): optimal_loci_350039_G1, chr10:148838030..148839395, Cluster 17
tacaaaatttaagatcacgatacggttcaaatgaaaagcttgaaaccttagctcaaaacgcaccatgtgtagtaatacgctcggtgcaaaataagaaacacaggttctcgaaaacatgtatatacaacaaggcccaaaatctaatgcattgtacgagtcttctgaaagaagtcttggaaactactcataggtacctctgatttagtaccatacagataagtgcgcttacgttatgagctcgtgcattatactagttgggtaacctaaaattacaagaaaaaaaagaaataacgcgaaacttgcttttctagtttagaaaacaataagcctacgtaacatcctacttcacctcctcatattcaaaatcaattgtctctcgactttacaaaagtagacaaataacccctagacagtttttgttgatgattttgataacgtgtcaatgatttaagtgatatcatgtttatcttttccagttctttcgtcttttagtatccaaaacttatatacttttacacaaaaaatcaataattagctattatattgaccttattttttttctaaaattaaggagtaccgttttattgtagctaaataatgctatcaataaactattatattttttattgattttattaaacaagttaagtggtatttcttctaattattaactaaatcaattgtttatttgtatatgttagtttaactaatataaggtaggtctttgtaaaaattggatatattttattactttttgctaaatatttctaaaaagacaaatagaaaattaattttgttagaggcatggcactttataaatcaatttagttgtttaatccgctgtcgtggcacaatggcgagtccgaggcggatggcccgctcgagcttgaccatgtggaagaatctgatgaggatgagggggtctaatctaatcatgactaaactgaatttaactcctttcaatctgtaattttattcttcgtttatatatatattttggatcttacaaaatttcatcattttcaattcaaaactgtggacgtgtaaaatgtggcaagttaggcagcaaaccaaacgacgagtcgtcatgctagaagacttaccgcccatcccaggtcgtcgtccacgttccacatccgtcgtcgggatggacgcgatgaggtagcttgcgtttgatgaaagattacacatggatgcgtgtttgaccgaggcgctggcaagatgttgtggtgcactcgagcggcatgtagaggcaacagaacagaagatggtggcgcatctcatcgagatggatcaagctgagactgacacgagatgtggataagagattggacaacctcaccatcgagcacacgactaaacaccc

SEQ ID NO: 2967 - DNA, 1281 bp, Zea mays
  misc_feature (1)..(100): optimal_loci_35100_G1, chr1:213216773..213218053, Cluster 17
gtatttatatagtgaggtttgaaataggggagtgagatagaaagtgtgaaatagggagtaagataggaagtgagatgtggaggttgctcgagatagcattagtgcgacttgcagccacatcgcggggagggagaggaaactaaaaccgcacacacttgggagtcggtgaccacagaaactggtgggttcaagaaatggtttcccactgttttttaaaattcgtttaaaatttaaaaacttaaaaaaatataaaaaatagaaaaatattataagagaatgaataattttctggtatatattacattcatatttatgttatttttaaatcaattagcattttgggttaaagaacaataaaatccgataaaaacaacaaaaccgacgaaaatactggtttaccgtcgagaaatctctgaaaactgtttatttgaatttatgaatataaaccagttaaaaaatgaaaaccaccgagaaacaacaaaaatcgttcggaaatagaggtttgccaggcggtttcaccattttttggcggtaaacaggtgatttatttattttttaaatttgaaaaagcaaaccagtccgttttggaggtttttagcggtttttcgacgaagaaccgaaattgactagggacggtttttgatttcaaaacggttcggtaaaccttgggtgctacccataaatcacatcgttgtggtcctagtgacgaactgaagatgtacatgtcgggcccagctttttcgagtaagtttagtaagtcaaatcctcttttaaatggaataaaaaggactaagaaaaaaattgtttattttctctttggttctttttaaatttagagagagtttgagtttttaaactagcctttggtttggggctcaacgaccctgcactctacactcttcgtcctggtgccggggaggcaataattgttcggccttgttcatgggcccttgggctgaaatacacggcttacccaaagtggagaggagataaacagattattatttcatggaaataaactctactatttgataccagcattcggtatctccttccaagtaaatgaccctactccctccaatctaaatctatatcatcactatataattcaccggtttaaactttgcaaaactcatccaactaaatcaccaaacaaattgcacctagacttaacacactatcaaaaccaattgttcatatagctagacaaccctatctcctttatttactcaaatcttcaaatctaatggacagtatcatttggatcattcctcacccccc

SEQ ID NO: 2968 - DNA, 1247 bp, Zea mays
  misc_feature (1)..(100): optimal_loci_36002_G1, chr1:217574591..217575837, Cluster 17
gaatttagtattgtagtcggttagtaaagatgttcctccctctatcagtgaaacttatagcgttttaaatttagccaacatattaagtgcaaaacaacttattagtaaaaaaccgtgtaaacaatataccaggctacagatacaagatttttttaaaaaaagtatttcttcagaacagcactttcattttctatggatatttttaaaaagattttgtcacttccatacttattatatggtttgcgctgataaattagtttgtattatgtccttttaatttattcctagagctgttggaatatgagatgactattactattggcgttcattatagatggacatccataccagctccatgttgtggtcctaactaccggtttagggttttgtaaatagtccatttgattagatcgtttgacccgaggtgagagaaaaaacgtggatttaattgagacagcctcttggtgctcctaattatgaatgagtctgaaacatttattagagtaactttttatcatttgtgaccataaccttttacccaagaacatcctcttggtgctcctaattatgaatgagtctcaacataactcaattctaggataaaaagttactctaatttaattgaagtgaaacttagttaatgtagcataacttagtcaatctagcttaagttctagcaaaaaatagtcaatttagttgaacaatatctggttgtaatcaatatacctcaattctaactaattataatctacatagtttcaaactcattcataattaggagcacctggacacgcagtcacgtaggggtcttaactcatttatcaacgagtttttcaattatactctagatagcggtgagaactctaactattcgataaattcgagtttagagtgataagatgtataaatattagtatttgttatgtttttttacaattaacatatatatatatatattaatatatatattatggatgatttatacaatgtgaattgatatgttgtaatgtgaacaatatatgtgtttgtgaatgtatatgatatggatgaataaatgtgtttgtgaatgtatatgatgttgatgaatatttatgtgttgtgaaatatatatatatatatatattatagaaggatataaataagtaattatgaatgagctattgcacctccacggggatgtttcacagcatgcatgcatcatcgttttcgccgtcgttggacatcccattcgtcttcccggccttcgc

SEQ ID NO: 2969 - DNA, 1184 bp, Zea mays
  misc_feature (1)..(100): optimal_loci_37835_G1, chr1:227016230..227017413, Cluster 17
gtaagctcgcacaatctctccctacacatcttttttcttcgcctacctaatgctctatgcttttggagatgtgctagcccatttccatttgatgcccgagctcatggaagctacgattttagatgcaacccgctaaaaaacacagttgatccctctagaagaatctttcgtctttagagtacctgatttgttacctcatgctaagaaaatttggcaaaaaatatagtagttataattttttttattggaaataaaagctactcctctctagagtacctaattttattttttcttggcatgtgtcgtcaaggtactaagcgactttgatgtttccaatattgtacatgttaccttcttcaataagtggtttagattactttccatatgccttactgataactccatacattacaattatctcacgtttttcaccatcattagcttgtaagaaagcaagaactcattttgtaagcaagcagtatgtaagtctgtatgcatgttcagtgctggaaccatagtcatctggtggcactgaatttacagcttatagggcaatattgtacattttgaagcaataagatgttttttatagcttacagggcaaatcttattcgtcatttgctccaaaattttgtgagatttctgatgcaaaacctgtaatacgaattcatttaataagtagacaagtcaaactagtatagatcttaaaatagctacatgtttttcatgcataccaggaaccgatgcctgcctaatgtgttacagttcatcccaggatacccctacatactacattttggagaatgtttcagcttaactagcactctcactaattataatttttgtttcggtgaagtgatccggactgctgcactctgtcatctgtcactgacttttattagttttaattatcatggctagatgcactcattgttttcgtttgtactctgtaaatcaattacatgtttcattactggaagaccacaagtctggactagtagtctagtattggatcccttgggactgaatgatctcttgattatgattataattgtagcaggaaggacactaactcaacgatttgtgaagcttcctagctataatccttaatttgcatcaattttgtatgttataaggtaggtagcacagctatacaagtgcatgattaacttttatgtttctag

SEQ ID NO: 2970 - DNA, 1030 bp, Zea mays
  misc_feature (1)..(100): optimal_loci_38368_G1, chr1:229904499..229905528, Cluster 17
tttccgtccgtgaccgacaaatgcactaatgaagagttagaccattttacttctagattaagtgtttcagccaaaatataatatccaattgtttattaaaaaagtgtaatagctatataaataagataagggattgctcaaccacgatgggttttatttctagcacttagtttaagtgcttaacagtagttttagatcctttttatcagttttagagagatatttgactgttataatcttgtcatttgtgtaactttgataaaatacctaacattgttaaagagtcgaaataatcatttctctaaaatttaagttaatctagtcctatctctgtcttcgatttttggatttttttttgggcttctcgtgcatcgcttctagcaagactatggttggggtttcttttttggagaaatcggtgctaacacatgtgaagaggtatttatatgatcaatctcttgaatcccctcaggagcatatctcgattccatgtttctcaatttcgtctccaaaattcttcatctttggatgaggttttttttttgggatggacgcttcttgatctcgtggagacccttctaaacctaagctattttggtaattagttgatcgagtttcagaccgggtccttctgcgctcgttctgtttttttgctgaattttttttctataacaatcgcttggtccgatactcggaggacaatcggaggtcgcacagtactgttcggtgtttgatatttctctactgtttcgtctgttgagctgcttcagctagtccgatgctttgtctagcactttaatccgatgtgctcagctcggtccgatggtgcagctttgcatgcgtttctttgttttcaccgaaggagcactagcagtcattggctagcaacaagtgcagcagcagtacgcgcatgacttggaccatcaaattttgagtacctaggttcaaaatcacgagacactagtcgctaggttcttaaaatcactttggccatgtgcatagtgttcttttggcacttgtttgatttgcg

SEQ ID NO: 2971 - DNA, 1392 bp, Zea mays
  misc_feature (1)..(100): optimal_loci_42156_G1, chr1:248868165..248869556, Cluster 17
tatgatatgcctgcgtatagcgtacatactactgtactgctactacttattctcgctctatccttaaccttctatttgagagtatgaaactactatactcgttctttattcagaccaaggctcacataccagatccattaatccagctaattcacaggttagtcggtaatcggataaggtcgtatcaccggtttaccatttgaattttaaatattttataatttttttgaattttttgctaatttttctataaataatatgaattcttttaagactttccactaaagccaaattaaaaaacacggtacagattttaaactaaaaatcaaacaagtttaaaaaaataaagaaaaccccactgtatatttgggccggtggcttttaaggtccaataatctcatacaaaaccctatctgtcggtctttgcacccattcccctctcctcctccgccgacatcgacctagccacgccactgccatctgacggagtagccgacgaaaccgtgccggtgagccagctacccggtcgataactcgctagaccgtctgctcgtccgcctagctggtaagccgtctagttaacatgataaatcgagccgtgttcggattaattaattgccacgaaatcacggctagcccgtagttattgcatcagaatattacgtagccaagccgcccgcatgagccgactaatcaggcgattttgctgattagccgtccctgctacccgattaaccggtccccaatagagagataagctgggaggcctctagtagctatgttttggggatttgctcccttttaacttcaaatctttttactattggtactgctacttgtaataatagttcataatatattaaattttcgtctttatctaactatagaaatgaatgattgtaaatggtcgatttcctttgtgctaacaccgataagatatggtcagaattatgatttttatctgatatgttttttttattctaggaattaaaaactataaattatgtctgcataaatttaccagggacagtagtcgatcgggttcaggtcagggtggaacaatctgcccacggttgctcccgtgagtttagtttgactagttactttataatttagtttaaacttataaatagcatgatactctcatagtttgaaaaccctaaatattttttgaacccatgattcacaggctatctaacaaactgtagtcatcgtatcaactatatatcttagaaatcataactagtagcaatatgtgcacaaatcatagctaattaagcaaaatcatactgcacaataaacataacaaacgaatcagtgggatattataccttggtcttcaagctagacggatcaaatccaaggttttcaactcgaataacaatattggag

SEQ ID NO: 2972 - DNA, 1047 bp, Zea mays
  misc_feature (1)..(100): optimal_loci_42322_G1, chr1:249456526..249457572, Cluster 17
ataatatggtgacaaagttttattatcatctttctttaattagttggtatggattatttgcaaattgatatatatgtacgacccaaattttttctaagatatttttaatacttctaaatatggaaaaagtttagcacttgatactctcaccttgtacggttataaagttttcttgatctataaattttaaattaggtggtttgcctttaattagatgctacatatttgtattgtatgtgtgttgtatgattatagttttatgggaggcctaaccgatttatagaaaatgtaagttattgataggagagttaaaatgcatttataattcgtttgactttttacctcgagtttgaccagtttttcatattcaaaaagtttcataattgaatttttttattttttcaaaaacaatttgaataagacgagccgatcaaacttggtaaaaaatcaaacgaattataaattgggacggagaaggtattatatatagctatcaacaaatatttaaattttataaaaccctatatcgaaaagatggaacatgcaaaaacatgggaggttctatgtgggtgtataagtgggagtagttttcttcaagacaacaattgattctggaatcatctcgacacagggagaacttattttaaattttcttttataatagtttaaattaaactatgtcaatatgcatataactcatttgtccttcttcaagcgttttcacatattttacaatggttatattgttaagttgagttatacacttagtgctcatattttagtccagatgctaggattacttactcatgaaaagttatgtactatcaccagaaacaactaaacatagaaacaattatgatgggttataaacttcacattcattttgtttggatgaatgtcttaggtaaatctaacatatgcctatatgcacgaaccacatgatagtaagttatgaatgtatatgctcaatcaatgttaccttgagtggccaaaggagaggcatgccattcataacatttgtaccatatttaaataagggagaatgag

SEQ ID NO: 2973 - DNA, 1231 bp, Zea mays
  misc_feature (1)..(100): optimal_loci_42424_G1, chr1:250309754..250310984, Cluster 17
cctttagtgtctctttcctttgtataaatatcaaaaacaataaaggatacggtgccccttttcatttcattctcgcacaacagttttcatttcacaagcgctaccattatcgtgggtacttctaccgttagggtgcccttatacgaataatgatatggctgtcagattagtattatgtttgttgatgtgattataatgatatgtcgtttcttctatcatgaataaattcgatggtagatacctatccgaagctaacacggtataaaattaagattttttttgtttgacaataaaaaaatgtccttccctgctaaataccgaaattcaaaatcttcactacgtgtcagctatttcaacttttgttctctatttgatacttttgctatttttttttgatgtaagaacgttaggtctaagtcgaaaagaccatcttgcccatcccatatatgtttttagggcgatgtgttgtgttcactgttcaggcgtacgggtaaaaaaactgcaaataaataaatatagaaaaaaatataccaatacgcagcagccttaacacagcatatctgggaaaacacacaggaagggtaagatgtgtgtgtgtgtgtgtttttttttgtcttggacttaacttttacaacaacaacaataaaaaaatgacggaagtgtcaaatagagaacaacagacaaaacatgcgaaatacaagaaagattttaagttttggtaccaaatagagaggagatgaaaaaaaaatctgggtaaaatcctacccgataggcttcatgaatacggttaaattttgatgtctcgaacattctcttgagcgcaggtatatcaaattctaccttacctgtgtgctgccatccatattcacgtgcggtttggatgcacacagtgagtgatgactgatgaaagaaaaccttggacggacctgtaagtatctctgtatctgcacacttcttgtttcttggcctcttctgcccacttttgacaaaccattgcatgatggagtcactttttcgctgcgaattgctgcagttttaatttattgtggcttctacagtattttgtcttatagattacagctgtaacaactgtggttgcagagcagtcaaagaaggctgggtgcaggacagccgaaatagtctgcaatgtaaaatagcataaaacaatacgtgatcatacacactatttgctgagcagtctaaagaagagaacacttgcgcagagtggcat

SEQ ID NO: 2974 - DNA, 1351 bp, Zea mays
  misc_feature (1)..(100): optimal_loci_44633_G1, chr1:262138717..262140067, Cluster 17
ctgcgctgtgtaattgttgtaatacgccagtaaggatactattattcctttgcttctataagataattgttacttctgtaagttgacatcttatatctgtttagtggcgatcggacaccaaagcagaaggtgaaattgaaagtgacagaagaaaagcttctgaatttgatgttgaagtacaatggtggaaaaccaagagttgaggtaccctcttttctgaatcttgagttctgcttaacttatggtgcttaaattgaatagcagttttgggctcttcatgcagacgaaactaaaaagtgctgtacagttacaagacttgctggatgctacaagacaacttgtaccaccaactaggtactgtatgatcagataaatattttagcctagtatttagattgcatgataactttatgaaatttgcttccccaactttattcttatcttatgtatctgcatgttctattaccagattgctgcattattcaaattgttagtttgatttgatcttctgtttcttcaactgctcttttgagttaaattcggtgaagtgattaatgttgtgtattaggtctggtcgggagagtgatagtgatgctgatgatattgagcatatcgagaaacttcgtcaagtcaaagcagtcctagaggaggtaatttcttattatccagatctacatatccatgacatttgttacatacatgctggataccttatcactagatggtttgtatcatagccacaaagttcacggatcgatagggtcgaggaacagggtaggctacttgtgcgagacatttacatagtgggaacgaaaatgaccctgcgtatccgggtcggggaccacgtttctgggtcgagggtcattaccaccgtacccgtttcttgtgactatggtttgtattcatgtgtctagtgcagagtgcaagctagtagctagatgcaaccatgcgaactgtatggtggtctaaactagctgaagggtagtcattttttggcgtgcatccacaatttttcattaagttgaaatggaagcaaaaaagggacacagaagttaatacttccaccagttactttccctttttgttggtgttgtgattgagtttatatttgaaatttaatggttaataatccacagcagtgttgttaatgctgttctggtactggctggaatgggcagtataccttgcgctgtcacctaaacttgcactaaagaggtttcctcatgtaccggcctgttctggcaatccagtccatctcgtacccacccaagaaaggtgccacccaagttaagatatcaaagactatcaacttgagcaggaggaaaaacatcagtgcgatttgtttcttgga

SEQ ID NO: 2975 - DNA, 1017 bp, Zea mays
  misc_feature (1)..(100): optimal_loci_45046_G1, chr1:264182768..264183784, Cluster 17
gatgatgacatttatttttttaagcatgtgggaagaagtcgtcgacaataatcaaggctagcgcctggcacaaccacatatatgcccttctagattacagaaaacagtagccatgctttcagcagatttcgtttttttttctttcggaccctgctaggctgcaatacacatcagattgtacaactagtttaaattaacaagtattaggttatcttcggtagatcggttttaaactttactatgtaaacagtgtcatatagtcatctacagttttatgtaccttattttatataatccactgaagacaacattattagtttatcagatcacacaggacctacacagtaacactggctgcaaacgtgacttactcttcggatttggaacagtattcctccggtccgaaaaaaagacagtgtgattaataatgatcaataaaatattgaaacagttcggaaactaatcgtgccttgtgaagcggggagaaaaggacaacatgaagaaggcacgtggggggtttgacgattagccttttaacctttccctttcacgcggcaacaaaacctttcctttattttcacacgagtctatttcaggaatttagagtcgattaataatgtcttcctttattttgtttcactcacttcatccgtctcaaaatatatgattttatagaattcaacacttcagaggtcagcgtcattatatgtggataatgcattagagcagtcccaacccttcacgtcatctagtttctatatcattaatttagctaccacatgagcaatctggtgacatagcaagaaaattaatgaaaaaggagaggaaatggtttcctctatgagaaatcaggtctacacgtgcaacaaagacccaagaaaccattgttttggtgttgggggtgagcatccggtttctatctgtggagctcacacgcatctcattggtcgcaccgttacattcacatttattacgacaccaaaacaaaatattagcgttggaccttatagtttctac

SEQ ID NO: 2976 - DNA, 1281 bp, Zea mays
  misc_feature (1)..(100): optimal_loci_45355_G1, chr1:266029639..266030919, Cluster 17
tgtttccttcagcattaacttgtttagtttaccataacttcttccagttgacctcctttattgaaacggcattgcacattaataggtgaaagaacttacagttgcctggcgaaactcctcaagcattcaccgatactgcatcctcacttcagtagagtctaccatggataacactcttaacgcatcctgtaattttagtgtataatagataataatttgttgctattgcgtgagatcacctttttggaggtaattccaatggtgatgtatctgcatcgtctttctaagtgggactttcttcttgctattaagaaatagatatagtgataattattaaacagaataaatttataaagacttgttagtaatttcttttcctaattaacagggtagtgatcatatttaaacataagttttgtagtttttgtaatagtatactatttggaaaaatactacaatataataaatttagaaattcttttcagtattttcttttcctagataagagggtattgatcataattaagcataagtgttgtagtttttgtaatagtatactatttggaaaagtactacaatataataaatttagaaattcttttcctagataagagggtattgatcataattaagcataagcgttgtagtttttgtaatagtatactattagtaaaattactatatacctgtattggtgctttgtatgtctgtgcattgtatttctgagtggaactttcatcttgctgttacaaagtagatacaatatggtattgttagtattcgcttttcctaaataatatggtagtgattatattcaaatacattgccattgttatatacaggacatgtccaggggatagctgttcttagtttctatgcacattaaaatttgttaaacaaaagaaacgtttattacctaaaaaacaataacttgttatttgcttcatagatttgatttgataactgttggttttaagtttgcaataacatgacactgacagagttccatgaataccccaatttcttatcaatttattaccatatcccagaaatgtgcgccatgagataactgtgtagcagccttagctttgcaaacatatttgtcatagttatgttatttggcatgcatatataattattatataatctaaaatagagtaagctcactgtagttatgtgacagcaacaacaagacctaggcatggtggtgaggaggctgctggtgatggcacatgcggtggtgcctaagatgcaatggcagcctttttatgtgtcaatgtt

SEQ ID NO: 2977 - DNA, 1016 bp, Zea mays
  misc_feature (1)..(100): optimal_loci_46255_G1, chr1:271002736..271003751, Cluster 17
catttttaccattttagtcacttttagccctttttatttgagtctttagtttctaaagtgactaaactttagtcactttgtatgttggccttggtttattatgctaataatcacgtgaatcatctaaggttgaactcgccaccatgaggacgtagattgtcggcaagcaaccgaatttgaggaataaataatgtgactacctctttccatatgtggtttgcacttgaagttacccttgctattacatattgtttcccataatcatattgtgtacagttctttattacctattaagtttttgcatataagttcttatcttagttctgctgataaggctttgttcgagaaactttataggctattcaccctcctctagccatctagatcctatcaattggttagagcttttgtcacctaattttaacacatagcaaccttaggtgtaaagatggctcatattaacaacatgagaaatccatcacaatttgatggaacaaactatgattactaaaaaagaaaatgtgaacatatttaagatcaatggacaaaagagtttgggatgttatagataaaaaattaaggccatcgacatgaatagttcaacacctaaagagaaagaagatctacaaaaagttaaggccattgacatgaatagtccaacacctaaagagaaagaagacctaaaaaattaaggccattgacatgaatgttctatttgatgctatttgttgcagacctatcgagatttccaaaagaaacacatgattactgatttatatccttctttcctccgaaggtattgaaggggagaaggaagcattcgtgatcaaatcattgatatagtaaaggctttgtaaacatataaacaaaatgatatgagatgaagtaaactccatacacacaagaagtttcatctatctctattatcaataaaatccccctttggtccctgtaaacaacaattcatatttatgaaatacataaaagcttgatttctttatacctttgaaagtgtt

SEQ ID NO: 2978 - DNA, 1171 bp, Zea mays
  misc_feature (1)..(100): optimal_loci_46626_G1, chr1:272931228..272932398, Cluster 17
gtatcgttagctgttgggagcgtatcctcgtgacgctcagtagactagtagagtatggttgagtgcaaacacctctaaaaatttaaagcagaatgtacccatattattctttttaatttttatgaaacgaactaaacatacacgtgcatgcatccttatttataataatgtgtttgacgtctgtggtcagtcaaactatacgttttccaagcacatgtttgccatggcgagtaatagtcatcactcgcacggagacgatccacacgtgtattgaaacggagaccctgctctggaaccacgcagcatgtgaagccggtacagctgtacaagaacatatgcatggaatgtgggctatttcgaggagaaagtcacgcttctgagttttactcgcgtgcgtgtcacgtctcacctgatgacgttttatttgatgagtccagtggccctgcggcgaggggttttataggctctaaattttatattataaaatttaaggaccaaaacatattatgattgggtttgtttttattaattttaaactaatattaaatcctaaataaattatgaaaaaacatttgaatcatcatctattactgcccctacacctacttatggcacctttgacatttccccttgaggtaattacgctagtgcccttattttagggtatgactatagatttgttcttgttttttagactttaattttttctaaaaatgaaatgttgtatgcccctattcctttagtgatacttaacgaggttaagtcttgataaaagacaattatgccctttcattatttgcataacaatttgattatatttcaattataacaacagatatggcaacaattcaaaattttgcataacaattcaaaactttttttggcatttccaaaataaaaaatggaaacaatctaactatatttttttggacatattcacaatataacaccaacatcatattaagcataaaagttggatattacctacataatataatagaggtaaacacgcaaactctgaaaaaccgagatacctatagttactctaaaataaggacactaacacaattgtcccaaaaaaacagagacaaacacgcaaaatctataaaaataggggctgcagctaaattaaaggcactggcgcaattgcaccttagggaaacggaagaaa

SEQ ID NO: 2979 - DNA, 1078 bp, Zea mays
  misc_feature (1)..(100): optimal_loci_46998_G1, chr1:274933410..274934487, Cluster 17
acattttaattaaagatgtgctgctctatctctttgctgtgtttgtgatgagtaataaagtctttcccacctaaaagaatagtaccagcagggcattgtttcctcttcccaatgttcccaccgttccctattcccaatttccaaagtccccattgcaaatttcacataaactcgtgaagagagatcttgagaaccatgacctgcaaatctctgaaagacacaggcccatcatgatgttggtcgtctgtaccttgatctgaatcaggttagtttgaaatcatgggtttgtgagttctctttatgttggtttttaaggtggtgttcttagttttgtcatcttcctcatttttatccttattcgtgtttttttcttagttttactcttttagtgctatataccagaagaataaaactgagcaaaaaatacgacaaagggtaaaaataagaatgtggcaaaactaaaagtatgaatttaattttctatatgattgtttctttatttcttaatttaattctgctaatgatttgcagatttttagtggcttcggtaacatcgtaatagggcctacagctacgaatttggattaattggggattattagaccagtttcatggtgtgtttctcgtcatagtttttgagattcaatgtgatgggaacccagattttaagaatagaagagcaaatggcacatttggtggaatcggtggaataaatctaacaagacttccactagtttcagcatcatctatgcaacatatagcagagttacattatgattcacatacttcttcagaaaaaccccacaaaaacaaacgtacaaatgaagctatgcatgcatcataaacaacatagggggtctattcatgacatgtatcctcagtgctgacaaaatttcagaataacctgcaaggagtttacaaaaattaagagcaacttcagagctactgattttaattatacatgagcgcgaaagggcctctatcgtaatagttaaggtttccgagtagcagctccgagacccggatttgatccaagggggcgaatttcgggcttggttaaaaaatccccacgctgtat

SEQ ID NO: 2980 - DNA, 1301 bp, Zea mays
  misc_feature (1)..(100): optimal_loci_49945_G1, chr1:290299720..290301020, Cluster 17
agacttgacgatagaattgatctatctgtttcacgaggaacaagtaattaactaaactagtccataccttatacctagtaaaaataatacatttattaattaatgaggattagtttattgtgatcgctactgacatcagtaaaaacgcctggaaggggaaggcatctgcgccggcaacatgcggcctagaaggctcacctagagcagagtccatcaatggaaagggggagggagggaggatcggtgccttcatggagaggagagtgacaggaaacggtgtggagggatcatgttgatgactgaaactggttgaaatatctaggtgtaggaatgttaacctaattttgatgggcttactgggctgagatgtgggctagtacatttttcctttctctttttctcttctttattgatatttttttctaaacactttctcagatatcagaaaaaaaaaactaattttttttagctgcgtctattgctgaccttagctgttggcaaggagccaagtacaagagtaaaaggctgtccaactttgtctaacacgtatgagggcctatattttcttagccaactattgagaacctttatacctaaagatttgtttggaagcacccaaattttcaatttttaagaatatggttttatgaaaactgaagcggtttcaaacataccagtttatatcctagtttatagaattctagaatttcaatttcttaaaaaaccaaaaagctagactctcctagctaaaaccggtttataaaaactgaggtggttccaaacagcgtgagccattttttttcataaaccagtttctagggtctatacttggcacatttgtcttcaacgtgcgcgccagtccactacactgtttcggtcatttggggacatccttttgttaatatcgtttgctcatcgggcattacattattttgtttcggttgcgatatatgaagtatttaccgaaaaaataatacgtataagaataaaggaaggggagaaagaaagaagagaaaaggtgtattttgagtgatctgcgcttgcgcatgagcaaaagggacggcttttctggtcgtcaggttggattccctctgttcgtcgcagcttgtgggtgaagcaaatgaaatgtacgctgtgtgcgccctcccccctgcgtgctaaagacgaatgtatatatatatatgctagtccaagggagtagcacctctgctccgctggtggtgctaattcattggtttgagtagtagtccaaacagccaaatttaatctgaaattaatgtacatagcgagtcactgaaagt

SEQ ID NO: 2981 - DNA, 1368 bp, Zea mays
  misc_feature (1)..(100): optimal_loci_50519_G1, chr1:293568834..293570201, Cluster 17
aacatattattttgctcctatcatgggtaaacgttttttttaaattgtaattatttttatgttggtaataaataatagtgccaacaaaaaatatgttactgtatatcaggtaaaagacttgaatttctctgttccacttttcgtatttttttgttcttctgggacacaatatgcaatgtgcgaagcatatcaacaagacacaccatatagcatgatagtctagaaaaaattaaacatacatgcaaatgaatacatattattgcatgtacaactttatatcaatgtttatgagcttgtggtcaagcacaatgaaactaagtacttcaaatagctaatgcaatacactttcaaaagatgtacgaacgagagtatgtttcatagtaggcgtaccggttcaactaaacacttaatacattatttgagactagatccatctttgaaagtatgttgatctgagggttcaagatgaatcataacgcaatactgaataactgaaatcaggcttgggttttggttcaatatatactcattatcaagaaaatttatatgcataattcaaacctatgaatcaagaaggtaaatagcataaacgttgaaatggctaaagcatgcaaagaagagttgaaaatataccagtgcaatcaaacactagataatcaccatccaaatagttctctagttgttcatcgaaaccaaacatacaagttgtcttcatggtacttctagtttttttaaggaaacataaagtggaagcataaaatcctagcaaaacactacaacatttcaacatttgtaataagctagctctattagttcttcaacaaatccaccctgcaacattctatctcattagtttacattcaatgattgcatgatcacaatttacaaggcttatgttctaatggtcaaacaaataaatggcgtcctttaaattaatgtgcaataaatgttgaaactcaaaatatcagtctcatagaacaaacatgtactaaaaaggttaagcaaatatagcttcagctcctaatagactaactttgcatccccaacccattagcaagcaatacaagatagtgtaataagctatggagtattggtgttatacatcacaagataggctaatacaatacaagacagttcaacacatgtgatatatagtctattaataagctatggaatattggtgttacacttgtgatgtatagtctattactttggtataaatttggacattatttaaatagttcgacatgatgacacatgaatatatgttcaaacaaaaatatgagtgtacttcaaggttgtagatatctttgaatagtccttgctccgaattcgacccaaatctgaagctgtactatgcgggtacta

SEQ ID NO: 2982 - DNA, 1164 bp, Zea mays
  misc_feature (1)..(100): optimal_loci_50537_G1, chr1:293587129..293588292, Cluster 17
tactacctaaatatgaggggacgttgctaccaatgataaataattagctagtaaacaattagttataatatgtttagagccttggctaataaatgtctaaaatatgatgaaataatctattttacccttcaacggtaaacaatagctaagagagaaagtaaagagactgacacgggatcatctttttctctttttatgatctatagcgcctattagtaaacattgggctaccaattgtgatagaaacaccaaggtgctgtttgattcacattttgtaacgtaaatagtaatggtaatgaaacacacttgagtaccgacggtaacaagtttgaatagtccggtatccatttctagtgtggtattcgattacggttggacttgaacaaacatcatttaacgttatcggttacctattacgttaccaacatgtgaaccaaacggtacacaagttcttccagcaagcttgtactaggagacgccaaaagaataggattttgttcatccataagtcatgattttataatgactaggtctattgatattgctacgagtaattttttttttctcaaatcaatttacctcctccgtcaccagacaagatttaaattttaaccatgatggcactatgacaaatgaattcactaactttatgccaagcatcgatgagtgcttgtagattttaaaaggattgagactaaggaggtgtttgggatggctctaggttccaactccgatgtatagttgtagtttataatatcactttaaatagttttaaaaatatttttaatctaaacaataaacaaaatgacttttataaatgtcttctaaaggcttacagctccagctccataattttctggagcatctaatgacctactccaccaaatatactaagtttactggagctgaagctgtcctgggcctaagttgccctggtccagatggtcttagtgttgctttctatcgtgttgcttgtacatggatcaagaatgatgtgcatgggttgatcattagtttctacacatttagtactttgcctaatcctcttaatgcaactacaattattctcattccaagaaaaagtcatgctatcttggtcattaattttagatccattagcctaacaaatataccttatcaaataatttccaaatcattaataaa

SEQ ID NO: 2983 - DNA, 1056 bp, Zea mays
  misc_feature (1)..(100): optimal_loci_50734_G1, chr1:294821796..294822851, Cluster 17
tattagaacactagggtgagcgtcatatagccagcaccggtgggatggaccacctaaccaacatggcctataggtggcgccgactccatagagttgaaaggacctagatagctagatggagtgaccgatcaataaaaatattacataaaccatacaatatcaggtagagccaacatatatgaacatggggaaacaattactttctatagttttgttctaggttatttcttttgtcaaacttggagtttgtgaaagatatgtatgaggaagacaaggtactcaataataaagggaaataatattaacactagctacagaatgagtagatgaagtaatatgaaccaacaagtaaatgtaattgcaatatagtttaaagtgcaaaccacgtgggcaagagatgaaacaataattatctgtaaggtttagattcttactagcatcctacgtccccgttgtggcgagtctaaactaggtgattcacgcactatctgacataacaaacagaacacataaagggcactacaagaatcaagctagggatacactcctacaagccattattccactatagttgatatttgtgaatctcccacaaggaatgagcacaagagtccctcgcaagaatgatcaagtcgacaacaaacaacaaagtcgctcaacgatatcatgcttccttcaagctatctaggtgacaacaaccaccaagattaacaagaatattgtagttcaatatgatcactagtgccactagatataacaactcaatgcaaattattagagatcactctcaaagtcactttggatgaaacactatcactagtggtgagtgcgagatgttttcttaggcttactaggttgtatttcaagttgggaaaccagaatatccacccccaaacctaaccaagctctatttataaggaatatatattgtgcacaagaccaccgttgtgcacatatgcacaaactcaatctaaacccttcgtttaatgatctttagttgacgtgaaaacatcttctgcactctcctcccctaacctagctacatatgtgcaaaaa

SEQ ID NO: 2984 - DNA, 1262 bp, Zea mays
  misc_feature (1)..(100): optimal_loci_51075_G1, chr1:296881316..296882577, Cluster 17
ttcgaaaattttacacgatatattaaacagcgtagggccggaccacattttctctcaccacttttcacgtcttctctcccttggcaattttaacatatgagttaacggacaaaacacattaacctcatgactcccgccgagcacagacgcaactgcaccagcctgaatcttcagatggacgacaaaatgataaaaaaaaacttggcttcgcccgggttcgaaccggagaccttcagtgtgttagactgacgtgataaccaactacaccacgaaaccatgtttgtgtttttgttgtaccttgtactgtaatatactatatagcacttcatgctgtgtgattacataacagaaggtgatcgcagtctataaattaaagactgcaagcctatcactatcaggccgattccatgcattatttcagatgctgcgttgtaagtgtacaaatccgtgggggcgtacagattgaggagagaaaaatgtaggcaggcacacactgtaaactagctagagtgcacttcagatcattttagcagcgtatacattgggaaccctcacctgctgcttgaaaagaccagcacacagtgcacacccggatgcctgaaaagttttctagttagtttcctcgtcacgtgtaagcatgaatccatccttcattctcaacctaaaacatctctatctgactattcttggatgaagggtgttttctatcgcgactaatgaagagttcctttcagaacagaagtactgttaaaaaaaatatcggaacagttgtgtgtgtgactgtcaaaccctctgagcggtacctcatcggacccaaatagtttcggaggtgtgtcggattggtctgacgacatgtggcgatctatacaacaataatgttttacctagggttttagctatagggtcataagaccctatgaatagtcgcctcatcggaccaaggtggatgggtctaacgagtgttgtgtgcagtgaccagaaagggtccagtggacgtcagatcatacgtccaagccaatgtgttgctccccacccccacgtatgggagacctttaatctcctctaacattttaattacttcatttctttatgataataaccttttttaagtaccgtaacttgagagcaaaaatgtgtagctaacatttattcataaagaaatgaagtaataacctttatgatttatttaaacttcaaaagctattgaaaaaatgtcaataattgaatcatagtatatggagagaaactgtatagggtgaatt

SEQ ID NO: 2985 - DNA, 1141 bp, Zea mays
  misc_feature (1)..(100): optimal_loci_51380_G1, chr1:298975361..298976501, Cluster 17
tttaaggctatagcaacagaaagaacggtaaagaaggacaatgttgatatgggaagagacagtaaaatgtgttttaaaatgattgaatatacctaaagatttagtattaaatatgagtgtattgaaaagagttattcatgtgcttgaatcttaaattgtggtttctattgggcttcaacttttaatacgcactaagttacgtaggactaaaagattctgttgtctgctgatagaaatatggaatagtaaccaaggttacgtcttaatgcacatggaaacgttggacccatcgaatcacgttggattattgtcctaaagccaaactaaagtgagaggcagatgatgcagcgagcatgcatgcggcgtgaactccacgttgtcttgatggacgtgtggtcaattattggcctaagccaagcttagtgaggaaattatggcctcactacttgggaagccgcctaatccatcactagtgcatgcgtacaaataatggaaagttgcatttgcgatggcaaaaagctagttatgcagcgcacaggcggcatcgaataacaagttgagtactctcacgcgtccacttatcccagggcgtcttcaatggcatatgcttatagatgtgtgatgacatgcatgtccatttttctttagattgtttttgtttcatgccattgtctttagagcatatacaacctcatttaatattagggtctctagtgttgttaattgaaaaaatatcagagacggtctattcgtgaaaagaccatatctacacgacttaccatatatattgtcttttaactatatttatgattcaaaagctcagagttgtattagttgtattatgtaagtcgtttaactatttcttttacttgtacttgaaaatcgggagtgaacgagtggggaccagaaataataatgttggcatgtttgtttgcactttctactaagcttttggacgtttcaagaaaccactaatcttttgggacttcggcctatgaaagttgctttatgtgttttggaagtataaaagcactagtctaaagatgagcaaaatctcaaataagtcaacttctatagttcataattcaatctatcttgaattcaatcaaagaagagtaccaatataaatataaatatatat

SEQ ID NO: 2986 - DNA, 1168 bp, Zea mays
  misc_feature (1)..(100): optimal_loci_51472_G1, chr1:299450614..299451781, Cluster 17
tatcgatctcagttttgcattaacttggtgagagagtataccatatgtgtacatctaaatgatatcaccctcatcaagctaccaattttgaccctcataatatgacgttagaaatagatatctaaatactacgtcacgtgcctctaagaactattttgtacttggtccctgcagtgctcctaatctttgtgactattcttgtgtccatacttgaattgaactatggagccaagatcattcatatgtttgcactatgactaattcgatgttatatgattcgtgcaagacaaatgttaatcacatagcacatatgcccatcaaatgccaaaacccaaatctaaaactagggcctatacatgttcaataggccatatttcccatagcctatcctctcatcaatggattcacacacaaatctgtattgcctcggaccttgccacttgccagggttagtgagtagcgagtcagtggagatatgccaccgtagaaagaggggatgggtgagccattcgaggacttcatataaagtagtggtttcacatagccaaccatttgccggttcttttaacttccttgtttaaaataatttatataacttttcttgcttgccacttgcatgttcaccacttatgtgagaaactttgtattttcttctgttcaaaaatgaattttgcctgctttgctaaatgcacaaagaaatcattttgtctcacctcttggtattagagatattatggatataggagacatcaaagctaggggatggcgtttgtacctttcttgtttaataataatttagctagctttcattgtatactgtttgcttgttcactgtttataggggcgaatccaggatccaatcaggcctcgggccagctttttaaatatactattctttcaatatattttggtctaaatacaacaaatacaaatagaaacatatggactaaacctcgagccatgggtcaggtgacccggggcttatattcgcccttgactgtttatgtaagaaactttttttgttaatagatgtattttatgtaccttgctaaatgcacaaagaaaacacttgccttgcctcttggcaatatcatgacgttggagatagggagctttagagagagggaatgtgagagccattggagggactccatggccctccttattt

SEQ ID NO: 2987 - DNA, 1129 bp, Zea mays
  misc_feature (1)..(100): optimal_loci_52571_G1, chr2:4289206..4290334, Cluster 17
ggattcatgttcctatggattttttcctgtctcgtgctttggttcaatcccgtagttcaattccataggaaagtaaaaaaaagagtgctttggttcaatcctgtagttcaattccataggaaagtaaaaaaagagctcagagctcatggaaaatttcctcgagcgaatggataaacagtgttgattcctttcctatggtgttaccaaagggcttcccatctagattcccgtgtttccagtttccaaaggatttaaggaatctaacacctcaattactatgtttccctatttctatgttttttaccatgtgttccaaatgggccctaagtctcgtggcaggtcaggaatttacgtttctcctgtgcggtgagattcaaatgcaactcaaccaaaaggtgaaagattattgagttgttgtgttctctcatttgtgctatgagagttagatataatagcagattcataggaagattaaaagatggagtaatcactataacataaacccattactttgtatgttatagatccattacactctatcaatctagccattaactcctccattaatcgacccaagtggcataatcacagacaatgtcatggtgcgccaagacaacctcgatgactttggcaacctaggatgcctccaacatcccaacttgtgtgagttctgcagtacaactcttagctatttctctgggttacttgcattcagagtttaaataccacttttggatctaataagacgataacataatgaactctctttatttcactacatgtttgtgtatggtcttgtgagtccgttttgaaataattgctgatgctacccactttaattgcttgtggccatggtatttcatctccttccctccaagggagtttaaatgcaaactattgcatgcatgctagagaaagcaatatatgagtatgtttggatccattaatatctaatagttaactcattagtagcttatgatcataattaactggttgattatagatgttgtttggatctaccaagttatgggaatgttaaaattgtctatagtgtttgtacattcattttatctagatatatgtgcacggaaggagaggaggaatgtttacgaacgtaaataggtttaat

SEQ ID NO: 2988 - DNA, 1219 bp, Zea mays
  misc_feature (1)..(100): optimal_loci_52707_G1, chr2:5076042..5077260, Cluster 17
aaaaactgagcatgtgacgttcacggctgcgctttacactatacggcgttgagcagcggagaccatacctgtggggagcgggcgggcggtagggcggccgacgggtcgtcgtagccgaggagaagaggacaaatttcgatatttaaccctcattttgtatgcctttctacgtttagcatctagctagcacatttttgaaagcttaactctagtcacggtaattgttttgatttaagggattccattctattcgtttttatctttccaaagtttcttctcactctacccatgccttgaaaaaaacactagaatgcccctccaccaaattggaagagatcacaatttacatgcctagggtaaaattcccaaagtctacaaattactgtaggtgttaagcctagggtcaattttccaaggtctgcaaattagatgtgggaaaaatataaacaaaaagttaaatatcgaaatttcgcgacaaaaaacaaggtggtttttttttacccctcgtccgtctgtcatgctcatgctaggctgctccggccagcatcaaggattcgagatcccctcgctccaccccggtggggtcatcgacgctagacaccactgcttaatgctgggaagagggaggaaaaggtgagaaggagacatgccctctttccatctcctagtagtggtgtgctgcctttgagtcaccttcgcttatcagctgaaccgatcgaggaatcaaaatcctaagatatagtacatagcgaagagtaccataaaaaatggggcatatgcttttttagagacaaaaaaaattagcaactagtatgatcagttaagaaaatgaatagtatacatgtttgtattaccttgattttttatgagatgaaaaaatgattgctgtatcccaaaataattacacttctaagtttgagattataagatcaatgctatcgagaagctacatacataactatattaaaaatataattattgtacttgaaaagaaagaaagtaaaaagagagagagagataaaagacaattaaagttaggttgtcttcatatatagatgtgtatttgttttgttacaaattttaaactcttcaaagtgcacttattgtggcacaaagtgagtataagtactgaagtttatataggattttgtattatcttgaacttattataagactaataaatgacggtacccattcagggatgcttctagacaactag

SEQ ID NO: 2989 - DNA, 1279 bp, Zea mays
  misc_feature (1)..(100): optimal_loci_54407_G1, chr2:14114529..14115807, Cluster 17
tttaaaacacatatactatgtcctagggccttaaagccatcaaagccaaattcatgtaggctctcctcacaacaagatggttacaaccacccattagctatatttctacactaagggcaataagagaatgttgatcatatgaattcatttgcattcgtatgtatagctaaaatacaatactttagcacttgaaatagaaagttgttaataagaaaaataatttggcaacacactgtaatataacgacccacaccaataatcaaaataagaagatgagggataaccaaacatactaggagatgaactccatgacatggggttaggtggagaatatggatgatgacatgaccaataatcttaatgatttagtccaaacatctaacttggcaactatttcttgaatctccttttctcctttcccacaccaaatccttttcttttagtttgtctaaactatgcttctacaacttgttttctttccactttggcaaaccaagtgagcatcttgattttatttctattttggatagcgacatgttttctttattttgggtactctcatcttttttctatttagatatgcagctagaataccaatagataatttccctacttctttgccatcaatagctagaactttcaataatgtaattagcttttcaatagttgcattcatatctgaatttttatccttgttaccatctttttctcacacgataaaattgctttaccactttcttcttagattgagatctagtatgattattatcgaactgatctttacaatatggtgatttctctaaatatctaggaggtgcatgctctatgtaatatatcttaaagtatggtagaatatatgcctcttgatcaaactagcaccaagataagcatgaatgaaaacctattggttgtggtccatataagaattagctgctgaaaagaagaatgtgttgctactatgtgagatttgttcctttgccaattccactcttgagacttgtgttttggaaacaatcttgatgattggacctgtgagcaccaagtgaaggtcatacatctagatgttgtcaagatgcattcaaggatccttatatatgaggttactatggggcctaactactaggaccatcgcttctgaggccctaataccgtgaggacctgccctagctccagaatcatgcctctaatactattgtgagacttataagatcatatctcgtaacacaaattggtagacacagtagaacaaagagattatactttcgaggctctgagagga

SEQ ID NO: 2990 - DNA, 1408 bp, Zea mays
  misc_feature (1)..(100): optimal_loci_60380_G1, chr2:48407050..48408457, Cluster 17
catatagggagcgagctgccgtgggaagcggttcgggaatcttgaaggtgatcggacggccgagctcagtcgaagatggacgagggtgttttggtaatttgagtgttgtcacggcgttagtgccttccagacggttcggcagttgatcccagcgggtgggccgggcactttctttcctctcggcctgcgggtttgaccaaactgcccctccagtgcctttccaagtccgcgtcagtgtgtccggtgctgtctgcttcgtgatttttgttttttttttccttcttaggaggaacgtgtggttcctctccacacggaggctactaggctagcaactagcatatagtgcggcacaaggaattcatttaggattacgtttgtaattaacttaatcgattttgctcatatgtatgtgtgcttctgcgcctgtaactctgtctgaataaaaggtttgaagaacaatgaattttaagaaatgtgctcagtgctacactctttattatgagatgttttgatatttttagatatatttctctaactgtatatcgagatatgatgtatatctaagtatataaaaaatctgtgtctaaaaagataaaaactattttataatttagaatggatagaggactaatataacttgaaaaaaacagtgccaagcaaaccaaaagttgatatacatgcaggcgacaagtactccctcaaccttaaaaaagagtacaattctatatctatatacataatagctatacatataatgtacatatataatattaaagcgtaatttatcattcatctattctggctcttcgctactaattatatgaaacaaaaactatctttattcgagcgtctacgatccagagcggccagcaaggctcatcgcgaagtgcattaaaacggatttttatttatatcacgggaaacactacgtttttcatggcagtggccgaacaaaaaaatagattaaaggaagagctactaaaacaaagcacgtttagcgaaggaggcagtggacacagcacctgtcttgggacagtgggctgagagcagggacggggtggtaaatttagaggtcttgtactaaaattcaaaagaggtcttattttatagaaaaatataatcaaaattatataatttatgtattctgaattgtaaaaggtttactagataacacttataactctttatattaaatctatctgtttttaagaaattatattgtaatagaatacataaataaacaaatgtattgataaatgtgtttgaagagcaacaatctagttgttaattgagttcagcttagatgatataatgttagtctgttcactgataaatattgtttaggcttactgttgagctaagaagttttttaggcccctcagaattttgggccatgtgcaatcgcact

SEQ ID NO: 2991 - DNA, 1171 bp, Zea mays
  misc_feature (1)..(100): optimal_loci_62343_G1, chr2:58736991..58738161, Cluster 17
gttgctgagctgggcccacaaaactgctgccttcatatccaacttccctaggtacccctagtacatatccttcacagctcaaaactggctcatggtctaaataattcactagaaagccatgtaaaccttggaaaaactatttcggaagatgaatgaatattgacccgacattcactagatgtgtcaggtgttgtgtccgatgattgcaataaacatctgacacaattaatgtctactttatagctattatcgatataaatgtttgaagtggcactagatgcgtctagtgcaaggatcgattgtgcactagacatgatcggtgcccctaatttctatgtgtcaagggctatcagttagattctcttgttggtttataaatagacccctttgttggccttagctggcatctctagactccataaaatttagaacacctcttgaggctagagaaacacactccacccacttgcatatagtttttacatattgtggtactagttgagtggattgggatgattaaactcttattactattggtgattgttatcatctagaggtcctaaagttcgtgggattgttgagcaaccattaaagattattgccaactatgatcatcactgtgatgtgttcttgtgcttgttctttgtagaagattcacaatgagcaactataatggaattgtggcatgttagagtgttttactagagtgatccttatgatgtttttattgtgggattgatgtgtgatgccaattagcgtgtaaatcaactaacttaggctcgtcacaataaagacgtaggttgcccgcaagcaaccggacctcgagaatatattttatgtcatcttttgccctgtatgatttgcacttcatacatattctagaaagtacatttgtattttatttgtctatttagactttgtgtagattctaattgatctttatctctggctagcaagtagcttgttttatttaatacaatcttttatcaagttatttgattgattagaagctagcataaagttatttagaactggagcaaatatacacttctacatccattaacttagctctagtaataatattgagttttgtagaataatttatagatattcaacctcatcctatcatctaggttttaacactggtgcacaccgtttaggccatcttgag

SEQ ID NO: 2992 - DNA, 1000 bp, Zea mays
  misc_feature (1)..(100): optimal_loci_62420_G1, chr2:59049990..59050989, Cluster 17
  modified_base (610)..(610): a, c, g, or t
  misc_feature (610)..(709): n is a, c, g, or t
  modified_base (611)..(611): a, c, g, or t
  modified_base (612)..(612): a, c, g, or t
  modified_base (613)..(613): a, c, g, or t
  modified_base (614)..(614): a, c, g, or t
  modified_base (615)..(615): a, c, g, or t
  modified_base (616)..(616): a, c, g, or t
  modified_base (617)..(617): a, c, g, or t
  modified_base (618)..(618): a, c, g, or t
  modified_base (619)..(619): a, c, g, or t
  modified_base (620)..(620): a, c, g, or t
  modified_base (621)..(621): a, c, g, or t
  modified_base (622)..(622): a, c, g, or t
  modified_base (623)..(623): a, c, g, or t
  modified_base (624)..(624): a, c, g, or t
  modified_base (625)..(625): a, c, g, or t
  modified_base (626)..(626): a, c, g, or t
  modified_base (627)..(627): a, c, g, or t
  modified_base (628)..(628): a, c, g, or t
  modified_base (629)..(629): a, c, g, or t
  modified_base (630)..(630): a, c, g, or t
  modified_base (631)..(631): a, c, g, or t
  modified_base (632)..(632): a, c, g, or t
  modified_base (633)..(633): a, c, g, or t
  modified_base (634)..(634): a, c, g, or t
  modified_base (635)..(635): a, c, g, or t
  modified_base (636)..(636): a, c, g, or t
  modified_base (637)..(637): a, c, g, or t
  modified_base (638)..(638): a, c, g, or t
  modified_base (639)..(639): a, c, g, or t
  modified_base (640)..(640): a, c, g, or t
  modified_base (641)..(641): a, c, g, or t
  modified_base (642)..(642): a, c, g, or t
  modified_base (643)..(643): a, c, g, or t
  modified_base (644)..(644): a, c, g, or t
  modified_base (645)..(645): a, c, g, or t
  modified_base (646)..(646): a, c, g, or t
  modified_base (647)..(647): a, c, g, or t
  modified_base (648)..(648): a, c, g, or t
  modified_base (649)..(649): a, c, g, or t
  modified_base (650)..(650): a, c, g, or t
  modified_base (651)..(651): a, c, g, or t
  modified_base (652)..(652): a, c, g, or t
  modified_base (653)..(653): a, c, g, or t
  modified_base (654)..(654): a, c, g, or t
  modified_base (655)..(655): a, c, g, or t
  modified_base (656)..(656): a, c, g, or t
  modified_base (657)..(657): a, c, g, or t
  modified_base (658)..(658): a, c, g, or t
  modified_base (659)..(659): a, c, g, or t
  modified_base (660)..(660): a, c, g, or t
  modified_base (661)..(661): a, c, g, or t
  modified_base (662)..(662): a, c, g, or t
  modified_base (663)..(663): a, c, g, or t
  modified_base (664)..(664): a, c, g, or t
  modified_base (665)..(665): a, c, g, or t
  modified_base (666)..(666): a, c, g, or t
  modified_base (667)..(667): a, c, g, or t
  modified_base (668)..(668): a, c, g, or t
  modified_base (669)..(669): a, c, g, or t
  modified_base (670)..(670): a, c, g, or t
  modified_base (671)..(671): a, c, g, or t
  modified_base (672)..(672): a, c, g, or t
  modified_base (673)..(673): a, c, g, or t
  modified_base (674)..(674): a, c, g, or t
  modified_base (675)..(675): a, c, g, or t
  modified_base (676)..(676): a, c, g, or t
  modified_base (677)..(677): a, c, g, or t
  modified_base (678)..(678): a, c, g, or t
  modified_base (679)..(679): a, c, g, or t
  modified_base (680)..(680): a, c, g, or t
  modified_base (681)..(681): a, c, g, or t
  modified_base (682)..(682): a, c, g, or t
  modified_base (683)..(683): a, c, g, or t
  modified_base (684)..(684): a, c, g, or t
  modified_base (685)..(685): a, c, g, or t
  modified_base (686)..(686): a, c, g, or t
  modified_base (687)..(687): a, c, g, or t
  modified_base (688)..(688): a, c, g, or t
  modified_base (689)..(689): a, c, g, or t
  modified_base (690)..(690): a, c, g, or t
  modified_base (691)..(691): a, c, g, or t
  modified_base (692)..(692): a, c, g, or t
  modified_base (693)..(693): a, c, g, or t
  modified_base (694)..(694): a, c, g, or t
  modified_base (695)..(695): a, c, g, or t
  modified_base (696)..(696): a, c, g, or t
  modified_base (697)..(697): a, c, g, or t
  modified_base (698)..(698): a, c, g, or t
  modified_base (699)..(699): a, c, g, or t
  modified_base (700)..(700): a, c, g, or t
  modified_base (701)..(701): a, c, g, or t
  modified_base (702)..(702): a, c, g, or t
  modified_base (703)..(703): a, c, g, or t
  modified_base (704)..(704): a, c, g, or t
  modified_base (705)..(705): a, c, g, or t
  modified_base (706)..(706): a, c, g, or t
  modified_base (707)..(707): a, c, g, or t
  modified_base (708)..(708): a, c, g, or t
  modified_base (709)..(709): a, c, g, or t
tctggctctagagaaacgctcatttcttgcgtacttgagagctagacctagagataatctttgcatttgctgagctagactacataggctggtcaagcaaccaaacacgtgaatgttgtatcccatgattcgggtcactccatttgcaggcaacaagcacacctgtcatgactcatgaaatgagcttagacggtgtaaaaagtaagatttggtgaatgagaatcatgtttgttactactacataagctcattttttatgatgaaatcaaagtctattatttaccttgcatgaagaaccatgcgtccatgcgtgcaaactacctagcccttttcataagaacattgatttccatctcaacaaagaaagaactcaaaataaatgaaagcattgcttgttgtcctattactctttttgtcagccttgtggagctttggaaaggagagaatttgaatagagtaattctcagaaactcttattggatgagagagagagtcaatatagacactaacatgcttgctaattgtttatttatataggttcaaatgatgcaatataaacttgttaacttattcctatgattagccgatccacatataattattgtgctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatagacactaacatgctggctaggtgtttattatatagttcaaaagatgcaaatataaactggacaatttattgaaagtgatttaggacgatcaacatacaagttaagggctttccaaggaatttttgaagatttgtcaaggttgtacaaaagtccaaaacacaagacaagataagcttaagcaaaaaaactcgaagaaatattttaaaacactccaaaattcaatatggtatacggtggtgtaccgaatggcacaccagatacaacttgcagagaaggctaaaacttg

SEQ ID NO: 2993 - DNA, 1403 bp, Zea mays
  misc_feature (1)..(100): optimal_loci_6456_G1, chr1:33260025..33261427, Cluster 17
ctactcagtcttatcctacgttgcctcatgcaggagcacaccaccagctgggtcatgtggtgccactctaacagacctaacttcatcccatgattcttttagagtatgcaatgtcctagagacatcacaacaaatgtctagctagtcactccttttggaatgaacgatctgacgcaaatcactgtcacaacttcattttagtagcttgacaaggcaacctccaagaatggaggttcatctcaatagttgtcatctcggcgagctcgtcgatgcctcgattcaaatagtgtctctatttttttacatatcagtattagatttgttctaagttaaacatttattttttaaaaaagctatatttatttagatttacaattagaaatattttcataatatattattcatatgttgtggaagtataagaattatttagataaatggctaatgatagtaatattcaactttgaacaaagttaacatgccatgttaaaaagaacatgagtactctctgtattaaaaaaatataactctgagtaaatttttttttaactttcatcatctctatagaaaaagattacacgttaaacaagtatcactatattgatcataaaatattttttatagtaatttttgttaaaggtgtcaacatttatattttttgactataaaattggtcaaacttccgaaagttttaaaagtctcaaacctttgtttttacggagagtaagagaaaagggtcgggcactcattgcaatgctgaaaattacaaccaagcccactcagtaaactggtcaggccagattatgtcaggtttttgtggatagagcagatcagacagccacagcctacggggagacgaacgcctttcatgtttcagcccgttcatcctccataaagatggttcaacggtattcttctcggcccaagcagccaactcgctcggggctccaatcgccgcggacgcacggctggccgctgcgccggcaacggacgtccaccgacgcccgattttccgtcctctccacacgaagccgctgcgcgcctgtggtccgtcgaccacagccaccagcaacggcctgccggcggtgcctcccttagcattgcggcatacgctccacgcgcatgatccgccaacaactgccacagaccgagccggtaaaatttgatgccctcatataaatattaaaattaggcctattctagtgaaaaataaaattttgttaatatatatttgatattttgtagcaatagcgtataatacaacatgataataagtaaacataccttgaaacgaactcttcaattatatctccatattgaatcttctccaaaagtatactcttcaactaaatgaactcttcaattatatctctatattgtaagggagataaaatatagataat

SEQ ID NO: 2994 - DNA, 1001 bp, Zea mays
  misc_feature (1)..(100): optimal_loci_64718_G1, chr2:73282461..73283461, Cluster 17
ccaaagagctattaaatagaattgttctttcctatagtaccctaataaataggtttagatttcataaaaaacacaagaggatctttgcctagttggttgcaatgctggttgcaagcatcaaattgcgagctcgtaggattgaatctcacgaaacctttcttgtgatcgaaaaacaaagcatttgagagtaattagccatgtgtgggatcatctagatcagtggtatactagtccaaaatgagctctaaatgcttaaaacatcaagtatttgcaagcatagtgaaaaacccttaaacatcaagtatttgaagactggagggagtatgaagcgacataagttgcctttggcttcaaaaaggttatagttactaaagaggctattacgaaaaccacagccgcctatcaaatcgaaggttgggatttcatatgtgccgaaggtaaattcaacactggatctttataagacaaagagccttgttttaaaaaaatgctttaaaatgtttcttttttcacaggaaaaagaagacatatggggaggaggtggtggaaatgtccatccatgacgaagtcccactagctagcatgggacctaagctgaatccatttactgaaaaaatatcgaaagggcaaaaggatggcttccgtttttagtgtgatctttggtgctacatctgctgaagatacatctgtgattaagcacaaagctgattctctaaagaaggagacaaccgaaggtgtgctggctgtggtgttaccaaagcaggccaaaacccacgatattacccccaaagagaaaattattcctgaaaatgtcgacagtgagaaaaataaaaaagttttgaagatggtagagaaggaaaaggagtactttcaaaaggaaacacatatgcgagaaggcgagcaagtgaccaggccacctgaatatgttattcgccacgtcgctggtaaggagctcatagaagaacagattaccaaattgcaaagttttgtcaaaatgctaa

SEQ ID NO: 2995 - DNA, 1046 bp, Zea mays
  misc_feature (1)..(100): optimal_loci_77444_G1, chr2:155972136..155973181, Cluster 17
attgccgagtaagcacaagtggttagggttggggctaacccgcaccttggtaagcatgagcgctattcccaacaattttcaaattacccaatatttcaatagtggctacactttaaacttgagatgtggacacaatagaatagtgtttcatgaatttaagtagggcccctcatgtttgaaaaaagaggtgttttggattattttttttggcttcttgttttgttttttaaataattggggtaattcatccgagaagttctcaagatttcctctctatcacttagtggattaagccgctcatgcaattttggtttctttttcctcacatctatcctatttaggcctttatggagctttagatagagataaatatgaaacacttcttatcgtgtctatattttcaaagcaaaccaagtgccaaaaagagaagtttttttatacaagtagcatggccaagtgcttgtgtatagtatgaatgcccccaaggtgacttttgccaacctctttttattttggatgacatatagttcttttttttctccctctttcttttttcttttttagaataaactcacatgccatcatttattttgtacatactaggtacgtgctcgtgcgttgtcacgaaagttaaaaattagtataaaacacagatacagaacaacaaacatcactctgatatgcaaaatccgtgtggaaaaatatcaccctaacattatgttgcatagaatgtgaccaagtaaaagcaaaatgtaagacttcaaacacaacccgatcgcgtaaggtcgtcaataataaataaataaaacattgactgaagatttctgccacctgtactttaagagttgcgttaaactaaaccacatttaatccaacgagttgcaaaagaaattacagttcttcagatcatcatctggcgaatgaagtttgcagagcaaacattaactttttttgttcataccaataaatgcattgcttacaaaattcctgctgccgctggagctacacctttgtacaatgacatcagagtcactgagacgccgcgc

SEQ ID NO: 2996 - DNA, 1294 bp, Zea mays
  misc_feature (1)..(100): optimal_loci_8193_G1, chr1:42865330..42866623, Cluster 17
ctagaccctaggcgctaggggtttgacctttcatcttatatgagattgagaaccttaaggatcctagacgactaagtgcctcagtgctcaaagagccttagacacataattctttcatgaaaccccaagccatgaggccctggggatctagaccattcttatgaatgggcttcacggtaggagccccggataaaagttagttggagacattctgggggcaccaaggacctcgggtcttaaaccattattgcgaaggggtcacgtaagtgccgaagtgcctagacttaggaatgctctagggcctcaggccctttattggttcttaatgagacctggtgttgatgtcttattcctttggagtgctttgtgatcaaattgcttagagggttaagaccctaccccagatggagctaggataggtcttagcacatgcccccaaagcggtggtcttagtaactgaacccttgataatctattataataggatttttgaatacgtcttaccaacgtccggggataggaccttctttagtatggttctttgattcaccatgaaaaaagacacatgctagagcgatttgtgatgcagatgactgaaaatgtgtctttgattcatcgacctgtgaaatactttatttgtgagatgagtagagccttgcctcttgccctcttagagaccagattatagtgcttgaatgaaatgctactcctcctgaaacttgaattggagatgcttggtgatgttcagtcaaaggacgagtgtttttgacgtgtattctttttatttctttataaaaaactttcttaaataataagtttctcattctaaaatgttatgacattactttgaccacgctgtatgccatattatccattggcattgcaggaacgcacaaggacgtgtggatacttagcaagcacgtttcgtctgaattgacctctttgaagtcttgaagaggatgtacgtccgtaattcctaacaagtccttgtcagttgtcacctactatcgcaaggagcgcccgtcactttcagaagaaaccaagagttttgccgtcacggttttctaaaagttttagaaaagtttgtaacttcatgaagtttaaaagtttgccgtcacggttttctgaatctccttcttgtcttctaaaagtttgcaacttcaactttacatttttttaaactcctaatggcccgtttcatcaagttcactaaattttatgaagataaagtaatcctaaacagggttagcttgcctactttttcaagaagccaagattaacagaagctgagatt

SEQ ID NO: 2997 - DNA, 1318 bp, Zea mays
  misc_feature (1)..(100): optimal_loci_82425_G1, chr2:184116683..184118000, Cluster 17
tgtgctcacttgtatatttttacattcattagttatattgtcatgttgtatctctcattttatacaaatatttaacttacaatgtgtaggttcagattcacgtgctaatgttgatgaagttattagaggcgggaaaggaccaaagcgtctctaattagatacttttatatttttttatcaagtttattgtatttttagatgctgaattgaagtaaatactatcttagtctatgtttgtggtatattttgttttagcattatttttttggccgcacaatatattagggcggtttaaagtaaccttcaagttttatagagtgcgccggggcgttaattttatagagctccgccactgagcacaactactcgagagtgcaagagtacactggattgataagataataactattatgcagtggtttagaaatttagctatttttatacttattttaatctaaaaaactataacaaatttgcggcaataaatgtgtgcaagtttaaaatattaataccaacagtagatacatgttcactagtcgatgtattgagttatttgtagtcgtggatcacactttatacaaaaagatattcgtagtatagtgccgtgtacgtccaccaataaaaagatgaagtatatcagtggtgagcggtcaagttagacgctcctaaaaacgtgatcatttagcatacccaaacaggtgtcgcagtcacgagcttcgttctagaggtctatccttccaatcctacatgtgcgtagaggatctgaactattggagcaactcaatacaggagaaacacactggtcaaaaatgaacctggataaggagtaaatcatcggaggagttgtaggaagaaatagaaactcccacatgattactccgtgaaaccaaccacacactcaattaacataatatctccactaatcggtcatgaattagcctaaatggtaaaatcaagcccaacctgcgccacatcatatcgttgagcgacttataggatttaggtggatatagggaggataaatagcctataaaaagttttacaaacttaaaaatattggtagagcaaagttgattagtattaaaagtgaagcggaagtatatacatgctctagctctagttgttttatgcaagtcacataaacaatactagtagcttgatctttagtacataatgaatgcagcaagctatttactagccagagatatcagacaataataattgctaagtgtaatctacaaaatgctagttgagcaagaattgtacaataagtagtatatataaatgtgagagtgaggagtgtaaaccacatggggta

SEQ ID NO: 2998 - DNA, 1091 bp, Zea mays
  misc_feature (1)..(100): optimal_loci_87177_G1, chr2:211472836..211473926, Cluster 17
ttctagcgtcgaaccactgtaagcatgtgtatatttgtcttacttcaatcactagcactagtttgtaaactgctagtggattatagatatgtgaaatatattgttgtttttttattattgacggaatcaatttgtttaccactaaattgctattatttccaacatagaaaatgttgtaacgagagtttcaagtacaaaaggtgcaacgtttgacactcttcatgtgcagcataacgaagtccctaccggccggctaccgtaccagatgagcatgtacatgcaccagagtacacatcagagatgtctcatggacgtactatttagaattttaatgtatttattactttgatttgacaaatgactctcggtttgctcctagttcgtccaacaataattcacggttctctgtgtttcgcagcggcaagtatgagcttcacatttttcctttttaagtatcatatgaaaacctttttttacagtataattttttttcgaagttccacaactttcttaattacctcactcacaactaagaaattttatatccgtttggatatagatattggagtgtggaattgagaattggaattagttttctaaaattctgttttttggttgcacatgaaattaagatttaaaatcgaagaccaaattctctaaaattagactataactagaaacactatctccgaatacagagcattcacttctctgtattgtatggaattagaccgtacaattacaaaatctaattcagtaacatccaaacagtagaactgaaattacatcttatttcaatatcatgatagatttggtattgaacccaattcaattatccaaacggagcattacttattttttggacgagatttactcgacttttaagaaagcaagtcacagagtttaacaaccataatcctacgcaacagtggggttaccagtttacaagaggaaaacaaaacatcctgactgtcagcaataactggctcgaccaacagagcaaaatatcacccagattttgaaatacagccatattgatccgacactgcatcatcacgcctcggcttgaatttctgcagccacatcttcgt

SEQ ID NO: 2999 - DNA, 1086 bp, Zea mays
  misc_feature (1)..(100): optimal_loci_8776_G1, chr1:46238201..46239286, Cluster 17
atgctccattccgcagtaaccgaacggccccttaatatgttccaaatcactaattatatggatttcttaatatgtttcaaaccactaattatatggattctgtgttatgttttcatctaccattacaactatcggactacctccaacaggaggggggaggggggaggggggagggttatttttacaaaattagttggttagtttgtttttatgtcatgaagcgatatgaaaaatgaagtagtctctatttttttaaaaatgaactggtatatttctaattaaaaaaagaaaaccttgaaccatatgcatgaacgatgacagacacaaaaggaggttctggcgttctctttccagccatgagcccaccatgattgtgcgtgcagcatacaggacaacattttggaaggctacactttcgtataaatgaaggtgatgccctcgtcgtaaacataagagtaaaatagtgtaagcaggctaaatgttttgccacatcaaatttttgcgaaacaagagaatgataagataaagagaagtatgatgttaattatcagtcgactaagagttgactgtagcacatattccaaaacaagcaatgagagtatatgtggacccagtaataattattcgatattcttgcagccaacaaaatagccaatctattttatgcagtgactatatagttaactccgtcggctggctaaactattagccttgctctaagataaaaactagattttggcgacattactatttatttctcggtactaagcggctttatgctctatctatctctaacgctggacggtgcgcggggaaagcaatgtctccaaaatgactatgctagagcgatctttattactataagaaatgatgattttttttcataacatttgatatagatttaggccgagggattgtttgtttggaagcaagaaaattagaggagattgagaatgatgttacttgttagtcaaaattgaaaattaaggagattttaaccctcataattctctgcaatccttttgctcccaaacataccattgtataaatatgatgggtttttttgttgctacgtgtagtttatca

SEQ ID NO: 3000 - DNA, 1206 bp, Zea mays
  misc_feature (1)..(100): optimal_loci_95324_G1, chr3:16984284..16985489, Cluster 17
tgctttgaacttctataaagacgtttttgctgaagaactaagtcctgggattaagctatttggaaggagctaggataaggtcagggaggaggaaaacctgatgcttgttgctccttataatgaggtggagattagagatgccatctttagggtatatttggcaactttattttccaaaaccacaatttataatatcatggtttaatatatgccatgacaactatgatatttcaattcaacacttgtttagagacataatattttaggtgtagtgtagaataagagaagactgtagctgcatgcaacctaaaaatactgtgatattaagaaaaccatggtttaaaatacatagtccttgtatgggctttcaaacgcctttggtctaaaataacatggtatattaaaataacacgatattaccttggaactaagaaaataccgtgttcccaaacagggcccaaggaatcataaaagtcgatgtgtgtgtgtgtgtgggggggggggggggggggggtttgtctctttgggtaaccattggggatccaactgtgatataagcagttagtcatggggggaccgggggggtgcgtgtatgcattcttagtttaacggggaaagacaaagggacatgcttgaggctggcagagggggaccccctcgcctctctttcatttgggatgtattaaaggatgatagagaaagcagctggcgctggttcagttaaatgtcctgcactatcttaattttctagtgctcacattcctcatgtgggtgaaccctcgaacaaattctttttttggtttgaacaacttcggggcatgagggcgtgagcttccataagagcgaatgcatgcctatgaacctagaagacaattctatacttgagatttaccatagctttcactgtcctataggttcttttcctattaaatatctgggagtttctttatatatcttttgttaaattgtatagagaagacatccaacctttaagctttttaggagaatggcagggtattgtctgtagctgctacagctacgctcataaagacttgcttaactagcattcctatttatattttatctttcctgaaatttccaaagtgggatattaagcttttgactcagatggccgattatctttgcaacgagtctgagggtaaaaacaaatatcatttaggtaatttggaaaatgtttctatgtac

SEQ ID NO: 3001 - DNA, 1119 bp, Zea mays
  misc_feature (1)..(100): optimal_loci_95360_G1, chr3:17164338..17165456, Cluster 17
tgtcacgcctggttttaaggagacaactggttgcgaaccatatatgtgccctagatcagtttcacacacacacaacaacatcatcattggaagaatcatcacacgatacttaaagcatatgataaattatcttagaccaaattcgtagcagaaatgagtagtcaccacgaataacatttataattgtaaaactagtaaccccacatgcatctaactatggctcgcccgcctagtactcatcgcacacttggaactctaccatgtactctcatattctcctactcaattgcaatggatataacatagttgtcgtagaaatagcaaaggtgaatacttgtcatactccacaagtgatagtaaagcaggtgcttcgcctttcaagctagaatacacatcgtgcggcaattagtccaaatagcactctacaagccataggagggaagaccgagccacatattaggttgaggcacaagcatacttagtgtcgccttgatacctgggctttttggagaccaatttatgaggcgtcagattcattttttactaaaaaactacataaaaaagcttaatatttttacctctaattcattttttatcttataaggctaattttttccctagaaataaaagatacttttactgaactactacaatttttgttgatttcattaagcacgttaactaatctttcttctaattactaactaaattaattatatattttttctaaaacacttagaaaacaataataaaacaatctccattttttacacataccttcttttagctaaactatcttatacatatattttttagaaattttctgagaactttaaacctaaacctataaaaagttctgagaaatattctgaaaatatacgtttatgttagtttagctaagaggtctatgtaaaaattgtagatcattttattatcatttataagacatttttaaataaaaatataaaattaatttagttagtaattagaagaaagaacacttaacttgattactaaaatcaacaaaaaattaatagtttaatacgaatgtttttagctctagtaataattttagactcagaagataagaaataaatcaggaacaaaaatattaagctc

SEQ ID NO: 3002 - DNA, 1336 bp, Zea mays
  misc_feature (1)..(100): optimal_loci_95784_G1, chr3:19469228..19470563, Cluster 17
tcgtcgatcggcctactacagacacacaccagcttttgtattttttacagactaccatgcacgcatacacgaccaaacatcaaacatggggtttaattcaaataccataataagcaaaaataagtaaaacaataaaataaaataatatatagctagttcaaaaaaaaatataataccgcataaatcaaacaaagtccattagcttttaaaaaacaataaaaggacaaagttcttatcgcaaatcgtgaccacggttccattcgagaactggtttctactgtaccacatgatattcctgcactggctgcaagatggacccatgcggtgcaatagaaaaccggttcttcgatggaggcgaaatgaagtttcgtggttggtggtatactacacttcaaattcatatctagacaaaaaaatggatctgtataaattaaacgtgggcgaatatgactgaaagaatggaaggtggatgctgtgggcgacagaagggaaggacccactctatatttacaaggtgcgagttctggatttttttcttcattttttttagaattttttcaaattccatcgctgcaaattgaatgggtcggctgacacaggtgcaaattaacacagttaagtttaacggcctatacacgcaccttagtaagaatttgtaaaaatgtggatgagacaaggtgagggaccgctaatggaatccgctaaagggtatagcgcaaactgcaggttagtttatttatttattttttcttccgctggaaatataatacttggcttttgctgcaatttggcgagcacatgccgttcgtagctatgaatatttgaccactgactggaccgatggtcatggccgaacagaaggaacgcgtacgtggacgccgccatgctcagtcactcctcgcatgcacgctctcgaacaatacaatgcaagttgcaaaaagaatggcgcacgcacccaccagctggacgaagaagagaggaaagaagaacgcaacaaacgcctgtgacgacaagggaaaaaaaatcctgccgttttcgttcgtacgtatcgtcgtcccaacttgctgatgagcaggcaagtggtgatgagccagttgcactgacgacactactgtggcaaatgctgcagctagctagctgttgcagacacttgcgttgcattggcttgcagttcatcaggcgcactgcttaattagctgatgagtagtgtcatatgaacaatttgctacacataaacagagaacgtagcaggggtagcagctgcatgtgcttatatatatacacgcgcgtcgtagagctatgcgtgtttatatacatgtatactcgcctgctacct

SEQ ID NO: 3003 - DNA, 1189 bp, Zea mays
  misc_feature (1)..(100): optimal_loci_98324_G1, chr3:33756614..33757802, Cluster 17
tagtaaattataaaggtcccaacgctggaggaacatgttcagccgcagcccgaagaggagggccggcgagccgacgctcccgcagactgcagtggtcggcctcctcttctccacggcgtcctccctctgtccccttctccggcaccagctagcccggcgtccccacagcacagctgcacagggcggtgctggagagcggagcccacacgcggcacgccactgtctcccgccggaaaaactgaaccggtttattttgcttcaagtagggaacgataggttaagctctagagcagagacacctaaacattctgttcatcaatgattttataaaggtttaaaacaaatcggtcccgtagctcagtcggtcagagcgttggtcttatgagccgaaggtcgcgggttcaaaccccgccgggaccataatccaattataatttattttttgtctactttttttattaaatctattttttgagaccaaaattaatttattatctactttttgtctgcctttttttgtccactctaaatttgatttatttctctgtctttatttaaatctatttttttccagaccaaaattaatttattatctactttttgtctgccattttctgtccactctaaatttgatttatttctccgtctttattttatcaaccaattctaaatttaaaattgttatgtggtctttttttaacgtaaattgttatgtggtctgtcctgtctaaatttgttttgttgtctgtctctttatttccagtcacaagctccgctacgtccgctcacaagctaggctaaatttgttgtgtatgttttttttcctgtccactcacaagctgcgctaaatttgttgtgcatgttattgttattattttctttggtctatcttttttcgtctgtccactcacaagcgagctgcgctgaatctgttgtgcatcctttttagctgcgctaaatctgttgtgtatcctttttagcctatgagcccacaagataatctagccgagtcaaagctaacacaccctttcttttgtctttgtactcaaggtatagtagtcaagctaagactcgttttttggggaaataccaatggtagatgcaacctagataagggatgaaaaatagatgtaaactggtaggaaatttcttctcctttgttttctatgaaatttcaacccatgtgacc

SEQ ID NO: 3004 - DNA, 1085 bp, Zea mays
  misc_feature (1)..(100): optimal_loci_185454_G1, chr5:80270170..80271254, Cluster 18
agatttctatgtttgttatcattcagtgacaagggtaggagttttcttatggttgggggaatgataaacatgttgacacatgtgcacggaaaatcagctgttgtaacaattttagtcacaaatggtaatactatcaaagcacttcacccatcagtacatacatttatctaaaactactgcgtgaaactatcaatgtattttttgcattctttgcaaagtttacaacacggtatagcctgcaaagaacagtggatggtgatgttcctggacaagagacaacccagcgaggttgcacacagtcctataatattcttgaacaaacatttgcaaacaagatggtgatgttcctcccaatactcttaatattctaataagaagaattttttactctatgacagtcctaatggcacatacagtacatgttttaacaccatacataaattagatttacagacgtggtcatagcactgagcatacagcgagtgactgaggttagaaagacactgaaaatacaatgactcacatatatatcatgagctcctggtatgacatgatgagctagcaactgaaggagcagtaggacagggagagacgaacggctgtccggctctagcagaaacaatggccggacagtgaatagcaattattcaaacggttgttgctgctgctgcatggtccatgtgtgctagatggatgatggtgaaatagcatcatctgtttggaatgaactatgtgatcgagatcactgaataaaatggactgacaaacgcttagaaacctaattgctgtctttaaaataagagagtaaagaggtgaccaaactttgtctcaaaaaagccattatgtgtagaagtaaaaaagggaatatattgttgaaaaaccactgctcatttattaatgattagaagtccaatcacatacttgtccaacagtagatcttttgtgcctgatccgcctccatgcactgttgttcgcttattttaatccgtaccggcttctattaattctacagcgtttttatctgtataaggggtgtttgggagtgaagttttttcacagttttggaaaaatactgcaatattctc

SEQ ID NO: 3005 - DNA, 1314 bp, Zea mays
  misc_feature (1)..(100): optimal_loci_10382_G1, chr1:55507977..55509290, Cluster 18
gatatgcaaggtaacaatatgtaattacaatgaactaaagaatctttgatgctgacaccaaaccatctggtaaagttacttgccaatcaaactgaagaatcttcaatgctgacatcaaattgaaaaatcttcaatcaacctgaatttagtaaaaccaaatagatttttaaatatctccatctattcaaatcgataatgaactctgaaggactctatagatgatattgattcttctttagttagaacattttgtttactaaaatatttattttcttttatcttgacggtttctaagaaatatttgctctacattcatttctttttgcaatattaatgatacgaatttttttcatctattattatatattattcatatttttttgtggtccttgaattgaggggccctaggcggtcgcccctctggcctatggctagagccggccctgtacgtggcccagttccttaatacagtggttccaaaccatattgagttttgttgaacatttatttctggatgtatcagtttgaattgtgttggtgtgatgttctaaatgaaatggcacctgccttaaataattcacttttttccaccatggttgaaaccgaatttcattaccttcaaacagtggaattacacaagtctgagcatacaatgctcagaacgaaaagaccaacttcaggggtgtttggtctaactaaacttcagttcctgtcatatcaaatgtttaaaagataattaattttaaaatatagtttaatataagattaattatatagatgaagaataaaagacaagaacaatttattaaatctaactaaccatatatttaatactcacaattaatattcaaacgccctcttcactgggtctagtctagtgatgacaatagaatgtctttatctatggatttgttaacgacaaaaagtcatacctaacggatttatgggtatgtctggatgtgtatatccaaatctgtaaacctatgtttttttaaatatgatcgaagagtagcttacatcagtctacaatacttcaactagattgatttatttagagtcgtatataaaaattggtggatctagaggcgtatataagactgagttctcaccccaaaatccaagagcacatgcgcgtacctgaacaatgacaaaggacgccggcgtgagaatgatggctagggcctagggtgcgcagttgtggatgaccgctcctatgccctacgaccgtgttttgatctactggctgccctaggaatgtattggatcaagtcaaaacagacacattaaaaatccctttaaataatttgggctgac

SEQ ID NO: 3006 - DNA, 1149 bp, Zea mays
  misc_feature (1)..(100): optimal_loci_107480_G1, chr3:93181714..93182862, Cluster 18
agttgaaccgtttagccatctcttttagcacttttatttcctttacttagtttgtaaccctccttatttctctttagctaggagattttaagatgtttttgaaccacaacatctaaatctacgaatttttgtggaagtgtggtcgtaatcacactaagtcctcgtgttgtttcattttgtatcaaatctgatgttatttccttttggttttaatcttttcctctcaacccatctagttacaattttgagttgattctttgcgttcacttatttgggtaagtgttttggtgttaatctctggtttctggattcattgcaacctcacgtatgagttgatccaaattgtgagcaagctttctaatagatttgctctttcgacaaaaccccaagtcaagttcgaattttctgatccgactttgaagtttacatccttttgatctcaaaatttctggacatcttaactctcttgtgaaggtgtatgtaaaacttcagcttaatcgaagtccgtttggatcgattttgtattctaaaactaaaattcaagatgctaaaatagtctaggttagcagcactgttttgggttgtttgggacatttcgatgtatgttttgcgacatagttgggttcattctttttgcaggttctcccgataacttttctacatctcttatgtgttatttgaattttggatgttagggtataaaattgagaagaaagctagaggtgtgtaagagcaaagatttttattagcttccattcacccccttatcagattcgatccttcagttaatctctgttaccagtgatttaattaagctactataattaacttactaccagctaagaccctccttgttggtttgctttggtttggtttccatgtgcgaagcaaatcttgtttcttttttttagaatataatataagtgaattgcacacctcctcctatcagtttaaatttttggattgaactgattgttgcatgcaacttaatatggtatcagaggtagaggtcatgagttcgaattctgcttagcacaattaaaataaaataattgttgctcgctcatattccacgtcaaagacccaaaaaggctcgacgtaagagagagtgttagaatataatacaagcgaattgtccacatcctatta

SEQ ID NO: 3007 - DNA, 1082 bp, Zea mays
  misc_feature (1)..(100): optimal_loci_114018_G1, chr3:136260534..136261615, Cluster 18
actatggaggaaaagacgacaatgtccttagttgaccttgtagttcacgtgtataggactgagggcatgattgtaaattttacaaaatacgttgagatttaaaatacactggttacggtcggtacaaattgcaacatatacccttaacttcaaaaattcagacaagtcgtacatcctcatagaaattagtaataatatataaatatttataaattcatgaaggattaaagcatatttcacaaagcatcaaagcaatatctcaaaaatataagtgataaacattgtgcatatatacatatagttagaaagtcacaacgcaatacattacaaaacaaaactatccaatcgaaaatatgttgataaccataataaacactgaacaattatcatacatcaaactatggagcataagaagtcacaatcaaaataagacaatgtaatatagcaatataatcattatcatgtatttaaataaagcactagcaaatctagtagcatatgactatataatcaaggtatatatgatgacatgacacttgcattcaaagcttactcctactacttaacatagtcaacatagttggcgtcctcctggtccttctcaaattaccaagcaaattatgaatatgtgtcaaggataataattggtaagagactataaataagaacaataccgtttttaaacagctctaaactatatacaataataagatatatcttgattttaggaaaataataaaattagtttcatattttctaaattaagatgaatttattatcaatttacaaagatcgacttagaattaatatttttctaaaaaataccaaattcgttaccacgtcaaagtactgaaatacaatttttttaacgatttagttttctattttcggtaattgtttccatttccatttaacccttaattttggtaaaatttcgaaaaccattctcaaaaaataatgttttcattttcaaccctgtctatacctccagactttgattatgtggctcctgtggtatccaaaatagaagaacctctgttcctctttgcacaagagaggccaacaatagttctagttctagt

SEQ ID NO: 3008 - DNA, 1181 bp, Zea mays
  misc_feature (1)..(100): optimal_loci_116547_G1, chr3:152182803..152183983, Cluster 18
ggattggactgacacatcaccaaccgggagaagaagactagtgagacttagtctttttttttccttccttttttattctgagccaacaatatagcctggaaaaagcacattgattcagatgagacgttataagatctggtattatggaaatttccttgacgtacgagttttacaggacgatcttcgttgttaaaggttgtctcttatcactatcagctatcaaaggtgtgcggaaagtggtgatgataacagagggacacaaaagagctttactaaaaccaaacacagatgttctctctcaatcatctgcatttcgtattgtccatatttgaagtaaggtaacgccaagtggtgggcatattatcgatcaaatgttcagaagcacatgaattcaatagatattgatatatgtataatctgaagaaaatgaaaggaaagctccgtattatagcagatactagatggtggttcagacacttttttggagtctttggttgaaatggtaaatagtatgtacaactcaactgtgctttgaactgggaaaacaatttcttgttttttttcaagtcggtatattcgtcgagctacacgcctaacaagtgctacatgtatcctcctcattctttgtaccagaaacgagatgcctttgtcagagaatgaacttgaaatcggcttcttgaataattgcagcacggctgttcagagagttggtggacatgtgcatcatgttgcaagctggtaagattgtacaaatagttactgctgaaaattcgatcaggccaggttatttaaatccatagtctctacctagtggtggtggcagaatccttgatcctatcacggttgcaaagtgactagtaatgtggcattgggggtctgggttagaatttctggcttcgggaaggcaccgtggtggtgtgggtgcagagtggcggcatgtcagtgagcgagggagggagagaatgtgtaagggccattgaggccaggcaagatgtttgccttgcttgctttaaaacggttacataacccttacagatttggactcttaggccctgtttgggaaaaaagtttttgaaaaccacagtttttgaaatactacagtatactttagtcatgacaataccgtagtttacaataccacaattttggaaactgaggtctagacctaagtttagaatacc

SEQ ID NO: 3009 - DNA, 1167 bp, Zea mays
  misc_feature (1)..(100): optimal_loci_120112_G1, chr3:174530793..174531959, Cluster 18
gcttccatccaacatatttaaaaaacacgtagccaatatggatttaatggatcaactatgattctagattaagggctcatcaatgcaaccatctccctcaatggcaagtatttgctttgagataaaaatgtgtactatagttattgagttcaggagcgcatgactgattactataacactttagttttggtgtattgatctattgaggagtagaaattgtaagctaatagattaagcagttaagaaattaagttctaaatatatgcgaataagcatgatatcattgtggaaatgttgggttaatattatttgggctcggttggactgggtcgtagaaccgagccaaacatctctctcataacctaatctgggacgcaacaatctcgcccatacacacactaacgagataaatctatctccgcgcggaaacagagggaaggccaccaccactgctaactacatcgaccatcgaagtcacctttccatgacgactcctcttaattgcgaaggtatactccttgattcttcattttatagtggataaaataacgagctaagatcctttatacatagataccagaactatattttaatatatcatagttaaaattacaccttaaaagtcattaataatcaatagcattatgctaattctgcttgacaaagcactagtttattgcaatcggtggtcactaaatcaactctcatcctcatgaacgcttgccatgcatgctactcctctcttaggcacatgagagaatttagagtttgtttgtaattgtttgctttactttttcactctagtctacaaaatataggggttgtttggtttctctaactaaagtttagttcatgatgtttgaatatcatttatgagtattaaatataatcttagttaggtttaataaatttgtctcacttttagtcttcatttgtgtaattatttttataaaactttagttggtagaactaaacattctcataaatgtatcttgataaactctgttttaggaaaaaaaaagactagaacagtatctaagaggtcttataaaactctaggttttttaaaaaaagttgctctatagcagagtgtgtgaaataaagttggtggaaaatcttaaataactcttaatccttaataatgaagttttcgacagctagagttgg

SEQ ID NO: 3010 - DNA, 1020 bp, Zea mays
  misc_feature (1)..(100): optimal_loci_121116_G1, chr3:180003683..180004702, Cluster 18
accatcaacttgcattaggtgagtacttggagttttcaacttgctgtattatttccttaggtactgatgcccagctccttttatttatatggtcatttgcacacctacagatgcaagcttcaacaacgaggagatgacaagctacatcatgttttattgaaccagtggatccttgtttcagttgataagtgagacaccatatctttgttttagttttccagagaaccatatacaattgtatcagttatatatgtgatgaatactgaaccgccagttttttatttgtttagagaaccatatgcatcatgttttagcacaaaatcggttgtttcaattgataagtgaaccacaggacgattgcttcggtttataagtgagccaccatttttagtcacaaagttcttgtcagtgttaatatctagtgttgatatctgaatatagtatggtgctcttgtcatccttgtatcgattgtgttcggtgaacaggctgcacatggtgaaaccaagcagacatgtgaattaagttcagaaatttcagggtggtctacattgtcagtacaaccagtacaaaaaagtgattccttcgctaaaacactgaaagtgagcaagcactgctatacaaccaattgtgttccctgctccagcttgcatatatgagggctaggacgtctaccaggaagtgtagtttttgatgaagctacaacacaggaagtgtgcctcttttgcctgtgtttgtgcgaggtggagtaaggtgtgttctgaatactgaagctagcagtatgttataaaagctaccagttcaaactagcaatttatacatgtatgttttaaataacatatcttatgaatacttgaggaatacaattagaaaatagcctcgtacacactagtttgtgattgttcgagttttctttttttttaaattatcataaaaagttagtgtgctgctccagtcatgggtagcaggaggtatgtcagtgctttcaacttatgtaaaagtcgacaacttttgtatggccc

SEQ ID NO: 3011 - DNA, 1017 bp, Zea mays
  misc_feature (1)..(100): optimal_loci_122329_G1, chr3:186225142..186226158, Cluster 18
ccacatagctctaagagggatacgggattgctcgagagctctggatctgttgacaaatctaagttgtcagtgaagaaggatggctaatgtaggtctgacaaatccaatgctgatgataagcggggagccttgaagggcctctgttttacttatgtggagaagtggcaaggccataatcatagatgtccctcccgaccaagactccattcatatgattcaagatctattggcgtcgttacgttccacttggatgttgagaaggacagggtttctagtgatctcgaatctgacactgtccaagttactctagttgttcaggaacaaagtccatttgaccctagtctacttcagttaagccacatcgctcatgtttctattaggtgcgctcaagacagatttagtctgctataggacattgctattatttgatacaagggatttatccattattcatatagtaatatttttagaaaaacaaacacaactctctaacaatttcgtcttcggttagttgtttgttctcttctaccttctgatcgaccaatttcagtgtagttgaatttgttcaagtagccacctcagacgcagttggctcattatttcctgaactcacgtgagtcctggcaactctataaccaagtctatgcattttctatttttattatatattttttgatgtagtgatgtagcagcagccttcaaatatttttgttcattcttttattcaaaatgctcgcataagacaagtgttgaattcttattctagtctatgttttgttattcgagtaattttcttatttttttaaaaaaacacctattcataattttttaaataagtttgttactgtagggggtggctatagtatttcctttttttctttcatattataaaggagaaagagagggatatgtcacgagtttacatatatagtcattacaacgcttgcactcatgttcttacagagtcggtcatcatttttttccattctacaggagttgagtatcagcttctgggga

SEQ ID NO: 3012 - DNA, 1199 bp, Zea mays
  misc_feature (1)..(100): optimal_loci_126157_G1, chr3:206206450..206207648, Cluster 18
aattaatcaaataggttaccaacttttgtgaaacaaagttgtgaatctgaagcctctcatcacctccaagaccgtgtcggcaccaaactctttcctccatctcatcatctcccaccacatttgcatcgccttctcggaatcaaacttcctgtcttccagaaacatgcatttaaggtcacacacctgctaggtaaaaccaagttgttttaattgttgggcagcttcagaacataataaaccatgtggaaaattatatttctactttgtcactccaacgatttctgtaaggaccacgacctgttccagataggaagctagatatacatattagagatactaacatactgcagtttgcattctatagacatgacttcgccgaaactaacaatgtattgtttttgcatcatattggaaagatttatttacaacaatcatgaacattcaaatatctaattctatgccactatttctgaactaggcactaaactactccctccactccaaattttaagttgttatgtttttctacaaaccttagtaccttactgtattttcataaatttatgtctagatacatatctagacaaaccagaagacttaggctaaccaaatgaagcataaattaaaggcaactgaaagagaagttattgattcacttacactcaaaatttgaatccctagctccgtccgtaaagaagatgaaaatgcacgctagaaaatatgaatcacaaattgctggaacaaaacaacagcatatgaaacacaaatccaatttgctgatagtagataggcactaaaagaggcacttccatatgctactcaaactcaaattcagtctttcgtacaaaatggagtttgaaatagtactgtcgtcaacacttggaatcagctcatttgtaaaacgagttgttgtggttatccttgcaatcaactatgcatgagcaacatataatatgttggtagaaaaggtacattttccttttcctgaaaatccctttttgacaattgtttgtattagtgtcgttggaagtgttaagatgtcaccctttcagaaacaggggtaggtcatgctaattttcctccaggacgccataggtcgaaaaggcacgacatcaggggaagtccgagaacacacctgtctagtggagtcactatgtgcagtaaaggtctttaaggctcacgtcattgacgccatcgtg

SEQ ID NO: 3013 - DNA, 1090 bp, Zea mays
  misc_feature (1)..(100): optimal_loci_126215_G1, chr3:206595992..206597081, Cluster 18
ctattttctgcgacggatttatatactctctccattataaaatagatataattctcatgttttaagcaattaaaccaatttcgaatttaagtaaatatatactccctccgtctatataagttagttatttagatttattctaagtcattcactatcaactttgaccagctacatcagatattttacaagattttacaacgtaaaagaaaaattattagattcatcatcacttgaactatatataataattatttctgtagtcaaacaaggataaaaatataatgtatattggcacaaatataattaataaatttaaaaaatatttgtatagttagataacgacaactttttttgatatttttgcgataaaatgaaatttttatagtttttttcctacagtcaaagaaaaccaaaaaatacttgtcaataactagtacagttaagaacaaaagttataatttatatattttaattaaacaatgctaaactatctgttgcttgtgcaacagcccctaattaatatgtaggacaggtgcaaaattaatgtgtagaaaagaagtagatgtcgtttgctgtcaccgggtgtgggcttcagtggataaaactccgaatcacatagtacaacccaattaacaggcagttcgatgatgcgcaaaaaaaaaagcaaaacacgatcaaggctgctagttacgttgccctgaacagactaaaggaaatcaggcaaggaatagattgataagaaaagtgcacaaagaaaggaagaaagaaaagatctgctctgttcttgttctaggtcagcaggactttcgctccagttgcctagcgagctagcatctctttccatgcctacctctctagctctcccaaagttacgttggtaccgtacaccagcagaccattgcaatcatagctgcctccccgccaaaaacttaaggctactgacaacgaggatttcatgtctctgttttcaaaaatgccacatcagatttatagatgaataaaatactctctctcaatagagagtttcatctcactattttatatgtcaacatacttcttaaatgctgcatataaataaccaatatgattt

SEQ ID NO: 3014 - DNA, 1113 bp, Zea mays
  misc_feature (1)..(100): optimal_loci_126954_G1, chr3:210223173..210224285, Cluster 18
tagagaacccaccacaatcaattcgtctaggggccctcaaaatcataggaccggggctgtgtgtgtgcagcagttttccccgggtacatatatacaactctatagaggaaatactgtgtacctagagatttcctagttaacttgccaactctcggggaaaaaaatcatatgagtttttagtggtaggttatttacgcatgaccatatataatttaactagctctttacactcattctatcacccgagttcagaagcagtcccaactcccaactggagtaatctctttcgcatgaagcaccatcccttgcgctcttttaaggcggcaggcatgtctttgtccacttcgaagcgtagtacacatgaatgtcctcaaaaaatacaatatggcagtgaggcaatcccctttgtgttctttttttttttgggttaacaactcaataggcttgcataagaaatttgtcagtgataactatgagaaatggattgggtagatatagtggagacacatggagagaacgaactatagtcagataaataaacaacaggactacttgaaaaatgtttcgaagttaaaaaaatctgaatgttgcaattttaaaatacctagctacctgcgctatttgcttgggccgcttccttagtttctcattacaatactgttaaaataaggcatcgtatatattagctgagaaagtctagaaattaccactgtttagaagaaaaattttaaacctacacctttggattttatgatggtagaaaggtttagataaactaaagcttccatacattaataatagtagattcataataacaaatagtaacaaaaaaaatgaaaactctgggttttatgagttcaaagagaatcatacaagtaaagagtatatataaaaacaattagtaaaggtaatttttgaataaaaacctattgaaaaataatagtttgcccaccaagaaatttgggaaaaaagaaacttggataagtagtccacattttttattaccaaaacagttaattttaaaactgaaaattttaaaatagtagttggatttccatacgataggaaaatgcctaaatggaaaattagtgtagtgctatataaggtttttaa

SEQ ID NO: 3015 - DNA, 1154 bp, Zea mays
  misc_feature (1)..(100): optimal_loci_127221_G1, chr3:211613450..211614603, Cluster 18
gatttttctatactcaccactgctctatctattcatcagtagctgagtagaaattagttacatacgcggaaacacctagcggtttatagaaactcggccggtaaggaattttttatataattgtcgtgaataaagctactaaaaactatgaaaaaatctaagaaaaattatatatgtatttcattatttattctattaatatatcaaaatttaaattataacccatcatatgtttgagatataaaaaagaaaaaaatatcattttaatcttttatattggatataatttttctatttttataactcttaacataaaatgaattacaacttaaaattttatagcaaataataaagtgcatttataattttgtgaaaaattttatgactttcagtattttaattacacaaggattgcacgagaagctccattgcatcttagtttttgcccataaaccaaataaatttaccaatagcatcgtggatgctactctttattatattataaacatttttgttggacttagaactctcatgaacaaaattcactgagagggcgtcctgggatttttggggaccctacgcaaaattaccaagactaggtatttatgtatacaaacatgtatcaagtatcatattggttacataatctttatttgaacaacattatatttcaaatccccattgatgttttttgtctgcctatgcctccagccttgggtcttgaaatacgtattgtaaatgctaattgtcgcatactcgctctgtgtagtattagatgtcgttttagatagcattttgcataacaagaaatggttaattggaggataaagtttaaattgtgtctatattaaatagaggtccaaggctctttttactagttattgacgtctcaccatgcactatatataccacctgagtttgaaacaaggaagctgtgcatgccatgcattttttattttttttatttttgcttcgcgtttcttttttgcatttttctatggcgcgtttttttcccttggacctgtgtggacaatacaggttgcattgcgggattttttttactgcggcttcttatttatgggcaagactaggtatatgcccgtgctttgccacggaaattaaaaataagtataaactataaatacaaaaacgag

SEQ ID NO: 3016 - DNA, 1104 bp, Zea mays
  misc_feature (1)..(100): optimal_loci_12762_G1, chr1:69884737..69885840, Cluster 18
tgttggatctcaattttgtttttagtatcctaaacaatttaaatgatgtagcattttaatttttgggggcactattttaaggtatcttgttggagatctctaaaataagaagtagcttctctactctctccaaatcagacatttgacttatggatgttctatgaatgttttctcttttacatttattttaccagtttttttaaaaaaacaatagtaaataaaaaactataattatgaaaattaattgtgttggactccacgaaaataggtctacacaatgaacatatgatgtggtatgatttactaaaaaatgttattatagctttagatctatgcttttctataattaatttaattatagtaaattttttatcatggactaaccattgcgtgtttaagttgtaggtaaagattttatgctcactagatcatgcatatctaaattataaatttatctaggctcatgtattgatttatctagataaaattataactcgatcatacatgctccaataagcataaagtttttgctacatctcaagcatgcaatgtttagcccataatagatccactattattaaacaataaaccaaaagttagaattaattatagaaaaatatagatctaatcctacaataaaaactttatactaaaaacataccatatcatatgtttagcatatggctctactcatgtagagtctaacaattttttcatgcttactcaatcatttacctttgtcttgaccccttatattttgattttcttatttccctttctatgttgagcactcaattatccccccttgtagctttcaatggttaccaatttcttgctcaatcttggatgtggaccatatattattcatcgccattaacccttttgttatatcactctttggcttactttttgtcacatggaacacacttaatgatggttaaccatcgacaaatccagcctattctagaaatagagttgataggcgatggcgagagcgaacgctcgtgtagactctccacttctctcctcattttcatgacttcttggtgggagagcaaaacctccacttataaattggagtgcacgcacatacactagcagtgt

SEQ ID NO: 3017 - DNA, 1261 bp, Zea mays
  misc_feature (1)..(100): optimal_loci_129084_G1, chr3:220761285..220762545, Cluster 18
cttaagctttcgagttagattggttgatgcatgcaaattaatagtgataacttataagcacgtgttcttattcagttattacccatggtgcattcgattctccattcttttcaagtttattgtttgagaaacccggaggccaaaagctaactatttgagttattgatcctatttgagtcacttaaaaaagaatgtgaagcagcaagacaatttttctttgagttactaatcctatttgttgtaagaaaaatatgtacatggtttgttcatttaaagttgtgttgcttcaactgtagcacaccataatacacctctatggctctatctcccggtaccttcgattgagtcttgtcagctgaacatttgaatttcaggttcgttcttatttctcttacaagttcatttcctgctgtattgacagcttttacagtctgcttgcactcgtttactccaatttctaggttaatgacttttccaagaacattggatatgccattgtcagtcagttctcagcaccgttgtaagctgcatgtagtcatctaaaggcaattttagttaatgtgttccttatagttagcattagcgcattaaatttctaagcgacgtgtggactgcaaggtgtgcgatcatatatgtacagtgctttcactgttgttgtacgcttgtactcgcaacttgccaacttcattgtccactgtcaagaagatagacgaaaagcaagagcagtgaaagggaagttcaggtgtgctctcagcttttgttgctgtagatgagatgtgttttgtgaatatgttgacgaaaattttaatataataaattacattcttataacttttagtggactgaatcttgagtgtcacattttcaggtcgatttaattcatgcggtgctgaatcagtggccgtgacatagacagggggctagccccctgacaaaaagaaaatttgttttgtagttgttttttatgactaaaataaaaaaaagttagtgtataataggttaaaatatagtctgtaccgtatatttatgttgatttttatgactagtgactgttgtatattgtgaatgtagatatattttatttattaatattataattgtaattatatatgtattggcccgtaatgaaaaatcctggctatgaggcctttaatttgggcacttcaagaccatgcaattttgagtctcttatgcacatattttcttctttcatcgttactgaattcaaatgaagcaatgtccttttacatattaatcaaca

SEQ ID NO: 3018 - DNA, 1394 bp, Zea mays
  misc_feature (1)..(100): optimal_loci_129269_G1, chr3:221692250..221693643, Cluster 18
gtagcttcacaaggaggttagaaagatacgtggagaattttaacccgtcccatccatcgagtcggtgtgaattgatcaaaccactctctagatcggggtcttctccacaaccgacaaaaaggaaaacttcatgcttgtgtgagatcttcttaaaccaccttgcaaatgtgatcccaagtactcatagcacgtaaagaagtccaagaaattggcccaaaatacccatgcaaactggagcaccaaaacaccaaaaacaagtgaaatcgaacaccgaaatggaaagagcaataaaaaaataagcaaacaactcacaaaaaatgagccaccataaacctaggaggtaagggactccattgacacaagattaattggctacagatttagattatatagatttaatgatttctgcagtgtctaaattatctaaagattttaataatagattagagaaaggggaaaacctacaaggatgaaatgaaatgatgtgctagcgagataaaactggttggattagcatcctccatccttataagactattacacattcccaactagcacttaaataattagagtcgaaccacttaaccctgtgcacgttatgtgcttcgcgcacgatctgatcgagttcctcaccaacactcgtggaaatcactataaataaatctatattttcagtttattgcgatgacgattttatggttagatccgttggtgattcttctattatgtgttaatcttattgagttagttcatatatgttctgttctaatgtcatggatactatctttcagtagatctaattttactttttatgctgcattataaattaaccttacgtcatgttaattttccaacaatatcaaccacgtgtccgcagagtcttggataatttacactactataaattaacggctcgtaaatagtcatgttccacccgagattaaattgtttggccattatatagaatttagaatacgcaaatcaacaaagtcaaatctctctgattggttcaagcataaacgaatttgaccatagacgtatatcatatataattcactgctgtttctaccgctcagcagtatacaattgctgataaactcactgtcgtacgtgtggctaggctccatagcgacctcccgggctccggttgctccaaaagtcaacatcccattacactcccaaattcaacatctcattacgcggcagagtacgctccataatggagtgcctgatcttctttactcaaggtcgcaactagctcccaatgaggctaaagtagttgcatgtgagcttatgcaagatttgggaatgatattctttggactgttcacaagacttatattcatcaatattaaaatcaggcgaacaatattattcaatcgaatacggagtac

SEQ ID NO: 3019 - DNA, 1154 bp, Zea mays
  misc_feature (1)..(100): optimal_loci_131868_G1, chr4:3043292..3044445, Cluster 18
agctcaatcggattgtgggcccataataggatcgaggaattggttgactagacttagggggcccactagccttctaaaatgccataatccaagcactcataggagcaaaccaaactagccttcaaccctagaatcaacatgtgtttcctctcaatggctcacaatctaatcataaggattgatgggcccacattcaagcaaatcgacgtgccaagctattttggacgacacttgcccactcaggacacattcaagaggacccatgagtctgggagcccacatggaagtgagggggtaagtaaccctctagatctaccgatcaccctagtggtcccactaagatccactgtcgtgtagcatgactccatgcatgaaagcacactcatgcaacatctcaatcatccatttcaagttggtttgatcctatggctcaagatgatgaacacatggatcttggtcccacttaaactagtataagtagaggagtacaaccactccccactcatgaaagcaaagaaggaagcaaagcaagatctcaatgttaaattcttccattttattttagtagtagaaatgtctagaattagaagttgaattatgctttgcttaggttcccaaagctagacttttggtcttgtatatctcctgtaccactttcctttttgtaattcttttaatttatttaatatattatccttcctctactttgtatttactttgtgcaacaatgtactagctatattgtccttgtggtatatcatagcatatggttgttacatactagattgatgatccatgaaccacacttatattccctcatcaccttttattaggatttctaatgatttgattatatataattgcagtagtgggagaaggtataagtgtggtccttatattttgtgttgattttggttaccacttgttgaatatattgtctatagttgcaagcaaatggtaacaccattttatagtatttgtattccacgatgtatttagaataagttgttaaatggtaatgcaagcatcaactgtgtttgctttggcaggagttacatctcttactatctcacctaccacttaatgtacctattgtgtggactcgatctgtctattgcaattatgtaattaagggaaaccatagaagtagagat

SEQ ID NO: 3020 - DNA, 1266 bp, Zea mays
  misc_feature (1)..(100): optimal_loci_131984_G1, chr4:3278699..3279964, Cluster 18
tgctgccacaagccaacgaccatgcatttaaccgatgtttcaacacatttcaggaaaccagtcacacacacgaagtgagtgctatgttctgaatttgaaacaaagcagattaacacccacccatttttttatcttagggagacttcatttggaacatgtattgagccggcaactgaaaactgtcttggcattgactacctagaagatccaggctgaactcaagaggaatagcgaactgtggagagcagggcaatggagctacctgacaagacaatatgctagatgatgtccatacaactattcttgtctagttgatgtacatataactattatgaactagttgatgtgtatagaactgttcctggactaactgaaataaagagagaaaagtttgttcctgatgacactcattcccaatccctcattaatttgtttgcagcgaatgacaaatcctctcatggtaagtgttttttttgtcatacaattttgttatttggattatcaaaaaccactactactctaaagaacgtgtcaatttctctgaatggatcatgcatgtatgtaacctcatctacatattgttgttcacggggccatatattctgacatatatgtgcattcacgcatattgacgagggagacagagaaagaacatgcatgcctctatatggaagcacggatgcgccaatttttaacacggccttaccaagaaccatctctatagatcatttgtgaaatgtaatcaaatttaaggaggcagttggtgtttccaacaaccttgagaaaatgcactttattcttagagccggattgaagcaccaacaaccactaaaggcatttctagaaatggacacgtcgatagaaatttatttttggaggcaacgataatgtgcctcaccaaaccacatgtgtggaaaaaagttatgttttttgtttccaaatcaagttgatcaaatacgaactatatatatcatagatgtatattttaagttctctataactttatagttgatgtattttcaattgagattattcaaaatcctagaattatgttttagttttctaactttcatttggaaattttcaaatgacgtcggctatagatgatctctattccagcatttttgtgtttgatgtggtttaaaactttgtaactcaaacttttccatttcaaatcatttatgtgccagaattttaatacaagattcatgaaagttaagagaaaaggatggcacatacaatacactaggaaacaggtcaccaccg

SEQ ID NO: 3021 - DNA, 1066 bp, Zea mays
  misc_feature (1)..(100): optimal_loci_133439_G1, chr4:9748931..9749996, Cluster 18
aatttgctaaattgtactactgtgctcgtagcccaaaccgtccatgtcaccatttttccattagtcgtctgatcctttatcaatggctttcgactatgtttgttttttgttgtgtcccttcatgtattgttcatattgttttgaaggagcacatttgctctttttgttgtgccttagtcgatgtgtcatgacatcttaatttagaccgaagatcatatgttaagatctaatgtagaattatattatagaatatcaaagcttttaagatcctgcctacctaattctatctaagacacattattaaaatataacatgcatgcactccattaaccgtacattcgtaaattgtgcttcagaagcattgtaaattttggtacagatgaatggaatgatctttgtgtttgtacaaatacaaatgttgaatatgtaactttgtggttgagagatgtttctacatttagggtttagggtttagacaattatattactacggtgcatcctaggatgagttgttgccgccgtagcatctagcccacatcacaacactcgatctccccatcacgatcgaaccaaaggtagaattttgtccaattacccgaataaagatgtgtggttttataacatattgattatatttatggataatatgacatacaagtttacttttatgactttattgaatatttgtttgtagtatggaaacacacatgtaattgattgatatatttttcgattgataaattattttggaacttgagttctacataatcagtaaaaattctataaattaatcgatcaccttcaaaactttggtgtagctttcaaatcataattcttttgtctttagttttcaacatatagtcacgctgcatacaaggcatgcttttgatagtaagaaaaggaattgaagaaaaaagtgaatgagtttattgaatcataaagatgagttggctattattgcagtggagaaacaacctaatatcaacacagaagatcatggccctacacttaaagaaattgttgacatcattacaaaaaatgctagtgttgttgaagaaccggtttc

SEQ ID NO: 3022 - DNA, 1169 bp, Zea mays
  misc_feature (1)..(100): optimal_loci_136311_G1, chr4:23622233..23623401, Cluster 18
gacatgcaatgcaatgcaatgcgatccttccattcatatagtcccgtctccctctaaccaaccaccacagactaattttctgaacaagcacgctcgtttattctggcacatggcgaagtttctttttgaacggtgagggggtggttgcagtcttagagctggtttggtgacaaaagaataaaaaagatccatcagaagtaaacctgcaggggattttctttcgtatggacgctctccagtttttttgtcactaaaccgcggttagggaaggagagagaagaggcatttgggtggggaagagaaagatgagagagaaatgggttctgagatcgcttttagtacagtttagtatctttgctatggagataaagtgttaatgtgtgctaaactttaacacaacacttttagtcactctgtttgtttttaataactaaagtttaacaaacaagtgtcgtgctaaaatttagcaagagaaaaaaaaagagatctaacttgagtttgcttggagccttgtatgcagctattggcctaagacactccgttttttagtttttaggtgtttagcttatggtaggataagaagcttaaaacttattaaaaactaatataaaaagtgaaaaacaaaagcgtaagacgactccctacgtattaaaatagttgatggtatgtaatttaaattttattttcaaatagttgccattcttattttataatgcacctttcctttttttccctttcaatatttttttccaacgcatctctatctctattgtatttctcgttatctctctttcttattttttgcgcacagcaccttttacttcttccaaattcctgtgtagatctataaaatgtcaattattttgaaggttggagttccaaacaacaaatttgagtcagagaaccaaaacttcttaaggctaagagatttcacaactatataattagcatcacgatgataaggaatttcagcgacaagcaaaagaaactccgtgaaatatccttatttggcactaccataaattttaaacttttctatcgataccgatttttatctcttatgtattatttgtcatgtcttttagtttttaggcctaacgaatttaagtggatgatgataaaagactatatttctcttgtttagtgtcttcctaatgtttttttcttag

SEQ ID NO: 3023 - DNA, 1290 bp, Zea mays
  misc_feature (1)..(100): optimal_loci_13754_G1, chr1:75763100..75764389, Cluster 18
agatcaacatttttaaggggttcttattgtcatctccatgggagatttgcaaagaccaactctagtgatattgtggcttgttgaagtaccggctcgttgcagaaattaatcccatgaatcacctagtgtacgcttgccacaacacggatataggatgccagcaagcaatcgaaccttggggataaatattgtgccatcatttgccccatgtggtttgcactccatactatccttactattataaatacttgtttttaatattttgtatttatatttttaagaacatagcttgtgtactcatatgtattccttacaagatattagtttgtttagggaaatattcttgcataaaatagagcaagtaatcgcttctgtatatctttttttaattagctctagttgtaattattagttgtgtaagaaatttttataggctattcacctatctctatccatcttctgcatgtcaataggctcgcagcatcgcccatgccccacccgccactaccacatcagcctcgcccttgtcagccaccgccatagtcacccttgcccttattctcctttgtgacacccaccttatgcgtccatcgacatattccccaatacctactgtgactgtcatccccaggttcctaacgccaagacaagggtggtcggtgccaattctacctcgtaccacaagatctcgatgaggggcagatttgataacacttgatacatcttggcttgagcaaagctgacatggcttggctccaaggggagtgaatagagctcgacaaagttggaagttgactatttttttctaatactaggtatgcatgctcggtctatcacctggataaccgtgagaggagagtcaatgcctcgactgtacatacaggaatagcatggtgttgacaattcacgtcgagtcatcgacgcctgttgcctcaactaaaagaagtctctcaaatttgaaatttttgaaaaaatatttgagatcaactatgtcaagaaagattaaatggcttagctacatattctatcgagaaggatatatcaaaaaatattgatttgaacattgtcgtcataaattttgcttcaacaaatgctcaatggagttgtttgttttttagaggcgttagaacaatatgtaatctaaaataatataattttattcttatctaaggtattcgtactccatttttttgcttttaaaatttctatttattttaatacaattactaggtatatgcacgtgcgttgccacgagagttaaaaatagtataaaacatagatatagaagat

SEQ ID NO: 3024 - DNA, 1307 bp, Zea mays
  misc_feature (1)..(100): optimal_loci_139359_G1, chr4:42141396..42142702, Cluster 18
gaggttgtaggttgcagtgcgacactacaacacaaggtttcaatgcatgctatttgcagtattggcgattctaaaatgttaacatggaataaaataagatatgaggcttgtttgaattttataatttatgtaggtcatttggctttaagaaaattgcttcattacattaggaaattgttatgtagcttttatactgaacagctgcagcaatgttatcaagttgcctggtcatgaggggaccaatcagacgactaatagcctggttagtcttccctagtcagtagtctagtcatcctggcttcatgtctttctattaagggtgtatatgttatatagtataactgtatcaggttgtatgtgctatactgtgatgtagtattcaccacaattaattggtaataatgttatcaagtcatccgtctaattgcgattagtcaggcttatcggtgccatggtgattagctatgcactacaattagtcacgattagttgggctgatcggtgccatggtgactaggatcaattagaagattaaagatttgataacattgattggtaaagaaagcaagcagcctggcatcgagaattcaagtttcaatcatggtttctgagtcacttgtgaattgctgtgaactctggaccctagactagtgggccaaattgccagcctaatataataccctaaatgcaacatgtagcctagtcttcctccttcctgattggacaattatttgtgttaagtcaatgactagtcaggacgactaggaacctagttgagctaattggttggtggacctaatctaggccaagggaccgataaggatgacttatcacaatcttcggatgatttgatatcattgctatgcaacaccatcaatggcggaaactttcctgtgatgaccatgcttgctattcaattaaatgttctattaataacttgtgtattactgtatttaaacacttgtggcttatacattgaacaaatatatttcttatttcttgactcttagctactgttgttgattttggtataactttactgttttctctgcatgagaatgtgctattaaatttgtgtattcaaaatctcggtgttttgatgctttgaaactgttgtttatttttagttctatttgcatgggtctgctgtttcaatttgggaacactaggcactgctatagctatgagcagaaaggaaggaaattatattacgattttttttaaaacttagtcccccagttatttttttcttgcatgttttttgagtgttgtgtcagtttttgaaatttttgtgatatgtttcctag

SEQ ID NO: 3025 - DNA, 1353 bp, Zea mays
  misc_feature (1)..(100): optimal_loci_15538_G1, chr1:85893559..85894911, Cluster 18
aagcttgtctcataaatttgaatacaaatacaaattcaaattcaaacattctaggtgtgggtgctactactattggatgactctttgctataaaaactgacaaccaggtggcaccattaggatgtgggctatgcaagagctttggtgctaggcgggagtgtggcatctaacacctaggtgatgactaggtggctacatggttaaccttcaaacattgttgacaagatatcctatttgtattctatatactgatggtcctgtttgaataagtgtttgaagtctttggtgtttcagcaaatgggatgaaagatgttgtatctggtgtttcagattcatttgtttgaagttttgttgtcctgtgtgaccaaatgggattccctgctatttgaagtcatgttcaaacaagtgtttgaaatctctgttgtctctgttgtttgagcaaatgggattaaagaggctgcctctgttgtttcagattcacttgttcgaattgttttagatagtcgaacacttgtgtaatttcatatttgtgtaattttagacttgtgtaattacaattgttgatttagtgcagtcacctgaaaatgtgtgtgcatagtaaaagtttttccatgtcgatcatgtgtaattttcaatgctgaacaaagacagtgaaccaaactaaacatgagttgtgttggtgcaacttacaaaaaacagtaaaccaaacatggaccatattgattctggctaattgggatcagacaaccaaacacacattgcattgcaattgttgtttgcttatacaggctacgttcaacctgcatctcgacttgaaccgggctctattcatcccaataaccaaacagatggtatatgtttccaaaaaaatccaggccactattttaccccgtttataccttgaaactgaagtccaaaaataacaagctacctcaaatgacttttacaggtgcaaattgcctataacccaaaactgaatcttaggggacgtttggtagagcttccacgactctgtttccagcgagaatcactcccgcagagtctaacggtaaaaatctaaactgctccatgatggcagtgaagtgaatctagtctctattttgtactacaaagtgtgggaaaaaaacatgcttcccaccttcccaccgctcccaacctactccaaactctctaacccctcaggaatcactttacagcctaaacagttttcgttaaatagatttacttctgctagagatttactcaaaatcactctattggagggaagctatgtcaaacaagcccttaataatcgggcacggcaccaggccacctgaaccgagctaacagtttctccaaaccagctcgtcggca

SEQ ID NO: 3026 - DNA, 1398 bp, Zea mays
  misc_feature (1)..(100): optimal_loci_156503_G1, chr4:154801870..154803267, Cluster 18
tttgcgttaatagaatttgtttcattttgcaaaggatgaatgacaaagttaaggacaagttgcttctaaatatcgaatgaagtagagagacacttagaatagtttaggaccttgtttcctttggctgaactataaagaagggtctacattagtacttgatctaaccgagtctaatattattaagtatgatgcattagccggcggcgtaactagaatttttctttagggtatgctatctaaaattttcatatacatttgatcaaaccatttggcaattcagtaatagttttagttttgaatataagttactgtaactacactaaattgcagagtaagtcttaaacttaaagattaaattaatataaacaataagtcttgcatttcaaaattaagttaattttttcacaaattataatataaatatatgaaaaggcatattgatagtttataaatgaagtcatgaaatagagattcgtctgattttttaatgagaacttctaagtgacataatcaatgtctcggttatgttatctttgtctactttaaaaccttaataccaaataattaaataaattatatttgcatagattaaatccttagccctcacatgcaattacacaaacaatgacatgatatatatcgagttcttgatcaatctcgattgttttgttgttgcataaatccttggtctcgctgcacaaaggaatatgaataccttcttaattctagcaattcaaatagatatgattttttacacaaagaaaaagagagaatgaatgtcgcggtgatatgattgatcaactctgagtctcattgtttgaccagcaaggcaccacacgtgtgcgtaggtcctcccctgccatgaagttgtctcggtgttttgctattttttcacgcctacacctcgtagtatagcctctagtggcatctcatgagtcacgcttgtcaaagaattcgagtgattgagtgttggattgtcaattctgtgatcacatcgaccatccatcatgctatcccaagacttcgtcagatgggtcctagggccatgagcctaaacaaaaaggaagcacaagctacaagaccattagtgcacatcatttctatgatgtatattttcatatatttttccactatctttacaaatatatgtgtatacatgtaccatatacgttgtcggggcatatttggcataccccttagatcctctcctgaacttggcattatatagctcagaggaggcccaaaagtcatttggaagaaacctaattcacatatgttttaaattgaaagtaatttagaggtttttataggcgttgaaccttgagaaatagggttagaaacaaggttgtctgaccaacgagcatgattcgatgcctacacgtagggtgctagagtaag

SEQ ID NO: 3027 - DNA, 1055 bp, Zea mays
  misc_feature (1)..(100): optimal_loci_157701_G1, chr4:161023519..161024573, Cluster 18
tccacaccttattaattctagggaaatataatttatattgtagattatatatattaagaaatagtgtaatcataatttttctatataacccaatccaagggcaatttagtttatctaagtgtctaaaaaatattcattttgggagtagtaacttcaaagttatgaatatctttaaggaaaggtgttttggtttaaaacctttgagaaatttttcttattttcacaaacttgaactttagggtgttacagaatgtacttgaatattccctggtatatacctttgatagtagcgtgaatcttatttggccaagtcattggctcacataggtaaaactcttatctcaaatcttattggttagcttgatcttgttgtatctgagctattctatcttctagctagttctccaactccatcatatagttcccgagtctatagacatataagatatactaaataactaactaaactaaaactaaacatagatcataaatcccaaatattataaataacaaaacaaaacatcctaataacaaccaaattagactatattaaacctaaacataataagtagcattataacctaaccataaagcatacacactgacatatacacgtacaagtcgaggatgaaaactaaaaacaggttcataaccataactgatttacataaataacttagtttatacaccaaaaacatgattcaacccctaaaactagggttacaaaatacaccaaacatagaccaaggaagaagaatatcttactcttgaaggtttgtagatcaaatctaagctttcaaggttgaataaatagactgagtgctagaaggtttggaagagagataaaaaacaaataaggtctatattgactagggaaccgaggttttttaaattagtgtttgatgtcatagaccagtaccgaggtactcacacatcaatgctatggtgataaatgtgttgctatttatgatgtaattccttagcatcatataatctatgtggtcgagtcatataatcttaatgttataggttacggtgtcgactctaaagtttag

SEQ ID NO: 3028 - DNA, 1052 bp, Zea mays
  misc_feature (1)..(100): optimal_loci_158784_G1, chr4:167212792..167213843, Cluster 18
gtaatttcatgctctggaatttcagaaattctaccccaaattgacgttacaaacatacatcatgaccgtgtagtttcatgttctggaatttaagaaattctaacccaaattgaagttaattagaaacagacataatgaccgtgtaattatagatggccaactagagaacgagagaggattactccaatagcgctagtataaaagagttctatgcggtgggtttattttttttacggacggtttcggttatagcacacaagtgataatctcgattagacaaccgtcagtggtacaccctaaaccctaactcaggtgctatgaaattggagaaatatttctgtgcacgtacaaataaggtaggcatatgcatgattaacttgtcaaatatccgccctggcattccttgaattctttatagcttttattttttcttataaaatgtagaatactaaagacctagatatacgaagcaggggtaggattatgaaatgttgattattcagctttactagctacttcgtcaaatattattgctgcacgggctagtaatgtgaagagcgagagagaagtaatttcgggcgcacaactagccaaaaatttctaatatcctttttaagcactctggggattaacataatataaaggttacaaaaggtgtcttgataatatgttggataaaatccttaacgttgagattatggcaggtggcaagtacatcttaacggaatatatctatcatagaaatttatatacacggcacccttacttttggagagaaaactctcatagtaactttgaccaagcaacaacagtggaagatcacggtgtgtcgtattccataagagatctaaggttttgaccatgaaaacgcgttgttgaataagcgacatgtttgtcattattatcgatcgttaatcagcatcatcatgcgtcccatgacgtcatgcatagcgatggggctattcgcttcggattaaaaaactaaaattatgtataaatagtaaccatatgcactacggtcactaagtaagtaagtatgtacgtcctatagc

SEQ ID NO: 3029 - DNA, 1069 bp, Zea mays
  misc_feature (1)..(100): optimal_loci_159103_G1, chr4:169972788..169973856, Cluster 18
ggaggatgtcttgtctgtcctgcctttgtgttactagaaagcttggccggccggcatgccatgccttgcctgctagtgatcattactaccaagcacacagcaggccgatcaaaagattaatgtcttgggccgacagatcagatttaggtttcgaatgcccagggcccaggaggaattaataggatttgattttggctcataaaataataaggtctcagttcagcaatgattgcattaaacatcgtcaggaggattcatcagaagagcgaacaaaaaggaaaagtcatggacacacacatatatataaaaaataaatattagaagaacataaagcggcgggctctttttgtggatataaaaatataaaaatggaaaaggaaaaaaaagaaggagaagatgatcttccaatctttgtacgtaatttgtacaattcacattttgttgggttctgctaattccatcctctcttcccaacgcaataatcttcctgttgcgtacatgatccatgtcgataagcaaattaaagatgacgttttcctgtttcagaaacctaaaaacattgttttactatttgaaatagtatacgtagcatgaagttcttgcttcaaggcttaagaaagttcaagatagtaaattaaaacaaaaggaaaccctaaccttcaaacaagatgtagccatggcttaattccttaagatgatacgggatcagtaaactgaagatgggctttctggttggtgtcacaaaagatgggctgcagtaattgggcctggttgtttttttctttctttgtccatcttggactctgtggtttagggatttggggatttggagcctctcatcacttgttgactctcacctcttatattttttatctttatagtgaagtttttgctcgtcgccgtccgtgggttttctcttcgtaagagttttcccacgtaaatccatgtgtctttcatttgtttaggtattttactttctcctcatcttgctttctattggagccatctctaaagttttttggtgtgtggtcatattggcattagaggcatatatgtgatgtgttctttg

SEQ ID NO: 3030 - DNA, 1257 bp, Zea mays
  misc_feature (1)..(100): optimal_loci_162551_G1, chr4:190049068..190050324, Cluster 18
gtgcttgggtttaggtgttgtcgagttccttggctgtatgcagctcgttttaggaaatcggagctgttcgtcccttatgttaagctcgaccgtgatgactctagatatgctttgtgtgtggggctaccgtcgttgtttgagggggcctgccgatttctctgtcgtgcactctgtattgatgcagcttattccattggaggatagctttgttttattcggtttcagctgtgtggctgcaactaaccattctgtccttttgcgttctctacctacattctatctagcaaggcagaccgtgtttcttcagtcgtgatatgatgttgtgttgcgccgttttctcattgccaggtcacctgttttcgaaggctccgtcgtgatatgatgttgtgttggggcggaagaaacatttctacaaataattagagttggcagaccattagtcaaacaaagttcaagcttgttggttggattgattggagttgtgtatcttctgacacaactatttcagtggaatgtacacatccaattgtcagcagatcagctaaactgcttctacacgatgaagtgatgaaagccgtaaatgagcgaaataacaaaactcaaagaacaaaaatgcttatcctcttcgggaggttgttgtttgcttattttagtccttcttctttataaatattaatcgtcatgctcggttcctttaaaaaaaaggacataaatgcttgtttggataaaagtttgctaaaatgcatgagctacgactaaaattttcttatccaagcggtaaggtcgagatgtccacaatcagatcagatacgatatgatgccctaattactctttttttttaaaaaaaaaacttcaacactcctaaactttctactcattaatattcagaattgtttgaactagtcagagtgaacacacgccttttcttttctgtcaattctgcaaaaaaagcgaaggcctaaaactaaggcatgtgcatttcaagaagaaaatacacagagtagctaagaagagtggtcgaaggtgctcgcgaggcctgtgcatttcacacttcacactgacaagtatgtgctgaaaattgccatccctgaatcattttgcaagaaaggatgattgagaaatctcggtttcaatattcgactgagattcagcatttgcctatggcctgtattgtattgtacctatggaaagtagtgccatatatactgaaagttggattgtgtgtgtgtggttttgtttttctctgtggttcctct

SEQ ID NO: 3031 - DNA, 1021 bp, Zea mays
  misc_feature (1)..(100): optimal_loci_168380_G1, chr4:220513695..220514715, Cluster 18
ctccaacaataagttgatcaattactaatagttcggtagggatgggagacactttgaaactccttgtttgtatagagtgctttcatttagaactcagtactcctatataggggtatttttcatacatgaccaagttccaaactccaccttatactagagtgctttcatttagaactcgatactcctagcgcccatattgggacaatcattttagatgattaccacaactcctcttggcacattatgccttttattagagtgtttggcctagaactcagtcgtcctcacctaatgggccttacacctacctcatcaaattgttttgagtatctttgggcatatgcaacacataataccccttaggacaactgagtctagtacgttgttgggtaagggataatacctatttttgtttttacttaatgatcgtacttgtacgatgttgtaacatcgagctcttgatttgtgaagtagttgacagacgaggtacctaagagagttttggtcagggactcgcaaccactttagaagtcatctcattgcttgaatctattatcgagctttgttatttaacatgatgtactcgtgtctcaggtctttaagaaaattcgaagatgatcctcttggcacctaatcctctcgggtcgatgctaccttttctgactgaaggaattcatgaaagaggtattcattctatggtaaagatgggctttaagagtcatgtataccagaaagaaaccattgtaccatagctagatagtagattatatggaaaacttagttaggaaatgtgtatagcttcgggtccgcaagactatatattgtaccatagctagatagtagattagaagtcattcgatcaacaagcagagtgtgctcctcatctcctcgacattgccaccccgttttcaaggattttataaggtaagaaccatgccaccctaatgtggtctctagtagatcatgtcactgaggcatatggtgtcaccaccttaacccggtagatcttgtactaagcatt

SEQ ID NO: 3032 - DNA, 1182 bp, Zea mays
  misc_feature (1)..(100): optimal_loci_172015_G1, chr4:239020225..239021406, Cluster 18
atgaaacctaaacaaactcgagaccatttgcaaataggtcagcaggctaacacgaggaaatcaataataagcagttgtcgtacaggtatacagtatatgactacatgcctgtagatacagtgaaagaaatttcttctgctaggcaagtaatgtgtagatatataacaaggaatataaacatgggtacatggcatggtttcccattttcaggattattgctgattgaccatcatatttctaatcaggtgttagtattaattcactaatatatatagtttgtcgtacacaatttagttccagaaatgcaaatttaatcgcaagcaaagtatagtttaaactttaaaggaacaaaactgatctgggacattactacattgactacagacttataaacttctatggcacaaaaatgttttaatctcaaaactctattatatgtgaacttcacatgcactaaattttgcaaccagtcaatatcaactaaccaatacacttttactggaatcaactccccacaacgccatgaatttgcaacccatcaatcaaattgaatatagaataggaaactttctaacaaaaaacagtatcacattgatctccaaggggacttgtgttttagtccaaacctgagcacttatgttcaattacctgttttgctaagcacttatgtggagtcgtcgcgcaagggaagatgatgtaatccccactaattcgcaaataggtcagcaggctcacacgaggaaatcaataataaggagttgtcgtacaggtatacagtatatgactacatgactgtagatacagtgaaaggaatttcttctgctaggcaagtaatgtgcagatatataacaaggaatataaacatggcatggtttcccattttcaggattattgctgattgaccatcatatctccgatcaagtgttagtattaattcactacaggcacatgataatctaaggaaatttagaaggattcaattctggtcatccaataatatgctagcgagtcctaaaaatccccaagatgcttttcgagcgtgatatatgatacaaaaggttggatacaataatgtcaagcacgaagtcgtagacctatgacctatgagcaaattatcacatcagaataagcacatagatagccaatagcacaacttgatagcctcttagaacataaaaaata

SEQ ID NO: 3033 - DNA, 1170 bp, Zea mays
  misc_feature (1)..(100): optimal_loci_172074_G1, chr4:239443433..239444602, Cluster 18
gtgtacgggaagtccaatgcacatcgaacttaatccggtgtgccaacacctccaactcttcaaaattgtctctctgcataagtggtcagtgcaccaatgggctggtccgatgtgccaaccaatataagtcctaagaaagtgctttctacgcactcggtctggtgttaactccattttggataattcttctttcatttgattggctgattttgtgtgtgttcttatgacttagacagacatatttaaagattaaccatgtagtctaagtcatgcaacttcaccatttgatttatataactcgcattctcaatttggctcaatatagctcaaaaacaccaacttatataacccgagatttccatttttagattactcaaatatgttccaagggacatttagaacttatccaaaatgttgaaccaccgaaaatccatcttttacacaatacgtcccctttctaactgggtttgatttatttctgacttggaatcttcaattctcattcctatgaacctgtgattacacaattaacaaactagttagtctatatagccagcaaacgcaaaaaataatataaaattgtctccgagacccattttcctttcgcacactaaactaattataaaaagggagggagaacatctcaagcataagcaacattgccatggcatgcctatggaaagagcaccaatacaagccaagaaataggtacgacataaataattataggaatggctacaataaatcgcattgaggtcctgtttaggatagctccggttctagaattttttggtggttttgatggagaaggttattaggtgctctagaaaatcgtgaagatagagctctaagccttaaatagaagacatttagataagttgttttatttattttttagattaaaaatattttttaaactgtttaaatttatattgtaaactacagctccacaccagagttggaacctagagtcattccaaacacccctaaatacaacaataagcatactccacaacctagacatggacagtgtgatatcattatgtataataatagtgcatgtttgttttcctttgctaaactttagcattgcactttctactaaagcgtagctactaaataaacaaatagggttgctaaaaatattgtgctaaagtttagcatctatta

SEQ ID NO: 3034 - DNA, 1165 bp, Zea mays
  misc_feature (1)..(100): optimal_loci_172571_G1, chr5:1325629..1326793, Cluster 18
gtaaaatttctccctctctcccaactgtattttcattcacgataaacattacgcttcagtagacattttcaatatcacattttaatcactagacatacttgagtaatgagctacatttttttgcctgtgtagtgttgcgcacactgctaacgtcagtcatatgcatcttgattaacaaatactctttacctgctgttcataaaacagcagctatcagaagttggttttgacttactggaagttttgtagtatatattgataaccttgcagttacatgttagtcacggatttaaacctaacatcttaagactttgtgtgtgggaaccatgagttcaacactagagtagcgttcacttgtttcattacaacaaactatctgtttttttaaccttttcaattcaggcacatcttaacttttcttttttgtccgtatgattttttacgggatccattcaataaaccaatgctgccagtggtaactagctggcaatgtagattccctgcttttgtttgttaatttgttttcactacacaattggtagctgtggtgtatcacagaagaattgcttagcacatgtgcaattggtattttatatttggtttggatcactattctgaagccaggggaagaaataataagtttgtgagcttactgtggtatgccattgttgataggaaatattgcccattatagtaataatactgttcttcgcttcttgcaataaactagttaccaagacatgggtgttgaggatttaccaatttttctctgggtttatttccatttgctacgaaacatagggtgttaggatttaccagattttcttgaatttaagctgatttgaaagttgaaaccaggtatccattttttttggtaaacactgatccagcattcttttttagaatttcctagttttgtatgtatatcgtaaacaagtttgaaattctgcatatttggtgtatgttggtgctgcgtgttgattttatatatccttttagagagcattgcaatatattaccagtgatgttatttttcatttgttatgatgccatagttttaccatctgaatctttgttgttctttctttctgtttgtttatgttgtagttgttcatggtgctctccatcttttaacttgataataatgatatattccatgatttag

SEQ ID NO: 3035 - DNA, 1001 bp, Zea mays
  misc_feature (1)..(100): optimal_loci_173336_G1, chr5:5437613..5438613, Cluster 18
aatagtatctaaggcactctcatctatattttacggtctcacactgatgtatagatataatttgtgtgaagaattatgttatggaaaacttcatatgtacttgtatcattttatgatatgattgtaatcgtatatcacactcagatgcttctaacatgtctggatattatgatttcagttgaatatgtggatgcattatcattcgactattgttttgtgttataatttgtgttattggaaatctatgttctgaaaactttatatgtacttgtatgacacaactgtaaccctctattgatgtgtgttacactcaaattatggttttctacttccaaatgtatggtttatatatttttgtacatcaaattatttgtgaatatattgttatttattgtgcaggtgatttgaataaaatacagacaaattctacgatttttattttttctaacaaaactgtgtttttcggacaaaaatcaccggaattctgtcaataagcaatgaaatccagttagtcaaatttgataatgtaaatcgatcgagaaatgcgaaattcgggtaaaattcggttaaatccagtttttagaaatagttgaaatttgaatcgaagaacagtatggttaacacttaacactgtcactgatgcaaggaccttaccaactgcggtgccgaccgttcgaaccgatcgattccaatcgatcgacatcgatcatagcattaaatgaaccggttagtaacaaccaactttaatgacctagtttttctgattagtctacatatgtgatgtagttgtttttttaaccatttgaatttcaaaaaaaaaatgaaaaccatataaattacttggttttatcttatttacaatttattttgttttaatatttaagttacatatttttatttataaattacctagtttaaattattatgctcaagttatttaatctttaatcgttgttacgattcatatattctatctgtttaattatgtaatcagatgtatt

SEQ ID NO: 3036 - DNA, 1374 bp, Zea mays
  misc_feature (1)..(100): optimal_loci_174450_G1, chr5:12287191..12288564, Cluster 18
attcagatactctaaccactcctagagaaaataaatacagtatgtctatgcccaacagtatggcagtagtgaaattataaagttctgcaaaaatgctaatcacatagagcacctacaccaagatatatatcataagacaaccaaaaggaccccactagtttgtctcatgaaaatgcagtaagatattcatcaccaacatacaaggagccaagaggttactacccttagggccagtgagaagcagaagttgaaacaaacaacaagcttttggagcttcttttgtggattctcgtatgttctaatggttagcggtagtgatattccatatcttatacacttcatcatacagaatttcaatccaaaatcaccttttccaaagtcacaatccataataactttttaaaatgttacaggcccttacaaatatagcaaaatgtagcattacgtgcacaagagtccatgctgcacagctaaaggcatttgttgcccacactaagttttcaattgaagatacaaattgccacaccgaccgcatgcaatgatttaataaaagaaaaggagacatactaatgcacacaaaaaagatgctcttgattcataaaaccaaaaaaactcaggttacttattatgaataagtagatgttcagatcagttattcaaccatttaaaatatcagttcgttaacaatgtacttaatcattccatacaaaatgtctgttaagatcttgagtcttgactcatctttgtttagttgaaagtgaatcttgtttacccttttcaagtttttcccataaaaaacaattgatggtggtttagttgaagttgattattcaacctattgttaaagaaataacaatcaaaacactccttaatacagttactgttccattacttaacagacataaaacatttttcaaactggaaaattgtagacaaagttattagtggaatattataatattctccatccaatatatagagcactaaggcattagacaaaactatcacatcctcccaagtcagtgacttcttctgtagcctccctgaactgaggtttgtggcacagatatttggtacgaaaacgaaaggctacctgaacttctcaatcaaagggtcatgaacaacgaatgcaatatacttcatgtgatagtaggtcttgtggttcccttccaccttcttctttggctgtcgtggaaagaccccctttagaatgcatcgataggaaaatgtcaaaaaatgagctcaaggattcgaactaccatcttaagtaatatgtgacacacgagccatgtagaagacagtgactccataaagggctgaacaaatagtggtaattaagctcagctggcaaaataactgtcaaaaaatgactaa

SEQ ID NO: 3037 - DNA, 1157 bp, Zea mays
  misc_feature (1)..(100): optimal_loci_175039_G1, chr5:15554850..15556006, Cluster 18
cgagaaaatattttgtgccaccaaccctcaaacggtgtgggagtagtaggagcatctcctcggcccaccagcccccaccaaccatgaaagctcccatccagctactttttttttcttgaatctggcttacatcacactcaaaacacactgcatgagtgtatgcgcatcgtcttcctggttcaaccaaataaatgtaattcgaactcatagattggagttggagctgatctcccatcataatcctcataaaactactagacatgaggcgccccacttggccactttagggcccacatgggaggacaaaatggggccgtggcagtggtggtaggtgctcctacctccggggttggtggttgacggatgacatgaccctcccaaccatttttcctatacatctctacgttctaatatattttactatctcatcttaaaattatcttctcacatatatgacgtctccaactatttctttatacaacttttcatatatacatctctccttatattacgttctaatatattttactatctcattttaaaaaattctcctcgtacatatacaaggtttccaaccatttccttatacacctcttcatatgtattataaaattcaactaattaacatctatttacattttttaaaaataaaaagttatataatatttgtactatcataatatattattactatattaggagatttaaataagattaataccgtaaagaaacgactctattaaagtatagaggaagcttcgtactctatatatatacagggagattccttctccctatagatacgaggactccttacattgaactgttcatactgtatgtacggttaggaatgctatttagtgcaccgttggaggcctgtttgatttaatttttagtctaaagttagttcttcaatttgacctactaaacttagacattgtggcccagcctccgtgtttaccagcatgttattaatcaggcaaaagttgacctgcaagacatgccatgaatctcaaaacaaatgcatcaggctgacgtgcagcccctgcagcaaaaggcatcagcgaacgacaactaccaattaaataaacgaaacaaatatataaacaatctcctcaacccccgcaagtcccaggagcatgtcaggatcaaagaat

SEQ ID NO: 3038 - DNA, 1361 bp, Zea mays
  misc_feature (1)..(100): optimal_loci_176826_G1, chr5:24728782..24730142, Cluster 18
tcgatgttcggatggtcgatattcggacgaaaaagtaggaattttaggtccgctctctaaaattaatagttagctactaaaaattaaaattagttgttaggtttcaaatatcatcaactaatatcgtaactaattactatctacctcacagctaacaattagtttattagctagttcaacctagctaataatttattatcttactaactattaggtctatgattccagacatgaccttaatctgccaataaaaaatagagtgctcaatttggaaataactttcccttgatacgggcgtttagacctatgtttagatccaccctagttttttaaaaagtgctttttatatttggtttctagaaactggcttttagaagggaaaaattaagagaaggtgtttggattcatctagtttcttagaaaccggttttagcggggagaaacaaacttcttggttttaagaaactaagaaagtggtttttagaaactgaataaaaactgacttgtttggagaccttctagatttaaaaaaaagtttctaagaaactaggtggattcggccctatttgggagggtttcatatcaagaattgcagcttcggttttccagcttcaccataaaacgacttcaacagattggtaacacagggttcaagagtgtttggcttgcacatagacttcaacttctgtaaaacaattaatttgtgcggggttccttaattatccttgatgattagctggtaattaaagagacatgaatcgataggtcatgtaaccaatggcatggtgggtaatttttgtgcaacttattgtggaggtatgaaaacaatgttttttaggagcttcaaaaaatttataaaactggcctctagtatcattttttttgaagctagagctcatggagttggacctatttgatagaaaaagttaaaataaatctaaaatttttgaagtggagctctcccaaacaggaccaattgatagtttcactatcatcgactacttctaagattgccacgtcaatatttatctaagaaatattgtatccatgaaactctctcatctcccataagagtcttgcatatctctcttcattaaattacataccatgtcatcatgcatgcttgagtggcatgttatttaatgagagtgaaacactaatgaaatgcccactaaaatttttcttataagcaagtggttaggatattccaaatccctagtaacatactcatctaaggccctgtttaaaacctttagagctaattgtttgccagctaataagttgatagttggttttatctgggttagagcagctaataattaatatctatttgtagggtataactaacaattagttgatct

SEQ ID NO: 3039 - DNA, 1258 bp, Zea mays
  misc_feature (1)..(100): optimal_loci_177360_G1, chr5:27770554..27771811, Cluster 18
tagtgcagacacaatctccaagattacgtccaagacaaggggacaacttatgatttagaactaaacttaatttggaggaaatttctagtactctaccgattgatttagtcagtgaccgaggaagttgatgacatcgtgagagtgttgcttacaagtcaccaaaaaaaaaagggattacaatgtcagatcccttacatcaatgcctaaaaaagagtaataaaacgtctttgcaggagtcgtaagctacaataaggggggaaaaccaacttcccaagctaatctgcgttcccccatgtttaaaattgtcaatctcatattgaaggagcaccgaatgtgtagttgggctcctggccacaccagatggcaatctagttctagaaaaagagcgcgcgacggtgctccaagtagatctagcatgactacgttctctgcacgtgttctagactcggtacgacacgctgcacgtacgcgtgcgcccgcgtcaagtcgcttaggtaggcgaagatcgtgctcagcgtgcaagtatcataaatctaatcaacaacaccccaatctatcgattctcaaacaattaaacgtacacgtgcagtacgtacgaccatattgtgtttttattgctaaatttatatatatatatatatatatatatatatatatattatttcgaagatgtcagatgacttgtatagttttttttaatatgctagatgatcgcacgacctgtttatctgaccatattatatttggtaaaaaaaatattatatacattttttatcaattgtatattgcatttatattgtgaaaaaaaatggaagacgaatccatccgttgctgagaaatgtattctgttccgagttggcatatatgggcctgttggttgctgcagtagtagctgctgctgttttatacagtagcctgcctgtgaagggcagatatgcagcaacagccgcccgcttgaaaggcttccgaacaggtggtttttgcttgtgttgagcaagccatcatgcacatggagagggaaaagagagcgacgacgatgggcgagagagtgtcgcaattgcgcggcaactcagctgaggaggtgatccaccgttgaaagaggcacaaattaaacggtagcgacgcctccggctactagtactagtgctgtctccctcaattcctaaaagatgctgctgaggtgcgtacgcgcccgttgtgctttcggcataaactatttgattccgacgcgcttgaggaaggaaggaagggtcaaggg

SEQ ID NO: 3040 - DNA, 1345 bp, Zea mays
  misc_feature (1)..(100): optimal_loci_177641_G1, chr5:29051211..29052555, Cluster 18
tgatacaagagctgagttgtatatcatgtctcttagttatctcttgtacttgaaaaacagatagatgatctcagggttgtatgtatatgtcctaaagcatcagtttccacggttttccaccatggtcgtactctcccgcattaatttaaatggtaaaaaagttcaaatgatgcacaaataagagtttgaaccgtgattgttggcttcataccgacattcacaaccacataaccaatagaacacacatgtctttatgttttattctctgtacttagagatggaaaccatagcaacatacatacactttaggttacagccaggcttgaacagttcgtttcgggcaagaactcatgtttctaaacgagataaggaaattaggaaaaagacacaacttcacgttgtagtcctgaaataaaataataaaataatgtactaattaaaatataaagctgccccgtaaccagtgtgacttgttgcattattccatataggatgggctcaaacaacacggatgagataggagtgaaatgtcaaagtaatcatttggagagttgggtgtggctcagccatataggtgtaacctgatctctacaaaccacacacagaaagtattcggaagtaaacgcaacaaaaatcaccaaggaaactcacagaacgaaacagttctctaaaagcactcgaaacaataatcatcgaatgacgcctactgtgtagctgcttagagttgaaacttcaaaatgacaacccactttattcaaatagctagaacgaattatatatattaattctgcagcaaacaatactagaaaatgctaagagaagcgacaacaatagtgtatgcacagtccacggatgtaccccggcacgccactttctgttgtctctggccgatactgaaataatgcattgcctgttaacccatgggcaaacggcgttaggggttagcagcctactactgtttgagtatcggtaggcaaacggcgttaggcaaatggccgataccgatactgaaataatgcaatgcattgcctgttaacctatgcaaggagaacctctcccaatggccgatcgatagatcactcctgactcctgctagtactttacagccatgctttgatttgatgtgagcaggcacagcagacatgagtgatatggaatggacatctaccggtcaatctcctttttctttttttgggatcaagattcaagaagaaataaagcaaagcttgcagtcaggctcagcctgcaatactagtatatatcacaagtgctaatacactcaacgattagctactctgatctagatgtgtttagaacgcatgcatttgctaatccatgtttaaat

SEQ ID NO: 3041 - DNA, 1280 bp, Zea mays
  misc_feature (1)..(100): optimal_loci_198225_G1, chr5:163735955..163737234, Cluster 18
gctcaggctttagctgacggtcatcgatatgccctaggcaagctgcttttgggcgaattgtatacgaacttatctttagacactagcaggatgttgtgggtagagaccattaaagcaagagggccatggtgtagagaccattaaagtaggagggccatggtggtttttgtaactctaggtcaaactatatttttagcagtacatacctaacttcctaaggctacttagcacttattccttgatccctctaacaaactaatcatatgcacttctttgggccaggctctgtttaagctatctagggagataccattaaagcaggagggccatggtggtttctgtagctctaggtcgaactatatttttagcgacacatacttaacttcctaagactacttagcacttattccttgatccctcttacaaactaattatatgaacttcttttggctaggctctatttaggttgtctagtagttgacttgctgacccatcaactctagattagttttggatcttttttgaccaaagagatcctgtttttgatgtatatgctagctcgaatgagtttaatacccccttccttaagattggataacttcaaaggtgatgagaggatgagtcatgttttaatttttattgtaattcacccatgcctcctacctgttggcatgagttttgttaatagagtgaccaaaccaggttatgaatcttaccatcatatagtagctgcttgccaacttgtcttctttcatattttagccttacattctatatttcaatatggatcctaggtggagtctaaactttgatatcttcagttacttgctcaacaagcaactcaacgtcctaagactcctgccaacacaagccatgtcttcttcaatggtctttctcccacccatcatcatcaataggatgttcctgatcatccccattctcttcaacctctgttttcatattcatatcctcccctccatatccatactcatcatctatggatgctcatccttcagccaatgaaaatcctaccactgatgccccctcctacaaccgaagcttctaccatcgatgctcctcctcctcctcctcaaccttctgcttatccataccctcctatatactcgtatgggtatccatatggtgctccttcttatggaatgtatggtgctccacctccatatgctactcaatatggtgctcctcctccaaatgttgcttgatatggtgctcctcctttgtttgctcccccatttagtgcttgtcctccattctgtgct

SEQ ID NO: 3042 - DNA, 1159 bp, Zea mays
  misc_feature (1)..(100): optimal_loci_200929_G1, chr5:178740989..178742147, Cluster 18
cttagagaagatttttctctattctaggagtatctctagtggtactaagaacttcctatttcacggaagtgcttttagctcaaacatgcataggaagctattgggacacatagatctagatctgtagaatccttgtgttgtattgcaatatgatgagataataagatttgaattaactaattgattttgtatttcaatttcataattaaatatttttatcatcttcaatacaaggaggatgtgcaccagtaggatgatgtggggcaagagtatgaataccctgttagctaaggggagacaaggacgatacaccatcgaaaagtgagatgacacggatgagcactgtgacgactaggggcatgacttctaggtaagattattatgtattttctttggtgactaagttttttggactacaatgcatatagttccttattgcacatttttgtagctatgcttttatttgccagtggaaataaactatgtggctcatgcacataagtgtttcactagaatgcatggaaggttgtgaaggattcagtgtcctatgaccgtatataggcgtacaatatatattttaaggagaccctaaagcaactgatggacaagaatcggggatcttcgtccatttacttgacaaaggatcaatttttaagataaaacttttttagatattttgtcttaaacccccaacacaatattgatctaattataaataaatatatctatgtaggtgacagtttcttatatggtgaattgtcagaaggcttatcatgctctttgcaaactctaggcttcaaaagagttataggatttgtctaaaatgaatagatggaaccatggtaatgatcacgaagcacatttatagcaccagcaaccatattcataaggctaaacctatggtaagttgtattatatcatatgtttgcaatgactacaatatatgatttttctgtacgagaagctgtcattggagtaaccccaagcgatgttaggtttatatgactagacatcacataacaaactcttcaaacctagagcatatgtgcagtcagttgtgcacaaatcatttagtgagttgtctacacttagtatttattgaataaaatttaattgttaccttgcttgattggtttgtgcttcaatagcaatataattt

SEQ ID NO: 3043 - DNA, 1055 bp, Zea mays
  misc_feature (1)..(100): optimal_loci_202888_G1, chr5:190246561..190247615, Cluster 18
tttccattaatgcttttgtatatcattcaatgaagcaaatcaatatattaggagatattaatgatcaaaatagctttgcttatatatgcacctttcctgatgcacgaactagtgagccaatggttgagttatataagttttgagctcacaatcaagtttaggttcattcattgcattgaggacacaacacacatatgacaactttgattacttgaatagttgattctaatagttgtgtattatacatatgaatggatgcaactaaaaaaataaaaatctctagaaagttaaaacagaacaccatagctatggaacaagtttaaaagagactaatggtactatcttcattgccaaaataaattgattattagagttatcatgagtaaagtaaacttagatttgattgtactttgccaaaaaaataccaacatcattgacactaaatatatattaaatattatatctaataatactaatttggtacgttaatattagagatactttattttttgcctatccattattgcctgagtttgtttgcatccactcaattctaaaaacgaaatctttggccatcgaactataaatattgaacaagtttggcaatattgctagtgttaacgtggttttgtatttattgagaataattaaaactactttattttctaaaacacaaaacgatttttttaaattagaaaatattaacctaattcataatttattaaaaatattatttatctcgtgctactctacttgattttttatttctcaatttcttttctaggttttaattgattgaataaatatttttcatttatttaaatcattatttcacactatagtatgtacaacatagatcgtgaaaacttatagtagattccaagtaagcataagaaaaataacaccaacattgcaagcgccatgctctgccgtatatactcgctctgcctgaaaaagataccattctaaaataatgcataatcaaattgtattaagtttcactcactttatgtaagaaatgatgattatcttaataaataagtaatttagatgat

SEQ ID NO: 3044 - DNA, 1293 bp, Zea mays
  misc_feature (1)..(100): optimal_loci_203542_G1, chr5:194099177..194100469, Cluster 18
tgttaatccgtctgattggttgctcacatcgtctcattttagaccactgtatttattgattttatctgaaattatgtttagttacctgcatataagagacaagagacgtgtactgtataagagatataaaataagttattttgcctgcatctagcggtaagcttaaatcatgtgtatccggccggtcaccctcccgagagtagcgcgcaggcatccaatcagctccaatataactgcaccctgcaccactgcctctaaacttctgaagtatctccccttgaagtatcttacagaggtagattgccctgtgccaaaagatatatgatggtgttgatatgcctgtcctgtgttcttcatcctttttttactctttttcgtcattcctttataggacctgatacttagtaacaccttctgaccactattaggacttgtgaagcttttcagactcttgctattactttatatcttatcaattaattgttgtatcctatttgatacaattcatcagctttaatcaagcagttttttaagcagagctggtttgaaaaaactatttaggaaaacatcactaaaagttttatgcttaactgagggtgtgtttggttcctttagtaacccttctaaattttagaaactaaactttagtccttaaaatttgtatttggcagccccgttagccattctatttgacagtttagggactaaaagtgaagtgggaaccaaacactcaccgagaaaagggaaataaggagagattgaaatggatgagatgtgaatttttttagctttgtgtatctgtccattcctttgtaagagaatcaaaaggtagttttacctatgaaatgtagctgttttagaaaaaaaatagctttacttgtaaagttgtttttaaaaaaagattaaaatgtgtttaataaaaaacagatcacaacggctcataatatgtcggatgaaactgtgccaaagatgggacttcgaacttcgatgttgaataatctggaaatttgctcttgaatgtcacagattctgtaacttccccttttgaaaatctgcagttttgctcttggaagtcaggacgtagtaccctctatctccagcgtacatagtcgtcaaagggactcggtttaaattgttactacaacatagacaaaggtagaacgactttagtctatataatatatgcgtagcctgcaaccgactcgtaagttcactcaacaattggacactcgctaggacattgcagggttatgtaagctagatatgaggaaatggatacataggaggtaggag

SEQ ID NO: 3045 - DNA, 1343 bp, Zea mays
  misc_feature (1)..(100): optimal_loci_203859_G1, chr5:195673686..195675028, Cluster 18
atagcttttttattttctatatatataaattaatattgatgaatgtttaatatgtttatgtaaaattattaaaatgtgctcatacaaacgcacaaataacttattttagactgtgcatatgtccaaatgttcaggtagttcttttttcttcttaaagttgagacactttattaaatttaaggagtattacatatttttttcattacaaatagacaagaaagtttcttttttgtctcctttcctttttgttgtcactgttgtttctttagccccagcttatttttcagcacaatttattcttcgtctctaactacgatctctgaccttaggtgaagatgctctcagccaccaacgaggctttagcgcaggaaataaaaatatattcaaccaagggctagttggtaattggactcattttcttatttttgtgcctaagggctagttaatgtttcacattcttctctatgtcacggagatcaattttagcacggtttctatgaaaaacatataaaataaaaaaattgagtttaaagttaattgaggtccaaaataattgatgtagttgttaaaataaatagtgtaagcattataaacagcaaacaaaaagaacaaatgggaagaacatgaatttacgagtgtgtaagaaaaaaaaatgcaaactctatagcgaagatacataagaataatgcataagagttttcgatgtgctcagctagagaataggacatcactgcttgttgacacgaatgagaaatgtttgggggaagaccaaatttataccaagaaacattagtgcattgggtgggaatataaagttctggaggagaaccgaagaatatttagtcccggtaaatttggacgggaaccctaaacttctaagtaggaatagaaagcaaatccttttaatatcggttctctgctagaatcgctatgaaaggtgtatctgctttttacgctagcttgatgatgttcttgagtacaggttggtgcgacaataagagttgaagtgtagtactggtactaaagatatttctgcatgcatgttagtaccagttgatagattaactatgtactaaagacttgatattagaatcggttagagacctgtactaatatgctcggaataaacttgacatttaaaacccgtactaatgatggagtcggtatcggttttaaaaacataggaacaaaagttgataaacgaaatccctattctccaactgacgtccaggcagccaacggccccgagagagcactacaggatttactgtaaagttttttgtattaaaattgcttttacgtcgtgtacgtacatgggtgatggaacggataagaaaaaggtg

SEQ ID NO: 3046 - DNA, 1323 bp, Zea mays
  misc_feature (1)..(100): optimal_loci_205133_G1, chr5:203032397..203033719, Cluster 18
acactctgttatttagtatcatatcggggccaacataactgaaatattgttcgagattaatctccccgacatgaaggtatatcctttctagctgcggcattaatttagcaaaaaaaacagaaatagaaaaaaatacacttgttgatccagtaatacaatgtgtttcttcttataggcccaactctaccagtaatacaatgtgtttcttcttataggcccaactctacaatcataataccaatgtccagctcaactctttctattatccatcttaaaacaggtgggccgatctatgatgccatggcctgtggtagcacgagcagagagttgggatggcccagaagctcgggcggtgcctgaagtatgggtctatggcatggtgaaagcatgataaattaacaatggacaagtgctccaattgtgggaatgtttgatcgataccacaccgtgtaatctaatctaactcaaaaaatctttagctgagttataaacatccgaacttttaaagttgaagaaccaatctgcctcaaattcccattggccgaaattaccagccttactccactagaatacatcctgataaaaggcattataaacaattatatcatggaaagggagaaatctagcccatgtttccaaccacacctttttctctctttttttccttttaaaaagacaaggatcaaagcaaacactagcttttagaatctagatccaagcacgtcctatacatttttcatggcctattggtccaacgttgctttcgcattatcctcaatcatattcacgatatggataaaaaaacatatgaaaggtgaaaatcgcaaatgcaacttgcaaggtagttccagccgtcccttcgtttgacgtgggaaaggacacgagaatcaggcaaagacatgcttgcagatcggcgaccaccacgacctcgatcgcgatcgcagggcacaccttgaaggcaagcacccccgaataaagcgccggtacgatccgattcattccacgaaagcatgatcatttaaacatagtccatcaaacacgattaagtttaatggttgtaccgagccgatctagacacgatacaaagaccggctaattgtactaggctggtcatgacaccaccctattaggatagtattaggataggtaacggatcacgatttaaatgtctctttgtttgaggctttaattaattttagttttaaatgaatagaaatagagtttgattctaatacaattcggttctcagattctatagtataaaatttttagagcacattatcacccctacagccgatacgatggggcagaatcaacctacaa

SEQ ID NO: 3047 - DNA, 1326 bp, Zea mays
  misc_feature (1)..(100): optimal_loci_205423_G1, chr5:204830016..204831341, Cluster 18
tgccccgctgtgaagacggtgtggaggacacactccatacgtttgtgttatgcccagatcgccgagatttggagcccaactggcatcagcattgacacccttgatggctccacttgctcctactccaccattctgtcgaccgccatatctcaaaagtcatatcataaattgttcatgatgccatgggaagccaacaatgtcgttgtctttagatgagactaaaactctgttaaggatgtcgctaaaaaagttgtagaggatctaaaaatttggcgccatcgatttcttgttgagggtggattggaacttgacctccgagcgtatacatgcacgtgcaaaacactgtcttgcactatagattgtacaaagtgagatttaaattagggaccgatataggtgtgagatatgaagtatgtttttagataatctaaggtcgagcccaatgcaacacattaggtttctatgtataaaacttcaaatcttagtttctatcttttagtcgtccactcgctctccccctgtcggcccctaggatgtatgacaccccccttcctcttcaacaacgccctctcacagccaccagaaacaggggagcaaggatgctcatcccttcaggtcgggggagttctagtctcccccattcattaacaaatgtgttttatatgtgaaattaatctattttaagttccataacctcataacaatgtgtattgcgataaaataaatattgtatactttttaaaaaacttcaaaaaatgatataaaatggtaaaaacctaagttatagtgtattggggaggtgagcatgaaaaacggtaaggaaataggataaatatggagaaggatcttttaggggaatgtatttaaatatgaataaaaagtataaatagggggatttgataggagaaacattggatttagtcttactagtaagatgcatgtgattagactttgttttaataaaacataaaaataaatgtgttctgtttgttaagcgggtgtgaatgtgaaaatcaatgaccatagttcaaactccaacttgtgcataattttatttcatttttgcataaagcgagaagtagaaatgtgagtgtggaaccatggaaactagtgctttatatagtgtagataacacttttgtttctccaaatctatgtccacttcattgctctctcacaggaatcctctccatgcgatagttctcctcgtggtcgagtagcgcgcagggcaaaccacgttggcccgcaacagctgcgcacacggtggcactcctctccaatggcgatgatggaagaattagacttgattttccaaaaggcatgtcga

SEQ ID NO: 3048 - DNA, 1006 bp, Zea mays
  misc_feature (1)..(100): optimal_loci_205766_G1, chr5:206570383..206571388, Cluster 18
gttgtgcggttaggagtgaataaactcagttggccctgcattgagggggtgtttggttaggagtgaataaacacagttgaccctgcattgagggagtgtttggtttgagaaatcactctattcaaaatgaggtggtgcatcataggtctatttcctagtaaaaataaggaatcactccattcaaattgatatatgctaatacttccttctatttgattgtctacaagttcgtaaaaatgataaatcactccattcaaaatgaggaatttgattgtctgcaaaccgtttaatgctcccatatagctatgatcaagtaaaaatatgcttcctatataccattctattgctagtgtctagctgatgacatagaccaatatttaactcaagctagcaaaaaaaccgttcatactagttcatcaattgctctgcttctagtgttgctgttactgttacagcatcaacaaggttatatccagaaacctgtacaggtaccatcctgatgagtgcactaactgaaatttcagaaaatatgtcaagggatttctgtatatgaacagaaacctggggaggtcactgcaagtgaaatgcacaagtagagctaccacttgtcatcattcagttcactagaaaacaagcaaacttgccattgcacattcagactcacactatcaggtaccatttcacactgccatttccagaatcaaacagatacactagttttcagataacgatagcaacaggtctcacagatagagtaacatacatagttaatgagtcatgatggcaacaataggtaatgagtagagtaatgatgtcggattgccgcatcagtttgaaactcgccttctggtttttcggtttgatttgagctctttgatgcagtatcgttagggtcggaatcagaattagaacttgcatcgaagctgatgccgtactctaggtccgattccatgatatcatgaatatgcacgtaatcaatgatctgaaggtaaaaaacacaagtgag

SEQ ID NO: 3049 - DNA, 1330 bp, Zea mays
  misc_feature (1)..(100): optimal_loci_205826_G1, chr5:206908545..206909874, Cluster 18
ggcatgacagtctccttttcccaacttcacatatgatgtacaccaagttaaccttttaagttggttaaagttttcttccactatcaatataagattaaaaattttatcttcctaacatttattatgggtcatgaaatattaaaagaactaaatgagccttatctattatttaaaccccctaacatttattacggatcatgaaatattaaaagaataaaatgagcatgatctattaaccccgacatgcaccctcccactcctaaaacataaaataaaagacttcagagaagagagaagtaattttctaaggccggttctagtgagagttttttttgtattcaataaggtgtcacataaacgttttttatgatgtggcaatttttttaataagacataagtgaatttcacgaggacaaaactcttttggcacgattactaactctctacatatcataaaattagacatctataaaaaataaaactttctaataaaaataaatattttatctagattttattttttatatgacatctcaatctcgaaaaacgttataaaactcgttgttgatactatcaaaacttgaggagagaaagtagtgttattcgctgatagtagaaagtctatctatgtaaggacctatttgggaatatagtatttttagttccaagatgatactgtggtatttcaacataccataatattttagaccaaaacatgtttggtagtacatttagaaatattgtacatctaaaatattttggtctgaatcaaagtttttcattggcgtatggaaagcgacggctacggtcttgccctttcttctctcctacgttgcaaccaaaatattgtatctttaaacagatattggattaaactaatataaaatatatcataattgtatcatgtcgctttgtaaagtatggtaatataaattgtagtttaacggtttgtgtgggagggcttcaatgcttcactttaagaatttcagcttcgttttttcaggtttactataaaataactccaacaaattattgatgtgggttcgagaagtgtttagcttgcacataaactccatcttttgtaatacaatttatttttgtgagtttttttattacccttgataattagtggttgtcacgagataaccgaagcactatgttatgtaactagtgacgtgatggtcatttctatgcaactttatgatgtatgaaaacaatgtttgtgaagcacattttgaagggcttcattattttcatgaagatgacctatagtttcattttgttttcaaagctagagcttgtggtgctaaacctatttgaatggaagaag

SEQ ID NO: 3050 - DNA, 1130 bp, Zea mays
  misc_feature (1)..(100): optimal_loci_206931_G1, chr5:212354811..212355940, Cluster 18
gtcgctcccacctatatcaatcaaggctttgcttggttgtttgtctagctctagcaaactatatttcttacatcaatattctaaccacaacctattagttcaactaagtcaaactttgaatccacctaacaaattatcattatttatgtcagctaggataaatcaactaatagttaattgcagaggcgcatccagtgggtggtctaggtgagccgtgtcatatcctaagccggcccaccaaaccaccagttcacctaggcccaaaaaaacctgacaccaacaatgtattttatacttgatgtttggattattttatgttgtatttatattctaaaatatgcacttataaacttaaatgttaaatctatagtctcatacgctattattatctttatattctgaattgtatgacaaatcattatggattatactaaattatttatgaaagaattcctatgacatatctcacgaagaaatcctagctacggcactggctaattgttagctgaattgtagggaagatgttaattagattattaattatggatccaaccaccgagaccttagctaaatgcaagtagttataaatgttattagctgtgtaggatcagactagccttaactatgtccatatttggattgttggatatgattctaaaatctagactcttctttgatgtttttttagattttgtgcttgcgtgttagaatcctctataattttgaggagccgttgggtccgcaaaggattatgagaattcagatttcagctagcgacttaaaaaaaagaaatctggattttgaatagtgataatcagttccatctggatctcagattattatactattttcggatactagattcactgcagagaagaatgtctaaaatgtccttgggctttctacacttcttgcatctctatcgcacacgcgaaatattaggactaggtgtctgatgcccaagatccaatcagattcgtacatgcacgaattcgaatgtaccacacggattatggatctttggtcccaccgtcctctagacgaaggttgcgtgggcaataccgtctctgccgtaccgttcggtcaactcaacgcccgcgaccctccctagtctccttcctgtccgacgg

SEQ ID NO: 3051 - DNA, 1158 bp, Zea mays
  misc_feature (1)..(100): optimal_loci_212402_G1, chr6:29015031..29016188, Cluster 18
ctattttatacacacacggcgcccccagctatacgtcactgcttacgttaattcccccaccggatagtagttgtttaatggcccaaacaaaccttgttgttgcatgcatcatggaccaaacaaaatacatagttagttaaatattactgttatatatacaactaataataattatattattagttaaaacaaagcaaggcatatgcagcagctgctggtactacccagtacatggcacatgcgtttgtttaatcccctgttgctgtgtgtgtgattgattccttgtattagctaataattagttaggtcggtcgtcgtctcccctctaatccctcttcgatttagaattagtagtcttgtacgttgtttaatatgcttggacgacgacgctctttgttgggtgtgcacttcatctttccatctacactagctagctagacacacatgtactatagctagctacttgttttagtatgctgctcttctaattaactaaccaacatgattgcactgctaagcaaggctacctttggtacggtcttaaactttgtgtggcccatatgctgctatactatatcatgcatgtagattcttcctgccaaggtgcatggtttttttatgttaataggtacggttagttgtcgtagtacatactaaggcatcgatcgtccacttatatatatcaaaccctgcagctcaaacaagctgcaaataaaaaaaaaactgaagctggtatatgagtgtatattgtatatgaaataataatgcatatgcggctgcatgcatcagggagctgagtcagatgacaggtgtaggtttgaagcagcttgctgtacgtgtgcaatttttttctctcataatgatgtctcgattggtgatctgatgacgctgtgattattctattctattcatctttggttgtagacactccttttcatttgttaatagttttctggtccagttgatagatagaggttaaataaaagccagttgtagtctaccttaactagtacgatagtacaacaggattggccggcggcgttagtaaatttataatttcgtatacaagctgttattgttattacatacactagccggttactcgtgcttttctatagttgttatatattatataaataggtattgaaatatttattt

SEQ ID NO: 3052 - DNA, 1014 bp, Zea mays
  misc_feature (1)..(100): optimal_loci_221139_G1, chr6:87679989..87681002, Cluster 18
atttataaatctggtacggtatacaaaatgatactgttcctatttgaataaattgatgataaatctatttatgaacattaatcctgcgtagccaagttatcttttgttacttgtttagaaagttggcaaaagccacttggcaaatggaaagacacgcatttaacaaattcatgtgttactaggttacatgctcgtgcgttgctatggttgcttaaaattggttctaaacagtgatgcaaaaacaaccgaaggtgtatgtgccaaataatagtcaaatgcccaaattttattgatcccataataaccgtaacattaacatgtgactaaacaagaagaaacatagacatattcaagaacattatccgtagattattgtggtttagaaatataaatattctaagtttgaataaaaatcctctcaaatgtatacctatcttttttttcttcgatgaggtcaagatatctccgaatatttttaggcttaagaaatcgacatgaattcacttcaagttaatagattaatgaagaagatgcgtcgtagagtcttgccatcctgtgcaatagtagggtattacgaatgactatttcgtcaacgatattattattattataaattgcaacatgatttatatgtatatgcaacaaaatactatactcaccatacaatgttgcatttttagaccactattccaccactccatcgcttgcataacaatgtagctaggcacatttttattttattttcaattttattttatttgtaattttcattgttgtaccaaggaactcgtaagcatcaaactaatgatatcccaaatataccattcaatccttgaaactacgcaagtcctatagaaataatacaagctgcaatctaagaacacataccttttgattggtatctgcacacatctatctagtctcaatgcatgtgttgacctaatggcaacctttgtttggttaacgacataaagtgagacgaaactgcacccatagatgcaacgttggctaaaa

SEQ ID NO: 3053 - DNA, 1270 bp, Zea mays
  misc_feature (1)..(100): optimal_loci_223945_G1, chr6:103352284..103353553, Cluster 18
taaataaagtgtagcacgttacgataaatttaaaagacaatcattttaatcgaaatgaagtgaatacaattgtgaattatgtaggaaatctcccaaaccagtttctcagagtagcaccttgtactcgatagttaaactgttgttggagcatggtggcagttttggactttggtgtggactatcgagctccttttcttcaactgtaaggcaggttccaatgggacccgataccgaccattgacgtctcggtcctcttggcaactagtgtatagcgcgctcatgcgcgctccttgatcgcttctacctccatctcattagatcagggataaaggtaaccagttcagtaaacacagatgtatcatctaaatgattcccctatctctccttttactaaagacccatcctgcaacccacccaatacaaaggaatatacatgtaaaaatctaaaacctaattaaggaatagaaagagcatcaatcatccgcttctcatgtattatattctttatttgcataattctagcttcctgtgacaacctttttaatgcagaactaagctgatctttttaatgaaattcctcgattgtatagaacagattacatctcgaggcaggaaaaaaagtttggcggataatattcacgaaactctacactatttatttgactactgaatgagagtctaggggcaatctaggggtgtgtaacatgatacgtctcgaatgaatttaacaatgtaaatttagcattttttattcaactattcggagttccttcagaacattttttagcataactgacagctgcctttttcataacatttactctcatatggcatttcaaatgtttcgtaatttagaaaatgttgattttaagctaacaacaacctgatgtgtataaagcaaaataaaaaaaatgtaccaaagcattatgaaaaaattgcattatactttacaaggcaacaaaggcctgcaataatagggcacggccgcacgggcacgttctcattaaaaagcattatcaccctgttttttatattctagcaaaacgaacacataacaacaaagtatatattgcagcatgactgcagataaaaggactatggtatcgataatcacatggaaatatactgtctttggaatagggccacaaaaatgcaacatcagaatcttcacatacccatgccgcaataggtggaagcgtgtttgatcagatatcatttacttagataaatagtttccttaaggcagaaaatcatggagacatttttctta

SEQ ID NO: 3054 - DNA, 1237 bp, Zea mays
  misc_feature (1)..(100): optimal_loci_224850_G1, chr6:108071289..108072525, Cluster 18
gtataattatccattttttttgcttgtgttgctaattgagttatacgtgcttgtttcttggccctttttgtcaggacttgtgttcgcatcaattatagtcagtggaatgttactagtgtattgattggacaatgcgataataatctgatataacaacagtctcaggattagatatgtttatttagaatgctgcatctgtttcacatttgtgtttgttgcttttcatccataaaggtaatcttgtgcacccgttttcttttctcactgaattttttgttgtctggtgctgctgtatgttggaccagttataggttttttgtgaatctcagccgggtttgattcgcaagacttcatttctgttggtcagtaccttagtagatgttaaatatggcaaataggacctgcctgtttttggactgcttcaactccaattccagtctcacataggcttgggaatgggccatataaactcacgagcagagagtgcctgcaaactcactctagcaaacagttaatattattttggacaatataagatgtacgagggaacgaacatttattttatgcaataacatttttgtgcaactcaaattcttcactaatgaaatgttctgttactcgagatagccaacttttggttagatgatcaaagatcagcaatcaaattaacatgtgattttaacttcgtaaattgatccattaaatgtaacttctttttatacagcaacatgcaatttgaacggatagtgtgtcgattgattaatcgaaaaaatagttagcgggaattttccattttttataggatgaatcttcacactttcaaaatggaatttttgtgttaagaaattagtgcatattctatttcgaacatgtgaagatccattttttttaaaatgataaattactatcgaccatcttttcgattagtcgatcattgtttaaattgtacgatgttgtataaataaaagaatttatagttaatacatcagtttatgaagtttaaatccgatgttagtttgactgctgatctttgatcatcgtacccaagccttggctatcatgatgcaacaacacatttcgtttgagtgcacaaaacttcgagttgacggatcagtttattgaagactgagtgcacaaaacaattattgcattcaagaagatttcctttcctcacaaattttatgctgtccaagatggtattacctcttattagctagattggagattacttgtggat

SEQ ID NO: 3055 - DNA, 1065 bp, Zea mays
  misc_feature (1)..(100): optimal_loci_228076_G1, chr6:125244107..125245171, Cluster 18
aaccatcaagagttatcaaaaaccaaccaaaaatcatctatgttacttaccaaactgtgaatcggagaattcatgaaccgttcctctagaatgaaaaataaaaaaagggaaataacattttagttagtttgtatcatacaaggatatgtctcagcaagaaattctaatgaaaccaagatacaagaataaatagtcgaagtgatactttcagctgtggagatgtcagctcaacaaagaaagagcataatgaatgatttcaagaacaaatatatattacatagaagtgttcagtgacataaaactgagcactggaagggtaaaactgagcaaaaaacacgactaagggtaaaactgagcacaccagcaaaatcgagggcaccaccctaacataaaaaataggaattccatgctttatataggatatataggatcgagggtcttaaagaatatgtttttgaagtggtctgcagctaagagtaaggtaatgtagtgaatgttgtacccatgaataaagtgagcacttatgcaatgttgtacaggagaacccaatatatttcatttggacattaatatccacagtactgtccaaattcacatgtgaaattccatcaagaaatcatcttctcatataaaattagcactatacaattgtttttttcggttgaatcgctatagcagtaaagctggtctttaaagtaatcagactttttatcagaagaaacaatcttccttcacacccagtatccttatgcatttaccattgatctcatttgtagagttggagtaggcaaaatcgtatctagcaaatttgaaaatgagattccattgttgaaggtcaaaattcatcaagtgggctgctgaggcaaaataatcgaagtttttagtagttcactgctgggcacatgtgcattgtaagtgaattgttgatcttattattgataaactaaatctggtacaagaattttgtcatcgatatcagttctagattgagggatggttctggcagtttaaaaacaagtttacaaattatatagtgataaaatgagacagaattgtatctagatg

SEQ ID NO: 3056 - DNA, 1358 bp, Zea mays
  misc_feature (1)..(100): optimal_loci_229038_G1, chr6:129983265..129984622, Cluster 18
cccgagccgagtcgcctcacccgcgcatgaaaaatgactaaaaaacaaagaatgacttaatgttgtctaggatctaaaattactaaaaaatcagaaatgactgaaaaacacggagagtgactgaaaaacaaaaaatcacttaatattactggaatgacttaatgttgaatagaatgttaacgttgtctgaatgcctgaatgcctttgtttagactctgaaatgacttaatattgtctgggcgctagactaacttaatattgtttagaatgactaaaccaataacaagaaatatttaaaatgcataaaagtaaaataatttaatgtacactggaatgtttgaaatagaaggaaaataacttaatgggggcgcacctgaagccgaatcgtggcgcagagcgagccgcgcgagggggaggagcccccacgtggctaggaaacgagccacatttggcagcatcggaatgtgattttggaggaagaaatctaatttaccgccctcaattatcactgtcatttgattttccgcccatttgattgtgttccatctgattaaaaaagagttttttaaccctgtaatttaaactataaatatttttaaaaatatctaaagtaaattaaatttaaaattattcaaatgtatttgtacataaaaataatgcaattaaaaatctaaaaacctagtttagccttggaaaattacaaaaaatattttagcttgaaaaaaatatgaaacttctttaagattttctaaagtctctatgctatggtgcctagtttaaaaatatttgaatcttgatggacttattttggtgcttatttgctagtagaaacatgtctattataatagttggtattaatcatccgaactacatagaagcatgaatggaatatcattaggactgtaacggacattgatcctatgcccagctgcatgcgtgcaccctttgtttaatatatttaataagttttttacaaattactaaatttaattaatttttagagaaatgatttatggagcataatatggcagaaaaatcaagatactagcacatagatcatgatatttataaaaatagaatcaagtgacttgtacaagatatttcaagctaggcaccgtaagatagagcatgatttagaaaaatctaaaagtagttttataatactaggagccaaactcattttcaattaactttccgatatgaaatcatgttttggaatatttaattatattattttatcgcataaaaatatatctgatatcttttttgaatttttagatattttctgtaaaaatattttagcctcagttactttattagaactttaaatttaatttgatttgcctattctaacatga

SEQ ID NO: 3057 - DNA, 1234 bp, Zea mays
  misc_feature (1)..(100): optimal_loci_229179_G1, chr6:130353056..130354289, Cluster 18
tttgttgttaattacatggtaatctctatgaacaaaattaaaggtgtgtgcctttaaaaatgcacaatacacaaggacaatacatttaaactacgagtctttgtttcaataggttttgaatagcaaactagcaaacattgatttggttttttactatcatgttgatttggttcaatgtgactgaacaacgacactaagatctatgacattgatattggtgctatgactatggcatcaaaccataaaacctagacgccatatgtcatgccatcaacctcctatgtctaaaaatgaaatttgttccaccaaatgtataaaagtgaaaattttaaaaataagacagatgttgggtacaaaaagtcttctcctatctcctccaacatttagctattcatttccttgggaccaaggttggggaaatttaattatttgctatcatttcccatcttctcatatctcttcctatcactctctcctcttttgacgtcgtccttgacttgcacaccatgtcacaaattgttataattaggacccttgacttgcaaaacaaaagtgtctttatttaaaaaatccaagagaaaaaggtttagatgcataggtttgcttccaaaagcaacatgattgcttttgctttaaccttagatgtgggaaaaatgcaacgatgaaatttgtcaataggagtattgatggtcattgtagataatatcatatggaatgcaatatagttagtgttccatcatgcacatctttatgtgtaatggatacaacataacatcttcagcaaagaatgatcaacattttttgaataagaagaccatgggggagatcctcacagtgagaaaagatatattaaaagaacaaaaaaatgaaaacgtttacttacaacagaggctagaacctcttaaaaccaccaatgaacacgagactagtatgcaagtttgagtattcaaatatgttgcatgcaccttctactacgcgtatgacactttggttttgctctctgaccatgtttgtagagaaattgtcatttggagctctgtttaaggtgaaacagaaaagctatgagaagttatgaaaataggtaatcttctaggacttagtcaattgaattatactctaaatgcgtttgtctaagtcataggaagatcctcccatgagctgtagtcaagtcgagaagaaaaggaggaaaaatcatgttttggctgctgtgtgggttgcaccggacagtccagtg

SEQ ID NO: 3058 - DNA, 1039 bp, Zea mays
  misc_feature (1)..(100): optimal_loci_230330_G1, chr6:135468436..135469474, Cluster 18
ttgatgatttcataatggaaaagcaggatgagctcgagaaggccagtcaggagaattccttgcagatattcatagtaagattatctatccaatctgaaagttcttttctagctacaatcatttagttgtttggttctataaaatagagattattctgtgtaaaactaaaatgttgtttggattatatgcatgaaactaaactgaggtttgctaatctctcctttgcctattatttcaagtggacaacagcaacctgagcatcttccctccttggccattgcatatcaaattcacagggtatcagcatgcatcatgatttatgagacggagtgatcctttcttccaatatggtttccccttgtcttctttatttatttggtaccaactaagttggtttaggtgtcataatatttgcttatttccatttttctttcatgcagcaagggacactgaaattctgaggctgaagttcttagatgagaaggctgcagaaaacaattgtacatgtattcttattcttgttcttttgctttgttgggttcagttgtcagcagtgatagtgagacaccaacttaagtatatactcaagttatgtgactgcttatttgtgcttctattcttcattgtcggtagcattaccatttgcttcccgcacatctaatcttttgtaagtggaatcaattatttgctactagtatttaaactatatctgccatgtcctgctagagaacaaatagaacaagttattaagtgtattgtctagagcatgtaacattgtctatcaaatatgtagaagtgatgtgatgagccagttagtattgagttttgtaataaggataatttgagattgtatagtttcacataagcacatttgtgctatgatggacctagatactttatagttacatgtgaagtggttgcttgttgtcatggttttttcatttatatgctaaaactgccttacttcacatatgtggatggcaattaatatttacaatttggaaaaaaatccaaaattgttattatggtactcgtgctt

SEQ ID NO: 3059 - DNA, 1183 bp, Zea mays
  misc_feature (1)..(100): optimal_loci_232729_G1, chr6:147214572..147215754, Cluster 18
ctaccttaaacggcaaacctccatgcttagtgaatattttcatagccacggtcttgtgaagtgcccactttaaaaaagacatgtccttcttcagcagggcatttgagaaacaagttcaacaattatcctaaaaataacatgtaaattcgagtatatctatagtttctattaaaaatttccaacgtcactaaattgttaaatagatcaaaagattgcaattgcctccacacaaatcagagagtgcaagtgttggcttacttttttacttatacatcccacgcaccaaataagtcagatacatcttttggtagtttgagattaaaagccacttggtggtataaatctagctacataacaatcaaataaaaacactgaatacttcacttattgccacacaaacatctatcatcgtatttccaatttctttgattaaaactattaattaagaaccagataaatatattgattttaagtggtaattctagcttccacaacaaccttttaaaggcatgtcaacttgattagttaaaaagtgttcatacatttattgcactgtgaaagttccttgttttgtaaggctccacttaatagaatcttgttgatcatccaattgcacaaatgcaattttagtcactattttattccaattaagtaacatcccccccaccccactagaggtcttcttgaacaaatgataaggggagtagtgtttggtttccctgtctaaagtttgaatattaattatgagtattaaatatagacttaagtagatttaacaaattctacgttgtctccacgagcacagggatgagctcaccgttgcagacttgcagctgccacggcatcacatcacatttgacttgaaaattgttgtgaagccggcaggacgtaagctgaattgaacgggtcaagtcttagcctcatatggggtccagtctctgacgttcatgtccatccatggaagacttgaaatcacaccttggaaaacaggtttggctaggttcacatgaacacgcagccagatagatccccgtttacattctgtacgcatggctgccaagtgccaaccgatttccaggtcaagcacaactgataagaaaatggaggccacaggcccacagctctttatctcttatttatttattcattcattcactcactcactcactcatttcgttctatt

SEQ ID NO: 3060 - DNA, 1240 bp, Zea mays
  misc_feature (1)..(100): optimal_loci_233180_G1, chr6:148955957..148957196, Cluster 18
aactagtacaactctgcaagaaaattctttcgaccaacattaaatttggcttgttttttttgacaaagctcattggaaaggtcttcaagtgatgctgggcagttaatgttgttaggattaaagggattagtgtgatctatcactgctagatatgttgctagtagactggatcttgatgttattctttttctcccccgatagagtcgcaaaaaacgtgttgacactagaacagatctacatcacacacgagcaaggtctagcatacccatgatagacacatgactttgaacgtagtgaggtacgtagcggaccgatgaaattgatatagaaactgattaagtcgatgttgatcctattgtttgctcgtaaactccttaacacctcacggaaagacccatcactgagaagcacgtgaaggttgtcctaggatcatcgtgactatatagaacgtcaccaaacccatcttatacgtgatgaacaaggtagagaggaaaaaatataaaatgagtattagatcaaattttggttcaatggatattggataactcatcgatcgtattcctcttatacagagatgtggatagtcttatcacatcggaaataactcgaaacacatttgacaagttttaaattataaaaatcaatttagaaatatctgattcgaaaatagcaaaaaccgtcttgactaacaaacttggctagaccagattttacatggaaagtcgacactgtagttggtctaacaatagggtacctgtctggcctgatctattttgtactagaaggctagcttgactaggttttagggacggcctaaccaacttaagtaaccaagtatgcctgtctttaggtataaacaactcttttcaactttgttctaagacggtgtttgttttttttgacaaattattattatctccattttattcgataatagagttttagttttcgtatttaataatttagaaaaccaaaatagaataaaatataaaccaaacatctcctaacttttttatgacaaaagttacaccgtcgcaattcacgccctaggattctagatttagatagaacataaaactcagtatttttagagtaccgtttgagaaaagctataaaatctatagatttggtctttagatctatgctttttacagatttcgtatagcgggaaacgcttggttttaatttcctaaaacaatcaggctagcagtgttcagtgcactgtgcacctccgctacag

SEQ ID NO: 3061 - DNA, 1398 bp, Zea mays
  misc_feature (1)..(100): optimal_loci_233283_G1, chr6:149324280..149325677, Cluster 18
tgtactagttgaatagctagtacacgtgctcgagaagtggtgcccaaaaaattagctacgttgggctagaatttctgacaagagtggtagcacgcaagggcgtagtctggatttttgcttggaaggacctacccaatatataactataattttaatatcaataaatataatatatatatatataatataaaatagttactagtcataataattaacacacataaacactaagtatataaaaatttaactcattacgaatgctcttttattttagtcatactctgcatgatctcatatcatagaagtcatcaatcaatgcatctactatgaactctatggcgatctccttctcaatgtagattatcaaacaattacttagaaactcatatcccattgtatttcgatatcttgtcttgacaaacttcattatagagaatgcatgcttggtcgttgcaattaaaacttgtggagttagaacaagacgaatcagtctgcaaaaaaccaaaaattattaatatttgcaagtgaaataatgaataatacaacataagctttaaacaactaaagtaagaactcataaacctgtccattgaataatactctttagattttccagttttcattaattgataataaaggtcgacgatgattgacaaatctttgaacatgggatttattggtacatcatattcataatgttgcaattgtcttcttatgctagctctctcttatctaaaaaatcacttggacagaactttgaagccagcaaacaagcatcatcaattttcaatgaactgaatgaatccttggggtctaaagaggtgctcaaaaagagaagtaatcatatctatagtgatgctcaacaacaattgtgaaaatatcatatctatagtgatgctcaacaattaactcatcctttgcatgagatataacaaaatctgcatacaaggcatttattcatatctggaataccaaatctgtgtttactacaaaatgatattgcatcaccaataagatgagtccaaccatgatctctaaaatcctaaattagcttcttggtaatgactacatcaactattgcattcacaatatcttggtacttttgttgtaacttttttacaaaaagaccaataatacccatgagctctttcataacatgcataataaagacaaaaccaaaagacatcattgattgaacaacacttgtggcctttgatcgagcacaaggtgaagttcctgaacctttagaattaataatatatttcaatacaagatatttaggcttgtgaagctttgaaaggctacaaattgaatcatagtgaggctccaccttatatcactaggacactgcaatgtacaaatttggttagccgcatttccggtttcaagttcatcaag

SEQ ID NO: 3062 - DNA, 1012 bp, Zea mays
  misc_feature (1)..(100): optimal_loci_2344_G1, chr1:12523624..12524635, Cluster 18
accataaggggctttaagggcttatgctttaaggcgtcctagggaatgtgggtccatggtggcttatatttgtatgccatggtatgtggtcctaaaaacatagttagtgcgagattattctctggataggactaggtcctcatgtatgggaccctaagagcagtccctacacagtgtgcttataggccacctatgttaggattcttgagcgtgccttggtagcaactgaggatatgttctttcttgagcgttgacagactgtgtaaacctcatggggtgcacatagtagtagacgtgtcaatgcatcaacacttgatgtatggtcaaaagtgtcgagagggaacaatcatagtcactccatcacataaaataaggtgtatacttttctagcatggtagaactttgaccatttcttaaaaagcatataccattaacaaatacaaaatgagcatcatattaaagtacttttgaatacaaatttaaatatataacatgcatacactaaaaaatatttttggctgaattattagtaaaaagttttcaaacattatctttttggaaaaacatgcatgccttatttttttatttcatgagatggagccatggagggagtattatttgtatggttgcaaatgcgtctggtcaataaggatgtaaggcccttttagaggggagggagggttgggtatgctgaatcttgacccactttggatttggaccataagggtctatgccctgtattttgatgtgagatttcattgtttagttccatcttatttcattgtttagctccatttattataatttctcgacaatggaaaaatattttcttaattatctacacatcgataatacaaatagtccaatttatgttatattattaaaactttggtaatagattttgtaagttgtttctttaatactctggctgaagcataataacacatatcaatcaataataatttaagtgtgaggaattagtttttctataaaacaaaattagtatacatat

SEQ ID NO: 3063 - DNA, 1091 bp, Zea mays
  misc_feature (1)..(100): optimal_loci_236486_G1, chr6:164995563..164996653, Cluster 18
gattgtgattggtatgttgcgtacatccgtccagactgagtgcgtgtattaaccaagaaacaatcgttgtttgattaactgcatagagccatgttaaggctgcacccgtagataaaacataggtaaaaaaatatattcattagttgtatggtatttaaactatgtgatacaacaagctcaccatggcggcccacatgacccgactgtacacggtatcatgtgccacgctgtggttcactgttagcaatttcgacaatttttctcgttttcggtttttatacggaatttttttgatacaaatatcgaaaaattcgttttactattcaaaagtttttaaaaaatcaggaaaaccgaatttcagtgttttcgaacggatttcagtgtttttaggcgaaaaagatcgtttgaccttgtaaaaaattaaattttagctccattttattgtagtgtatatgtatgactttgtaaaacgtaagatacataaattaatatgaattgcatgcaattttcatacaatatatatatatatatatatgaatataaatccaaactctaaataatacaagttcatacatgacataacaatataattacaagacgcggacttgttgagtgtttgagcttctatgtgtttatgattttataaaaaaaatgcatggatagttcaaatcaattatgagtttatgtgattttggacattaaattatttgtgagtatattattagtcattgtacaacatgatttgaacaatttgcaggcatatcctataaaaaataaatttttgctaaactgaacgacaagtccgccgagaaaaatgaaatccactaagtcaaaatttaaaatagtaattcgtttgaaatctatgaaatttgagtgaaattcactgattttccgtttttgggtggtggtgagaaatgaagaaaaaacgggaaggttaaccctggtctgaacatagtggccgataccctatagtatatatagtactcatgcatgtaatgtaaccaaggtactagacatctaaaagttgacttcacttgatttttcttttccccccttcttgtctctactaggtaggtgcccgtgcgattcca

SEQ ID NO: 3064 - DNA, 1295 bp, Zea mays
  misc_feature (1)..(100): optimal_loci_236715_G1, chr6:166244752..166246046, Cluster 18
gctcgtgtcatactcagtgtcgtctatagtcatccctagaccatgctgacattctcatcacgcacgtatgctcactcttatggtccataaatcacgcttgtatgctcactcttatgctccataaatcagtagctgtcgtaggatttatatttttgttcctttttattaaaaaaatgctaaacgaaacctagagcatgctacgtagtgtgtacccgtagcgctgcggcatgaggaaaagggaaagcccggaattcatatgtcttgtcgtctaaaaggccacggacgggcccacggctactgtactctgctcattccaaaagtgtcctcgacagtttgttaaaatataatatgtatacttcaaagttcagaatcgcatgcacaaaagcaagcacagtagcagacagcggcacgtagcagtagtatatatgactatattttaaatatgaatcatatgggtactttttcaaaaaaaaaaaaaaagaaaccgccgatctcaccctgattcgtgatcagatgaatgaatggggtcccttgtacgccgtcccagttctcctttctttccgcattctttgcatccaaggcatggattcctccaattaacaaagtggcaatatatgtatgatgcgcgtcaggaaccctaagctttcgatcaaatcagcgtctttttcctccctggtccctgcttgtcatcagctcagctgtctatcgattcggccaggcgaaaagggcccaaatacaggtaggagtatgtgttgaagtggccatcctgtatgttaagttgttaacccttcttttttattattattttgagcacaggaaagttactttcatataaaacattttaaattcagaacgaggcggggtgggggctgggacatatgcattcaagaattagtacgggggcattgtaatttgatgcggcttacttggtggcacaggttgttttgttcaaaaatagttgtcgtttttgtttttttaggattcattaattcttagatttgatcaaatatgtgaaaaatataggtacacctgctataaatctagctaaattagaagaaaaaaatgtttgactaaaataaattactggtaactattttagaaccgagaaaccaacaatattgattacctgaatgcatctttaagggagtgtgtttggttactttaatcactctcctaaattttagggattaaattttagttcttaaaaattctatttgaaagacttattttagtcatccctttaatattttagagactaaactaaagtttaagaggtgagaatcaaacgccctatt

SEQ ID NO: 3065 - DNA, 1079 bp, Zea mays
  misc_feature (1)..(100): optimal_loci_236917_G1, chr6:167426446..167427524, Cluster 18
ctacatttttcaagacggaacacttatataactaaaaacacagacttcaacataaataaacacttagtttcaccacagagaaaaatcctcatttaactgcagttaaaacaactggcatagatgagaaaaatgaagcaaattcaataaatgatcattaagatgaatctactacacaaaatcttacaaaattgagaaaaagagaatgtgtttagctgttctagaaggtaaaggaattaattcagcatagagcaatgcatacattactgctaggctaattacatactgtatggcagaagtaaaatgcaaagaaagaataaaatgaaaaggttgtatgtgcagatgaattgcaattagagctgtttctcagctttgcatgatagaaccacataggcagttctgatgcataactatgggtgaaaaggatggatgtgtgtggtaagtgcagcttttgttatcttttttcaccataaatactgcaggggggagtcccccaccccaatgtaagaattttattgttaaaaaaggaataagaaaagaactgtgcagcagggaacaactgaatggatttcactaaattattcgctcatagatcataaatggattcctttgcctgtaaagcaacaatgcatgcaagattcatagagtgataagtgttcaacaatagcttagacatgctggaaactgtagtaggttgaaagcaggtaatggtcttacaaatttatgagtcgggtattcagcgctttgcactcctgaatgatttcatcctcatcaagaagctcttccaatgtaaagttctccttgtccagaattgtatccacctgaccaacaggaaaagaaagttaggcatgtgggacggggatgccccagtgtatgctactaaattttcacaagaaacctgagatggtaaaaaaaaaaggtatactaagggcatgtttggattccaggagctaaagcaaaaatgattatagagtttagttacttaggagctaaatatccaaacaggaagagctaaaagtgactaaattgatacttttttcaccactataatcagttttagtgcttcctatttggatctttag

SEQ ID NO: 3066 - DNA, 1055 bp, Zea mays
  misc_feature (1)..(100): optimal_loci_238128_G1, chr7:5153382..5154436, Cluster 18
gtctctcaggacacgtgcccctcttcttctaggcttacaccgccatgtgccataagacgtagggccccatagaggtttacacaatcaagtgctctgggacacgagggatcgtggggggcttatactgccaccagtaggtagctaattatccaatagtgggattagtacttgcatatgcagtgtactaaacactggtgaattattagggtagacaaatctagtagctagtagctgttaatttgatttggaataatattgctggaagttgagcggcatgaacacgaaaattggcatctgatggcgacttttgaacacgagagagtgcatacgtatacgcattaataagagccagccaataccgaatctattcgttcgacgatcgttcgtgttgtgggggtgtgcatagtgtgttgtgctcttctcgatctctccgtaatagtcatagctttcttaggctaactccagtggatattggcagcgagtacacatccaccgtgacgcgggagccgtttgtgcaatgaaaaatgcagtgcctaacagcttatggatgtaagtgacctgaagttcggtttaagtctggccacggccaggcacgacacaaaaataattaagatctcaaggtacgacctagtacaaagaaaaaaaatggactagtagaccgaaataatccgagaatgatcatgctgtgttgtatcttaaacttgggcacgatagacgacacaacacaacatgactagatgagtcacgcttgagtcggcatggtacgaagtgagacaccgattaaaaaataataatttttatcttttcacaaaaattatagaaaacatcgatgatgcttatatttatcttaagtagatcatatgtttttttattaaatctctatatatagcaattttgaccttttgagtcacgttgctagtcatagcaatatatttttaaatgatttctctttctcatatgattatttttaatctataacaaagatatgaaataatttgaagatgtaatttttttagatatatataagttttttttgtcgtgcttagcctggcatg

SEQ ID NO: 3067 - DNA, 1195 bp, Zea mays
  misc_feature (1)..(100): optimal_loci_238754_G1, chr7:8924264..8925458, Cluster 18
cttagtatttcagaagattcatatcaatcaaaacacaagtgtggtcatcatagcagcaataaaggtcattccctccctggtcgagttttttatagcagcaataaagtggatttgaatagggcaatgtgcatcacacttcacttgagaaccaccaaatactgtctccaaactctatgaaggcatacattttttttgcaaatcagatatagaccatagaaaaagagtcgaagaagaaacaagttcccagctaccaattaaaaacaatcacaatcggcctagactaacaagcttcaagtgaagacctttcctttttcatcaaataaatcacatcggcaatgcaacaaaccgttgtgaaagcaatttccaaaaatgaaatcatcatggtgacaaaatatccaccaaagatggatcaaatcatagaggataaagaggaggtataaccggtggacgaaaatcactaaaacatgaggatatgttctgcatcgtgcatggaaaaggggctagccacacttcaaaaatatgctcaaaataaagaaaagcatcaaagaagtacaataggaaacaaagacaatatccaactattgggagaaggcctctggccaaaggttcatactaacaaaatcaatgtctagatattttcttaggataaggacatcaatcaaagcaaaaggccatcttcgaacgttggacaagctgaagaagacagaagcatagcttcggcgtgatcggaaaaagctttagagaaggaaagcgaagagggtctcgaaggtgaacaaaaggcttatatggtatgtcagggttgtaaaataacatgattgtactctctcaattacgaagagttactatgtaataactaagtggtaaagctgtaatttcatacaaagatgtatattgggtcatcctataaatagacgaacaatgccactactataggggtcggtcctttgcaaatctcacatgtggcattcttgtgtgcagagcttctgaaggtataaatgtatggaaacatccgtattaagcataagcctatttcatgctcaagcattcatattcatgtatatatgcggaaaattatgacctccaaaggttgtaatcaatcgaatgacattgaattcttgaacgacaatcctattccacacacttattgaaatagccaaaactccgtatatcttgagtccatcttgtgccttggacc

SEQ ID NO: 3068 - DNA, 1070 bp, Zea mays
  misc_feature (1)..(100): optimal_loci_240298_G1, chr7:17256529..17257598, Cluster 18
aatattttgggcagaatgtcttatgtaaatttatcttttggccacagatactgttgagcgagagagatatctttggtcaaccatgataaatattcgtgcaatgcctcgaaagctttctcaaacgaatgctcttggaagttggctccatactaattcactggactttcgagcagctgttgatagggtttacggagccgatcggctaatccgaccgacttactgagtggtttattagtaatcggcaccggatggtaaggtcatacgcctgtttaccaatttgaatttagaatattttatattttttaaaaaaaattatggaaatttttatataaatactatgaatcattttaagactttccactgaaaccaaattttaaaatgcgcaaccaaattcaaactaaaaaaataagaaaatcagaatgaggaatcgactagatgagtggctagccgatggagaatgtcgattaatcggagtgaggcgctgataattcgtcgaccaaataatagctagagttaggggggttccccacctttcaacttaaaatctttttaaataaccattgctacttgtaatataggcttctaatacatgtaataatagttcaatgtgctttatttgccaaaaaacaagaggtacgtttctacaacccccatgtcgatttatcaaatctagaaccaattaatcggtcatatcgaccgataaatcaatgacaaaccgttttaattcaaaaactggtttggatttgaatttggcaagtttctatcgatttatcgagattaatcggatattggtcccagccgatttttgccaagcaatcggtttggtgaaccttggctgtcggtaccgagcaagcattcggtggatcaaagcctttctctttggccctgcctgttttcgcttaaatcctgcgatctgatgaaaaaacgtgattaaaaataatcccatcaaacaacttacggtgcccgattctcgccatcgtggtttcgacttgactgcgggatttcaacacaaccatgagacatccttgcaaggggccccgataaaaactaacggaaagcttacacactta

SEQ ID NO: 3069 - DNA, 1288 bp, Zea mays
  misc_feature (1)..(100): optimal_loci_240876_G1, chr7:20248382..20249669, Cluster 18
atatttatatcataaatttattatctctactatatttaagtgtgagtttttcgtgcgtcgttgactccgtccctagaggcctagacaccctcgttcactcaacgtttaaatacaggctctcgtttgcttgggtttacaggaagcgttggtttaaagttgagggcgagtcttatatacacccattctatctacgactgtatagatgtatgtagtcagtaggaaacgggtgattgatgtacctagtgtgtgggcggtgggcctactcgatgacaaatgcttctcgttcagatgacgtggacatctttgctctatataaagtgctactcatgtgatatagaaactacaacaatgtatgagtttctgactagtcattaggtaaattatgaaatacatgttcatactgcaaaaaatgttatgcaatcaagattttttgtgcaatttttatgtagttaaactactaaaagttatgaaaaattcttaaatttttatataccttattgtttactctgttaatattttaaatttctggttttagttcctcctatattaagcgatataaaaatagaaaatccgtttgtttttaatccttttatgttggatatatttttatatctcttaatatatgataaattagaatttaaaatttaatatattggtagagtaaataatgaaatacatatattctttttaagttttttttttggtttttgataatttgattgcatggtgactgtacgagaactttgatcgcatagtttttatattttataatatatttatttagttttatagatgttaatttttataaagttggttaaatttaaaattctagattagaattattcttaaaactaatttatttaataatagagagaatacattagttagctttactttcttaatagggggtgacagattttttatagttgaaatattattgcctccgctatttgacgcttggtctgaaatcttaattccgatctttgaagggagaaaatagtgaagtcataactcaaagattgtaaagtcatgcttggattcatccttcagaaagaaactcctataaatgaaactagtttgcattgctatatatcgtaactttatttaaatgagataattatctaaacatgttctaaacctttacaatgagcattcgaaagtgctaagttacaaagaaggtgacgacatgtcttactcattcaggcctcacatccgtcgtgggcgacaacgccacgccgggtgcctacaccgacaccattgctctcctcaatcaagcaactacaatctc

SEQ ID NO: 3070 - DNA, 1214 bp, Zea mays
  misc_feature (1)..(100): optimal_loci_241230_G1, chr7:21796748..21797961, Cluster 18
atttttagataccacttggatccagattgttaatttggaatataaaatgactaacccatatattttttaacagttccccaaggatacatgtgttcttatggctattatcaaacaataaactgctcactagagataacttgaataaaaggaaacatttactagatacatgttgtttgttatgtacaggaaacgaatcaatttgtcacttaatgtttgactgctatgtagctaatttgtttgtggacataactgaataatctttttggttggaatgtaggttgtaacttgagtcaattgcttatctctgatcgagttctaagaaatatgaattacagaatgcgatttgtgcagcaattctttgggtcttatggaaaacgcgaaacaaaatacattttcaattttcagggaaaaagttggcctggtgtgcactctgctggaagccgatcttcaagacaagtgcctcgaaggaggtcgatttgtgcactagtattttggagaaaagggcgcgcaggaaccggagtgcattatgtggagagagagagagagatgtcaagctgggaagctttgaccgagaaatttgcgagatttgaatcgccttagctggcgggttgtgtggaaaaaaagcaatagttagcaggatgggtggaaaacatttttacgcctttctatgaggtgttgtcgatgattaaatctgcgagcgtgcttagaataagctaaaacctccaaatgatgtaataggtggaacacttcatttttgtgaagaaataaagcaggggcaacctacctttctatctaatctaaaaaaattaagccgggtaatgaaatgaaatgccagcgtgaaatgaaacgtccgttcaaatctgagctctacgatatacggtccctttcgcctttcggttgcggtcacgagttgccacggggcaggcacaagtatgcatgcggacaaaaacaacacgctctgcggttatgaacatacgagatattaagataaatcatttcgtccatagtttcaattaactttttttaaaaaaaaaactatttaaatttatattataaacggagctgtaatctggagctgttacaaatacactgcaagggttagtttggaagacacaaaattgtagagaattagaggggttagaattcccttcgtattctctcttggtttttgtggcttctgaactcgccttaatagatagaaagtggaatcttat

SEQ ID NO: 3071 - DNA, 1008 bp, Zea mays
  misc_feature (1)..(100): optimal_loci_24784_G1, chr1:150221519..150222526, Cluster 18
atttacagtttcgtgtttcctattttacgcactctactagagacagtctaaggatagctaaacacattcctatcatgttttcctcgggtgtggatctaacggcctacgggtagccgccggccactcctactctgagcgttcttcattttcttcaacatcagcgcctgcctgacttcaggagctcctatgagcatctacgacctatcggtcaatgactaattaaggcttaactaagtgctatgtgtagattaggtgttcttgtgttaggctaaataagatcatgtggaagttgataactgatcattactaacagcaatgccttgtaattttttaatgttcctaatttataggttcctattttctagtgtagagattatagtaaaaagaatctcctctaacacattggcttggcttttgaactcaacttcagcataaagaagacgatcaagaacaaacgaagattgcttgccgtaagatggaggtgttggtgatgcagtttttccgacatcatggatggggatctacttataggatttgcttttagatttctttaatcgcgttgtgtggtgtttggtcttgtgttgtgggagacatcagttctttatcttgtgttgtggaagatatcagttctctatcatgatttgtaataggtcgggtacttttatctcattatctaaaaaacgacatctttaattgaatcttcaaatataaacgttctcaaatctggatttttgtctagccaaatacggagagcagcacgactccctaaactggagtgcacacaagatatgaaaaagttgttgggtgatacgtaaacgatgcagatatcaagtgattttcactctaataacttctcaaatgacgatttatagagtaaattttagaaacgcctccgaagatgctctttacaaccctattgttatttttcaaatattttgttagaaatacatatatatataatattatggatggagggattgggtaagtgattacgcgaagaaaaggcaa

SEQ ID NO: 3072 - DNA, 1250 bp, Zea mays
  misc_feature (1)..(100): optimal_loci_256646_G1, chr7:121411671..121412920, Cluster 18
aaaagacaatacactttttatgatgtggtaattaaggccatgtatggatcctcctaacttatttatttagtggctaataattagccggtaaataattagctggcaaaaattagtcagtgtatgtttgaagacttggctaataaatgtccttttctctttatacgatttattagcatttattagcaaggtcaaatggctaatagacaaacagtttgtcatccctcggctaacaattagtcaatttgttagtcggtctatttagaggttaagatgttaaaattagtcgtcaaactacttgccacatggatccaagcataccctaatacacttttttatgatggagtaattaggtctatgcccctacttttgctcctctttttttagtttgtattattgctaatatttttcaaaataaagctactatttgctcctatttcattaacactatctaacagtgattaagtctcagtaaaaaaggagagaaatatactcttgcaccattgtccctactttttcaatagcaatcacgcatatgcctctatttttcaaactaaaaattgttagtactatgttcaaacatattattgaacaaaactttaatttaattatggaattaggttattttttaaaaaaataaaatttggacaacttatgagaatattttttagatttttacatgatttgtaccaacaattcaactatattggcacaatttataaaaaaatgagaacaatttgcctataattggaaaacaaaatatggacaataatttaaccatatttgaactgcatatatgacttcatattgtcaatttagtattccataccaataagttcaatgtttcagcacactgaaatcaatgaaataatttgcggttagataacaaagcagagagtacttcacaaaataaataaaaaacatgtgagatcatctcatggctcttattaattgaatacttaactaagcaaattataatttacaaatgcattaaagtttgtaattaattattttagatttgtgtacaaaccgtgaagtataaaatctatatttattttttaatttagaggaatctagttaaggtttgaactaaaaaaatcaaaacatgtgatatcataatgacactatcaagatagaccacatcaacatggaactaacacaacaaaaaagaatttaatagagctaccgttgttaagcagctgccataacctcatttcgatattacaagatagtgacggcaatgccgccaccac

SEQ ID NO: 3073 - DNA, 1104 bp, Zea mays
  misc_feature (1)..(100): optimal_loci_261014_G1, chr7:145628670..145629773, Cluster 18
aatgcctagggagatatgggagggttgttttgaaaatgatattttaaaaaaaggttctttcacattcgtccttgtgtctaggttgcacaggtgcactaattggttcggttgcacctgatatgttccccatttcttagacatatgttgtggcactcgttcgcaatgatgaattgtagtaaatgcctctctatttatgtcgtctattgaataaaccttcacattcaaatgaggcactacatcaaatacaatgagtaaagaatgccacaacaatctagcatgataacattcaaataagagaggatgaatagtttcaaaactactacaaagcaacatgattattaccatttaatttcttggctaggttatcattggtaaggatgactctcttcttcgagaaccataaaaacctcaaatttaaaggtaattttgttcaccactaactagaacatgaaatacatacttcaataccattgttttaagaacaaattggtcatacttctcttcaaactatatgaagcggacaagagtgcctagatcaggacattgttgtcaatacatccacatctacatatgaacacaagcaacagaaatccatcaattttatgatatattattctttcctagtgtggattcaaatatgtctaagtccttattttatattaccatcaagctctagatctagccctagtttttgaattgagtatcatttgcatgtttgtgtgtttattacaaaatttgtggattgtgtggttatcgcaaacttatcgaaactcgatgtattaccttgctttgaacaaatacttattttatctaagaaaagaaaaatcaaacactcctgttgaagtacaactataataccacaacatgttaagatttggtgagagcatgcaattcaatatgatattatagggtttcaagtcctaatcctggtgtgccccgaaaagtaaaatattagtatttgacttacatttctatattatagactagatcagtgttcgatggccgacaagtaatcttactatggactatagtgatgtttggtaggcttcaacgagaaactcaacttgatggtgaacacgagacaatgatttatacatgtttgga

SEQ ID NO: 3074 - DNA, 1199 bp, Zea mays
  misc_feature (1)..(100): optimal_loci_262250_G1, chr7:152944579..152945777, Cluster 18
ttaggtgttgagcgagatcaggaacaacaggtgtaacaatatgacgagaaaaactgctcttagaatattgtgccccgagatagaaatatatcacgaaatatgcaaggctctttttagtcaatgctagtcttttatcttttacactatttagtgattacaaaatttataaactaatatcaaggtggagtggtggaccattagagtcggtctaatcatcaagctgctcctccgctggttgagttcgttggagatatgattatccctcgccgcgtcccgtcaaatcctctcgtggttgccaccgagctagtaaacaacaacatccggcatgtgcgcgtcaccagcgcgtccaaatcgctgccttttgtcgcatcgccactgcccaacggccctcctcctaacctaaagtcactaacaactttgtctaatttacagggtgtttgtctctactcccactaggaacagccatggtgccacgcccggacgtggccattctaacagctcctagctttagtggccgcacactctcttggctaaaagaagaaaagttgtaaaacgtgattatcgtggctagatcgatgatgattaaagttgtaaacgttattatcgtgtcagcaatggaattaactccctttgttcgcaaagatataatttaagatttgtgccaatcaaattagcttaataactttaaccaagttaatataaaatattattagcatttatgtctccaactaggtttgctaaaaatacatattataattaatttaataatacttactctgtatcataaataatatatctttatataactttggttaaaattaaaattatttcatttctcaaaaagcaagaagttcatcaatttgtatgtcgaggtagtacatagaaataggagcggtaatggactacgattcaaatgttttttcataaaaagttagggttcttaattaattctagttcgaaaatgactagaaatagagaccggtccaaatcggattcgattcttaaattttataatataaaatctagagctcattaccacaactacgtagaaaagctatggtgaagctacgtctcacttggattgcatattctgttttttttaaaaaagagaaaagtgattccgtccaaaaaatatcaaatagcttacactataatgagaagtgaccaaggatataacaatccttataacatatccacac

SEQ ID NO: 3075 - DNA, 1094 bp, Zea mays
  misc_feature (1)..(100): optimal_loci_262627_G1, chr7:154902271..154903364, Cluster 18
ttacgattgtcatgcaactcaaatgtgttccttctattatatgtaaacgagttatgagtagacaactgaaatgataatttattttaataaattgtctattaaactatcttatgattacatagaactaaatgttgatgtcaagctcctaatagcgaacaactccaagtcatgaaaaccatcatgatgcatagaattatataatatatatataagagctaaaaaaatgtctccggtttaaatgtacaaaagagctaaaaaaatactagatacaaatttcaaaagtgacttttatctccaatagagcttaccaagatgaggccaacttaatttggactcagccaaaattattctgtcacaatataataataggaaaaaaaacgagaaagatgacaatagctcgagctaaattctttgctcgcaatcattactctcgccgtgaattcagagtatcgagcagtccagctgttcctcactactgaaagctgaaacatgtcctccacgtgaggaatccagagatccagaaattgttgtttgctcactgtcgtttgccgcggagattggaaactgtgtcctcccgtcgattgcttgggctccagcgaagcatacatgatacatctgatgctcaactttcgagacatgttcagttttaacctcgtactaggaacgtagaacaatgtataaaagatcggcattgcacatcagataacagatgtctttgcgtgctttgctttgcgaatattcaattattcatggatcgttgttcctattttcctgaggtggatctcctgctaggtttggctccggttttatcgtaactatagctatacttattgcatcttggctccttaatcttttgtgtatactcttctcagtttaattcctcaaactaaaactgcttatatgctcatgccaattaaattaaagtaaaaaaaattatcttcaatctagctctctttgttcgttccatggccgctcactgtgtgtgccttaatttagagcccatgcatagccacaaagacaaggccggccgacgggtagccagggtttacaaaaccggtggggaggtaaaaaccgtcccccaccggtaatggttt

SEQ ID NO: 3076 - DNA, 1131 bp, Zea mays
  misc_feature (1)..(100): optimal_loci_262740_G1, chr7:155598226..155599356, Cluster 18
aaacaatatttcatttttcttctcaatgttaattcaactctcatacatgtgtacctagctcatggttttccgacggtgactaccctgaaatataacgaggtttgagttatgctacaaatgatactaacctcagtttgactaagttttccagcagcaacatcatcagtaataataataatagtaataataataataataataatatgtggcaataaataagtatttttaaatatcttataaaatggcatatatatacttacagattgtaaacattgtaatcagtaatacgattatcgataaagttattcaaatctagaatagtttgaattaggacgagctaaaattcgtcatattttaggtaagtagagaataaacatcttcagcatgatatttggatgtcaaaaaactagcactaaacaagatgtggtggtttaacttcttgccctctttagacaatatattcaccttcacatcaaaattgcctaatttatagattgccaagggtctatatgtatttagaccatgtttggtgaagttccgacacatcaaaactggtactaaactcgagctattttttatctccctctcaaaataaattagaaacatgtaaaaccacaatttttttaaatttactggctttgtctcctccgtacactgtagcaaagaggtggagaaaaaataaaaccatgccaaatagccctccactgtttccctagatattaaatggtaaataattggttacttttagttcagtggtccgtgcaaaatatacatacatgatttccatagtataacactatagcattaagcaatgcttaaatagactaacatttccatgatcacacttgagtattttaccataaactatgaaatgttactaggaaggatgtattagatgaagttttcttgaagaaagagcatatgtatataagttcttaaaaattatccaccaatgatggatagacacggaaaagaaaagttatcataaaagtaatgtcagagaaggggactaattttgtcgcttcccgaaccgacactacgtgtaacaattaaaagcgaacgtatttttaaaaatgactaacccttaaatttgagtcgttgatctatatcaacatttcatccaaccgctct

SEQ ID NO: 3077 - DNA, 1137 bp, Zea mays
  misc_feature (1)..(100): optimal_loci_265120_G1, chr7:167825965..167827101, Cluster 18
aagcagacaataaatagaacctacttttcaccgacttcctagataagatgtttttttgaacaatatcagttgtgccaaacatggtttatctctcactctatatctgtcatttacagagttttcaaaaagattctttttaaatctaattcatcttcaacaacattctctatatcttatcctttacatattaaagacatgcattagaaacattttttcatcaaaattttatacatacgcatttgtcataccttgatatttagagctcataaaatatctcaagaagtttttttttaaaaaaaggtggatttagctttacaagaaatgaaaagatatttatgagaaactaaatagttccaaagcattctaattgatgtgtttttgttgtgaaaagttttaaacgcatttagacatgtattgtttaaattctctatttttataatacttcctcattcttctaatatcaaatctaatctctggaaacttccggagaaatttcatgttctctatgttttttgtcacgatattcacaaacttagagacattttttgtagcttaaaaccttctcaggtgtatatcgaattttaaacaaaataacaaaacaaccttgagaacgctcttatttgggaaagcgaggtaattaatttggtcattaataatagttcagagaaagaatttttccttatgtaaacgccatggaactttctaaacgtgttgggaaaaagagcaggccagcagcgacccaactgcatgaggatgactggatgaggcctagtccaatcgctacatgttcatcgccttgccatcatgcaatcgcgttctcacgctggcgttgccggcgcggacggtcagattccatcagtgacggatctagaattttatcaaagggtatgtcgttcaaaaaatttatacataacctgataaatttattttataattatataataattatagaatttacatcgtgatccattattgatgcactaagtaatgaataagacctaaattaaacgattaagttaaatcatccattaaatacaatataaatggtttaaaattcatattgatagttcaaatgcaaccataaaggagtattagatatttacacattatttgttgactgcctttcaaaggaacata

SEQ ID NO: 3078 - DNA, 1137 bp, Zea mays
  misc_feature (1)..(100): optimal_loci_265321_G1, chr7:168900094..168901230, Cluster 18
aagagaacacgagatttctctatatttctcgctatctcgattgtacataaaatttcatcaaataacatgtgagtacacactttttctagcacccacgtataattgaagcataaagcatctagcacaagtattaaacatcaaacatgtttaaatgtcctataacttaaatccaatagcaagtagaacaaatccttgatcacattcttcttgttgcaatgcatctcttgggtatctttatatttttcttgccactgaaaagatatcaaatgtatttagcgagcatgtagatcaaaacataagttgcaggttggtttagaaagaattgaaaaagcttataaggcatatatataaaggactcaataaataccatgtagtattctagagatgctgactaatgatcatcattttagtttcaaatgtggtttgaatccatagagtttcaatactccatcttcgaatttagtttaaaaactctaagataggaaacgaacaacatatatattatcatcgatctcaatatctctcaaattttttgccaatgatttaggctatttcaaacatgtaagacacaatcaatgggaaacaattatagttaagctttgtattgtaattacaaggagccaaaatacaatgatatccttaattgcaaaaaaatataccaataaattttggtgttaaatgaatggatagaccaaatacacatcatgacggtgagcaaatgttatttttgtttgttcccatttgacagaaagtcatatccaatgccttgttcacatcgataaggtttggggtgctataacgatggctaagtgaggtgctaagtgaggtgatataagctcacgatacgcaaacgcaaaattcaactaatggattgcaaaattcaaattaataagggtcatgggcaaatgcagctaataaacaaatgtggtattgttttagttaacatacaacaacgttttggaagttaacttacagctcttctttgcacttgcagcatttttcagtaccttacacacagcatgagctaaaaagtaaaaaccatcaagaccaatactttctttggaagtttgaataaaaattatgtagtccaattaacagttttctaatattgtaacttaattgaatatttatgacctg

SEQ ID NO: 3079 - DNA, 1215 bp, Zea mays
  misc_feature (1)..(100): optimal_loci_266046_G1, chr7:172719411..172720625, Cluster 18
agagtatttacccatacgtgggttatcctaacctatttgtgaaaatctgattggtcacgtaggaacgggtctagatctaagcacacacataatcaaatcgaactaatccatctgcattatcatatcttaagagtcactacaggaaacgcgaaaaaacgtcggtcacaacaaaaacgtcggcctcgatgggcaaaacagtccgttctctcggcctaggaggtgaaagaaactaggaagaacataaaacgtagaaaagaggaggaaaacacttgaaacgaagatttctcacgtgccttagtgttagttgaaggaaggcatgcgaatggggacccaaatcctcaaaagctcgcgaataattcagttccaaatactgaaatttgtccctaaaattttatatttttaataaatattttgagctcgaatgctttctcgaaggaatatttatctttgctagtacctattttttttgcttagatttaacttgagtacaaaaatttaccctggttatttctcgaaaaaatcccgatttaatactgtgccttttatgtccggagtttccttgtttttttagttcaaaatttatagacagtggaaactttgtttataaagtaggtaaaatttcaggtcaatcgtaatttatttacttggttttttttgtttcctcttctgcacatgcagcacggccgtgtaaaaacacagcagtggcccaacgcggcactgctacacgtactgggtgttgctccaattttttcctatgtgtgataactttgagttttttccccaaaattttaatcacacatattattcaaaatatttattaaaaaatataacattttaagtacgctcaaacaaccttaagcgataaagtaaattgtaacaaattaaatgataacctattattttcttaaataagatgagtgattaaagctgatgtggcgtctatctgtttctagttggtactgattgtggtgagtttcaaaaataaaaaaaccacttacatattatatgacttttatttaaatataatgtaccttttatttccataaaaagtcacagttctaaataagagttagtaagaaaagttgacgtgacgttgagtcgctgtattctcgtggtaaaggctatgtattggagtgatagataacacactgataataatagatacaaaccatacactaatatgacggtaaacataagtccaaggctaggtgggct

SEQ ID NO: 3080 - DNA, 1242 bp, Zea mays
  misc_feature (1)..(100): optimal_loci_266454_G1, chr7:174275530..174276771, Cluster 18
ggggaactcagtctgatgctcctccactatatataatcacttgtgttcctgataatagttggagacagcacattatattattattcatcagtgccacatgtatctccgctagcatattatataccagtctatcaatccgtgctatcacacgggctacaattttagaacatataagtatcaggtaatgcttgatatatagtcttttattctaaatctatcacaagatatttttccttttctgtttttttactacgtatctagacagtacatctaaatgtacagtaaaagctatatatttagaagacccaaaaccatcttataatttgaagcgagagagagtacaactcactaataaagaacttacttatattaaactggacactttttctttatttagtataatatatactctgtagtctatatctagttattgtaaatttattaattactatttatttgaagaaagtataaattatattttttgtgtatattcatatttttattttcatgacatcatctctatatattttaatatacaattactccaaaaccttaccattagctatggaggtttcttgttgcatcatgtatttcatgaagtaaacgatctaaatgtttagttttcttttttttcaatatcaactgctacaacttttctcttgcttaagttgaaactcttgtacttgttgtagatttcatcaactcacattttttatatatttttaaaataagaatttttggtcatataatatgttcttaactactataaaagcataatctattattagaaacatgcaccatatcgcttaagataaattatagagcttgaagtgagatcttgaacatgggtagtaatgctaacctcaaaagaattttagtatctaacccttataatggtcgatattttactctaaagtgttcttaaagggccaaaaaaatataaccataagtggtaccccaacacgcttctcaagataattgaatgttacctatcaagaaaaatatttgcaattatggttatactacaatatagacatatcaacatttacttaaatatatccaaactaacaatgtatataaattatatgttatggttattaatatggttttaaaaaatctgttagtaccattagtatattagtgttaagaaagtattattttatttgatgaaacataacatatgtgttttattgctcatgcatgttggtactacgtgtataattactttatgacaaaggggat

SEQ ID NO: 3081 - DNA, 1050 bp, Zea mays
  misc_feature (1)..(100): optimal_loci_267028_G1, chr8:842252..843301, Cluster 18
aaagataaaattatacataaatgaggattcaaaatcatagttgttggccttcaaacctacattcacactcatctagttattctttaagttatcctaaggataatattaaatcaaatatagatggatattttttgttgtatatttgttttcatattttctcttcagattcgaatcgaatacgaatattatcgatttgaatgaatattgatatcttaaatatccaactttgagtatacgtatataaatatagattggatatggattagatactgaatacctagactcatatacggatcggatttcagccctcttagacggatcgaattcgaatatgaatgggtatttacatccctaaattatctcttaataacttctaatatcttaattcacttatgaaataaaagaaaaggtgtcagttatataacaatgaaaattcatacaataatatattaattgtcttatggtcttaatttttaacttattatattgttatttgtgacacaatgatttttttgtctctcctctttatttcctccacgtgagcaaagattatacccctccacattagcatatatatatggcacaatatacgaaaaagagtataatcccactattttaaatcaacgtctaaggttcttaaggccatatatacaaccctattttatatgcaatttcttgggggtctttaaggataaactaaaaaatacaagaaacagacttttcgtgaagagtctatctctacatttgttgtacatattgtctcttaactatattaatgatctaggagcttagtgttctatcatgtagtctagtagctacctcttagacatagaaaaccgattcaaaggctcggtgttgtacattccctaagtgttgtcgtcctcaacatctaaacatagctatagccagcgtagctaaacataactaaacattccctaagtgatgtcatcctagggctactaatagttacaggaagtttcggccaccttcctcacctgcccaaccaatagcccccgccacgcatcccgtggaaattagggatcgtttcat

SEQ ID NO: 3082 - DNA, 1338 bp, Zea mays
  misc_feature (1)..(100): optimal_loci_267153_G1, chr8:1833870..1835207, Cluster 18
accaaagatatcatagagaaccccttatctcttatctcgccaccatattagtataaaattagagctggaagctaactgcagttccttttccttttctggtttcaagttgacttatgatgctatttatatcaaagtttgatggtacttctggccttgtggcatccactgaaacttggttaccttcttatggaggtaaacttagtggctatagctgttgtccttgctcttttctagcaaagctctacactatgaattatcccagactaacctttgatagcaaaacctatatttctaatgcgtgcttaaaaatatgagtttacttaggtatgcaaaatagtgaagggacagaggtaacgagattaaaccagagtcagataagagctctttagtgtaacttatcgattcagtaggtggtataggaggtagtgttttggtaaccatcgtggctggaggggattatatattatggttttccaggatgatggcttgtggattgcatttatatctgttgcatttgtgaacttgttagttggactttttgtatacctttacattgttgatcctaggaaaatatctccaagccatattagcggtgatgaggacaatgagaggtatgattatctcatcatatgattttagggggggatctcgatttgcctattcgtattttagaagataaaatacattgagtttttatgaggaaggcatagtagtataattgcattttcttctcatcaaatataaaagattcatttaagtgaaaagtatgttttttattcctagctgtttttggtggcgactatatatataatatgtgggcttagagcaagtgcaatagattttgatgtccttcataatttataagaatagataatttagtgaaaaattaccctcctatagccaacacgttgaactttcatcttaacttatgaattctctattcaggatggaccacttctaacacatgtatttatttgtttttgcagtctatgaccctaaaatccttcttttcatgtttggaatggatctggaatacaacgacacactcattggtggtggcttctcttttcagaaatccaaacaacaaaaaactatcggtgtgataaatcttttacgattgggatggaatatgaggctacaacaaaagcttgcaacaactagaatagcgaaatactagtagtaaaatgtgatgtaacttgttatatagcttgctccttaccaaatcatgttgctacaccactgatacttctttcgtctcaaaatagttagctttcttaatttttgaggataactttgatcaaatatatacaaaaaaacactaatacttatggtgtatag

SEQ ID NO: 3083 - DNA, 1098 bp, Zea mays
  misc_feature (1)..(100): optimal_loci_268200_G1, chr8:7512813..7513910, Cluster 18
cgtattcagactataatgtgatttctttactacaaataataaggatatagaactgttttattttgattttccattatattgtaatgattcctcctaaaatgctttattatgcgctattatttccatcaaataacaagaatgcttctcttgaacaaggctcgtgtatgtgtatagaaaaaaaatcttagtctcttggatcagttatcacaaattgcgcattagttcaagggatcaatttattaagcaatagttcagcaagcatcgcactcctattatctctttattctctccttaccaaggttagaacccagaagccacaaagtcgacaagtcacacaaccagaacatgaaacgaaggcatgtgtttgttaagaagctcagtttcaagaatcttggtataagaatcgggttggcgagaaggtcgattcctgggctgtacaagtgttgctcaatggttcaaacaatacacaacacattagtactgatgcatcaaactggagatcacagacaacatggcagtactgaaactacaaatgattaaaggaattgtaaacggttctcttaaactgcaaatgattaaagaaactataaacagttcacttaaattgtaaatgcttctcttaaactgtaaatgcttcaagatggaaggtatgctaatgactctatggaactacacaggcttctctgaaactacaaatgggagatcttttgtcttctctactccaaattgtacagaaataagaaagaaatgtgttggtcacttgtctttggttcctttagggtgtcaaaaccaaagcaacacaaatgaacaaacaacaagtttgtcctcttaattaactcttcttcgagagttaatcaatgaggaagataaaagaaggtgcatggaagcattaacttgaaataaaacacaatagattaaagataaagtgcattactcatgtgaatgtatagatatcttatttaattctatacaatatgacaaatgattacacgagtaccttcagtttttacaacaagtagcatgaaggtaagaagaatacatagctttgaatgtcgaacctcgcaatctactctagccaaaaaaatgtatcatatgcat

SEQ ID NO: 3084 - DNA, 1409 bp, Zea mays
  misc_feature (1)..(100): optimal_loci_27258_G1, chr1:165414605..165416013, Cluster 18
taatttagtgcatgtccatttgtttatagcagtagagaagagaagaaatatatgcattctaacaatgatctctacatgacattttagatacagcataaacaaaaacactttaaatttcactggagaaagcatagactcaaaacactacaatttagaaaagaaatgatgtgatacctcattgatgaggaccatttcaatacctttgaaaatatcttggaacttatttctcctttcctccacggacaaggttgcgacttctactctgaaataggcttataccattcagactcactttatttaatacaatagttacatccagtagttggtcctattcttcatatatccactttgcaactcataaatagcatattgatctgtcacataagtcgatcaatccatgatgcaaatgagcaatccacattatacaactcataaacatattgcctcgttgagacacacaactaaatcatgcattacatgagccaatttaggtagaattttgaaaaaaaaactgccttctcatagacttatcaccaaagccttgttgttgttattgtcttgtttctttacacgatgatattgatagaatgaagcctaaactaaaccaataaatgtgcaaagtgacatgagttgctagagaattagctacacatagatgggacgctataaaaacacaacgatatacaataaatgcagcatcaaaaatgggaataagaagttggtggattttcacaataatagtgaaagatggaagttaatgacaaaacaataagatttaagaagatatgtagctaaatgatgagttgaggataaaaataatccctttgtagagtttacatacaatttggactagaaattttaccagtctaaccagatacatctaaatagatattgtaaaagagatataactagatcaatggacattcttttttgagatttaggaaatgcaaattgtgagctcaaatataattttatgaacacatgttaaaacaactcaagttgtgtgcatcaggataatgaattgaaagagggaaaaaggaatacattaatattaatatacaaacctgagtagagcatcatgtaggtccagttggtttagttgcaaggaagcaactacctttgagaagtggatatgaaaccaataaatatatcattaaataccaaattagtaggtactcaatggctcatggaaaatttaagtatagaaaaatacatacaatgttgtatttgctgcttgtcgtctcaccaatttgttttggtccttatggctctaatcgatacttactcctagaacggtatggatattttcccaaacatatgatattcatatggatccactgcaatggagagcacggctaatgtgaattcaacacaaaagagaatgtccttatggggcttaagagcaaagt

SEQ ID NO: 3085 - DNA, 1000 bp, Zea mays
  misc_feature (1)..(100): optimal_loci_280543_G1, chr8:90423436..90424435, Cluster 18
tgccctctgggtcgactgattcactgttttccctttttccatttttataattttaatttaagtttgatttccatgttcaaataaattgtgatccaaatcacttcaaaaaatcataaataattagaagagcactttagtaaagtttgatctcatttcttggtgaggatttttatacaaaaataatgttttccctttctgtatttgaggaaaacatatgtaaactcatgtttaaagggaaaagaaatcaaattcctctctaaaacttgtgacatgtgtttgtgtattcatagtggttttgtgtcatacaaaggtagagtgttacaagcttacatgtatgttctacttatggaccctacctatcatcaggcctactgcttctatctcattgtgatctcatatctaaacaaacacaaactctatacctcatagccatgcaatgcacatggagcgcgcatcagtgttaatcatttctattgaggtgaccttccaagctaggcctcgctgagtgaggacatgtgccttaaggggactagtacaccataatagaatctcagtatggttccttgtacttttactacatgtaagtatattcatactacctagtcatcgctatagtattttttccattccttggtaaagggcatgattgcctgacctggtatggcattaaatgtgatggtagacctacacaatggcaacgagtacatctgtagccctaagagcatgtcaggttgaaggtataaccataactcatataataatgtagtttgaagcattacttatctccccatttgtagttgttcctgtctagattttatgttacgtttgaggactttctcgaggtgattttcataccagttggtgggacatgtatgataagttgtgtctatgggtgcccaggcctgtgtcgcttggtatgatgtaattggtacctaatgtagccttttgtacttgattgtgttttatggtacactttgtgtgtgcacgctcaactataggg

SEQ ID NO: 3086 - DNA, 1160 bp, Zea mays
  misc_feature (1)..(100): optimal_loci_282653_G1, chr8:102704765..102705924, Cluster 18
caatatgatctgatgatcgggttgaggccgtgcgacccttctttttatagttcagggaaagggacagtttggtacataatgcttatctagctatcagctcgatgagaatggagatcgatctaaaatgactcctaaaattaatgagatctatctctatctttatgtgaggactcctttatagatagggacatgctcttgttaaaaagatattgttcttatcataaatgatcatttttctctaatctgttcatgcgtgctgatctggttgtgggtcgagtttccctgtgcccgagtccgagttacccagttcgagtttgagtcagtcagactcactcactcacatgtcagtatctccattgttggggcgtccttaacacaactgtcatctaggtattaggaaaacaacacatccgtttcacaaatttcagaatatcatgatggcccatatctttgttatagataaactcttggaggaacattaactctatatgcaattctttgcaatcgacattagaatgctgaccactctttagtctcatctcaagtacaagaagactacaaacttttgtgatctaaaaagcacaacttatgtgaagtaaataaaaatccaaagaattttcttatactcatgatattgtttaaaaaccagtaaattaatagcttgatcaacaacggataaaaaataattgttcaaactttatagaaaaaaactgaagataataaaacgcagcacgtactgaagctgttctattccagcacattgcagcagcatctatctatcagtagcgcgcgcatccaataatgcatgccctccaacggtccaatcctcatcgcatctcacagtagaaattccagtgccgggacgatagcgttaagcgtataaacaccatccgtcaaaagcaaacagaatgcggcaacggatcctgtactaatgggataagaatggaacaacgtacgcaagcagttaatcgacccctccctagcctgtcgtccgtccccgattaattacaactccggattactgaaagaccatgggtgcaacgattttatcactctaagagcccgttcgtttagttcagattgtgcccaggaattgttccggtttattaaaattatacaaatttgtgaatacaatcaacgggaaatgattccggagggtc

SEQ ID NO: 3087 - DNA, 1273 bp, Zea mays
  misc_feature (1)..(100): optimal_loci_282853_G1, chr8:103705405..103706677, Cluster 18
tctataaaagcatataacaagtcaatatcaatatgtaattaattaagtagacacacataattgcgtaagcacactcgtatttcacaaaattgaaccacacataacatagcaactcaagctaaaaatcaccctgctctgggtccttcccccatgtccttgtcatactataatattatatacatagatatgggatacaattttgcatatagaaatacaggatactccttatgggcaagacactgggctaactaacaatgcaaaaacaggatataccatttttgaatacggtacagtataatcatgtattaatatggggtaaacgaaaacaatcgcaatatggcctaacccgtttccattccattttcatttttctcatatctttttttcataccgttttcacatgtgtccaaaaatataaattcaagcggggtaaatataaaaatcagtacagaacagaacgagatttttttccaaccgtttacacccctagctatagctccaattcatcgtaaagctctgccaaaagggtaaaaaatgaaaaagtttaaatactcccctcatctataaacaaccttcacataacactctaaaatattttttagtttattttacccctccatttaagttggtttcgcttactcttaacattttttttatttttttatgtacaaaatgagtttttagtcaaaatttattagttagtagctaatatcataatttagcctaggagaatatattatgatttttataattattttgataaatgagggatcagataagataactttaacagtacaaaactaaatattaaaaataacgaaaaatacttatgtcagaaaatataacttaaaatttaatttatgttaattacgtacaagttaagttttaagtttatattttctaagataattgagaacatcataacttatgttaaattttttcatcattattttatatttaattttataatattaaagttattatcttctcggaactctaacctatcaaaataattataaaaaaatcatactatattttttagactaaatcataatataatttctggtttcgtccgtagtctcctttatcgtcattcacaacccttcgaattgtgtggcgaggttctccagtgaggcagccatgtgttccagttattagagcttgaatctttgacggcttcttcgcttgcgccagcacaaagacgatggtgagagagaaaaataatccctgatttaatagaccctaggtacctaactattacgagcacaagtgt

SEQ ID NO: 3088 - DNA, 1383 bp, Zea mays
  misc_feature (1)..(100): optimal_loci_286794_G1, chr8:124492392..124493774, Cluster 18
cgtgaagacgtgggcctgatgaaagaataaaagtaaaacctataggaaatttggtttgaaaaattataaagaaattttatttagttaaattagcaatgacttaactaagaaacgagatattttataaattatatatttttacatcttattaagttatttgcaatttaattatactattttttacaactttatgaaattgattttctaggtgtgctgctttttatcttggtttgattaattttattatgtgaagaataaattttaaatatgtttttctactatattttacaatgataagattcaaaaactaattttaagtttagatgaccattgccgacacccgtttggatccatatcagtatatatttagtatgtcatcagcatgacgtcagatccgtttgtccagaggatcaatgtgacacatcttgacaagtataaaaatagtgcactttgtcagtatatggacggtacggcatacctttaacaaggactaaaataatgcagtttatgattaggcgacatgaggtacctgtttaagttgcggaccggtagtgcgcgtactcatttttttcacgtgaactttgtattgattcacttagctttaattcgtatcgattctactgattctacaatattttatctctttgcggtaatctgaataactagttttaatctaaagcgaacaattttggaaactaagtgtagtcaaaatcatgtatgagtgtgatagatttttttgttagttcattacgatggcgtcctcaaacttcaccgtgatcatgactaaacaacctagaacatcatacaggcgagtgtggatctactagtaggcaagcacgaccttggccatagatccattcgaagaaagaagatgaggtagacacacaaagtctgcttgtcattgagataaatgacaatagtttttttaaaagacactgatgttaaattaaacggatttcaacttccacatagctcataacttaccattatttttctataacctacaactcatatcccacaaccacttttttcaaagaccacaactcacccaaatacactctcagggactgtcagattctatgagctaaaataaaagtgactacaatttagtccctttggagctaaagatccaaacaaggatagttaaaagtaactaaattgatacatttttactattttagtcacttttagttctttttgtttagatcgttagcttctaagtgtctaaactttaattacttttgttttagctcctagggtccaaacgaaccattaatacttatcgtgttgggctccatattgcaggactggatgataacgaggctcaactcatctcctataactgcccaagtgggaattgctatgagtaccaagcatttgcta

SEQ ID NO: 3089 - DNA, 1123 bp, Zea mays
  misc_feature (1)..(100): optimal_loci_287953_G1, chr8:131116810..131117932, Cluster 18
ggtgttttttggtcccagaacaatcaaatctaacattcttaggaaatattaaggccacttgggtgtacatgggttgagacaacaattggttttctagtttctgctcacaaatatcaagctctttggattttccacacccgtgaggagctctagtacctagggtcatgagatttttttttgctattttaggtttatttttttctaggctttttgtttgttggcactagataacatgttgcttttcttgggtccattttcttatgtagattttttacttcccatgctcttggaccaattctcacattttcatccgtgtacctgagttatatatcactagtttcaaatgttttggtgtcctaggactatcgagtactacacatttaggaaactattaaggcactaggatgtagggtgagacaatatatttctaactagtttcttctcccaagcaactagttctctagattttctacacctatgaagagctcaaatacacagggtcatgagttttttgctattttaggttcattattccaagtattttgctcgttttggcactcagccacatgttgtctttcttggacccattttctaatgttttcactatttttggtgagctatagcccattggtttcaagtgtttggagagtcttgaaactatcaagttctagacattcttaggcaactattaaggccactatgatgtacctaggctaagataacacctcaaatccaacaattaaaataatacattaataatcaaattaaaacttaggataaagtaaaatttaaatctagtgcttgatctcatttatctttagagaatgatttttgtttgctcataattgattggtgattttattcaaaaaaatttatttatttggaacccaattaattaatatggaaactttggttcaaaaataaatactttaatgttaaatattttggtataattattatggatttttataaatatttaaaaatttatttatttatatttttatgggatataaggataaaagattttggtaatttatttatatttatatttataattatttatttatatttaatatggaacccaatttattgaaaattatatttatttatttaaaaatatttt

SEQ ID NO: 3090 - DNA, 1061 bp, Zea mays
  misc_feature (1)..(100): optimal_loci_288077_G1, chr8:131806097..131807157, Cluster 18
aggccatcttccggcctatatagaacttctagtcatcatctaatacactagctaacaatatatttatatagtatttgtttctaaattttatagtgatcaactgacctcaacaaaaccctctagctccgcccttgatttggacaaatttaataatacagccaaccgcttattataaggctattatcaacagctttcataactcatctttcgttttaaactccactctacaaattgtgttgtgcaaaaatagtgttttacactgctatatacatgaacatgatttgctggacacagcctaagggtctttacgactcaccatttagctcgtttgtatagtagttaactcttcattattaatataatacctcacttatctctctcatattttttagttcttgtatctatgccgcctataaaattataggtcgcttctttctattgtcttatatatctagttcacattaacatttaggttttgtttgggagagcttcactttagaagtttcaagtttgtttcagcttcttctatccaaacagttccagttccacgagctctagcctcaaatggtgcttcaaaaccactgtttttatacctcctcatagagttgcacaaaaattatccaccattgttattggttacatgacctattgattcatgtctctttctccattctctaatcatcaaggataattaaggaaactcatataaattaattgtattataatgctggagtctacgtgcaaaccaaataatcttaaaactcgacttactgatatgttaaagatattttatgatgaagttagaaaaccgaagctataattaccaaagctaagctctctcaaaataaaccttagtcactttatagtagtatagccgcacgattgatttgcttcatggcctgggtcgtttcacagtcataaccagaaccgacggtcagtgcatctgacgttagtcccagtagatggatagaccggccggcggtaatgtgatgcttcagttcagccacctggcgtgagtccgacctcaaagctaaagagtcgtggctagtattgtgttgcct

SEQ ID NO: 3091 - DNA, 1052 bp, Zea mays
  misc_feature (1)..(100): optimal_loci_291367_G1, chr8:149615028..149616079, Cluster 18
gagaaattctgaatgaaatgtaggtgtcacagaaagccttcaaagactctgtgcatacttaggatcttctaagtaatacagtaaaaaaatcaactaaaacaatgcaaatgagatacaaacacccctccttcttaacaacccaaccacccagatttaatagctctactatttatcccaattaatcctactatgtatttagatctatccttagctcagtctcagcagagagttttattgtttctaagaacgtagaataaaatggaacatggatgaaacgtctacgcttaatataatgaaaagtgtcattctacgaattttaaatatctaattttatgatttgtagaaagttagtaatagtgccaagagagttcacttcttctatctcttgttaaaaatattgtcacatcattaaaattgttcaaatgacaacttattagatgcaaataaaaaccccactagccttatattaattgattactagtctaaacatgccttttattaaaggacttgtttggatccttgtggcaaacagtttgccggctaattttagcaccataacctacaaaataggtcggctaataaattggctaattattagttgggggctttcaaactatttgcttattagacatttgaccttgctaataggtgttaatagatcgtataaagtgaaaaaaacatctattagctaagtctctaaacataccctgattaatttttgctagctaattatttacatataaataataagctagtaagatccaaacagaataaatactcaaatcatttacgtgaaagtttccacagcaggtgaggagatggacgtgcaattgccgccggacaaaagccatagcccacagctatatgcctacgtcactggagccccgtgacgcatagacatgcaagcacgtacgtacgccacacatgcacatcaggtcgtacgcggcatgttttagtttgtcttggtttcctccaccaattggacgatacagacagcctagtagtctgacctgtgcgaagagcggcaaacgaaacaatggtaatcacaaaac

SEQ ID NO: 3092 - DNA, 1068 bp, Zea mays
  misc_feature (1)..(100): optimal_loci_291989_G1, chr8:152727813..152728880, Cluster 18
tgtgtagtatatgtaaatgaggacgtaactagttactgtcctagtacgtgaaaagtatttcgttctgcttctaatggtttgggcagatttagttgattttgacccgttagatcacttattttgtcctgcagttactatttagtaatttagatcatgtggcatgctgggtggaaactgtgtatgtgaaatgtgtatatgccttctatgtttggccagtgcaagctgataataactaatatgatatctcgaattattagacaaatttgtgaaatgtgggtactattactctcttagctaatacgatataggtctggggccgccgcaagcgtgctgatagagtgacacggtagtacgtagacgcacgatatagaggttcagtttattaggttttgggttgcctgatcgaaatttcttacgttttctatgtggtgaatgattagatttaagtacgagaagaacttacgtactcagatgacttgagctagcgagtagaaataatcttaggaatcttagggtctgtttggttcatttagttcatggactaaagtttagtctctactttaaaagtatttggaacacattaaatgaattataagaagatcaaaatatatcttagcattatttcattattagtgcgctgaaataaacgaggggcaaaaggtgaaattaatatggtttaatttcttttagtcatcttttgagtgactagagataaaaacagtttagttcctgttttaatcttacggtttggtaatttaaggactaaatagaaataaaatagaggacaaaccaaatggggtcttagccagttcttgcgattctatgtattgttttatatctattttgaccagtggcggatcctggaatagataaaagacgagactactaagttagccaaccgtggcgttgttggtctgcgttgttggtctgacgacaagcagttagtaccttgtcctgggcaacttggccagttagctattgtcgatctagagcctaggatgggtggctgtcaaccgtaggtgtggcatagagaaaatggagggcaatcactggtgagacaatagcggg

SEQ ID NO: 3093 - DNA, 1075 bp, Zea mays
  misc_feature (1)..(100): optimal_loci_292951_G1, chr8:157926550..157927624, Cluster 18
atgtgtggcagagtgtagctagcgtcgggtgcagagtgggtatgagaagagctagggttcatcgtctcttataaattctaggttgatttgggtcaacgactatttatttaagaggcctatctccgttaattgattttaagagacaatcaagttttaagtgtctttgtaaatggtttgtctgtctccaaaaaatcaggggacattttagaagacagtgagattttatgtccacctctgttaatcaaatcgtttgtcttccaaaatcatctatgtaatagtgataatatgataatttattctattgagctaggctcatataaatttagtcaagtatgcttaaatatttctcttattaatatgcaaagtggactctatttgaactcatctaaaatcttcgtattccggttaaaaggttataacacattataatttatttttttttgtaaacgctctaatgtgtttaaggaaaaaatatggctacaactgaagttttattataggaaaattcaacgtcctgtccactgcagtggaagccaaaacacttgtctacaccactctttgtaactaggatgcaggacctaagagcatgtacaatctagatattatgttacggttctctaagcactaatacatctaagaaacttcttcatacaattcaatgtatacaagtcttctatcttattcactagaatctcttaacatatggttcatttatgtgggttgtatggatggaactgtatctaaacttagagaaccgtgctagagacgttcattcaccaaaatatatcttatgttttttacacttatctccttagtaactcttaaaatacagatcatttatgtgggttatacattgccctaacacctatatcttaatgacatccaaaggaaggcatgtaataagaggtacaaacgagctctaaggttttagcctaccatgcatacgaaaaacacaagtatatagatatgtagttttgggcttatttaatctggaacgatagggaaaaaaatgttgtccaacgtaaggattttacttgtaagaaaaaaaaaaagacactgttcatatccacaaaat

SEQ ID NO: 3094 - DNA, 1076 bp, Zea mays
  misc_feature (1)..(100): optimal_loci_292956_G1, chr8:157974832..157975907, Cluster 18
ttccatcaaaattacagaatagactcgtgatgcaccatatcatctagaatggattgattcttcaaacaaaacacccctctatagactttgaaatgagtggatggctcaaaccgaggagaggaagaaaaggcgagatataacgtgtatatttagttataattagtggcttattttaggactaaaggtgttccttgctctcctaaggggaaaaaaacggatgtccattctctacaataggttgcaacaaaaaggagataaaaaagtgcacgagaccttggaccatggattggtgaaccgttaataattggcgcgtcgttgctattattacgatgagccgaactctgcatgcatgcatgtggtggtgtttttttagcgatctcatcattctcgtgcatggtgcatgcttcataacgccttttataatattgttaaattaaatgtctagtgtgtgctctaataaatctagtgatggccaccagttggccatcagccagtcggtccacgaggccgcgccaacctaacctaacctgccctgccgtgtggtttacattgccactgagatctcgcttcgtcaccctcgtcgatctggttcagacgctcgcatagtcgcatggtcgcttctatacttctattagcccatgtgtatgtatatattgggtatttataaatatcacgtcgacaagcaggtttggcaaagcacacatgccgctgcgcccagaaattaagcagtttgctagtgggcgaacatagaggcaaaaaaaaatatatattgagaggcttggaggagctagcggaatagttggccccgcacaaggaagggtctaccggtgttcatttaacttttggtcatccatacctacgtgtgtatgaaaataaaataaaattccactagattggttttaaaacacaaattctcagtaatttttatttagaaatatgaataatgaaattactggaaatgaataatctccactcctttaaaagttgtgtgcttcgtgcgtcacgctcgatttgttttctctctcgcacatccttctcttgcatgcgcaaccaacaatgcaaccattacgagcatt

SEQ ID NO: 3095 - DNA, 1181 bp, Zea mays
  misc_feature (1)..(100): optimal_loci_292957_G1, chr8:157976205..157977385, Cluster 18
tcttaccagcaagcgcctcgaaccgctgccgcaacactctaccacccaatgagtgctccgaatcatgagtttagttttgcattggttgttgtcaaagagtttatgagatattaaggtcgctgataatatatgtattgctcgttttcatgtaattgttatacgctactattttatcgaatatttatgtgtcatcgcaacgtacgagcattatactagtataattatgatgtttgtccatgtaataattctataatgtctataaaaaggggccacccatcatacaatgtttgtgagtttgtccatgtaacagttgtactgaaataataataataataataataataataataggatattcgtctccttatacattgtgtctgagtgtctctattgtattgtttatagttttatacttaagaggccatattgacacactttgtaggtagaggtttattgtagtaaaggcacaaatatactcaaatgtaccaaaaaaaggcaccaatatactcaaaggtactaagtaaaggcaccaatatacttaagaggtcatattgacatagagcagtctcgacactgtatggtatgcttatcaatcatgacgtcacgatcatgttgatacggggattttatagaggttcaagttgcaaggtgataatatcctacaccctctctcatgacgaatttctatataagaagactatacaagagcgcaagcttgaagacagaggggattgtacgttttttattaccttcatggtcctccttatggtcttatagatgttagtgaggagaatcctcccaaccttcaaacaaaaaggtcttctctttaggtgttgtgatattagactcgagtattggtcgtccgatctaatccgatcaatacaacagactgatacgatctatatttttttatcgcaataattcactgatcacgcataggccacaagccatgtttttacccagatcccaatccaacccgaagaaatctaacccaaagccaaaaaacaagacacaacccaaaaaaaacctaaccgatcctgaaaatctgacccgatacgtctaacaggtaggcacgggccaacccaatctaacccgacactgggcacggatcaagcatgggccataccaaacaacccacaggctgaccttgacctaacgtttgaacaagtctatgtggataa

SEQ ID NO: 3096 - DNA, 1069 bp, Zea mays
  misc_feature (1)..(100): optimal_loci_294377_G1, chr8:164942661..164943729, Cluster 18
gtctatgcttctaagacaaatcatggaactctttcatagcctagagtttgcaaagatcatggtaagccttcttatatagtttaccacccatgaaactatcacctaaacatatatttgttcataattaaatcaatattatgctaggagtttaagataaaatatccaaatatgttttactttatagtattgctcctcagtcaagtaaatgggccaaaggacgcacaccaatgtatctatgttatccaattttaacatagataattcaaacctcaaagtaaacaaaaatgatatatgccactatgtataccaagtacatatgcacacaatagtgaaaatgtattttatagtttatcaattgcaaaaaaaaacaagtttctttaacaaaccatatatcatgaccctaaaacccattcttaattatattgaaagtctgcaacaatgttttttgcaaattttattttagatgtctatacattttacatatgaatactggtagtttaattataatcactctattttttaaagaacaatacacacatacaactctttggtagaagaaaattcaatgccttgagtgttgtggcgtggattaaaacacatgatgatgctattgttgtaagtattagtgaagtttaggatctatattttcaataaattatataaaaacaacacatgattcaaacttaacacatggatatgaaaaaatgctaaaactaacatgattaaaaatttgcagccaaaatatcgattcatgtatggtgccatagaaaggatgcaaagatccgatataatttaagttatggtttaaaataaatgagtatttaaatcaatggaggtgtagcgcaaagattaaaacacatagagaataattgaaaattttgtcgaaacatataaagcagtaccttagtaaaggtgatgcagttttaattgcatcattagtcaaatttatctaaagtttgaccaaacaattaatataagaagagtattagacacaaaataggtatattgtgaacatatattatatgataaatctaataatacatattagtattgtaaattttgctatttt

SEQ ID NO: 3097 - DNA, 1028 bp, Zea mays
  misc_feature (1)..(100): optimal_loci_2949_G1, chr1:15138516..15139543, Cluster 18
ctacataacgatgaatattcaaacaagagatctgacaacgttatgcgctaacagccaaaagaatacagtatagctatttgaattaataaggaaaagaatccagatcttgctgcagaacctcaacatgctcatcattgaaagctagattatactagggtgggcagttggtacacaagagatagaataaaagcttctagaccaaagctactatttgaaagaatcttcggttttaggtgtaatcagcagccaaatatgtaccctactattagagttgagggtggaagttattcaggacatggttgtggtctttgtaactcacatgggagtcgataaaagtacagctcctaaacagaaaagtttaaaagaacacatcaaggtgactgctaccaaatttatgtgcaattaaggttaaataacaatgtcttcatggctaatgacgcaggttaagaaaaaatgcaacaaacatccacaaagttggatcatggtcatatgagatagagaaagaagagtaggggaggtgagtatgagggaagtaaacaattgagggtaaatgtgcatcttgacaccagaagtgtctagttcctttgatccatgcacatttgtcgaaaattgttcgacagtgaatttatgtgctaggtcgcttattcgagaactaaaaataaagacataggagacacgaagatttgtggcgatgtcaattgctatgcaacatgatctgatgatttgttcctcattttataatccaaggacgcacgacaggtttacaagatacatatctacattgtctataggatggaaatcataaatgagtctatcctaaattatcaaggagctgaactctatttgtacatgtgtttcacccttatctattggactttaccatatctgctaggatatcatctcccaattttataagatcttccccatatttatccctctagaatctctttgttgacattgtttccctctggtcatgtcagctgagtctctagactctcagccgatcccgtggacccactagtcatatc

SEQ ID NO: 3098 - DNA, 1199 bp, Zea mays
  misc_feature (1)..(100): optimal_loci_295163_G1, chr8:168292572..168293770, Cluster 18
taacatcaacttatttctcacagttagtactaacatgatgaataaaatcatccactaaatttaagaaatgaacttatgatacaccaactcatttcagatgatgtgatttctcaaaccaaacattctctaagacttttgtttgaggctgctccaaaaacgaagcagagacgttttagtgatttcagcttctatccctgagacaactttggtttcagcattttttatttgggtcatttttttgtagaacttaacgaaggagcctagaccggaacaacttttgaagacaaaatcctatcaaaaacggtgaattcgaaattgttttggagttaaacaggctgaagccactaaaacatgactttcctgaattctccgtttcttagaagcctaagcctgactttctttgtttttagaagcctaagccgaggctctctgttctttttcgtgcttgtttcgtaggacttttaattcgtaaatacaccaaagaaaccctaaggcctcgtttgggagagacggtgcaggacgccccgtgaagccatgaccggcggggcagtccctgccatgctcctgccccaggtgtttgctaccccgcggggtgggtagctccggctgttgtttggctgcaccagtgttcactgtcccacgtgtccacactacactaccgttcaaggagcacctgtcatttgacttattttttttatttttacagcccacactttgctttcatggaaacaaaaaaatatataaaaatcaataaattttaaggggaaatggcctgaatgaaaaagaaaaacctaaaacctccagaaaaatcaataaattttaaggggaaatggcctgaatgttaacaaagttgcaatcacaaatcatcacatacacttgtatgttccaacattccaacagtgattcacaaaaactagctggacacttgtcttccacgaaagcatcacaagatcaagtttttaattggatgaaaccagatattcataaaaattagtgaaatttggaagttctagctagcaaatcatcagccacatgttaaagcgattcaactagcatatcatcagccactatctcaatggttggagaagcatcacaagatcatccacatgttcatcagaagatccacatctttgggctcgatgttgtgctgcaataacaagtgaattatttcaattagtcagtcaaagcctacatgtaat

SEQ ID NO: 3099 - DNA, 1055 bp, Zea mays
  misc_feature (1)..(100): optimal_loci_295839_G1, chr8:171410010..171411064, Cluster 18
ttctgatcacgcagcaatttgatgtaagtgtactctctacttcctatcttctaagccgccgtgtgtcagtaacaatcatgtagcatcctattcctgtatatttttcggggttcaaatatctggattatcttctccacacaaacttgagaagttacttttttttggggggggggggggatgtcgtggtccttggtctaggctttctgcttccaaggttatatgtttggtgcatgaatgagctttcgctatgaatgtgactctgccctagtgggtctgaacacttgagagtgcaatgcagtgcagtgcagtagcatcttcagagtatcaaggaacacttgagagtaggttccccttttattacgctgtagacaatccgttatgaatactgaatctgtctgaaactgtgtctagtaccgtccttacctgcactgaactaggatatctttctgcgctgcagggataaaccagtttaattaatatataaaattgacagggcttccaataagaatgtcatttttgagtaacatgggctagatacaacagttttaacatgtcaagtcctccgccaaggggtggtgggtaatctggttacaatttttgcggcttacgataatcaacagaaaaaggcaaaagaatcaccattttacatcccggtttgtggcaggaaaggaggagcctgtatgggcatagcctggtcgttatcactggattctgaatagtttcagtccatggatacagctctaccctggtctgcatcaaaatctgaagcaatgacgagggacggagtggaggggtatagtatagagcaacggcgagcgcacatactgctacttatcattgaggagaaccttggttaaatcttaaatatagacatccataaatattacatcatttagtttatataaatataaatattgtaagtacagatctgtattcaacatacatgtaaaatctttttatgtataattttttaagatatattctaggaaaaaaaatattgatcaaatacgtgagtgaaagcatctaagccgatagttagatttcggtgattaata

SEQ ID NO: 3100 - DNA, 1014 bp, Zea mays
  misc_feature (1)..(100): optimal_loci_296074_G1, chr8:172991876..172992889, Cluster 18
gaataactattaaatttaagcaatgtatatagaaatgtagttatgcaagtatatctaactagtgtgttgtgatgtaggaaaagtgcaaagtaggggtagaagtggaagtaggtctgctttattgtggaacaaaaaagtatatatgatgcatgacctatttgggacagttagaagatcgtggggttggggatcgtaagagttgattttgcgaccagggatcatgagggaattcatgtgaagaaattcccttctattctttgaattgcaagggaatttcttctcatggattccctgatttctgatcatcaaactagtccgaaaaaagctcggctctcacatctacgggctagtgcatgtatgtaactgcaattactagttgctaataactaatcgactagtttttgttaaagttttatttgtatttaataagctagtacttaatattttttatataaaaagaagtaaattttacggagataaaactttttggcacaattatctattttatagttataaaattaaatatctacacaagcatagaatgtccgctctcgtctcgcctatcgccttttacggagacaaaactttattaagagtagttattttatctagtttatattttattctataataattaaattcatattcgaaacaaagctatacaaacaattgataccactctaataaataaatatcaaataggcttctggcattatttcaggtgtcactggaggatggatccaagaaagaatcagtcgagtaactgtggatggcttcgaatcggaattcacagtttacacgacaaaaaaaaggaactacataatctgtggaactcatattattttgtcggcactgacgaagatgaacctagattaagcaaaacctttgaaattaggaatagatcacaagcgagatttcggaagaataggtggttaagtgacataccttgaaaaaaaacagtacccctctttattcgaagggggtgtttggttgctcctgctaaagtttagcacg

SEQ ID NO: 3101 - DNA, 1243 bp, Zea mays
  misc_feature (1)..(100): optimal_loci_296360_G1, chr8:174173700..174174942, Cluster 18
caaatataagtaccatattagcacaacattgaccttcattatctaaaaggatatgtggattcaatcatgaataacaatttcatagttctataactcctttcctctttaaacgaatgaggacttgaggagatggaggagcttgattggaggtgttgggtgaaactagtgcaagttccttgtcatgcaatttatgtctactaatgaatattggttgctccagccttgttgttgtatgaacaaatgtgacgtgctgagcactgaatacgctaatgctcttttgaatggaagtgatacgtctgagctgaattggctttgcattatacttttgaataaaccggggtgtgtcttttagcccttatatctaatagatggatgggctacaacctataatattcgcagacaactttcatttacagtacgttttgatttgtagtttacttctattttgccagcttaaacttctctattcttttaacaaatcattaggaaacaatctatttttaatcatcgaactattgtatgggtttttgaacatcgaatttcagaagtaggcatcgaagtatcaataggactagtttttcaaagtagttttgcttttatatgtttttaaacaaaaaaatgattaaataatatcgattcatttaaatcaaaataataaaaccactatatttttaaaaaaaaataatccatttattgatggtctgtttagagttatatggataattactcattaaaaaatctaccaaagaagttctttgataagttcttcctagagaaggggagttcctaaacaaattatagaaaccgggagttagaaaaaggaagcttctatcagctcctctcatattttcctcttcgcgggtccacgtcgcatgaggagctacgttttcaactaaacatagtgctttttatagttttttttttgaaaataaggagagagttgttttatagagaagttagagctagagctagaagagccttaccaaagggggcttatttagaccctgtttggcaaagcatcactttaatcatttgaattatgtttcagttttttctattcaaacaggtctatctggaggagctttagattcaaaaaaactgaaacttgaggccaatttcatgaaattttcgaagctcctcaaagggtatttcaaaaacatcgttttcatatctcataaagttacagaaaaaatacccatcatgtcattgtttacattacctaccgattcatgtctctttctcc

SEQ ID NO: 3102 - DNA, 1089 bp, Zea mays
  misc_feature (1)..(100): optimal_loci_298913_G1, chr9:8959885..8960973, Cluster 18
gggccgagaatggacttcgggcctctagtgttcatgagctctctctcgttcgtgcctagaggtgcagcccatagtcccgcatttctcatcggattgacgcggacgcggatgagatgctgcgaggctttccgatcccgggaggaccaccacaggccacagctacagggaggactggggacggacttaacgcggagagggtacggtggctacggaggggcggacactctacggagcttaggtccttttttttttggaacaatccatttttttaagaaatcggttttttagtttttaactagcagaggcgagcttcttaaattttaagaaaccggaaatctaatttctacaaattaagacataaattgatatgtttggaaccaactcaattttttataaatcagtttcttaaaaactaggtggttccaaacatgcccttactcatacacgatagatccttgtttagggggtatttgtaatggctccaaattccagctccaatatagagttgtagtttataatatcaatttaaatagttttaaaaatatttttaatctaaataataaataaaataacttatttaaatgtcatctaaaagcttaaaacttcaactccccgattttatggagcatttaatgacctgctccactaacttcaccaaattttttagagctggagttgtctcaaacaaagctttaatattaacgacatgtctgcgatagtttttttttaaaaaaagtgaatttaaatatataggacttatcatgaaacagtttgaatttaggattcattagcatactgtttagatacataacagtttcggatgcatgaaacggaggttttgctgaaatagcctattttgtttgctatatctatattttttatatactacatgcgttctaataaaaaaatgatcttttctaaaaaatgcaatattttgatacaaatactcatgagcactcaaaattagtgcacaagatacctaaagaattaatatttgtctttaacaacatttcaatactattatgattgtccatacataaaggtaattaaatattaaataacgactagttttttcgttacatgatagtt

SEQ ID NO: 3103 - DNA, 1131 bp, Zea mays
  misc_feature (1)..(100): optimal_loci_315523_G1, chr9:109147643..109148773, Cluster 18
ctgcttagatatttcataaacatcaaggataatatgaaaagatttatctcactatggaaagaatgccaactattatgaaacggatattgaaatgtatgacaatatttttgaggttgatgaaaatatgtgttgttagtttttatataattgttgcgcaatactattttattgaataatttgtgtgttgtcaccacgtacggacaatgtactatttataaaacgtgcgtgagactactacaaagttctagaggcagtttaattttaattaacagcgtaacacatggtcatacatatgttattatattgctctttttcgttgcaacgcacggttatttacctagtttttgttaagtactctactaaatagactttaaattagttaaacactcttgagatgctccaccaaatcctaatatttgtggagttaaaaaagttacctaccatatcactcgataataataagagaaaacgactcgatcatttctttcatgtgcctcagccctcgccatgtgttgtctccgtctcggcggagcccttagttttagaatctttatttttttagtttcatggagctattccaaatacatgtacataaaaaaagatgaaacagaaatataccactccaattttgaaaagttaaaatctagttcattttcatatgacttcatgacaacgaaatgaagtaatgaactaaccaaaagttaaatacctaaaaaaatccccgtgaacctgtgatcctatgatagacgctgccataccaaacaaccagctgttctttccgaaaggtggtagtggctcgatttgttttcattatccggaggccgatcagatcagggttaccttaccttacctacctacttgatgtgtgatgtgtgtagttcagtggcagtgaagccgtggccattatagctagataaatttagctatcatcagaagaaaaacatatgaagtagacttcgtaaatggctctctaaattcaaattcagtggctctctatccccaaacaatccctctatttttggatagcatgcttcacttgctaaacaaagttctgaatttataaaggctgttgaactagtctagtcctttctttgtgaaatctattttagagggtaactaaatcagtcaaat

SEQ ID NO: 3104 - DNA, 1273 bp, Zea mays
  misc_feature (1)..(100): optimal_loci_319409_G1, chr9:130491461..130492733, Cluster 18
ggaaaaacaatggtgtttatttatgtgctcctacacttggcagtagtgctggtaacaatgaatgcatctaaaacataaggttatgacaaacatattaccttactagctaagttttcgtaaactgctacgatttctatttgttcttaaatatagaatataaacataaagacatgtgtgttctgttggctagttgaatgcgaacatgtgtttagagtcaacaactatgggtcgaatcttcatttgtacataattttatcaattttcaatttaaatgtgaggggcatgacgacgatggaaaccgtgtatccaggaaaactggtgctttaatagagatagagataaagatagagaagagagttgtagatgcagatgctcatgcacttacttttttcctttttggaaaaaggcaatttagagaatatgaatgagagtttgggtttgcgtgtataaggcttgatcgagtgataccaacaagataaacttcttacagaatacaagaatgttttgagctcggtgacattgtgaatgtcaaagaagtaagtaccaagactacatattgtacattttgttggattagttgtggtcaccttcgttaacgagaagttttacgctttgtgggaagttaattatcatatatgtgttgaactgcatacagacctacatttatgcagaactttgtatggatctatatttgtgtggaactatatatggacctatatttgtgttgacctatgtacggacctatattttgtgtgggactatgtatgcacttttgtcatgttcgtatggatgtgtcatgtttaggattcataagtaattgttataaatgtttaggatttacgagtaatgattatatatatcacattctacatttattaatattatttcgaaacataaccaaatggttgtatgaatatgtcatggttagagaattgtctattgcactcatcaaccaaacactactacgttctacttcactctagaactaaacatcgttctgttctgctttagcctagaaccaaacaaaaacaattcggctctgttctaactaacaaatatagagcagagtcattatatcctcaaaatatggaaaatagttgttccgtcaaactatactttagaaccaaatactatattaaagtagctattgatgatggtaatgagtagttttcattactcattaagaacattatactagtagctttataatctgaagattttgagggtccaatgagcagttatacattcgtagaggcgagtgtaggcacactta

SEQ ID NO: 3105 - DNA, 1087 bp, Zea mays
  misc_feature (1)..(100): optimal_loci_324074_G1, chr9:153454243..153455329, Cluster 18
aaaggtactcaactaaaaagcgacttcaaatgaaaatataaattttaattcaactttgcttttgattgcttaccaacggagcggaaggaaaatgcatgtctctatacgggaacatgtgtgacacatggtcatacttaaggtgttgtcattttagcccgccacatttttgtatttagacataacttttttgtttctttgacgatcttagatgaaaagctcataaaaagatatacatgttaggtccgaagtcattctaatttgagaagatcaaaaaccatgtgatggcttcatgtttgtttgtctttgcatccgagcttcaattttttcatgtcttaagagtcttgtcatattttacaggtcttcaacgtggcttcctaatatcttccatgaggtactctcttttaataagacataaaatatatgtgttctattagttaggtgggtgtgaatgtggatcccacaaccgaggtacaaacatctatctatgcaaaattttactttacttttgcattaagcggaaagggtgacacgagacggtcgttgaaactgatattttatataatggagattgtgtattaggttatgtacaaccctgagaccttaagaagccactcatttaatggggttatacatgccctttgcaaataacattagtcaaataattatgttgttcatcccaactccaaaattcaaagttaatagctcgttggcacatgtatgttatatgctcagtccggtttccaaatcataaatccttttcgtagatttcagctctcatagcaacagtttcagtgatgacaaaatctaatttcaaacttgagataacatacatcctgagagctcaggtatatgcaatatgttaccttggatttttggaagaaaaatggcaggaggtctaccgactaccgttgcgaaaaatgtaaagttaaaccctgaaggatgacaagtatatattagcacgcaaaatagaactaccacagactaaaagagcataatagacaatgatggagccatgtgtcttgttgcccatgaaagatgcgtacagaatctggtgaggccgtcttcccttcgctagattgtcgtctct

SEQ ID NO: 3106 - DNA, 1007 bp, Zea mays
  misc_feature (1)..(100): optimal_loci_324320_G1, chr9:154788808..154789814, Cluster 18
gggaggatgcagaggaagtggatcgaaatggttcgtttgttttttaggaatccatagaacccacatttttaagaagtgtttcgacctataactaacctaacccgcgagccttttgaaccaaacacgagttgtcgtggattaaactcgtttcaacccgcatcaatccaataaccaaactcaagctaagaacatttgaaagaataatgatttgcctaaacatgcgtgcgttgtggaggaggccacgggcctactatgaaaaagtgaagattttatataatcagatagaatcatccattcctgtattccaatttccaacgttataattggggttagccaaaccacctatcttgttaatcaccgaaaacggtaaaagcactagttttcgacgactttcaatttttttggccggtttctattttcaaatttaaaaacacttttcgtgtctagagaaaccaggtttccggatggtttttggtgtttctcgatcatttttcggtgtttctcggtaaaatctgagttacgcatttttagtttttttataaaaaaatccagttttcttggctaaaaaaccacgttttatcagcgaaaatcgttgtttgaccaaaaaatattggctagttttaaaaataaaaattaaatatatgatataccaaattatttaggaatatatgtaatttgttttcataattctttcttgtttttttataaaaaaatcatttttattttgaatgaaatagaaaataaaatccgttcttagaccgagccgtgcacgagaaactgtccctagaaccgcggttcccgattggttttgcaatgtctaactagaactgaatccttcccctaccttgtttccaaagcaaacacaatattacttgcatgctccatttaaggcttgtttggttagaattgaattgaaggggattaaatctctaaatagaaaaaaattaatcacatttaatccctgctgtcctcatgcaaccaaatgacggccttagcgagttgtaaca

SEQ ID NO: 3107 - DNA, 1184 bp, Zea mays
  misc_feature (1)..(100): optimal_loci_325362_G1, chr10:4701601..4702784, Cluster 18
atcattctatcccttttttttgtatgtttcgcaattaaacacatccctagattttttaagtccactagagtgccagtaaataacgaacgcagaagaaaacaatactatactgtttttcttaccaattgtgtttggttaatctagattgattgtgatcctctaattaatctatgagactacatgagtttggatccgatttaggaagatttacacttgtacgtacaaatcatctcatgtccatatctagactttttctgcacaacttagtctttgttcgagctctaactctagcttttagagcttttctaaagaactgttgctgagcttttgatcatgagaagctaaaagtaacttttcaataatgttattggcttcataaacttaggacggtataaaaagttcatgatactaggcttcccagcttcttatataaactcatattttttaagcttatagctttccagaggccaaacaaaaaactaactatttatttcattttctgactttccacactaaaaaatctcagctttttgctttttcacaccgagaaactagcgagaagctcaaacaaattgacctttagacgtagacactaagtccgtgtcccagcagttcatccatatagtcacaaaaaatactgttttatattgtaaagtataatatttatatagtgtagtttgaatatttagatgaggatgagtaagatgcgggagatagttttatatatactaacaacgtatattcgctcatataaacattcgcatgcatatcttatcagtataagcatttccgaagaaagttaggtcggcaaatcataagactgaatcgagcatctatgtgtgtacgagcatcgttggctataataatgaattaaagaatacgagcatctatgtcgagcgacggacaatttaaaccgcacggctgctctgttttttttttttttttttggcgaggcataggggtagacgacgatttggatgtttgtgtgtacgagggaatggttggattggactaatgttgggtccactgggccgcatactgtgtccgccagacaaaggccaggttgaaggtgaagcaggccgggctccaaaggcccggaaacgtgaattgaatggcaaaaaaaaaagaagccacacacccagcgaatggtcagttcgtcctcgagacccccatcgaatccacac

SEQ ID NO: 3108 - DNA, 1135 bp, Zea mays
  misc_feature (1)..(100): optimal_loci_326246_G1, chr10:9144327..9145461, Cluster 18
atattgattgaccttaattgagtttgtaaaccctatgctgcaaaagtacacatatgagctaggtcacttgttcactagcctgcatggctgcatatgtcatgtgcacttgagccaaactgttggcaagtacattgcataaaaatctagtgcaggtatcagccaccaggcggcttggatgattagtttatttatctgttgtttaacttcgttagttgctgtcttttagaattccagccattttttaattccaaccattttttgttctttacgttaatgtagtagggcagtaggcatccaatagcagttggtttcctttatttttcttttctcaaagaagatagagtaacctccagtgatattttatggcatgctactttttgggcttttgtgcctcactctgaagtctgaacagacatgtactaggggtagaattcattatcgcagcattatctcacatccactgaaaatgcttaaatcgacttcgccaatcaatcaggactggattcatttatttcagttcatactaccatagtgacaacaattaatataaaaagcttaaaattgtttaaaagcttaaatctacttcgccaatcaatcaggactgaaaatgcttaaaattgttgtaggattaaaagcttttgttgcaatcaaaacataaggagtcatgaaaaattctcaaaatttatagttatactccattatttactttatcaatatattaaattttaagttctaggccaacctaagttaagagatataaaaagagaaaaaatatgttttattttttatatctctaattacatctataattttttgataatattttatatcttttgatagtttggttgcacgataattatactaaaaacttaattgcaccatattttctgtgtatattgtgagagctatgtaactatcgtgttttaccattgttgctttgcctacctagttgtatataggggtgagaatggtcgaaaaaaccctctcaccgtttcatccgtaaatttttttgttcggtcggaattgaaaaacagaaaagttggaagcggattatgaccggtaaatttcggtgtcggtgttttaaaccagttccgacaagtaaatttgtttgtacgcgttttggatccggatggtg

SEQ ID NO: 3109 - DNA, 1245 bp, Zea mays
  misc_feature (1)..(100): optimal_loci_326971_G1, chr10:12918865..12920109, Cluster 18
ataatatcaatttaaataattttaaaaatattttaatctaaataataaataaaatgacatatctaaatgccttctaaaggcttatagctatagctccataattttctggagcacctaatgacctgctccaccaactctaccaaattttctagagctagatttgtcccaaacatggcctaaatatataattgctagaattattttaattctaaattttagaaattcccagtttaaatataccaatcctattccaaatatgtattggtattcttgatcatattcctaataggtgtgttgatcctattctacctatgtgattattattgatcatattcctaatatgtgtgccgatcctattccaaatatgtgttaatatattatagatcatatttctaataggtgccctaatatttttctgaatatacgttgatattgttgattctattcctaataggtgtactaatattcctaatcctactccaaatagtttctttttattttcctttgcaagacaccaagctaggactataaatatagcacctctcggctcttatctcatccatctattggttgcccttgctatctctcacttcactcgttgctccctctaggttcaatcttcttctccctcttctccgttgcaccatagaagccatgctcttgaccaaggatgaccttcccaaaggaaacatctttcccaagggattatagaacgggagaagagggaggattagagagtgcatcgacgttcaacgccgtctagtggagcataaaccgtttcctatcttgagattgaccagaaatcgaggcaatccactattagatgcatctcgaggataaataggaattttagatatcttttccccttttataaaatcagccttaaacatattgagatttcttgcatttgaattgcaatcaattctagtatgtgcattagacatagtagtgaattcatcgcatgttgcaccaaatctacaaggaggttgatttgtttttacctaagatagagaggcaacagaaagagaatcaaagttggcatcttgaatctccttgatagctcctcactgatccacctcaaagcatgctatgtcatactcttgatcatctataactaaatcatttgccctctcctccaacatcttatgaacatacccaagacgttaattgaccaaagacttgatgatgagcttgggattagttgaatatgtagaatcatatttcttcttatcgaccatcttacta

SEQ ID NO: 3110 - DNA, 1219 bp, Zea mays
  misc_feature (1)..(100): optimal_loci_33122_G1, chr1:202768785..202770003, Cluster 18
ataaatggatatgagatggtgaaactaaccatcatgtagctctctcaaagtttcaaatagaggaaaagatttactgaggaatttcttagcccttggaagccaaaaattaaaagatgaggcagaagattggtcccatcttttcatatgtagtgcaaaagacagtgatggaaaaaatgtctcatattgtgtagttataacttgtattgatataaagaaatgaaacaaggacataactagtagcatcttataaatgagcagctaactacaggcaacatgcatactattagaggctgatatcagagaatcaactttctcaaaagcagttagcaattagcataggaaaatagccacatgatgttcatcaaagcagctgggggcatttcagtagtcttgctcctcaaaagcaatttttttcataaccagaaagtgtggaacacatatgcaaagatgctaatttctaaactgacataatggaacacatcaaaagaaggattaccaaaataattgaatcaaagaatatcaaatggggtgtacaaggagtagcacatatcgaaacatatacatatcgaaaatgtgtgttggagatagacacagacacaattgcaaatatggaaaagaccggatcaaaaaatcaatgtagagaagcttaggctgggagttaatcattttatttttagtgcttattggatactttgcctcctactcaaactttgcacaacaaagagaaatacaaaattaaaattgtgtgcttacacagaggtagacatatcaacctatttaaatctcaatgcaacatcactcaattaccagagatgcttgcaagttattgcaaatagaagacaaggtcagaatggcatgaaaaccaaaataaagagtgtgttcatgactcatgtgaaaagggaaaataaatactagtctcgaggcataattttaggttattactaatctacagtgttgttgtgctgttattactagacaattcagaatctatgtgaaaagggaaaataaatactagacttgaggcataattttaggttattactaatctatagtgttgtcgtgctattattactagacagtttagaattctcatgtgttgttattactaatatgtaggatgtttgaaaacatactgttggagaaagaaacttactttgattatgttgtcccgtattagaggatcaacttgaatcatacaccttctctcatcactagaaac

SEQ ID NO: 3111 - DNA, 1057 bp, Zea mays
  misc_feature (1)..(100): optimal_loci_33200_G1, chr1:203167197..203168253, Cluster 18
actctaatcagacgactgaaacggtaacagtaaccgaatgattataactgtaatggaatgactggaactataatagaatgacttaaagtataacataatggctgaaactgtaaaggaatgactaaaactgtaattgaacaactgaaactataatataatgacttaattgaacaaatatatactgaatggttgtatgagtaaatggttgagcaaaaaaagaaaatatcttaaataatcatcaaagtatcttaaattagattgcacgtgattaagaattagtgaatgtcttaaaatataatttaaatgacttaatataaaagagaaggatgagaatgttgagtgacttaaatgacactacaaaatagttgctaattgaacaaaatgtgtactgaataacttaattagtaaattattgagagaaaaggaaatgtcttaaataatcatcaaagtgtcttaaatcatattacacatgattaataaatacttgaacgttactaaatgtcctaaaatataattggaaatacttaattgattcatcaccttatgtgacaaatagagtccataaaatacaacaagaacatatacatagtcacatagacatctatcaaccactctatctatgaaacaggatacaacagacacatgggtaagcatgtaacaatcttattacgaaaaattgcaataggtcccctatatcttgatctacgatggaaaaatagcattttttgtatatattacactacattattttatgttagatgtatttacttaacctcgttgagcaagattcaagtattagacaatttttgttgttgagagaatctagctagctcaattttatgttatatacacctggcttgcaatttcctggatattagtttagacttgtaaatggacatcgctgacaaatagaaacagcctcagagatgttccagagatggtcattagcttacactagctcaatcttttggtttcttaaaaagtaaaagcagaaaaccgacctttgagcctgatatatctgatatatatatacatggtggctgcagcacccttaatt

SEQ ID NO: 3112 - DNA, 1025 bp, Zea mays
  misc_feature (1)..(100): optimal_loci_33535_G1, chr1:205224559..205225583, Cluster 18
tactattgtagtacagaagtggtaatagttcaaggccactatatattatgtgtttaattaaattattattcatttttccaatagttactatgtgttcatgacatctattatcaagaagcatatgtgtaactttctgaagaaatgtatcatgtgaaacaaatttctagccaatttcttattaaacttagtaatttaatgtatttttgggcattagatgccatatttgaaaaataaataaataaataagtacaaagagtatacatgtagatctattgtttatcaattatataacatcatttttaaataaatgtgtctaaacagtatactatctaatctagattaggggagcataaacaattatattaacttaaggtttaaccatgtctaattatatgtttattatgaataattacaaatggcaactcataatggtgtaggggcacacaaaggagttaaaatgactacaaacgaactcaagagaaattagaaatgaaaactaaaattttctaatcaaatgggcaacaatagattttgttgtcatttttacattattcaggaaactagtttataaagcaaggctttgttaacatttttacattattctaaaaactaatttataaaaccatagtattcgcaagcatagatggatgtagtagagtcaaggtccaatggttgtttatttattttatcctaccctatttaagaattattttcactactttttcatagttatcactagatggcattaccattatatttatatttgcaaataatttgggatgatgtgataatttcattagataccatttcataaagaaaaaggttgggcgtcttttcttttctaaattttattttgtaggtataactaattgctataatagttaatggcatatggataaagaaacaagaaaaacatcactaactcagcatccacttcatgtttgccattaatacggtcaatttgagcttgaccttatctcttccctggagtatttggtctttggattcttctcacatactataag

SEQ ID NO: 3113 - DNA, 1029 bp, Zea mays
  misc_feature (1)..(100): optimal_loci_33615_G1, chr1:205695022..205696050, Cluster 18
tagcgcgaggattggttacacatgtaagagataagacatatcttatgtggatgttaggcgacacttgtgaaaaaaaacaaattcacatgtttcatgcgtgtggcacgacacacgaaaagttgtgatttaaatgagtagaaattggaacctatgcagattttaggttgttatgcttttcttttcattctgcttgtgtttgtgtttggattcatttaatctaaacaagaattcattaagttacgttatcatcctataagcataagcatttcgaatatgatttttactaatacgtatagttttttgttgttggttttttgagaatggatcggaggtgcatatgtctgcagcgtccttttcctccaatcggttgggtcgttgatattttccagctttactcggattagtttatctcagtcattgtacacagtcggaaaactgacagaaaccagcgagactgtagccgttttaaatgttagctatttgtaaaaagactaaaatttcacgatggtgcaaaaaagaatagaccggattactctatccgtcttaatttacaattcatttttattaaatttgttcggctcattttattcattttttcaaaaatttaaagtcatacataaagacatgacaataaaatctaataataattatgattttttaaataagataaactgatcaaacttgacgttaaaaagtcaaatgaattataaattacaaccgagggagtacaatttacattccaatttcctcttgtcaaaatagaacatactatgatgcaaaaggaaaatagttgggtcatactaatattccggaagagctttgatgacaaaatttgcgtgcatgtattcatcgagtgtaggtctactttcgtggacatttacatttactagtaccttacgtgcgtcttcctacacgctctagcgaaggttatcgtcacccgcgccaccgctctgtgttttgccattgtttcacttttatagaggtgctaaagatcacatttgtagcttcagctgcacaattttaactata

SEQ ID NO: 3114 - DNA, 1200 bp, Zea mays
  misc_feature (1)..(100): optimal_loci_342573_G1, chr10:108113372..108114571, Cluster 18
taaattttaaagttctgctttaattttttacagtgaagaaattgacttcatacactctccagaacactcctctgtttcgaggtgtgtatatatatcttttccatgtggccaaaacagtatagaggttatataaacttaattgatatgtgctataattattagaatggatttagaaggattcaaacggatcctttaggaaaagaaatagtgggtacataattttctatatttattacacgtagttcgggttcactttgacttgtgaacactgaccaactccaaccattccttccatatttctctccctatatatactttctattatattttactataccctctaaaaagtactcctttatatatagaatgtctccaaacattcctcctttttagctccccttatacacttgttagtgtttcataaccactggccagtaactatcctgttttgcacatctcggagcggatggtgtgtaaggtggatacaaaggtctatacttgttcgggtagaatgtccctacgatcaattgagttgtgttccctacattattctgtagtagaggttacaaatcgacgggagagagggatccagctcccaagtctctgatgaataagtgcacgtgcgattacaagcgctctgtgtagtacttgtgttggtggtgtatgagtgtttgctcctgtcttgaatccatggtacttcctttggttttataggttaaggtaagaaaagggtcccattacataagtcaaagggtaggatgaaacgagtaaaggtcgggtgccgttgtgtagtcgattatcctccatcttctcaccggctaagggacactatggataacgtctccttcctctgttaggatcctgtagccacactaacgccacctcaaagcatgtcgttatgctcctccatgttcgacagtggtttacctggtgtcctttgttgacttcctaactatggagtagttaagcatatatcaatctccacaccatgacaattgacgtttgtgtcctgacataccaactcttgtgctgtcatttagaccacaagcctgtgttagagtctgactttcatgttcccatgttcatagtggtcgtcatggtacaatcccaaaattttcggacctacatggttgggcaaagtatccaacccctttgtccttgggggtcgggcgagtcgaaactctaggcaaggtcgctcga

SEQ ID NO: 3115 - DNA, 1300 bp, Zea mays
  misc_feature (1)..(100): optimal_loci_346030_G1, chr10:127269133..127270432, Cluster 18
attttttttaagtttgcgtcctgaatcaagcgtcctcttatcacgtgcacaatcccgctcctgtgtataaatgcacaaaccaaacattggccattggtctgttgtccaatggacgatacacaaattgcaaaataaccctcccgtactcccacggttcctccaaccactgtactgaaaacctcctctccaccctttcttccccaaacagaagcaaactacaacctatatgttgcctctagttgaggcctgaatataaacttctttgaccaagataacatgtgggtaagacagtagttaagaaagtaaatttctaaatataattaagttaggtcatatttggaagcaacctagttttaaaaaatccagtttatatctctagtttctataaactggtttacgaataaaaatggtttatggtttttggaaaccaactcattttttatagactagttttagctaagcgaggctagcttcttggtttttaaaaaactggaaatctaatttctataaactgtaatataaactggtatgttggaaactaccctaattttcataaacttcacaaactagtttctaaaaaactaggtgcttccaaacaagttctaagtatgagatcaagggagcaatacagttaaattgcaactatactcacaaatatagctgcactcatttgcattcgctagtagcgcttgataactttaaaaaaaaactcgaacgtagtcaatttgcaacaaatgttagaacttaccactgttttgcaatatgttgcagtaaaacgtgcataaacaaagagtttcaaggtgagatgtatgattttttcttaaaaaaagaggctctactagctcaaatcctaattcacaaaggggaatgcttgaaacaactatattcattaaaaaaagcagttaaaaagtaaaaaccaaacaagaagcaaaaacgagatatatatgttgtgcagttaatattacagcgtaataagttttcaaatgccaaatcaaaatgtctgtatagctattgtacttttcattcataataggtccatctttaatacggttcacagttcatactatcagcacgaaccaaagctttcatccaacagacaggtttcgcggtaaacaaactttttcaatctcgagtcttgacattcaccatctacgtacaggatacaactacaggtttttggatcaagaaaaggactagcagatgaagcaactgatatcaaacacaatcgcaagaaattatcaaacaatgctgcgaacatatactaattaagaaccattttcacattgaggcacaaagcaat

SEQ ID NO: 3116 - DNA, 1207 bp, Zea mays
  misc_feature (1)..(100): optimal_loci_347273_G1, chr10:134050235..134051441, Cluster 18
gcttctcgggttgaaaacacctgttgtcatttgtcaactgggaacgattatatatgttcttgcataaggaaaaaatgctcacagaagaaaacccgaattgttgtagcacaataaaaatagtctgagacggcgacctcgctgttgccagtcgcatagacagggaaatatttccggaccatgagctcatcaccagccaattctggtctgggctggttttaattcaatttttactattttgggttgaaaccaaaacttgagaccagattaacataagtgcgttcctatgccttggcccatgagcctgataggcccggctctggggtacggcgaggggaggtgtccgcttcaggcctccgacggcaaagggccctagcggctatgtgctgtcgatacgtgtattggactggacctagagctttaagcagacagcttttgtcttgggctagcccaaaagtacatgagcaaatagttagtagaacgctgaagattttctaaaaaaaaggtacgtagaacgctgatgctttgctaaaaaacagaagtagaaagcttatgcagtcttcgaatcttgcacgcactcacatcctcttcataattctgaacccaacggccatcgctgaatggctagattctcttactatgataaatggatgatcaacttctcataaatgagtgctaaagttcaacaagcgttttattattagatcgctgatcaagtttacataaattaatactcaagtttcaagtgtttattattagaccgctgatcgcctttgcgtaaatgaatgttgaatggaaccttgaggtgatttaatatgtaactcctgttgcaatgtaaagtgtacatccattttattcctggaacacattaatttcaattgaaattgtgcatggaatacgtttactcactttgagatcagtttctactcccaatatctcaatccccatctagtaaaacaaatgcaatccgacttcgtccctcctagctagagggaagcaggaagagagggtaagaacggctcaggtcccgagtgaggttgttattttttttatttaactgaattggttagtagttagtactcctccggtcctatgtggaagcgaattttaggccacaaacaggggcgacgccagtagtacttgtctggtgcacgggcaccagggtgtatcaagaatttctttgtaaattgagtaatatttattatatatc

SEQ ID NO: 3117 - DNA, 1322 bp, Zea mays
  misc_feature (1)..(100): optimal_loci_347343_G1, chr10:134407049..134408370, Cluster 18
aaataccatggttgacttggtatttaacccaattcaatttcttaccctccaatatcgacatccaaatggagcattagggcatgtacaacccacataaatgtccagtatcttaagggggtaagtgcaaaaaacacaagagacggtatcttagtgaaggaacatctttaacacggttctgtaagtctagatacggttctaaccatacaacccacataaatgagtcgtatcttgagagattgttttgaatatgatataagatttagatacattaggttatatgaaggggttttttagtgtatctaatgcttgtagaacaaaaagtagtacattcccctcccacatactataattctcgagttaaagatcgtcaagaatactgtatgcgttttggaacctacagctcactatctggtgcttgaattgtcgcttcgttttgctctgctaataaaagattcagcgaccttttatcgctaaagttgcacgataaccacacccatgattaaagtgcgggcaggcgattaggcgttacaaacggcatccaacactcgataggcatgctcatttgtttgggtgactgggacgttcggtcgcagcgcgccaggcgccagcgtcccaagaccaagaagggatgttgacaggtgggtcccctgtagccccaaaggggttacagcgtggtccagcacccgggcccaaacgtcttccaatggcctgacacatttcaatacagcaatcaattcactttcggtgagaatcgtacctctaattaaaaccaacagttcctcatatcaccattaagagacaccttccttatttgtttttttcggaaacatcattattttctattataatggtattgtttgacattttttagtttcacattattcactttagttctatactaaatcaaacttgttaaaatttggcaaattatttagaaaaaacaattttaatatactttggaccaatctcacgcgctgatggctaaacattgccttgtttggtcgcagacactcggggcttgtttaggagcagtggatatgctagatttttgtgctagttaaactttctaaagtcaaactaaatttatagaaaaatattagtgacatttatatctccaaatatgtatatattttataacaacatatttaataattattctgataatatttattacttatcctaaacagtagtaatctcttattctcttatgtatatttcattgaagttgaatatgttaagaacggagaaggcacgtttaataagatgaatgcgtaagcatacatcaacttttattaaaaaactatcatttcatgactattaat

SEQ ID NO: 3118 - DNA, 1410 bp, Zea mays
  misc_feature (1)..(100): optimal_loci_34793_G1, chr1:211527669..211529078, Cluster 18
catcttacttttacgattttctacaagtctctgctcctgcagcatcaatgatctcccagatccaacaatgtcaggcacttcatttgtcttactcttatcaatcttcattcttgtagagcacctgcttatctttgtggacttcatcctatctcattcatggaactcataaaacatgttagtccacctagttatattaattaccaaaactacacatagagctttatttacattgttatgaaggaagagaaagaattgttgagaataaaaattagacattgtagacacggtgtgattcagggatgacggtggaacttcaaacatcatcagggtgtgatgtttactttatagttcagtttcctgcatgcagttgaagttgaatcatttgcattgtgattatcaggctggtaaacccagctctgacaacttttagtaactacaaaggtcaaagttgtaaaaccaggggatcaagtttaagcataaatttaagagcagctaccaaaggtctaatcgtcttcaaagttgtatcatagcttgccacagaacttacctttaaaagccatttgagtagttttcataggtttactcatcttcattttctaaatctagacgtgctaaatgacacaaatctacttctacagcactaaaacgacagtataaattacaagtcattatacagtaccacatccaccaatccatgtaagaaacatggatataactaattgaacaaatgactgtttgaaatctctttgttatatgggaaaataaggaaacatacaaaacatcgaatgatcttgtatatatccttctttttccatataaggcacattcatcttataaagaaaatcaatagattatttttagctgtgcagagtcaacaatgtgtcctctgttagcacatccaatggcacaatgttatccaagcatcaggtctgtcaaacatagcacgaaccagcaagaacaaggtccaatagagagaggaaacaaacttagctgttcctttcattaccagattttaggtatagggccacatgattattgatcattttagataaatcaccaaataagtgttgggaaatatgtatattatgttagatttgtggccatacaagaaatgatagagtccaaaacggtgatatacatgatatgttaaggaagcactaattaaataaaagcttgttcaacaccgattaagaaggtttagacatgtccaccagaaaactctaaagacacccatacgtagtgggatcctaaagtgtgatagcaatagaaagagagacaaagaaagaccaggttgacatgagaaggggcaataaaatgagacttcaaataatgtaatatacccaatgatttagtcttcaatagaagtgtatgtagaacagctattcatatgtctcaaacttgactggtcta

SEQ ID NO: 3119 - DNA, 1114 bp, Zea mays
  misc_feature (1)..(100): optimal_loci_34809_G1, chr1:211675798..211676911, Cluster 18
gaatgattttgctcagcaccaaacgctactgcttgttattgttacaaaaacaagcgcaggctgagtaccagaatgactctgctcagaaccaaacccttcttgttacaggtaacaaaacaagcccacgacagataaaattgggggagcaacaagctggtgcgatcggggagcgagaaaggttttgttacatgcctatccctttggaggggtcagataaaattgtaacagaacagaacttactgtagcactatcagtaccatgattctttcatgtcgcacacgacagaggaacatcaacttcatcgtatctatgatgctctcacgttctcaagatcctgccgtaagaatcaaatatcaaaccacacaaacagccgataaacacgaagttcaatcctagagcgaacttaaacatgcccataagcaagtttttaatatgggacatgtactaaaatcaaagcagcagtacatcctctcgtcatagtactgttcttgctttaaaaactgcatatccatgttcgtttacaagcaacacagggttagaaacatttagtacccctggacaaaatttcactcaagcaacagagcaaatatcaacaatagtgtaggggtagatgcaaattttgatagcttatctgcccagagtttgagcgagagagaatgaacattcagcatctgttcagtcacaaactcataatcaaaggaaaaattacaggaaggagggggggggggggggggtattcctaaaaaaacaacacatactgctcttcatacctggaagacctttaaagagacatcaacagacgaaaggttgaagtattatgtgcagcaagtattcaacacatggtaaaattgtatgactaataaggtcatgtttggatcgactaggctaacaactactccctccgccccttatcttgaggtcaccaaggttctaagtcaaagttttaaaactttgactaacaatatctataaaataattatttttaaatcaaagaaattatatattgtggtagatgttttaataataaatataaagttttatttttatttagataatatttataaatatttttttattaacggttaaatcttcgtgactttaagattggagacag

SEQ ID NO: 3120 - DNA, 1043 bp, Zea mays
  misc_feature (1)..(100): optimal_loci_349870_G1, chr10:147936507..147937549, Cluster 18
  modified_base (359)..(359): a, c, g, or t
  misc_feature (359)..(458): n is a, c, g, or t
  modified_base (360)..(360): a, c, g, or t
  modified_base (361)..(361): a, c, g, or t
  modified_base (362)..(362): a, c, g, or t
  modified_base (363)..(363): a, c, g, or t
  modified_base (364)..(364): a, c, g, or t
  modified_base (365)..(365): a, c, g, or t
  modified_base (366)..(366): a, c, g, or t
  modified_base (367)..(367): a, c, g, or t
  modified_base (368)..(368): a, c, g, or t
  modified_base (369)..(369): a, c, g, or t
  modified_base (370)..(370): a, c, g, or t
  modified_base (371)..(371): a, c, g, or t
  modified_base (372)..(372): a, c, g, or t
  modified_base (373)..(373): a, c, g, or t
  modified_base (374)..(374): a, c, g, or t
  modified_base (375)..(375): a, c, g, or t
  modified_base (376)..(376): a, c, g, or t
  modified_base (377)..(377): a, c, g, or t
  modified_base (378)..(378): a, c, g, or t
  modified_base (379)..(379): a, c, g, or t
  modified_base (380)..(380): a, c, g, or t
  modified_base (381)..(381): a, c, g, or t
  modified_base (382)..(382): a, c, g, or t
  modified_base (383)..(383): a, c, g, or t
  modified_base (384)..(384): a, c, g, or t
  modified_base (385)..(385): a, c, g, or t
  modified_base (386)..(386): a, c, g, or t
  modified_base (387)..(387): a, c, g, or t
  modified_base (388)..(388): a, c, g, or t
  modified_base (389)..(389): a, c, g, or t
  modified_base (390)..(390): a, c, g, or t
  modified_base (391)..(391): a, c, g, or t
  modified_base (392)..(392): a, c, g, or t
  modified_base (393)..(393): a, c, g, or t
  modified_base (394)..(394): a, c, g, or t
  modified_base (395)..(395): a, c, g, or t
  modified_base (396)..(396): a, c, g, or t
  modified_base (397)..(397): a, c, g, or t
  modified_base (398)..(398): a, c, g, or t
  modified_base (399)..(399): a, c, g, or t
  modified_base (400)..(400): a, c, g, or t
  modified_base (401)..(401): a, c, g, or t
  modified_base (402)..(402): a, c, g, or t
  modified_base (403)..(403): a, c, g, or t
  modified_base (404)..(404): a, c, g, or t
  modified_base (405)..(405): a, c, g, or t
  modified_base (406)..(406): a, c, g, or t
  modified_base (407)..(407): a, c, g, or t
  modified_base (408)..(408): a, c, g, or t
  modified_base (409)..(409): a, c, g, or t
  modified_base (410)..(410): a, c, g, or t
  modified_base (411)..(411): a, c, g, or t
  modified_base (412)..(412): a, c, g, or t
  modified_base (413)..(413): a, c, g, or t
  modified_base (414)..(414): a, c, g, or t
  modified_base (415)..(415): a, c, g, or t
  modified_base (416)..(416): a, c, g, or t
  modified_base (417)..(417): a, c, g, or t
  modified_base (418)..(418): a, c, g, or t
  modified_base (419)..(419): a, c, g, or t
  modified_base (420)..(420): a, c, g, or t
  modified_base (421)..(421): a, c, g, or t
  modified_base (422)..(422): a, c, g, or t
  modified_base (423)..(423): a, c, g, or t
  modified_base (424)..(424): a, c, g, or t
  modified_base (425)..(425): a, c, g, or t
  modified_base (426)..(426): a, c, g, or t
  modified_base (427)..(427): a, c, g, or t
  modified_base (428)..(428): a, c, g, or t
  modified_base (429)..(429): a, c, g, or t
  modified_base (430)..(430): a, c, g, or t
  modified_base (431)..(431): a, c, g, or t
  modified_base (432)..(432): a, c, g, or t
  modified_base (433)..(433): a, c, g, or t
  modified_base (434)..(434): a, c, g, or t
  modified_base (435)..(435): a, c, g, or t
  modified_base (436)..(436): a, c, g, or t
  modified_base (437)..(437): a, c, g, or t
  modified_base (438)..(438): a, c, g, or t
  modified_base (439)..(439): a, c, g, or t
  modified_base (440)..(440): a, c, g, or t
  modified_base (441)..(441): a, c, g, or t
  modified_base (442)..(442): a, c, g, or t
  modified_base (443)..(443): a, c, g, or t
  modified_base (444)..(444): a, c, g, or t
  modified_base (445)..(445): a, c, g, or t
  modified_base (446)..(446): a, c, g, or t
  modified_base (447)..(447): a, c, g, or t
  modified_base (448)..(448): a, c, g, or t
  modified_base (449)..(449): a, c, g, or t
  modified_base (450)..(450): a, c, g, or t
  modified_base (451)..(451): a, c, g, or t
  modified_base (452)..(452): a, c, g, or t
  modified_base (453)..(453): a, c, g, or t
  modified_base (454)..(454): a, c, g, or t
  modified_base (455)..(455): a, c, g, or t
  modified_base (456)..(456): a, c, g, or t
  modified_base (457)..(457): a, c, g, or t
  modified_base (458)..(458): a, c, g, or t
ggttatctctcgctgaagatactaaagcaaaaaaaaattgtagtggggttctcaatgttcaaattaatctatcggtgaatggactatattgatttatcatatgaagatagaaagaataatggagctaatcttggctaaaagcttatgccctcttttagatatcatgaatacttatgcatcttttaatatctatacgattcagctgtacatcagacagctcaatcacgactgatgatcactcatgtcacttccggggcttctcgaaacaagactctgacttttcgcgacgtgtgacaaaccgtcacggtgtcgtaacacattttcagatgtccacaacatcgctaggcgtacctaactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtatgtcaaaaagaaaaatgatagtttgttagattagttaggcttatccataactagtctactcccgccatctctctgaaaataagtttttgttgtgtaagtttattgtgaaaacaaattcaaatatatatctaatattattaattatgtattgaaaatattaatgtttttacatatctagtcaaattttaaaaaacgttttgatttatcgaaaaaacgagaacatcacttattttgatggagcagagcaattaattaaagaattataagacccacaagtagtgctaatcgagagtgtgatttatatcacatagggaaaaaagcactaggaagcaggtgctcgagttttttttagaaacatttgtccaagttaaatagaacagcagtgcgtgcatgcttgtttatataagttgggggcggaaagttgaacacacgcgcatgccgtcgtgcaatgtccgtgggctttagagtatatatccaacagtgtgcaataactactagttctagtacatcaaaattaaaataaatctgttctttttccaacagcaaggagacaaaaaccgggacaggataaagaattgacct

SEQ ID NO: 3121 - DNA, 1072 bp, Zea mays
  misc_feature (1)..(100): optimal_loci_3742_G1, chr1:19258158..19259229, Cluster 18
atcgcaactgataataacctaacggcctgaacggtgatctactgtagaccttttcttgtgttagcccaagagaaaaagcccatttgatactgtttcattggcacctggcccagaatgtggtggagtagtggagtcacgtaaacatgggcttgaggatttagtttgtcactaactggatccatggaccatattctagcccgaagatcgtactttgcacaatgcttttggacggaaacccacttatcttctattttgggccttttgggttgtgtgatctatgtactagctttatatcggtccgtctagagccctacatacaaatgtacagttagtgctatacacgcaaggaaagacgcaccaaaactgttcgtggcgactggcgagaagccgagaaatacagcatatatttatttatttttcttctttttttcctgaaaagaacggcaggagattttacgatctatgtattgacagggtagaagtgcatcacagatgacaaatgaaaaatgtactgatgaaatactactactactaataataataataataataataatatctattaccaataaatatttaatgtacataaaattgattttaaaaatgtactaaaattttgcttctaacgtctcattacataacggtgccttacataactcctctggatgatgttataaccttatcagcttgttttttctttttttttcttacatctatatggatatcttctacagaacatgattgcacgatgaaattaaaatagaacaataattaactgaaagctattgcgtgctacttgctaagttaaaaaattattaaattcatttataaaatattatcaactttgtagaacttataatttctcaagattcttcggtagatgataccgttcgaagagtgaggcttaaattaggtgatgagctaagaaatgagatagaaaatctgatagagatggccttaggtatttactcctaggtgttagaacacggtgcaatacatatgtaggagacataacggtaatatcagattaaagagacagagaacgataatatcagattaaagagacataggg

SEQ ID NO: 3122 - DNA, 1090 bp, Zea mays
  misc_feature (1)..(100): optimal_loci_41153_G1, chr1:244067449..244068538, Cluster 18
ctaaggttaactgcaaatcctaactcgattttgcatagcttgcattataagaggtcatgaattctgcacaataagtatacagatgatatgatagctcatgagttgtctagttttataccttagtcttgttgcatgataagggcttgtttagctttatctttctttgcactccctttcttactttctttctttctccctttctttcttagtctcgttgcatgataagggcttgtttagtttgttgcaaggtcatgataaggcctgaaatgctccatcagaaatgctcaaatcagacgccaggttgcgttgagcgatgcaacagaatcagatcagtgaggaagaaatgatgaaaaaagaaatcaccctaacattgtctatttgtaactgatattttaaaaggcaacttcttgttgcccactaaatgtgatatcaatgtagttttgacatctttaatgcagtttttgctggatttgattttaatgtagttttttttacaaattcagtttttttgtgcaggaatgcttcaatgtttgtgtgtctggctgtgggtcatcaggtgtgaagtttagtccggtgaacaatataattatacatatgccatgtgtgaagcttagttggtcaaagtaatttagatggtccttgaggtcagtttgcttgttagtgttgcactattagatgaaaatataatcaatttgtcctcttttgatttttaataggcatctgtgtttctatacattataaatgtcatgtcttggcactacatttcagttgtaaacttggaggtcaataacaagttgtatctgtttgaatgtgaatggcatggctggtaaaaataagtgaactaacttggaatttagtggcataccggtatattgccttgttttcagaatccctggcaaaccgaataacaatggcagagacagggaatagctacacgggtaaatattcccagcagggattgagtggcataatagggatccacttgatcccggggtggaaaaaatcagctaagggatttgatccgtaactgccgaacaaagccttcttgttcttcaaaaaaacgcgtctcccctttgtcctcctaccaact

SEQ ID NO: 3123 - DNA, 1248 bp, Zea mays
  misc_feature (1)..(100): optimal_loci_43062_G1, chr1:253764604..253765851, Cluster 18
ccacacctaaacaataacaatgtatggaagcaacttgatgtgtaacctaccttactttccggctttgttcatccggtccttcaattccccacacacggccacatccactggtgtggtatggtccatctattattgactttggatttggcttgaactatttggtggttttttttttgcccctcttaattagcttctactatatatgttacgcggcgaccaagttatcaagtgagtaggtagctgattatgatcccttgaaaacgcatgagcaagagtgttccatatataggttcattagactttgtttctttacaacgacataggtgcagactttatctgtctgcaagatggtatttctttatcattagaaccctttggagccttggaggagttataacgcccaacaaatcgacaagccggctcacattttttttaagaaataaacagtaccccatcagttctaaattataattcgtttgatttttttgtgtcacgtttgatcggctcgtcctataaaaaaaatctgcgaaaaatgaaaaatccaaagctatatttaaagtatattatctgctaaataatatcacaacaaaaattaacaatagttatgaaattgaaacggacggagtataataggatctcatcaggatatagttggtatgaacgtaatgagcctcacacaaaagaattctaaacactactttatctagaactagctactagttgcatttggtcgtagatatcgattgctaatctaaaagagcagcatgcatagtcaacaaatattgcctcgtgtagttggcacatgccaccggctcaaaaattgcggtctagttcatgacacttgttgtgagtctttgagctggtacctacccatcgactgggacacaatcctaccacggaggcaccgattgcgattttcgtcgtcgtagcctgaaagcaaacagcgtgacgatgtgaaacgtccatgagatggaccacggcatgcaatgcaaggcggtttaggcagtgatgcggcaacctgttctatatataactccatcggtttcaatcaaaatgagttagacgtttggttttattttaacttaaaataaacttctataattagattactttttttacagaaaacacacaccgtcaaacatcaaactggtttgcttacattttttcacaattgaatatgtcttggtagttgatagtacatttatataaatcttcatatctgttttttaaaacaaatcctaaccaaag

SEQ ID NO: 3124 - DNA, 1046 bp, Zea mays
  misc_feature (1)..(100): optimal_loci_43596_G1, chr1:256564826..256565871, Cluster 18
cgcaacggtactacgtgcgatggtcgacttgtacaacggtgctgcggcgtcgctcgctgtcgttctctcgccaggcgacgacacgctcgtcgacatgctgagcggaggttctttttgctaaaatgtcagctcatagacggcttatagacccctgttgtacgtgcccttagataatcaagtgcaagtacactgacactagggagcgatgagtaggacacgagattaccatgaacaccatttgtgaatagaacagctaccagattggccagtgcgagagctacatatgatagctacgtgattatcaacttttataaaatatagacttctttatttatctactatattttcaattattttgttgcatcaatattgatcgtttccttctatctatatttatggaatattgtaatggtgaaaatcatgtcaattctaaaaaaacattgtactacagttagtttgagtataaaccgtctatactccgtttgaatatcgatattggaatgcataaaattaaattatacttcgtttggatatcaatattggagaggatagaattgaattgggttgattaccaaatcagacatgatattgaaatgaattgaaatgagatataattccaattctattgtttggatatcactgaattgttaatattggagaggatagaattgaattggattgattaccaaatcaaacatggtattgaaatgggatataattccaattctattgtttggatatcactgaattgaagtttgaaattatgtggtctaattccacgcaatacgaggggtggggttttatattgagagggtgtttctagttatagtgcaattccagggaattgagcctctaattccaaatctcaattcgatgtgcaacaaaacaacataatttagaaaagctaattctaattcctaattttgtgctccaattctacatccattttaaaatggagtattaagtttaataccaaatcaaccatagtattaaaatgagatgtaattctaattctattgtttgaatgtcactgaattaaacttctg

SEQ ID NO: 3125 - DNA, 1022 bp, Zea mays
  misc_feature (1)..(100): optimal_loci_44937_G1, chr1:263639813..263640834, Cluster 18
atcccaagacattgtagataagtgtaaggccgtaggcttgaacacaaaaaaatctagaaagggcgagacggcgagtgcctgggaagcgggcgatcgcacagagacctgcacacgcggcacgccagagccagccgtggccgtgctggatcttgtatccggcgtgtttcactttcagccgcatgccgcatgcctgcactctactcatgcacccttttgggaaaattactccggtcatgatacattaggacagcgacttataaaaagacagagagtcttccagagacagtgaccgaaagaatggcgtgaacagtttgggcggcatcgcatttctgttttttttaaggatggtttgttggctctcgagctttgctatattaatcgattgcaagaccgttactgacaaatcgggcccagaacaatatttaaaatagaagactttatttttataatatacacaatatatgttattaataatactcaaacatatataacacaagttagttgcccgtcatgctacgattcctatatataatatgattagactttgttttaataagacataaaaatatgtgtattctatttgttagttggttgtgaatgtgaagacaataatcaaggtttaaacccctatttgttagttggttgtgaatgtgaagacaataatcaaggtttaaacccctattttacgcaatcttactgaataacgtggaacgaccattgaaaccgatattttaatatagtagatatattcatctcaagtaagaaaatgtataatatatggttatcttaatattttcttctagcatgtcttgatgcgaaacattatgataacatcaatatcaattttatgcactaatatcttctcgatatataaagtagctaaaatattttgtctttcttgcgatattttagatcttaaataatttttcggcaacttcaactttgaaaagattctttctggtgatgcaactgtcacagacataatcacagatcgcatgtcacaaactagtttgaagtgatct

SEQ ID NO: 3126 - DNA, 1196 bp, Zea mays
  misc_feature (1)..(100): optimal_loci_45047_G1, chr1:264197753..264198948, Cluster 18
agtaatgcttcgagtatgacaaacaacatcacaagtaacatctacctatatgcaccgaatctccaccaccaccacaatatcgatgtcagaaggctagggaaggacgaccaataatatagaagacacataggccacactcaattcaatcaacatcacgacaatctacttgatgtcctatgtagccatgatctctacgagcaatcaatatcaatgcactagaatcccaactacgtagagtattattggacgaacgagtaaaacaccaaagagcagccactggacgactttcttgcatctccacaaggataaattctctcagatagtcagatgcctaatgaaattcaagtccatcaatattgacatgtgcgaaggcaagaaggatccaaattagttgattcgacactacttggttaccatcaatctcaagggaggaaacaaagatatcaaagcatcatgctttcaaatgtactcaaagctactctagtgacttggcttgaatagctcccaagaggctacatcgataacaggctagcactctccaaggaattaatggacaacttccaaagtgcatggcctcgttcggacaaccggtacaatcttcaaaatggaagtagaagattggtgaaagcatatgcaactagtacaagctcttgatcgaaatttgatgctacaggcctaactacttcgacgatgatcatggggaaaagttctagtatcagaatttcataaaaacaaaccaaaaacaattcatgagttctaacacatgatcaacaactgaatgaatgtcgaagacacagtacgagataagtttgacaattgaaaccgtagatataacaataaagataacattcatagagacaacaagggcagcttatcggataagaagtgagggaaagataacactatgataagcactcgcatcaaagaagggtggcaagaacaaatcattcaattagcaactctttgagcaacacccataccacctacatcataaatcataagtgctctaccactaaatgcatgcaactcaagaactttggcatcatcttagctcggaagcaagacaaaaccaaacagagttgataaaaaatattaggaaaaatagaataatggagacttctagagggccacaaacatagttaacctcatcttcaaaggagcatcttccttaatacctaagaggaagactaaactta

SEQ ID NO: 3127 - DNA, 1193 bp, Zea mays
  misc_feature (1)..(100): optimal_loci_46248_G1, chr1:270985126..270986318, Cluster 18
agagcacaaaatcaaactactagaaggcaaaagaaaaaaaaatgacgttgcctaaatgcgggagagaaccccacacacacacttgacaacaaactgatagcagagcatgcacgcatgcatgcagtgctacttatcctgataagaaaccccatacctctaactttagtttccgtgaaggatacccatgcttccctgctgcatctatctgaatgcgcctgtggctgtgacctgcagatccaaccaactcgcttcaataactgctccaagataaaacagaacaagttattacttcatgcataaaatattctcattattgcatgcgatggtaagttggctcacggcctcacctaccccttattaataaggtcttgtagagattcaagaggattaaattttttatattaaaaaaattaatcccctttaacctcttaatacatcccttacctaactagctcttacctagaactagctttatctttatggttatggttctgtttatttttcttttaggattatataatctagcttatgaattatataagtatatttaatgatatgtttatagattatcataatctaggtatctagagggtaaacaaacctgtggattgtctgggctttatttgctacttctgccatatttgttgcttctcctttcaaaagttcaagccacatgcgcgcaacgatcgatatgaacgactgtgcgggctgggctggccgggcatcattgggagttcgggatccagcagtaaacaaaccacgcagatcgatcgccagcgctagcttctatgcaggcatgcagctggttgcgcggttggccctcgatcaaaatagctgggatttactacaccttatttatcttacgtcaaatagagtctacttatcaataaaatgacccctttctgccattacgaaagagtctgctggtcgtataccacttaaggttagacgacgacatatgatacataaagagagcaaaacctattgttgtacaattgccactactttttttttatcgaatatttgttgcccgctagtcatgataaattaaaaagaatggagagaatactaattaatatattagagcccgtatttcatttcgagatagatgatactgaggccccttatcgctaggaaaatgctcctatcgccaagggtggtgatagctgatgacaccaacgtattcgtagacc

SEQ ID NO: 3128 - DNA, 1376 bp, Zea mays
  misc_feature (1)..(100): optimal_loci_46848_G1, chr1:273980876..273982251, Cluster 18
cttgtcaagcggccatcaagttattgtgcacttcttttaatcctgtgtctggagacctctggtctgaatttaatcagatgggcaccgtgaagtttctgaatgaaagataggtaaatacagttttctgaggccgctgcatatataagaaactaagtaagcattctttaactgtacttctcatgataaacttattttaaatgatattggtatttcaagaatgtcttactgtacttccacctttttttttgaagtaaaactgtacttccaccttattggcagattggatactatatggacaagatctgaagggcaccaaatctaatagattcagcatttggaaagcggagatagatatcttgactttgtggagatgatttgttgggattgtgattttcccttgtgcgtcctgaattttttttatttctcatcgtctgttgtatcatcctttttttcaactacagtttcatgttgtgcatgcatctttttgaacctttgcaacaaatatgcttatgtgacatgtattaaaatgaataccaaacacaataacattgggaaagcaaaccatcaccgctgaggctagccccaatgggtagtaacattactcattagatgtcacttaggacttctcactgatgtggcggactaaagaaaagagagataaaaactgtatcatcctgaagatacattaggttattctcaattcatagtaacatactcatttaatatatgacacaagcatttttaatgatgtggcaatagagttataggggagaaagtttaccttgagggagatattgcttggacgatcttagatattgaaacctacatcgtttaagtggcctacatctcgctcatatatgctagtatttaatactctatacagataaaaaaacaatctataagactattttcactctattatatcttgtcacaatatccaaaggtgatatgacatataaaattatataagatataactatctcaatgcatggtattatagattactttttgatcctctacaaaatattaaaaactagcatatgtgagagtatgagatgtggatcacttggatggttagaagtttaatacatatgatctcgtgccaagtaatatctctattaatatacaattttcttttttctcttaacaattttgccacgtcatcaaaaatgcttatatgatatgtattaaatgtatacgacacgttagattgggaatatactaatatcattattaagatagttgcatcttatataattttatataacatgatagctttagatagtatgataagatataatagactaggaatagccgtagtttggacacaatatctaaggttagaaaatcgtgcataatgcctgcacctattgcca

SEQ ID NO: 3129 - DNA, 1169 bp, Zea mays
  misc_feature (1)..(100): optimal_loci_48110_G1, chr1:281329536..281330704, Cluster 18
tatatataccgtagtacttagtatgtatacgtatatgctctttgtatatatgaggcgttctgcgtgatcctttcaccagctggtagtgcgtgcacgcatgctctaatttacaccccgggttagcataatataatggcgacactatgtttgatcgcctgtttgcatgttctcttttatggaaaaaactggtctcgagaaagttgttgccaccgctgaccaatggacaaaagtttggatggcagagaaaaacatgatcttagaccatctccaactattccctccacaattgtcctcctatgtatgtaatttctgttatattttactacaccatcttaaaagatacttccctctacattcaggacgtctctaatcattcactctaaccaactctcctatatattataattcagttatttaacgattttttgtcggtttttaaagttttaaaaatcatagactattcatactgtcataatacatattgttttcaggttacaataattaaaagaggtcaatatcataataaaatagactaattaaagtatggaaagtattggaactcaccccatacggatcggacgagctgttggagccgtttttcccccaaagtacactgaaggtggaggtggacgagctatacggttcaacgttggaggtggtcttaccgttccttttagcttgagttgcattagaacctaataaacaaggtacatgatgccacacccccccccccccccccccccaaaaaaaactacagtactagattaataaagacacaacacctatatttctttgaactagaagcttccctggaaactcgtatgtgtgagagtgggagagagaaattctaaaggcgggtaaaaatcatgaacctcgactggaaattggttacatgtctaccctggttcctataacacgagccttattgcatgtgtgaacgcgatgaggataaaaagatcgatcaaaggcgaaggctggtttgcacgctgtatctttaataaagcaactccgccgtgtgcatatatatatatatacgtctgctatagatgcatccataatatggtacgtagacagctcaaatttttgcggttcgcataatataccccaccatcagcagacgtatatatgcaaaacctttcgttgcagccaggttaaaaaaaactgacaat

SEQ ID NO: 3130 - DNA, 1043 bp, Zea mays
  misc_feature (1)..(100): optimal_loci_48707_G1, chr1:283313909..283314951, Cluster 18
cagacaatcttttgtgcctatgcatctatgtatatatctcaaatgttgataaactatctattaccaattcttaaccgttacaacctaaaatcagatagctttttgttcctgtcaatcgacaacatatgccaggtaatttaccatctttctttattcattcattttctctaaaaagagtatttttataatattattataataaatattacaatacttacatgcgcgcgcaaggcgcgcgccagttactagtgtggattaatttctagatatctgttcatgagaatgcaggctttccattccacggtatgctttgttgtcagaatagaagtttttttatccatgtaaatttaaaaaacctacaaaatttacacaattactttggaactacaaccttttggacatatataacattgattgctgcaatactagaaccatcggttcttgcaaaactagagattttcaggcaaaattaaaacttgtagttctacagcgaacaatgtatgttctcaaagtaacatctggaaataaaatagcaactttgttattagtgttagaccattgaaggtctacaaacacgaatgtggtggtgttgtgttgcaattatttacttggcatgactttctagtgcggtgactgtaatttcacttagtgtttagcttgtgtgttaatacgggttgacatgggcttttgaaaaagagctttaaatgacattagggaaaacaaatttcttaacgaactactgattttgctgcaaggttctttaaatgatattagaagtgttgatgccttctcttggacaaattgtctggatcttcgcactcccactatgctgactaattccactctgtccagctcaaggttctatatcttgtggattttagtaattattagaaacgtcatcaatgcaaaaacttatcggttacaatcagcttataggttatcaagtgcagaccactttggcccctgagatagatcagttcggggccatgcacaacaacatggttatttgtaaattactagcaatgccatggtctgttcatgcc

SEQ ID NO: 3131 - DNA, 1227 bp, Zea mays
  misc_feature (1)..(100): optimal_loci_51361_G1, chr1:298790275..298791501, Cluster 18
gcaaatggaagagttgggtagttttagaactccacaagagaagcagcaataaaaataaaaattcacagtaaagtgtagtactttgcttaggctatacggccgtaccattttcataccaaagagggcacaccaagaatgtttcgctttcagaagcatagtgatatgctcttaagctatggtgcaactgttcatgaaagatgagctgcacgagcagatctgatacaactaattagtgtctcaccagccatgatatttaattgtatttatttcataagaaccacaatacccgatcttactactaatgttttgtttccttaattgaagctacccaaagagttcagaccagtattttttttcccctcaatgaatactgaatcaactcatttagttaaaatctggcatcattacataatagcttgatataagtctattcaaatcataaatacttctcgaactgtcaagctataatcaacacataggacagtgaactgattcttccagacataaacaaaaatatgagcagatatagaaatggtaagacgattttatgctaataatgtgctacatatgagcatttcagatctatacaaagtattaacataatctagagatgttaacatcgaactacttatgggttaaggtgcttggtattgattccagggcctaggatggtgaatgaaaaaaaatgcatccttttctcaaaacatacaatatgcatataaaattatcttgctagtttcatacctcgcacacataccaacatcactaatgtaagagttatgtcatgtgagagcgtactcttcgatagtttatttcaaacactagataacataaatgaaagatattaaggatcttgattaatgcttttggtagatgtgagggcatcatagcaatgtgcactaacagctaaaggtagaataaattccattacaaaggtaaaggtagctccctagtccatcgaaagaaataaaatatattgggacaactgtgccggtgcccctgttttggggtgtaactgtagatttgctccacttttttagactctgtgtgtttgcatctgtttttcaaaacaaaactaaacaaaactattgtacatccctgctacgttagttgtactagacggtgttaaggaacaattgtgtcagtgcccttgttttgaagtataaccgtacgtgagaagctaaggaggtgtttggttcatgcattttcaacccgtatccattcaca

SEQ ID NO: 3132 - DNA, 1011 bp, Zea mays
  misc_feature (1)..(100): optimal_loci_55026_G1, chr2:17331068..17332078, Cluster 18
gacatagcagtaatgagctttaactgcaactcttattcctatagcctaaaacttagcttgtgtgtacaaatcaggtaggccttgttcgtttgtacgaaaatcaaagaggattgatgtgattaaatcatttcctattcaattttgactagtaaggaatttaaccctccaatctctctcaatctactactaatcgaacaagtccttatttggttttgtattttctatgatagatcattaaatttgtggctgcatatgcttcaaatgacccctcttcatttaaatgtggaactagtgcagaatgttgacatcatcaaactcccttttcaggtatcaagaattcaagaccctaacagcagtttagcataataatgattggttgatgtgactcggtacgaggctcccaaatgagtggccttcttctgtaaatacgggttagtaatttaaaaagagacggatgatttatagatggtctgaagtatcattcctacctgcgtgagccatcggttaatgccacttgatgcagtgatgtttggttgatcaaggtcaattttctcaagggtggctacctgaaagaaatcattttttcattaagccataatctgcccaagacttaatgaggacgcaaaaatgttgaaattacgtagagttaacttaacaataaagcgtaaatcacacctatatcagcaagcgcttcatgactagtgttggaggaggaacactaactaataatccaataaccatcatttagggcattatcagtaagcacatatcataccagttaaacttggatacagatcctttcttcagagcaaaaccattagttccgttatccttcagagtaagatcattagttagctctctgaatacagttagctgtgtaggatcattagtaacgtgtattattcagagaaatgccttgttcttgaatcattcagttagcgctaacttttaaacaatggaagaaatacctgggctcgttatctacgtacaagaagaacgaggccaccttat

SEQ ID NO: 3133 - DNA, 1193 bp, Zea mays
  misc_feature (1)..(100): optimal_loci_55197_G1, chr2:18252107..18253299, Cluster 18
atgcagccaccgtgcgtctcagtagtgagctctgtgtggccggcatgacaaccttctaatgccaatttattaatcatctaataaggtcttcagtcttttttgctcgatgtttgcaaataatgtttaacgcgtatcagcaccttgcttattaagcagaggctggaagaaatttcaagggcgtgtatctcctcgatgtaatgtgcttgaagttattaataaaatcttcctttatcaaaaaaaaaaagcttgcaggaagcagagtaacaagcaagagaaagaagacaacgcttgccctaaggttgtctccacgtgagagtgtatatggttgtgtaaaacatcgttttgtacaatagataatactatttacagattgaagtttcaaataggaggtgggatagaggatgtgaaaagagagctgttagagacaacattgtttactcttgaatcggtgaactcttcagcttaaagttcaactagccaagcaactccaccttgtgccgccccgaccttagtgtccagatctaagaaatctagcttagttgaatccctagttgattaagctaacttttctatcgagtctgtctaagaaatctagcttagttgaatccctagttgattaagctaacttttctatcgagtctgtctgagtcgatttggtttttgaatcgtttttttatatattttaacgtggaaaacttgaaaacataaacttgaaaacatgtttttagtttatttcttactaagataagaccaccatctctatacatacgagaggaatatgaccgattgagaatgtcgactttcaattgtcaaaatataaaacacttcccccatttacatgctttttctctaagcagatgttcatcgcatctttagtgcaattttatgatgccctatcgatcctaaagcaacatccacatgcttccccttgataggtcttcttgaaagattttaggagtctactcggcaaaaaataggctcaacctcaacttaaccaaccactcagttaatttcatcaccctgttgcgttcttgctataatcaaggttatttgcaatcacgggcgtactagcccttgttggtgtgtgatctagcatccatatcagcatcaaggcactgttggcaactccgataggaaaaagggcaagatccaatctactagcgacatatcgaatgatgataagaccaagggta

SEQ ID NO: 3134 - DNA, 1067 bp, Zea mays
  misc_feature (1)..(100): optimal_loci_56061_G1, chr2:22961358..22962424, Cluster 18
actagctcttatggtgtttgtttccctgctagattatataagctagaatatggtagaagagtcgaagagtaaaatatcactttatgattacaaataagctatccaatgttaacttattttagtttatttaagaacataaagcgatattttaccctctacctatttattataatctagcttatataatctaaaagagaaataaaatgccttagttttcattacaaaatggttttaagttttcttcacatttcaccatctttgtttattttcttgaggcgcgtttcatgaggaaaaaaattactcgctccgttccaaattagatgccacttcagttttaacataagtcaaatttctctaatttaaactacgtattagctacatttataggaaataaaatataacgtcaaattagattcattaaatccatactgaattattccctgacgtgcatttatttgagcttgtagatgttaatgtattttttctctaaaaacttaacaaaattaaacttcggacaaagaaagtgacatataacttggaaccgatagaataactgacgtcatgatctttacaatgtcagtgtagctagattcgtacatgcaatgtaatcgataaagcagcaaacagaacggttctggagatgtaatggataaaggtgaaaaatacttgacataaaacttgggggtctaataaagaaggctcaaagaaattacgcttcttgcttctcccagagtctctttttactccgttgactacgagcttggttgactgttgagaaaatagtatgtaaagcattcgaaataactctactagatactcttatgctgtattgctgcatatcccttttcccacaatggaccgtaggtgtggcacaatgtctaccaatgtaaggtgagattttcagctctaactcagagtttggtttgagaaatcacttcatccaacatatcacttcatccaacatgatgtggtgcatcataagtctattctttaaatttgatgggataacctcattcctcgtattaatattaactaactaactaactataaggaattaggtgataatg

SEQ ID NO: 3135 - DNA, 1252 bp, Zea mays
  misc_feature (1)..(100): optimal_loci_57231_G1, chr2:29540095..29541346, Cluster 18
aaacgaaaaaacaaaaccagagaagaacgagaaggatagattcaacaaaggtgaaagaaactcccctgatggatgaagccagcaagatgttaataaaatctctctagagaaatggcatcaaaaaaacgaaaaaacaaaaccagagaagaacgagaaggatagattcaacaaaggtgaaagaaactccctgttcgggacgacgatcggttgtttatggtgccatgcaatgttttcaaatgatctaatcgaccctagttgccatggcactgataaggcgaccagttgcgaccagctgtagaacaccttttgtgttggtaagttgataactgcctcaaaagtatctttctttcttgtcttatctatttaattatttacagtatgtaaagcaggcctctatgtagctttatgtgattgaaggaataaacagcatggtagaccattgaatcaacgagacggagaatccaacacttgttatccttgttgctttagattgtgcaatttagcaaaccaaaactatactgttactaatatgttctatcagtatacaataatattaaaaggagacaccatgttcatctagaagttatgagattaatcagaagaaaaatatattgtatttatgattgcctaacgatctaaagtaaagctaaataaaggtggtccatatccactaaaatagtaaattcagagtaataaaaaagggggaaatagtaatttgatttccaccactgtttagtaaggggattactgagctgttatgacatgtacaaccttgagcccctacaacggttttctaaatacaagagtcaactaagagtttgcatgatacaattatgagcctcttgataataaatgtagtcaagacatagtatgtatagatagttgtgtagagacagactctttacgaaaaaatcgtctcttaatttttttcacttatcaccttagagatcccacaaaagacacctattaatttaatggggttgtaaacacgcagcagtttctttacgccagcagtatgtcatatttacgtccgcatgcacttaagtgatatgttttctgcatataattttccccttctagatatggaactaattccttatgtcctgcagtcatatacgaaaattgccttttgaaaccttcagtcaaaggataaattccatgtcctaaactgtggtactcgtctactcggacaaatactttgacttgactagaaatatgggatgcaatgcggaagtgttcacatcttgttttg

SEQ ID NO: 3136 - DNA, 1051 bp, Zea mays
  misc_feature (1)..(100): optimal_loci_59396_G1, chr2:42628976..42630026, Cluster 18
cccttacattcttcatagtagtagagatacataccattaaaacatgtttttagtaaatttatcgaaaaagttaatatatttattattttctataaagttatccaataattatggttctaaataagtatactataaaatatgttccatgattaatctactaacacttatttggtgtcataaattttagcatttctatgataccattgtaacaataaaatgcacttgatttgtaattgagggagtactagctccatcctgaaaagtagtaattctagtttccttttgatcagattttaaatatatatatatatatatatatatatatatatcgtaattatagtattgaataagtataatgttaacatatattgaataaataaatacaatgacacttattttggataaggggtcgacactcgacagtgcgcgtggggaaggattgactacttctagctttttcagttggtagcaatcccatgtctacggttgatcgtctaggtcttttacactgtatgattgtatcagtgaaagtaggctctagatgctactatcctattcataaggtccactaacatgggatgccccatctatgtataatgctcttgccgttcgttttcatagctatagaagagtttatagtacatttcttcaagaatatataatgcaataaaacatgtataaaataatcatgaagagttgaaaatcatgactcacatcttctctccttttttaaagatgttgtattgttgtcacgtcataaaaaatgcttattgcctgtctccgaaaggtgtcgtccgagaagtcaacgagtctcttatttttttgtaccaaatatacttaaaataccaatattcatgaaataagtatcatttgatgtatcatgggatatacattttttttatatttaatctatttggtgataaaaaatatggacagtattctctttaaatatagccaaatttaaaaaaaaagtttagcttagttcaaacttatagtgagattctttttagagacggggtaccatgtgttaacctaataaacacatatgaaa

SEQ ID NO: 3137 - DNA, 1058 bp, Zea mays
  misc_feature (1)..(100): optimal_loci_62920_G1, chr2:61860544..61861601, Cluster 18
ttgtcggagcgaggttcaaaactccaataactctcaattattatgttaagaatccacaataaatccacactaaaaatccacatactacaactgcatattgactacttgtcccaactactacatgctattaatgagtaagggtcttataggatgacaaaatctgtgcccctaaaatttattgttttggtatgaacttttataaaaatgatttttcaactcaactcgtgacaaaaacttcatgaacgtgtatcctttcaaacattgtgaaggccgagcatgctcgcatcgaattcaaattgcaatagttatgcattaatttgtgggaacaagtctacataacactctgacctttagagggtggtctacttcacccctcacatttaaaaccagtagtttaacctcctcaactttacacaaaaatagtactaatagtattattcagttctagtaaaagttttagccttataagatgagaaattaatgtgacacaaaaatattaaactctttttatgtagtttttgattttagtaattaatttgttactcataaaagttcaaaaaaataggacgggtataatatcaaattaccgattttgtttaaaattatataaattttgcacaccagtagaagataggattgaaaaagacaaaattagtgttacttaagttagtgccacgtcaacaaaaccactaattaacattttctatgggttatttgtctggttttataaagctaagagggttaaacaatcgatttcaaaagtgagggggtgaaataaaccactatctaaagatcagtgggttacgtagacttattccttaatttgtggtatttatcagctttgattttccacatggaagattaaaaaaaagtgatgtccttaccaacataaacggacattgcccaattagctccaaaagtcacggagctaaaagaacttaggttagatcaataagaaaggggagaaaaatgatactctcatatatgtcatatgaaattgtctatactagaaaaagacagcgccctatcgggcactgtatgagacatatatgcataag

SEQ ID NO: 3138 - DNA, 1101 bp, Zea mays
  misc_feature (1)..(100): optimal_loci_72780_G1, chr2:128185637..128186737, Cluster 18
catacttacgtatgatagtgtttggttctgaaaccagttgggatgtagtggctccataccagggagcgactccgtccagggggattttggggagtcggatggttcaacatttgagcataatttcccttttttagatccactctatcctacgtggaatcaatccaaataacaacaaattggaagcatagcggctccgtcccaccatactccagaaccaaccactacataagatacttgactatgcctattttaaaacaggtattggcataaatcaacctgactatggctattttgaaacctagtcaggctggttctgttgtctgaggccaaactcctaatcctagtacaaaacaagctaggcctattttggcatatctcaccctatgaaacttttgtataaacattcaaaataaggcaaatgaacccaaatttgatgaaatttacacatagtttacttggtgaaggtatttgcgagatatctttcccaaaagattcgagtttccacatgatttcaattttttctcgtaatatgaggttttaaaaataaagctcatgcaattggatttggtcctctatgtgagttttggtgtattagttataaaaaaatttagagattgaccagctttaagagaattatatgcagacatgtgtccctagctcaacattgtgataaaactttgtggcccctcaatactaaagaagaataagtctttacttgttttatatttttaaattgactatagaaaacatcatactacaaagaaggttcattattttagaaagatgaagtgctcagagatctatgaaacccctgagagacacaaacactttacatgagcacatgacaaaataggtttgacaacttcagaaagtttctaacacgtccttagttaatccagttctcaaagtttggctagtgctcaaaacttctagatggttgaaagttcccaaagttcgaggcctattaggataatggtcatttttgtagtgagtaaacaaacacatacctcttaatcccccaatggtcaccactcaaagtttgactggtgctcgaaacttctagatggttgcaaggaatgaaggaatataattgctagatgt

SEQ ID NO: 3139 - DNA, 1037 bp, Zea mays
  misc_feature (1)..(100): optimal_loci_80282_G1, chr2:173420834..173421870, Cluster 18
gaggaagaacaggaggagtcagagtagtttgttcttatggtgaccgaatatgtaggatcttttagtcatagtggagctatggttaacgggaatgccagggaaaaatgacactgctgaaattgctgcatcatggcagttagaagagagaagggtaggcctagtgtggtggtgagagttgtctccctgagtcattaggacacaggttcgaagcagcctctccgtatttgcaggagcaggcttgcctccttttatcccttccctagaccccacttatgtgggagcctcaagcactgagtctgccttttttttatgacaattagaagagagacgtgttcccgttgttcttccatagtaaaatatcatgaatctcatgtcacaaacatttattacttgataaggatgtattgattctaacaataatttgtaaagtgatttagttgtgcttccaaatgatctatgcaaacacaaactgaacttgcatcatatataccttttaggaatgtatgcgctcatgtgctactaaaaaatgatataacattgatgcatattgttattctttgccaaggcgtccaagattatcttctcattttcattttcagtttgttttcccggtgcaaatcaagtttaaggcatggatttagcacttggcggcttaacctcagttaagttaaatgaatgcaggcgccaaatatcaccgttttcctgcaatagagtaataaaccatgcagcgctcgcatgtgtagctggaggggccaatgatgatgtgatagtgcgtttatgaacctttgaggtcatcaacatctatgttcatgagaacattgaaccttgggacccaaggggtagtacagggctacaggcatagtaaaaccgaccacagatgtagcagcttttagttagatctggattatttgtgactcatgaatatgaaaaaattagccctttcattatccatccacttggaatagtatccaccctttctgcgttttaatatttgtaacttgttttttgaaggagcacctgaccacctctcgctagaa

SEQ ID NO: 3140 - DNA, 1013 bp, Zea mays
  misc_feature (1)..(100): optimal_loci_8310_G1, chr1:43690501..43691513, Cluster 18
tatatggtacgccacgctctatggtctgaacatctgtatgttgctcctcaggtttcgatattagaatgtatccaggttgagcacatatctagattacatttgggtatattcggtatcctaatctccaatatcaaaattaattgaattataataaataaaatttaataaaataatatgttaaataaaaatcagataataaaaattaaaatgaatgcccattccgtttatctatattttttggaattataaaattactgcacgagtagagattaacatatttgtgtatatggaagagacaaattaaaccaatacagttatcaattaaatatcaattaatattatgtttatataaatatttaccataaagttgtaaattatataaatattttacaaaaataaaattaaactaaagtgttaaaataatttacaacaacaaatatattagattcaaactaataacattaattaaatctttatgtatcattaataattttaaattaacagtaaaagttatttgttggtatactagtaactagttttaatacaacattaataatactattaaatacttgatcacatgttgtaaagtgaaatgttttaaataggtttataataccttgttttgtttgggagtacagatactgctgtatattatcgaataaaactagaaacggattaagaaacactaaaaacaaatctgaatatccatatcgagaacagacacaaacatgaatatccatattaggggatacgacatccatttccattttccataactgaactccattcgggttctgttcggtcgcagaaggattggagtgtgacgaacaagcccttagcgggttgtcgagctcagccggacccgtctctcttgagtgccccgtcggtcgtgagcgtttcttacggctcttcttcttgtgcagcgcttgtgccccatggtgagcgtttcttaatgcgatcgtacgaagttgtggaaattcaaatgagaaagcatggtgatgaaaatgaaatta

SEQ ID NO: 3141 - DNA, 1189 bp, Zea mays
  misc_feature (1)..(100): optimal_loci_83342_G1, chr2:189227438..189228626, Cluster 18
tcacatggcgtgcagctgctgcaggacaacgaggttgagcccgcctacaagaaactagatcgcctgcaccatgccgacacggaacgaggtcgccggcgctggggtggctggctggtggtggggaggctaatcttcacatccccatccgatcgctcggacggcagcaacgcctagctgcagcagcactgcagcaggctattttgttttcctttaggccatctctatttttctctaatatatacatcttttgtttcagtttataattcgtttgaattttttactactggctcgtcttattcaaaaagtttcataattaccattaactttactaggatatcatttagcatataatatattttaagtatgtctttatttttttttagtttttcgaaaaagaataaaacgagccgttcaaacttagtacaaaagtcaaacgaataataaattgtaactgagagagtattaaaccgaaataagctacttacaatcaggacatatcaagcaacaatataatttaatataatctacgcagtgctagctaagcaagtattgtacaacaactatatatacacaattgcaagagcaaagagtgcaagccatatggggtaatcaataattcaagataggtggtttatatactaattggcatcatacaccaaacccacaataataatgtcataagaaccacactaaaaaaggcaacaagccacaattttgttaaagttgctctttatgaatctctcgtggagaatgatcacaaattctaacaagccacaattttgttaaagttgctctttacgaatctcccatggagaatgatcataatagccctttacaactgatgagcgaagctaacaacaatctataataaccactcaataatctcatgaactgctggtggtctaggtgatgacaatcactagaagtaacaagtataaagccggctcaatccgctcaactagtgacacaagatgtaatgcactagatctcaaacaaatgatgatctatgagatgcaatcgagtggagcgtatttctttagttttaaaaggtgtgtaagacgtgaagcgatattagccaaaaacgactaaggagtctatttatagccccgacttaaaatctaattgttacctcttcatggacacgaattgcacacaacagatatgtctaatgcgctcttgatccttacac

SEQ ID NO: 3142 - DNA, 1177 bp, Zea mays
  misc_feature (1)..(100): optimal_loci_8339_G1, chr1:43975940..43977116, Cluster 18
atgaattgatattaatatatataacgtactgattcaaaaataggcaacctgatcgctctaggagtaaaagaatatttactccacataagcaagaacccaatgaaaaaatcggtaatcgccttatgtcattctcaataagagtttcattttgtttccaatactgctacatcatcaacagtaagtttggcacggcggacgcgggccctgcacttaaggcgtggctgccgagtgccgacgacgtcgaggcgttagcgttacctcgcaaaacgctagggcgagcgcttggcacggttcgctgggctggaatcttaccaacacgagccaaccggcctttacgtttttttgcttggcaggcccaaataacacaaacaacacggcccattccgtcgtttacgattgaaccgagaatgtgtcgctgtacaagacgtttcgtgctgtctttaagataaaaaaagaagttttctttgatttcactaagccttactgattggtttaattctactaaaaataactatttgggtttagccacttaccgatgaagaaaaatattcatttttactgaagatgagtagatgactggctaaacttcaccacggttatactctttacttcataaatgatgtaatgtaataaagaattattttattgttttttctttgaattgctgagtatagctatgttaattgattggagaaccgaaataatcggtatagagacatctagagtccatgtaattgattatcattgctcaaaaactttttcgtagatttatatttacgtgcacaatggttaagaatttctatgtttttcttatataaattactgatttatatttacgtgcacaatggttaagaatttctatgtttttcttatataaattgctgatggctaatttggtgaccagtaatcacggtggatacatggaggaatcattgctatcaaaatataaatagcaatgaatgaaacaattttccgctgcgtcctctctaatagtttctggagaggacggtcgtcgtttaatagtttttttttatcataatcgggggggggggggaaaggttccccaccttgattccatttcatttcacattcccgtttagcccaaaaaggctagatggtacagaattgtttacatagccggatatatccggttgggagagcaacatggaaaagagtt

SEQ ID NO: 3143 - DNA, 1287 bp, Zea mays
  misc_feature (1)..(100): optimal_loci_84860_G1, chr2:198021524..198022810, Cluster 18
atcttaatatttgtttgtcctgcacgatcaaactatcacggataaaattatatttaactacttagctccatgttctatagaagatctcctaagccagcataagcgtacatgatatcttattacttgcttatcatgcatagacaagccacaatggataaaagtatgagtcaataatcctgcaactctacattgcttaacactagtaacttacttgcacctcacgcgagtttatcaaaacagtgtcgctttaggcatataaaattaacaatatatgtagacacttagaattatttgaacaaacaattttttaccgttcgatttacaaataaaacatcatgatcagtctagatgttatattacaatggtgctacttactaagaggtgagtggatatataatttagacacattgtgtggcagacaaatattattgattatgatgtgagtacacagagcttgtgagcactaagtatgctttttctcaatggctactgtacatttgttctgtttgtggtgtttgtggccttgggctcttcagtttgaatgtgcaagtgtaaaaaaacattggattcagtattgctctacttgcttttgcaataccacgaaagttttatcttacaagtatttttcttagacgcatgcctgaaagataggtaaaactgagtggagtggcagtggtacggacaaatgaccaccacaccctgcaatctacagatccggcacccgaattagatcgtgtggagcacaaaatactggcgacgtggatatacagatagcaaagatttgctccgtgctctatagaatagaatagaaagtctgggtttaagctaatgctgcaaatctgaaaagccaagtccggatataagctaatgcaatgcaggcaattctctgcaaacctgtattagctaataaacataaatactccatccattataaattataagatgttttatcttttctagattcgctgcttttgctacacgtctagatataagtaatgcctggatccaccgtaaaactataaatctagaaataacaaaacatactataattcacaagctaatgcattattagcttgcctaataaatccagaatcaagacaatgcagataattatgtgtttcttggactccaagaaatgacaaaatagtattgtacttcctcagtcccaaaatacttgtagtatttgtcgttcctcagtcacaaaataggactgtcatgttacattttcaaggactcggtgcaaagtgaaaaccaaaattgggcatctttttacagaatatgaacata

SEQ ID NO: 3144 - DNA, 1038 bp, Zea mays
  misc_feature (1)..(100): optimal_loci_85388_G1, chr2:202190958..202191995, Cluster 18
agttgtatttatgccaccagataatcacagcgaaccatctttcgattatatctattttatttgagcaagcccttccattgtatgattgtttgtttcacatagtttatgttagcatttggaataaagcaatatcgcatttaaacatcgtcgacttatgtgatatatagaaaccatagtaacatacgggtattcatctatcttgctgattttttagcgcataacgtttgggttgttcactgatagctactcttccaagttttcatatgtaactataattttttatgataattggagtaacccaggtgataattttgctcggatttatgaggttttgaatgacttgtttatttgcgccttttgatattgtcgcttttgtctttctgatgggactaatctaggttataaatctagtggaatttcttgattaatgtcttggcgtgaggattcaattgcctgggtggcagatatagtgatgggtgaaatttaatgtgtgaataccatgcaacatgttcacaagaaacttttggggccttggtatcgattccctaacgtttgttgggattgttttcgctgaatttttctttgttgttcaaatgatctataaagtaagcagtacaaatgtcttcgtgttttatactcacaaatgtcttcgtgttttatactctatgcattatttgtttagcaggtataaactactctttgtggcatacgatggaactgcagaggcacaaaaatgttttcgtttgacaacgatgctgggaaattatatgaatgctaagaagctataaggacaaataaaaaaggtatgttatatggaaagaatctatccaaaattatagtttcctaaatatgcctccctattgactttaaaaaaacactataatgtctgcttcgattgtaaccgctgttattgactcagactatccataacactataattaatgatgcattatctttctaacttcatctctattccaaactcaattttgctaattctctataacaaacacgttttcttttggtatgtttttatcaacc

SEQ ID NO: 3145 - DNA, 1030 bp, Zea mays
  misc_feature (1)..(100): optimal_loci_85599_G1, chr2:203608635..203609664, Cluster 18
ctttaaccattcttcggatttgtagacttccttcttccagggtcattccttttatccttgtctggatcaaggtccaagcattcaaccaaaagtggcacataagaaaaatattattagtgtataaaacagtttttccattgaagcaagcatcattcctaatcctctagagagtccacaggaccgcactgcaacccacaagtagcatgtttcaatttttgttttaaattgtaaagccatttttcaagcatattgtctgagtttttttggaattgtatgtaacttcagagccatactaatcactcttcaagtaaaaagaggcaacctaacagtcaaaattatatgttgtgtaatttcaaggcaaccacaccaataaaagttgaagtcccctttccaatttctagcttttaaattttcttttgatacaactctgtctttcacaacaagccataagaatacctttatttttgggggaatcctagctttccaattgaactagaaaggaactttgtcaatgaaactcctacatttgagatatagagacttaacaatgaagccttttaattaatggaccagagaactttatttttgaatcatctagattaatgtcatgacacaagtttttcaatccttccaacatctaagctccttctccatgtaatcttcgtctaaagattagagactcgtaattattagaaagagccaagttaacactaatgtctttatttaaggagagttcaaataatcttttgatttgattgagaaggggtattctccattccacgcttcatttcagaagctggtggactttccatttccaatatttctttactattttgtataaaacaactctttaatctctaggatccctttccaaatttgggattgttcttgtttcttttttttgcaaactcataggtttgtttttcatatatttttaccaaactttgctagataccttcttgactttccagtttccaaatccatttagtcaagagactgacattcatgcatctaagatcaagagaccctc

SEQ ID NO: 3146 - DNA, 1014 bp, Zea mays
  misc_feature (1)..(100): optimal_loci_86328_G1, chr2:207695633..207696646, Cluster 18
ctagttgcgaacctgctgaaagaggatcttcaacatcatctaaaataaacattcaataatttgtgctcacgccttgtcttcttttcagtaatttgtgctatttcagtcatttatcgtttaatttcagtaattatcagcaaccacattaattgttagttgcatcgacgtcacgaatcttagcgcaggtggccatgacatttttttcccggacgcatggtttacattgtaggctttcgaattaattatccctggctttatgacattatggcgctttgttacctgtagttggttatgtgtattagacggaggctggaagtttgtaccaggacatacgatacaagcttccgttatctggaaaaaaagttccccagactgacttgtgctgtttggataaatatttatgaagcggtggtttttttccccgtcccagtgttactgatgcagaacggagtgcggcaagagtagtgtttcaggtccagaatttgctccagtggaaacaaacgtattgaagcgacagggagagaaaaaaaagaaaagaaaagaaaggaatgctgtattattgaaactctcaagtattagtacaatacaatctgtaacattctgttacatgagctactagatgtttaatgggaaggcattctgaagcctatcaacgtcacctttgcgtcatttctgatgctacccggagcatccaatcgtccgctagatcatcatccttggcgatgaaacttgcaaatttgcaatcaatcagactgcccgtgggccgtggcgcgtgctcatcagtcaagaggaatcggttctgtcggttggcatgtccaaaaagccataactaaagaataggccgtgtaataataatatagcataattgcacactgagactgaaatcttggagcacattggaaggcagagagcgaatagattggtaactctgatctcgtcccgattttcaactgtttcccgaaaagaaagatcaaacttgagagcgagagctctctctctctctctctctctctg

SEQ ID NO: 3147 - DNA, 1118 bp, Zea mays
  misc_feature (1)..(100): optimal_loci_87921_G1, chr2:216561452..216562569, Cluster 18
ggggtctccttggcacgatctctgaactccttaacttcaacatgaaatcattcagatgttgggtcagggagaaaatcatgtggctgccaacacttctcgactgacttgagatgtgtcaagatattatctctagccgaatcatacttgaagattttaatcttgtgagatggcattgaatgtgtaatctagacatgtacctccctcggaggagcaaatggcttcttattctcgatctagaacaattttcaggaaaaaagtataattaattgtcagatacatattatgaaacaagtttaaatttaggagaagacggatttggacatgtagcaattggtcacatgattgtgaattggtaatttggtatggaattttgcacttggtgtcccccttttttacttgagccattttgagaaagtaggaagaggacgcaggtgcaggtgaacacttaagaaccttaaaagtctcaaacaaactctaaaatagactataaactatgaaacatactctgaaaaaaaactctgatgtcatttcattatctataaactaagaaactctgcaacatactccaattaactaaaaaagacaactcaattggcatttcagttaccataaactataaatttctgaaacagactatcactaactgaacactaaatgtctgaaacagactccaactaattgaacacaaaaaatcgagttactatatatatggtgaagatggactgacacaaatactcaagaatatttatatttttatcccatttgttttaaacaatagccttacaacacagatgactgcatatccaacacactcccaccgccaagatttccctacagatcatgagtttgaaactacgaacttactatttatggaccttcaattcgctttcatggagccttttttaagaataaatcattttccttcacttgccattctaagtagattgcaatccaaataaggaatcatgttgatgctaacaattttttcctctccttttaatataacaggccttccccaaagcgaattgaaggttcaaatggaagaactctgcaactcgaattccgaacaaggctatcacttccccctttttactggaggaaaagttgaaggggagcag

SEQ ID NO: 3148 - DNA, 1025 bp, Zea mays
  misc_feature (1)..(100): optimal_loci_91337_G1, chr2:232479385..232480409, Cluster 18
agatctcagtgttggtggacgtgcgagggacaataatacgaacatctatctacatcaattgtagtccaccgctcacaatgttaactcatgtgaatgaagccactaatgacttgggcattgtctctccgtagggtagatattgatatctaaatttgcgaaatttggtttattctctattatagtaaatacaatattattgtggatatctacttctgaaatagtagtagatttacacatatgtatatatattgttgaatatttactgtaaattttttagataaaggttaaactaaagataaaattatctaaatccttgaccgccgccaccgcccgttgctattggtgccaccgtccaagtgtccaactagactgcgtgttacagtgcgcgcgtgcctttggggcccgccaaggcagcatgcaagtggagctgcttttgccctctttttctctacgcgcgtcacgtcacgtcaccactcaaaccgaaatagctgctgtcagtgataaaattcagaagtgtgatcatcgtatgggtgcctaacatccggtcatcactgtttaaattgttgccggccggcgcaaccactcctctttatcatctagtatatactagtagggttttttcgcaatctattttgataatttgatggtcctttgcctaaactgttcacagcagcgtaagacctgcggcatatgaccgatttctaaaacgttttttccttaaaaaacataggattttctaaaatttgggaccaaaaaatggggcaagagagggagagatcccaagcctctatgtgtggtgtcttacttctctaaagtttttctttgttgctctatcgagtgtctcgtagttcgttccgccgttctctctaacgagaccaccgacccctccttttatataccaccggtacaatgctcgtgcgttgtgacgtcacataaattattcaataaaatgttaatgcacaaggaagcataacacataagtcatttatgagaaaaactatctcatcagggcattggttccttgg

SEQ ID NO: 3149 - DNA, 1385 bp, Zea mays
  misc_feature (1)..(100): optimal_loci_95734_G1, chr3:18993161..18994545, Cluster 18
tcctaagaccttattcggttgcatacggataagagaggattgagggatctatggagagaaatcccttagggctggtttgttggatagagaaatggagggggtccatagagagacatcctcttgctattcaatttgaatagcagaggattcctccccatggatcccctccatttccctatccaccaaatcagcccttaggggattgaaatgtattgtagtggattaaatcactctctattaaattttgactatcaaatgattaaattctcatctaactgaacaagctttaaatgggttagtcaaagtctcataggtgttcaaagagcgatatcactttcggaagaaacctttggtttgatcaaagcatacaacagcagcatactaaccagagcacgtaactgggccacatctgcaaccaaaacgcaacgaagcagcaaatggtacgtaattaagaaaccaaatgctgaaaagattaaagaaacaagaccttgccgcattcttggagcacaaggggagatgcagagtgcagtagtaataaacaagtggtctgccggttgacccagaacgagcgctagacatgtgcagttgtgcgaaacaagcatgggatgggaggaagccaattctagttttcaacagccaaccaacagcaacagcggcccgtactgcacggaagggccaatataccccttgttgatagcacctccaactcatccaatggaaaacgcccctattgttaaaaaaatgatgatagtgtatgctagactgctagtacagctgatgactcgggttaaaataaatttatgagtcaaaccaaatgaatttgttttagtcaaacaagtccgatgccagcatatatatttggaatctaggtttctttttttaaataaagagatacatttacgcagattgcatgtgagatgtactttggtattctattcgcagaatagtttactaaaatatgcgcatatttggaaagagaagtgtacattcgcggccacaagtcatggtgctgagcagacccctatttaatacagctgctacttgttaaaaaacagcttatctaagaacctggtgaaaaccatattctgcttcttggctgtttttaatttattctcagaaacaacggaactgataacctgctacagaagctacctgtttggcacagcttatgtttaaatcattaaagaagctgaaaataaattatgccaaacaggaccataagcaacaaacactgtttcgtgagaagcatctacaggttaaagaaagaaaccatatttaatatgtcacaaggagtaattataaaccggcaatatagtgcacctagagcaagtataataaggtattataagctggttaaatgttgagatgggggagagagaggatct

SEQ ID NO: 3150 - DNA, 1082 bp, Zea mays
  misc_feature (1)..(100): optimal_loci_97503_G1, chr3:28836680..28837761, Cluster 18
attggatgtgtcggctattggaaggatgtgaacaagggggaagggaaacaaaaaggaaatggggataaaaaatcgataaaggatatattcacgaagaataatgtatataaacaagttataactctacaaaagaggtaatatctcatgcattgatacttatctttctaagatagtcaacaacacttaagctttaaaaacaacaaacaacttatatataggatatttccaactataacttcaaccatctacatgatccaactacaagaagtttgacagtgtatcttggacttgaaaaatcttatggatcatctttgattagtgaccaactaagctcggtggcaatgcaaatcatgttctcttagccaaactattgagggtgaccaaacaatacaaaacgactatgatctaactatcatcatagaaaggaaattctagaaaaaattaatatctaaagaagtgcaagcttatatttagcgtaccatagacataaagtagtacaataggtcgacatggacaacttcgcatcaaaacttggacttatattttgattatctatcctttgtgaaagtttatgtaaattgatgtttcaaacatcatgatatactatctttttaggtaatggaataacatatactcatatatatgttttcattatattatgtttttttggtgctacacatgggtatttacctggttaaatcttataaatattaacatacatactcccttagtaatgaattgtgagatgttttggctttcttatatacatcaattttattatatatttataataacgtatacccaagtacatatagcaaaatctatgtatctataaaatgtaaaacatcttatctttgaaaaagagtgaggaacttttactctcttcgtttttgttacatatcatattagtttgttctaagtccaatgttcctaccttttaccatcaatttcagaaaatccatgtagtcataatatgtaaagtatatactacatctaatccaaattacaagttgttttagcttatccaaatacgtagcttttgatatatgcattgatatacactatgtctagatacataatga

SEQ ID NO: 3151 - DNA, 1744 bp, Zea mays
  misc_feature (1)..(100): optimal_loci_239863_G1, chr7:14997553..14999296, Cluster 19
actatttaagttttcaaactagtattaagagagagtaaaaacgatagcggtacaaacatgcataaatcttacgggtaagcatcgctgagtaggtggtaacacgtgccaattaatattcgaaatgtttttgataaagaacacatatacaatttgggggagaaaattctctacattgtaacctgtttcagatttgcgacacatgttcctctatcaatgatggtgtcactcatcggccgggggcacactctaagccaggcccaccacgaaccccacccggcatgttcgtccttttcataattccaggctttggcatggaactaacatcgtcttcgatctccacgagccgaagtcacgaaacgagcaggagacataggatcatcgaacgactatccacgtacgagcgcgagtgcaaacgagaaggaagcctggaactgtggcgcccatgtcgcctgcatgcttggccctagagccagctaccgccgcccataatgccctagcacaccaccgtgacgccactgccgctgatgcgccgagaggcacgtggccatggcccttaattgtcccaccgccaagacgcgccgacatcgtcgctatatgcccagccggctagccgtacgcggctgtgttgcgctggagtttctagccgccatacgctcgagacctcatcctacaaccagtgcgatgatctgagtttcttcttttcagagatctctaatcctcaattatgttacatacgttgagagggatattttctttgaagtggacgaagaagacataattttgaagttttatacattttatgtgtgtgtatatatacacatattcaaagagaatcttaaacgtatggatatatgttagtagggtagaatacatatagaaaaatatctaaaattaaaaaaaaaagaaaattaatgaactcaaaacacaataaaataaaataaaataaaataaaaaaggaaatacactttcagtttcagttggactaaattaaagtgaccatcccatgctgggacctatttagtttcatttaatattatcaactaaatcgaaaggttattctttagtattatttgtttttataatctaagacacgaaatcttttgtacgttcccgattgaaaagacggccccgggaaaaaattctccaagcgatctgtactaccctgatccgtccgttttggcggctacgcaaagtgttcccggttacttttactatcaaagtacaatagtactggccgacattgatgcgattctcccgcccgtgcttgagtccctactactacctatatggggcgaaccgcaggacgatccgcccggccccatgaataggatgaatacgatgcaccatttttaatatagcaaaagaaatacaagtggacggtcctaggagaccacctatagtatataggaataaaactgacacacaacacaacaaacagtacacggcaaagaaaaaacaggcgtccaccagccaaactctcttggtctcttcgctttgaactttgcttttgatcttttgaatgagatccagtacctaccgaccactttttagctgaaatgtgcatggatttttttatgtttccaaatccctcaatctaggctagatccattgccactagactatatctaccaccatctcactgcgtaccagtctgtatctactagcctcagcctttatctaccttaacttttcactgttcagcctttgaagttagcctatacccacatcagtgctcatagtcgtc

SEQ ID NO: 3152 - DNA, 1966 bp, Zea mays
  misc_feature (1)..(100): optimal_loci_112882_G1, chr3:129982862..129984827, Cluster 19
tgatatatggggaaaaatttaggagtaacgattgcagatagcctaatgttttattttcattccatgcccactgttattgttctctcactctcagttctttgtggcacaaacagtcaaggtggcccagtgataaaatgtggtgtaaacatgacaagtatttttttttaaaaaaccgtatttttggtgtattttggttattcaaaaaactttaaatttttatcacatattacttggtgcatgcaaatacgcaccaacatgtaaaaactggaatataaatccacttttatataaaaaaaaatcaatatttacggcgcacgtgcagtatacgacaaaatcgaactttcatctaaaattagccttgattttacacgggcacattcatccaaaatttatcgcacccttgcaaacagccatgtcatcggttgcaaacagcatgcaattggttcgctggaaatggaatgggcttgtgtttttgttgcgcgcgtggaaactgagctgatgttgctttatttgttcacgaccaggggtgatctaagatggctcagcaatattaacaattgaatcatgggccgtcatttgagctcattatcagcactgtcaaatatttcttcagttagatttacatcatgatcgtgcttccaaatcacagctccagttggttttttttttcccggccaatcgagagcccttataagaggaatttcaaggcaaaaacaaatcctgttgattatcattacattgtgccaggagacaggtaacacggatgcagtgagacgagcatcatgctgtttaattctggctacttgttcggtctatgcttccctctacagaacgaccagcaaactgatcaaatgatcaggccattcttccagtcgtgaagcaacaacaaagcaaaacacgttaaaattgtgtttttttttttgctaagctatctacaactccagatgcagaaccaaacagttctctcgagagctgcgcagtgcgcaacaagaaagcgcatcagccagaattcaccaacaggacgctaacaaaaccaacctgcaaattcaggaaatgaaaccaaggataggtcgagtgagatcgaatctcctcagttcaggtctccagattgttcttccacattgcagcttcagaagaacgaaagtaatttttaatcgtcatcggagagcaaacgatccattggaaaagcgaacaaaaggccagacaaacaggaaagagagagcaaaacaatcgaaagaaaccaagctttgtatagggaggagggcgaatgcatgaagcgagaggaggaaggaaagcgttcacccggcggctgagtctgcgtctgacctgccggctggtttgctttgcaatatttgtagattctcggtctagggtttgctaccgtcaggtcgggcgccgttttcagtctggaagtggcaaaaactgggcccaagcgaaacaaatagaggcccatctttttgtttggccgaaagtttatgttaagcgtctccaacaagatgcatcaaaatagtatgccaaaaatcaaaaattgaaatgctatatcatttaacatgtttaggacgctgaaaataaattgagctataacagttaagtcctaaaccatgtatttttctaaaaataaattacattattagaaaagaaaatgttaagaatgatgtagaaaacaatgatatggcactattagaggatgtggtatattttggtcatttcatgtgtgctctatatttttttataaaatattgtaaaatagaatattgttggagctattttttatgagttaagctctacgttggaaaaatatacagggcattgatttaagtcattgttgaagatgctctagattgtagaaaaagtcattcctcggatctcatgataatctgattttcctcattatttgctagaccataatttttaacctttatcttaaaaccgttgaccatagctttttttaacataaaggaggagt

SEQ ID NO: 3153 - DNA, 1642 bp, Zea mays
  misc_feature (1)..(100): optimal_loci_11671_G1, chr1:63662083..63663724, Cluster 19
taattttcatggttaaaataattctaagaaactattttaatccctaaaatacatcataaggatagcacaatctaggaaaatttatgggaatattttgtgacccatgagcttgaaaaatggttagagatctaggatacattgaaatgaacttcgaacatgaagatcttgacttgtggagaacacgtttgaaaagactaagaaaaatccacggagtgagatagataatatgagacacatttgcaaatattttctcaaccaaaacattatacaagagtaggatgaatgcatcaaacatgattatatgcatagttcatttttaagtcaatgattctagaaatttgtagaccatgttccatgcactaaagtatataagatcataggatattatttttcattttaaagaattttactaaagcaaaaaaccaagatgtgacactttaattcataaaaatcgaatctctaaccactattttcatatatgagaatatttgaattgcggtaagttccatgatgaattgagataaatttaaagataccttagagccatagattacaacagtgtatgctcattttcaccatcgctaattttggattaatttcataagtgtgaactgtagttggtttcgcgtgatcctaatggagattagaaactaatgtattacttgactattatgagaataatagaattggacgccaactgtatttctgagccttgtagatgaattatacatgagtgcgctgcttagggagtaggaagactcacttaaggataagataagccaaaattacatgacactaatctactatgtctagagatatgtcaatataaaacattcatccatatgcacaatgggaatggcacaaatgatgagactagactagaagctaaaagaagttgtatgatgttaaggtgatatatctctatagtcataattgttgatgcatcatggttgttctagcaaggtggaaccaatgaggtttattaagaaaggcgacaacccattgtgtcgatcattattggtgtgattctagaatgattttgtactcacaatctactgtatatatccctcaagtcaatcttgggtatcttactattactaattggaattcctaatagaggcaccacattaatttttgagaccctagaaaaatagatcttataaatcctctaataataaaaaaatatctagcctttaatttggtaataaaactgtaatcatcatcgttaataacaaccttggatctattgtaatttataaaatcactcatctctactattatgaaaatacataaagtaatctcctaatcttacattaaaattactcacatgtaccattccggaagataattcaaaataacccctaatttgtatataaattatccacattcattataataaaataataataataaaatatccctaaatttggatatgagttaaccacatatatgaaaagtaattcaaaataactctataaatttacatatgaatggcccagtttgctataatgaagataatttaaaaataaccccttaaaattaaatctaaattacccatctttgttattgtaaaaataataatttaaaatagccatctaaccttgtatataaagtagccccatcaactattataaaatataat

SEQ ID NO: 3154 - DNA, 3103 bp, Zea mays
  misc_feature (1)..(100): optimal_loci_119289_G1, chr3:169088742..169091844, Cluster 19
ctaacctgggaaaacgaagccatcaggtaggtaggtgttcaggttggttagtaagcttttacatgcggcgttgaccattggagagtgaataaagtatgggtttggtggaaacgcctcatggcaggctagacacttcccatgtgtgcataacctgtttctgccgagccatagtccatagatagcaggcgacgaacaaacacaactgccatcatcacttcactgagttgtttgatggatggattggatgcacgaattcgtaagaggtgcagggtttaggggcgtatttctggcacttatggccaccgtcagctcacgcaaattattgcagtaccattcggagaaagagctccaaaattcacaagaatataatggctgacattgacatatatgggagtttgaaactggctgaactctgaattctatatagatcaacaaacaaagccgtcccaagacaattcgtaaatgaacaccgatttttttttaaaaaaaaaacttagcctcgcttccacgaagtgttcatatagaactaaagtgttgaagtgttgtttggttaatgaaatgtaacataaataataatggtaatgattcacacctgagtactaatggtaacaaatttgagttggtcctaaacaaacatgatctaaatagctcattacgttgtaaatatgtgaaccaaaccgcacctaattaatagcagaaacgacgctagctacccgtttctgaatctacagccatttggagaaatggaggcacaatcggtggaccatttaccaacctgtctatctgaattcggaatcaagattggagggctcaggcaattagggttaagtccaccttgctttccactaccatcggcaaagaactggctacaggacaatccatcttttgaccagctgggtcgaaactaggagcgtgcttttatcgtagagccagcagtccaatgacctctggtacgtacgtacgtgggtcggtcatgtcatgtgactgttgcgggtatggcaaatttgactactctcggcactggtgggttgggcacatctcaacccagcctaggcacgcgttcgttcgagcggaattccttcaaatcaaatccaactgcttcggtcaagcaaacttagttttggcatcgctgttcaccaatagcggtcaccatcacctgctgtgtgcgtgtgatcgtttggcatgcacaccctcctccgactcggatattggaaaacgtagacgtagagtatatatttgctagccgctataactttattatagtgtagcgtattagcgtcaaagattttaagcagtaatgggccaggtaggagcacgattatgtgccaagtcagcccaacttagcgcaataatagtacctcggcccaagatgagatagcctattcactcggtccaaattcgcgcggtgccgtgaccgtgacagcgtgtgtgtcccattggccaacaccacacagccagcaggtcattaacagataacaaccatttcttactaacacacccttttcatggttcacagcacgtaaattgcgtgtatcaactcctcaagaatggcaggcgtccgctatggagatgagttagcttcaatcctgatatgtcacgttaaagaaagaggttccgctgggatatgttgcatctcgaccctgtttattgcaaagccatgcaccaagccagcacgatgcaccagcaccacgtgaggggatgtgtgtgcgcgcgtctgtgtcgtactttatagatattgatttgcttttctgtatatattattgtttaagtgtagacttttgagattttttctttagtttttataatgcctaagatacatataataaatattatggtaatatcttatattgtctttcacaacgacatatatggatatgttaaatgcaaacttagaacattactttgcactatctttcataatgacaaaggtggataatttatagaaccattagaaggtattttgaattacctttcataatgatagatgtggtaatttaggtacaaagatgcatgcttattaaatcaccattcataataacaaagttgggtaatttagacttaatgttagggagttattttaaattatgtttcataggggctgaggctgataatttagatgcaaattgggggggggggggctattttgaattaattttcataatggcaattgtaggtaatttatatacaaatatatggggttattttgaattagcttttgttatggtacaagtgggtatttagatgcaaaagcaaaatcaggggttacttcatgcatttttagtggtggataactttttaataaattataatagatccaacgactattatcgattatggtgattagagtttaccaaatcaaaggccacatgaatctgactattgtgagaatttctaggatttacctttttttcctaacgtgccttatgagaattaccttggtgtctccattgggtcctctaattagttataatatacaaaataaagacttaaattgtgaaaatataaattttcaggggcatcgactacccatcatcatgcccatcataaatctacagagaaccacttgatatcagtaaaaacttcacatttgaagtgatcaatggcattctttcatgttgtacatcataattgttctgttgacaaaaatgaagtcaactcctaacctagtcatttcagataaccactagtgattgggcatgatatgaaaccatgaaatatcaagctattataaatcgggaatgcctacaatggacagattagctgcatcgaatacgatatcataaactggtaccacatattcgacaattttataggttccggtaagttacaagcttacaggcaagagaaattcagcaattttggagataacttggaccctaaatctgtggtgtataactgatatttactcaatttctgcttaatttataacacatggaaggctttacatggaacaattacacaatgactcccagtttgacacaatgctttccctggagtttatagttgttcaaagcttgaagaggcataaaattttagttttaacatattcagtgaaataaaggggttaaaagggaaaacaagaccaacctaggtggttgcaagg

SEQ ID NO: 3155 - DNA, 1638 bp, Zea mays
  misc_feature (1)..(100): optimal_loci_119963_G1, chr3:173355848..173357485, Cluster 19
atatattaaacatcattgtacatgtcttaataagtcatgaccaaactttagccaatagctagagtaaaggcgcatcgggagaagatagttattactaatcagacaaaatgaaaatatttgaaaaaagattgaataagaaaatataaatactataattaataaactagttatccgtgttatttgcttggactagtttgctagttttttcaagatagcagcgaggtttattttatttattctttagagggtttgataggacatattatttcataatttttgaagcgaaacatgttatttcataattgtcatataaacacaaaagattagtgaagttacactgttgttaacacacattgaatgaataatcaatatttatgacccccgaataatatttctcctatttctacaagtttttgtgggtacatttaacggcacagctaaattttggacctagttagggtctgtttgaatccatgtgacaaacaatttatctgtttatattagcaccttgacctccaaacaagttgattaataaattggctaattgttagctagagggttggcaaactgtttgcccattaactatttaatcttgctaacatgtgctaatagaccgtatagagagaaaaaaagacatttatttagctaagacttcaaacatactataacttgtggctagctaattatctgctggctaattattagccaccgacgaacaattagccattaaaatccaaacatggccttaataattatgaacgatagatatggcctaattgtcttaagtttcctttagaaaaggagtgttacctgctttgggcttttgggcaggcataattgcggttataattacagccatgactcacttgagagagcagcagactttgtcgtttcatccatgtggctgctagctgggtgcaggtgagcaaatcttaaggctccactcggcatcgtgcaccttctcatagccaaaaagagaaacggcgcatcatttagatgcattgtatacacgctgatcgtctcatgcgttttatattatatattaataaaaaaagaagcagcagtggttttgcatcggatactggcaacacacagatgtcatcttggctagcaattgagcgcacagctgcctcgttactcgttggagtatcaaatgtaaaaaattatagaacaaatacaaaccgtatattctgctgtttggatcacactggcacagacaactcaatctcccctgattttaaaatgcaagcttctagagtctagacacaagacactgatcgcatgttagcgttgccatagttttctattagatcacggtttatcaggccgtttgccctatgagcacatctccatcattcaaaaaggtggtttgtttatgggaggagcgtgcttttgtttatttcgctgaacgccaaggaagaagagcgtcacattcccgagatcccacaggcagatcatccatagcgccctaacttccacaccaaatgaaatctcctgctttgcccagatttatccaccatgtggtggcctggtgggtgattagcagattacatgtgtctgtctgtttgctcgctgatatgaatgataaggccaccgttcttatttgtttaacaaactagcatatagtccgtactagca

SEQ ID NO: 3156 - DNA, 2243 bp, Zea mays
  misc_feature (1)..(100): optimal_loci_121786_G1, chr3:183376837..183379079, Cluster 19
accttcggatgcttttacagggcatgtgacaatggcaaatgcaaattccacaaatagccgacctttttagcggtcatattgtttatatatttataggactgagattccttattatcttgtgtgaagttatatttttgcccctcacgtttacatactattgattcacatttagagatgtacatttctgagttttcactatgcaaacatgccacacacatctctcagtcgaggccttctttgggcatcgcttccgattaaggttttcgctttcatcatcaaagctccacttacatcactctttcctttatctactctcaactcgtttttggctagctaaagcagtctaacgaggatttagtggatgaaggttgaagtactttggatcttttcaatctccttgacatgaaataaagactataaacaacatttgttaccttacacctttggtaggagaccttgttctcaatagtggatctgaacattaaagatgaaggtgaattatagagagaacagaggacatttaatcctaatgcgttagtttcgtgtcttagttgttagatctaaacttccaaagtacaaatccataaatgtaacatgcttgtttgtattgcttttgatctagggcccgtttggaagcaccacaatttctaagaaacaattggtttctattcccagtttctagaaactgatttatgggaaaaaaatttgggtgtgcgtgtttggaacctagtttcctgaaaaccagtttctagctttttcgatacacaaagacaagtctacccttgctctattttcaaagtaattgattccattgttcccttcatttttctctgatgccaattttaaatatagattaaactctttttaaatttaagattttcatataataattaaacattcaaataggacaaagcaagcatcatggggatcgtatgcataggtctaagagcggtggtaatctccataatttccaccaaatcaattaagggtggtacgtaatttgccaggcaaaaattggttttagctagagaaggttagcttattggtttcttagaaattgggaatctagtttctgaaaactgaagcataaactggtctatttgaaaataactcaatttctataaaccaatttctcaaagatttgttgcttccaaaccggaccttagaaaatataagatgagtcgttttattttttatattaactttgctagatatatcaaatctgatttaaataaattaaagtggtttacaatttggaatgggaggtgtattttttattcaatataatttgactttcaatttctatattaaagtaacatttctgttatcgtttttggaaggggaatgacagagcttgtgacaaagtggcagacagctccaccattttgcagaagtttgagtttgtttgattagtaacattcacttctaacggaacaaaccttaaactgggcctaaaagtcatatacgtcacaggcccacagcatcgatacctaccgaccgtttgccgatgtgacagaacagacaaaaagaacatgtgaagcttggtttttatctttgaacaggttgaaatttaactactttatctacacatcaccaaatgcatctaaatcaaaatggaaactggcggatatatagctcctcacaccttcatattcgtacagaggttagctaagcaaaaaaaataaaaaaacaacaaaattgcgtctgccgggagtcgaacccgggtctattgcttggaaggcaattatcctaaccgttggactacagacgctgctgtggtaattttattcagtttatgtatttatcacatgtttcagtacaataacttatgaaaccaacttgttattatagtattagtggactccaattgcttgtcaaagcgtttcgcatgggacttacgaaaactaacactgtctaaactcctagaatagagattaggtcatgacacgctcttttctatcccaatctctgttacatatatgctgcggaatatgacaatttgggtcatagtcgtctgtgcccaagactacatttgagttagccgagcatttcatggagtgcgagttctcaaacgtaccgtttctacaagacgtacgatgcataaaaccgagttttttctactaaaattgcaccttttatttgcgttggactttcattttttttttcaataatacgtttctcatccttgcagatgcgacaccgctctgactcacacttgttgcaaggaccggcatgtggttgaa

SEQ ID NO: 3157 - DNA, 2005 bp, Zea mays
  misc_feature (1)..(100): optimal_loci_121804_G1, chr3:183477883..183479887, Cluster 19
atctactcctctaattatacttgcacttatcgatgcccccacggtaagtcctcctacttcttttagtctctcagcctaaaccttagcgtccgtcattcatcgatctatcggtatggagtcgtttgatctttaccttcgtggttgactgtctctaagcttcatagttgcgaccacttttgtagtggtcagtctgtaaactcaactaaagctgataatcttcttgagaatcatttatcatactcagataccatagacgcttcatagttgcgccgcgccatcagccacaggttggcatattctgttgctgtcatctctgccttgagttaactggcggtgcatatagtcgaatatcaaccagtaggagagatgcacagtaagagatatatagaagcaaacagaagctcgcagcttttgcacatgaataatttactgatgtgcccaatcgatcaggaaagcacaagcatttttcctgttcctaaagttgaggaacacaatcagaccccacatctatcatgtcgttcctttcccagcctacaaatttagcattagtttcttgttagacccgtacacatgcaaatgatacaggggctcccggccagctactcaatttcttagcttgctagcaccgctttgtgttagacagagcggccgctgtgatctgcagacactgttggccgaatataacacatttattcgatgtgttgtttatatagtgtatcatatacaatatgtgaaacggagagagtagaatagaaacaggtggtggctagatttagattctactacaacagtgtcacccgactcagaaataagtgccaccagtacgtacaccaatatgaataagtatataacatttacaagatatcaagttaggtgcggcttgtcctgattttgcaagcaaccttattttatgttcgattttctttgcaactaatcagcaagcacctccatcttgttggccaaaagattcatttaattaagagataaccatagtatatatgaaagacgcgcttaatattccagaacaaatataattggacatacattcatgtatattatcctttattcctttttctgagaacgtgactatattatcctataatatataatgcaaagtccgatggtatgatgttagatatatatgaacagcctcataaacacttcaccttattatttctgaatgcagtcttatgcattcaaggcacactttacaatttatagagcattttctttatggaggtgaagaggtacttatatttcgtttttttgtgtgtatttggtccactgatgtgttcgtcgtcatcccccggcaaatttattaatgtgtggggtggtcaacaaatctgtttgacaaatacctgatattttttaaaaactatgcttgttaataaatacatacactaccataatctaaaaaaaccacaaagatagctaaccccaccccaaagaaaatagctagtccttagcagccatctctcaagcaaaatataataaaaatgaatcacaaattcacaatgaaaattttattaacctggtggttggccctcaaaaaatgttccatatagtcattgaattatagtttgtaattcaaaagaagtgatttttcaattaggttatagttctcaaagtaaagttttgcattggtcctggtatatatagtaggtctatgtcccctaccattgaaatttactcttcgaaaaacgctctgctaggaataatttaatttatataccgcatgattggttgacgcgctcgccaacgccaggctcgcgctggcctggacgggctgagatctaggaatctcccgtccccgctcatgcatccaattggtgaaaaagcggcctacattgcacccgcgcgtgcagatcagtctccgcctgtggcggatagcatgaaaccaatcatgcgaatacttgacgtgtgcatgcaatggctactaagtgaaggatgaatttgttctaaatggttagctagccttccgagatctaaataatataagtagcta

SEQ ID NO: 3158 - DNA, 3459 bp, Zea mays
  misc_feature (1)..(100): optimal_loci_122079_G1, chr3:184842218..184845676, Cluster 19
atttgtggaagcttcaacttatgctacaacttatattcaatcactagcactgccattagcgtactgagatatcgataccaggaaacgaagtgtgctcctgctgaaagtgtgaataccaaccgcaaaaatctaagctttataatgcgaaaaataattctattgatctaaagtatcggaggggactgaagacactatatgaggacaatcaaaggtggagattgtttgatacatctattccccggtactgactagacaatatatcaaagcaacttccaacttcagagagcccaaaactggtgactgaagacacagatgaatgatctttgtgttggtacaaatataagtattcaatatgcaacttcatgattaaaagatgtttatgcatttatacctaattgttcataaacgcgcgcagggcgcgcgctctggactagtatgcttagcgcttgacttgttttagtttttttttcctgggacgttgactacgtgagaacaccgagtatacggtcttctgagaatctaacgtaatatattacggccggggactctggtatatatatgctttttgagtagcgtgattaggttccacagtacagtacaggtggccacgctttctcacttgactttccacagcatgctgctctttgagcagcgctactgctgctcgttgaccatctattattctatctttccacggaggagaataagcattcaggactcgatcgacagcatgcatgtgttacgattgcgtcgatgcggatgaccatacgatgtttttatactcattgctacataacactgacaatataattactagctaggttctagatccttatattaaaaaccgtttcggttccaaattttctttgggaaaaaaaattgcatcgagacttcctaaaaaaatagtatggaattgctagagctagtacaacgtggggattgaaacgaagtcatgcgaaaccggattgttggcaaccgtttctccttgccatgcataagaaaaaagacacgactctaacagctcctccactagttccaaaaaaacagtccctaaaatttgttgataaccaaaaatcatgctcccacggtattttaaatgaggtcccccatacataccatctttctaattatccttatttagagcatcttcactagtttcctaaaaaaataactccctaaactcagatttagcaatatatattaagaacaacaacctccaacatatgttaatcctaactttaggttattaaatatttttttgaattatgcaaactcaacgtttctaggtattacttgcggcttcaaatttggtttcattcgtacgacaaagtttaataatcaccgttcttctcttgattactatttttattctgtatgaattatagtcgtcagtcgatttcctctaattttcttttggattggtcttcttcagaatgaggacggtagattcatccttttcacgactcaaatcattcaaagtgcatcacttgcatacatgttcgatggtgtacaagtgattttatggtgcgattgacatacaaaataggctattgtggggggggggggggggggtgaaacagctccctaagtccgcggactaaatagggatgtttgggaagttggtttatttgaggacttcatttaagaaaccgttagaggatgatttttattaataactcccaacaataattttagggccttctttttgtgaactagtggggatgctccccaaactttgagagttgtttcgcagtctcaatagcctatttcgctcatcaaaatataggtattagttgagagagaatttcgattgtctaattcacccgcttttagacgccattgttcttaacaccatgggttgaagatattaatgcagtaatatataagcattgtttgttgtgtgtgtgtgtgtgtttatgctgaaatcacaaatttagtttgaatttggcaaaaaattaaaaaataaaaaaattggtgggagaagttgcaaatacggttgttcttaatttgtagttgcctctacaaatggttttatagaagaaggttgtggtacctagccgcctctataaatctcattttatagagatatggctggacaccagtctctataagtagctgattcgtagcgataaaaaactagaggcgacttggatatctgtctctagaagcatacgagccgcctcgatctagggtttaaatctgtagtagtttatgcacttgtgtctttgcgaataccctttttgtcgtgtcgattttttcttgaaaaatccagttagtggactattatttatatttgaagttgagctaacactgaaaggaacgctcaatttacttgctaaactatgacatgcatgacccctgcagcattgcctgttttcttccatggaggcaatcctttcctttgactgctggagttgtcgcgctaggttttcaatccaactacttgcccagatgatatggtacggtgtgtgagaccgacttattatagaacgttccagttgaattcctgcgtgcgaaaacaaaacagttgcaccgtaccaccagtagttaattttgcaggcgcgagaatacaaaaccgcggctccaaactttatttgaaacgaccagacaaccaaagctggtctgggcaaggaatttgttcgtctttatatgttcgtgttttgaccgaaatatataggtcggtaggttagagacatgcccataattataaacaatcggagacgtacaaggacttgggggaaattctctcttccatgcattagcgacgacgaccaaggtgtgtgtgctaggaattgacacataatttcctccggggaaaggaagcacacacggcgcggttgtcgtcagctgatccagccagctaggtcggcgtagtcgtcgtcaagagaggcgccccaagcaggctgaatcggagcgatgcttgctcttgcaggtacttgcgcagtcgtacgcggtgatttagcgacttcctcttctagcgcagaagtaacagcgattggctgtgcctgtgcctaatcagcattcgtatctcacgtacacagacgcgcacggcgcatgaggattgaggagtcagccggccggtcggcagaaagtagaaattaactcgctgtttgcacttactgttgccaagtaagtactccgtataaagagagcaagcagctagccacgcagctgatctctagagggaaaaagtatagttgtttagtgttccctttttcatgctagctagctagctaggtcttcgccccctttgaatctgtccggaatcactccgaaagggcgccacaggcagctcaagccgaccactacctgcatacacatggatgcggaaatgtagccactaatcaacaagctgctgtgctgtgctgccgttaatggagacttgtgtcatggaggaagacatgcatatcccatgcgcgagtgctggtagagctgcgactgttttagtaacgcgggata

SEQ ID NO: 3159 - DNA, 1529 bp, Zea mays
  misc_feature (1)..(100): optimal_loci_125160_G1, chr3:201603247..201604775, Cluster 19
tccaaaggtctctcttgttgttttactacttcattacagtcctaggtccaataatgggattaaaaacataatacacggtcatagtggcctggtgtaactttttttcattgggcacggtgttcatttactaatttaatcgttgcatataatagtgtactagcaaccagtataatgcctaacaacaatgataagaaaacaagtttattcatggatgtaaagtggcttactagatgtttaaattgcgatagagatcttcactaggattctcaaagcaactagggctatgtagtactagtagcacttgtacggcgcgtcaataatgcatgtgatgagcaatgcaaggacacaatcatgtactcaggttgactacccaaacaggctatagtacatactccaaacactgaattcgaacgtgcaaaatggtgagaaaagtagcttcaattcagatggctgagtttaaaatactaccgagtcctacctaacctgtgtagccttcccatcagaagaatatgccagctccgtccagaaatttattggcctcctggcagaaggcaaaaggagctaaaagggtagctttcgacgcccatcatgtgtgtttgaaacttggagctaggctgagctactatgagacaatcgactaatgggttggttaaagatgcaaatggggttaaagtattttttgtcaggtgaatggaaagcgcttccattaaggatcccctgctgcgctagcttttcagtgccacccttttgtgattagcttgctcttctttccttctaaactgtaagtcaaatcgaatcatctcaagtttgatctaatttataaaataaattaatgatgtttatatattagatgagtataactacatttttattaattatatttttatagtataataatttgatagtataagtctttgtagttttctctatagtttttttatcaagttgtattgacttttgattgactctacacatgaaagttagaatagcttacaaatggggagagtagatcacagcatcatcattacgctgcaaattgcaaatgacaatcctagctcataatattacagggagcacatcctgtcgtcctttacacctttcgtgcctcattcatggttacgcagctggcaaatctctgacgtttacacaatttaatcagtttaaaataaattatagctacattgttcactcgtgtgtgtgtatgacaacgttatttctcaccctagatgataatcactcaccctgcaatgattcaaaaaataacttataaaatcacaaataatttaacaatttgttaagttatttgagggtgggtgatcatcacctaaaatgatgaatagtaattatatatatatgcatagacttgatggagtatttacaaaagcacatcattaagatcaaatgaatgaaatcataggtggggaacctctccccttctaccgacatgaaaaaaatgcatttgtcgttggttccaagggtttttgtcctaagggcgcgacattgttattattactatacactatttttct

SEQ ID NO: 3160 - DNA, 1800 bp, Zea mays
  misc_feature (1)..(100): optimal_loci_125571_G1, chr3:203524920..203526719, Cluster 19
aaggatggttcatggttggtacaacaatatacacgttaatgtagagatacagtaaagttggtaaacagtaatcaaggctaattatattagtgcattatatcgtcggtggttagtatgacaaaaataagcgttgacgttcacaagtatcgttctggttgttccaaggaacctattccaaaataaaaagaaaatgtatggtaaacatatatttttgaggtataaaaatcaaaacatgtgatgctctcacatgggtttagattttcaggatgggaacgtcctttttgttgattttggatcttcatgcctagttttagttacttggaaagctaacctgagaacataaatagaaaatatgtattaagcatgaggttatatgctgaaaagagtgatatatattttttttaaatgcatgcaaagtgaaactaaagtagtctttacttgtatgataggttaatgctctagaaacctgttttacagagtatgccatatttcttttcatataacaatgtcgtattagtcagaaaaaaggtcatctgtttaaagtatttacaaatggttatgtagttatatttgaaccaataacaaattttctttggcattctcatatggaaataagtatctgttctaagcatctctggaagacgggaacattggtagctgcttacgtatggaaaccattacaaacctcaattatcctttcgttattatcagtttggcttcttggagaacattttcaaagcaaaaaaagttactttgtaacttctataagcatgctttgtacccatcttaaaagaaatacaatcgtacatcaactaatctcaaacaaatacacagagtataggaagaatgagtgtgcaccttgcactttggaaagttgtgaaccactcaccaagctaaacatcattttctacgggccaaaagcccatgaaaaaatgtgagagttagtaagtggtgaataaaaaacaagtgattatagtaaagaacagttctagaaagaatgtactgtcgactgtcttagaagatcttaaaacgaaagaacacaattttacatcttttttcaggaaaaaggccataaaatattgtaaacgtattaacatgaaaccacaatataaatggccaagtaaataatgtaaggaaaaaggtaaatttgtgataaaaaaagattgtggatctaagaaacgaagaacgtggaattttattgcaaattttggtaagcatctaaattttatatctatgtttcattttgttaccttttccactttcatctaaatttctataattcttgctccttcaggcttgtcctctccataacagctggtggccaatgctaacaggttattattttttgtataactggcaaactaagcttatatcaccctaataattgtttgtagttaaattgtgagtaatccttgacattttgtgcagttttaatgtatgttatcctatgaatgcccctcatattttccctgggttctgatactgcttcgtccgatgggggagataggggtaagtgatcgtgtctagtccatggtgctgcgttttttcttaatcacccttgccacctggtttaacagttagcactgtttgttgccccaaagatatacattgccttgctgattttcattttagtagaggttcacctgtgaaacctgaacattggcttgagcgtgctttgctacttgcttggcagttcctatgcctgcttgctaaccactgattatattccctaggttctctttgacattttctaactatgttttttttacatggaaaagttaatcggtgttacctttcctg

SEQ ID NO: 3161 - DNA, 1719 bp, Zea mays
  misc_feature (1)..(100): optimal_loci_126470_G1, chr3:207739235..207740953, Cluster 19
gtataggaaacaatcatacacaatcctatcagggagatccttgcctactgagaccaattaaccaaataaggagcaggcgcacaaggcaacgagcctgtgcagccgtgccacctaaactgcctaaaatagcacacgctaacaaatattaactttgtgtaagtgcaactggcaaatagttacagttatactcaactcaaaattgaaataggatgcttcaagagaggttacttgtgctgacaataatacaatttttgtcaggatttgctcattccttctcttctgagagaaggcactgcattttcagcttcatccttggcaatggtgcctggcacacctattccacctatgcttgcaaggtatgcacatgtctgaattgagcaaaatgtgatggttttttattataattatgttttattgtttttttccagaattactaacgggttgactcagtcgttgaaagctttccatggcagatcatttacttgtgagtacaagtatgtccatggctcattgcctctctaagatactttctgactagagctactcaactaactatatggctattttaagataaaattatttctaaaaaacatgaaattattttatgaattgctattacaaccctgggtttccagctgtaccagatttcagaaaggtttgcctttgccctgaaccacaatgtcttccaagagtagcttaaacctaagctttctatcactcatgaagtcctgatttcagactcctgaattgaggagaatgtttcaaattcttgacagtttggaagagtcaataaccaagaaagaaatattttcttttatttttaagcataacttgtctatttttgaaggatcatgaaaactctgtagtgctaaggtaatatgcccacacttattcatgatgtttgtcgagcctcaatagtttacagtcattcctttacacgtacaaagttcatggctataatctgtgttgaccagaagtagttacttccataaccattcaccaagtggcccatgctcggatccccagtttattagaaactctctcgatacaaaacactgactttttctcattaatgtcacttctaggtatgatggtcagcgtgcccagattcacaaagcacttgatggatccgtgcgaatattttcaaggcaaatgaaagaatcaacttccagatttcctgatcttgtgaatatgattaaggagttgtgcaagcccgaagtgtcaagctttatactggatgccgaggtcagtttgactctgaaggatttgccatccctacacttgtttggcctcaaactatttttgttattgttttgcaaatctaggtggtaggaattaacaggaagaaaggaaatgagttgatgtcgttccaagagctatcttcaagagaaagagggaataagcattcctcaatttcaatagagaacataaaggtgagcatgcgatttactacacatcattaccactttggactattaatattgttttgggtcgtacttttatgtgactaatgccaatgacttttataaatttgaggaattattgtagttgtccatgaatttctctaattgattttgttatggttcacaactttaattgaacaaatcatagtcccatcccaagtccctagtgacctacttccctttgttcgatgaatatgcatctgtccttgttgtattcggtctcatatatagagtccttgttgtataccctctctat

SEQ ID NO: 3162 - DNA, 1519 bp, Zea mays
  misc_feature (1)..(100): optimal_loci_126605_G1, chr3:208525862..208527380, Cluster 19
atactttgttaagtctgtagtttactgttatgatatgttagacaatgcagtaagtgtcatcactcatggtctttgtattgcatttaattcgtgttccagagttctatagtcttgttacaggtgatcgtgaaagctctgtacataatcttccatatatgtttatgctatctgatgtttcgtactttaatttctcaaagatgtagttttggaggactgatgtttttctatttccttttgtagttcgattaacattgagttgtgtcactttgatgagtttgagacttctcagagtccaggttctcttttttcatcgctcgcaatatttgacactgaatactgtcagcatgttactgttttctgtttttattgatattctgaaaacatagtggtttaccgaatttaaatatactaaagttttggtactgttttctgtcagcatgttattgttttctgaatgacacgaataaatgacagtagaaaaacagcatgcacaaagatggacgagaattaaatatactgaagttttggtacaatgaaccgaatttagttaaaactgctgtagttgttcattattgtatgatgtactatgcaatgtagatgtgtggttcacttgtctagattataaagcatcgcacaacaacaagctactcttcttattctatcttttttctgccttgttttcctttggaattgggacagatgtaattttggcatgcattgtatttctcaaaactctcttttcaaataaacaaagatgcaaataagctacaaaaatattgtatatatttcactgaaacataaactaaactgagttcttatctttgtgtagtaaactgaaacataaactgaactgaattcttatccttcaatgtgaaactctagattcatactgcatgtgttcctcccataagatatagatccttcgatgcaaagaaatacctctggtcaattcacaacaacggagaaatgaatatttatctgaacaaaggttgaggtgtgatgcttgattgatttgtttgtgtaatgtgccagagaaactagagttgattcttcaatttgaaccttgccgtgaaggtctgatagttgtctatgggagatggtatttgaattggtggcaattgctatcccttagcaaggccaaccagaattgagtatttactaaacttatctgaaactaacagatgcctctgttcagttttgacagtcccttcagaggcatgatcttgatgactgtgtgggtgatgcaacattttgttttcctatttacaagttattttaaaattgagtatttgcaagatgctttaaaattgagtatttataaaattgactttctttatagtatttgcaaataaaatgtttcctaactggagcttgtatgctatatttgtttcataaacttaattttgttgatgcaggactactacaaagttctagagacagcttaattttgattaacaacacaatatatgaccatacatatgttattgttgcacttttttcgttgcaacgcgcggacatt

SEQ ID NO: 3163 - DNA, 2168 bp, Zea mays
  misc_feature (1)..(100): optimal_loci_12793_G1, chr1:70138723..70140890, Cluster 19
gaagcttatcctgggaagtcatcttagattttgggtgctccttatgcacttcagaatcagcaagagaatctgaactttgcaagttttgcaagactaatacctaacttttaggtaactcggatgaaacaggaacgtataaaacatgctggccagtttattttagagcagctagaatcagagcatcctgaatacacgattgatggagagaagatacatgggtcgagatgatactacaatgtatcaggagcggaggaacatatattcaaccagttccataattgtttgtgtagaaaagagacatggagagcctatatctcatgtcagtcactaggctcaagatcttttttccagtcatgctattgttgcaaagcaaccatatcaacataatctaggtcgagttattgaggcactctgaaatcctattaattctgcactttttagaaaatctgttcgacatggcgtagttcctggcatgacatctcctatcaaatcaccaatatcaacttatacaaggtgatccaatccccaagctctatcctttgtcttattagtccattttgttttggtatccttgttcttggagtgacagcagatcatctgatgtgctagtttctacagttcctattcaacgacattattgctcctctcacttttttaacttttagtaatcagaaatggtaaatgtgcttattcctttagaggatgtgacttatggtcttattttctactctctcttttaagtgctaaccgatcacatctgacaaaagtttgggaatcaaactagttaggtgctaaccgatagattgtggcacccatgctgctaaagtcgttgccatcttgctaaacattatatatgtaagcttactgaatacagtaccctagaacaatgccatatttccatcataaagattctctttgatttcttcatatttggggaacaaatggaggttgcaacaaggttgttttcatgtttttagtagggttatttccttttgttaactgataattttggtttgttccattgtgtttgaatagtgaacattcagtttgcaaaatatgaatgaggtcttaactttagcatatatatatacaactattgtattgctgcatagtttatgaatggggctggagtttggctctttgagtttattttactgtgcctttgagatgaacgcaacactctacaacaaagctagcctcctgattatagttcttaatttattctaaacaaagaatacaaatggaggttgaaatatttgccaacttatccctttatatggttacgttaaaacaccaaattgaatggttcaagtatgtttgagtgatggggtcgcctcagcatgcagaatactgacaaaatgtaatatggtgttaataatgaaacaatacttaagtaaaatgtctaccgagaaaaaactcgagttgtaacatggctatcaaagatggataaaaaatttgagtacacaaatatttgctaactcatgtggatatcggtttatcaacaaattaagctaaaatgatttgaatttcttttcttaagcatacacattttgttctagataaacttttaattgctatagagctgcaaaagtaatacaaaaaatggtcccagaattttgtaaccaagaagctcatcttggatgagattcaacaattttttataaatatatagtaataacaaaatgcagtttatggagttgctattgttacagtgactcaaacttacattcagttcctaccatgaatacctttctttttttgtgtgtggcattttaccggaagggtagcttataatttgacaagcaacaatattctgcatataaattctagggctgatgtaccttttttccataccaagtttagtgaacataaaagtaaaacataactatagtgatttggcagtagttaaaagggttgtttaacaacataaaagttaaattctagagtgaatgaccagtatcttacaaatgtcctacttaagataaacacaaaggttcgtttctctgtcttgatatttgagagcatggctacatttgtatatggcaattaaatattttaatattttcccttttcaaatagctaggcagcatgaatctgttgctccaaactgaaacatccctagtaattcctcttgtatccaaggtcccaactatagtcttgggaatgga

SEQ ID NO: 3164 - DNA, 1775 bp, Zea mays
  misc_feature (1)..(100): optimal_loci_131861_G1, chr4:3035643..3037417, Cluster 19
cataatagtgtacctgaatataaattatatctggataaatagtaaaagtcgtgcacctagaaaagttgaaatgacccataaggctattattctcaatgttagttttatggcgctttcatgcacatttaatagcgtgtcacgccataattttagatgacatggcaaagcatttaagtggaacgagtttcgtgggatgaaattagttttatggggggacgaaaccatatcaacactcgtttccaatgtcttagaataaatcgtgtgaaaccttcactgagaacgatttattccatcttcacatattttactaacttgtattggtcattcggttgcatcattttaattggtacggttggtctatgaaatagtgaagtacaattcttcatgtcactctctcgatggtgtggaagctttggaaagagcgttatgaaactttcgctgagaatagcctagtttagaatatgactgggcgttgtttagtttaatggtataatagggaacacacataaaatctgtgagtaattataaaccatattaacgtacgtacgtatgcatgacgtagaggtagacgtttcgaaatccaaaacgaactcgtgcaataactttaattgttctatataagggcttatttgtttagatatgattctatgtagattaaatggtattgatcagatttaaatttataacaagttaaaatatatcttaatcacacctaatccacgtggaaataaaaatatctgaacaatcttttgtcccacaaagattcgtatctacgacgtgaccgcctgctgccccggtgaatggctgggtcccctagctagcctcgaggaggatgggacatgagctgctagatgcaccagccacacatgagggattggctatatacactagctactatactaggggcatgtccagaaagtaatgaacgtgacccgtaatgccagtgcgtcatgaaaaagacaacactgatcgatccatctttgtctgtatggtcgtatatgatcaccaattatggagtatgctatatgtccttttgtgatcattcaaatatgacctgacctcaccaccacctagctttcattttacagtcgacaaaagcaaataaatagtaacgactgtggattagaataattgaagatgatgatcattgcattgccgccactgtgcactaagatctactactacgacgacgacgacgatgattgacatgtgacgttgcagcaaaggggttatatatagattccacgaaattatataactctgtataagttgacacctttttattattcaaaatcatctatctctaaaaaaggattatattttcttttttctcacatctaaaaattcgatctttttttaaacgacatcaaataaaagaaaaaactggccaaaccaaagttatatatctcaaaagtctatacagctctgtaattgacaattaagttttgtatttaaatttggtacccccgtgaaaatcgtttatatatttgtggagacaagacaaacgtgcagtgttggggtggagctggcccaactgccctagaaagctactcaagctaaggaggcatgtagtgtgtgcggtagtgaagcgtcatccaaatacagtgcacaaagatctactagatctatagcagcagcatggtgttgtgaccacacttcactattaccggagagctgagaccggccgtacgtcatctcctgcttcttgtttgcataattgcattggtgcggtaatttacaacttcaaaccttgagcaaattatatatatactacg

SEQ ID NO: 3165 - DNA, 2012 bp, Zea mays
  misc_feature (1)..(100): optimal_loci_134810_G1, chr4:15826843..15828854, Cluster 19
taataagttagacccttaataaattttattttaaaaatgaatagaaatagcctgaatctaattttttttaaaatgagattatactcagcttttaagaaagcaagtaacatagtcacttagtgtctggctgtgagccacgcaccagtacatgaaactgtggacaccagttttacagagagaaatccaaaagttcagaaataggctaaaaaacgcaaaccaacccacatagcaggattatttctaagacttccagatgacttccatgtaagcaacagcttcacgcctcggatggaacctgtgtagccacaaccacaatttcatggtattcaacatcagtctcctttgtgttcagcaacatcccccaattctgcaagtaagagatagcatcatacaagatacccattgtgcagtcaggaaattttttcttagccatcctattcctattcttccaaatggcccaacccagaccagatatcaggaataaacgcattctactagatccctgaatcttagtagaagaatggttataaaagaagtcctccacagaacaagggttattattccactcaaaaatttgtttccaggagctccacagaaaattcgacagccgagttttttaggtgctctaaatgctcataataaactggaaaaagaacatgatggctgccgaagtttgcgtgggcaatcaggggtttccttctctcgagtcctggcagaagtgttgaagaattgtttgagtattcagcacggtggaattttcagctttgcagaacttcgaagcgaaatactctgactgaactgcctgaaaaatacaaggttctgttttctcaacacaattttggttcgtccatttgttactctcttttcttcttagaaaataagttattacatgtgtcggatagaaatgctttcttttttatgggaaatttttttagtacacggacaaaactacttataatgtatttgttttctccatttacagtcttgggatttttttttacccttttgaacgggaaggtgaacctatatttttaattgactatgaaagcaaaatctgaagaacacattgatctcagcagcatcatggatagacgactgaatgctaactatcctcaaggtatctcgggagcatagggagtatttttccagtagcatgaaaaatgagatctgataataactatattaatctattgaatatataatgttaaaaataatgtattgaaagaaacgggttgtttgttggtgtcaggcttgggccacgttatactgactaaggaggagcagacggcatctcaggtaatgtgtgcagcgctgccctcatctgagtgaccatagcaatctctagcccagctcttgcttaatcacggcatgtttttgttcccaacgcctctcaaacccacaacaaatgcaaatccttcctcccatgctttgccttctactatatcgagaatacttatcagacaacagaaattatcatgtagctattatttccacttcctatcctgcctgtgtgcacaacaatggcgccacctttttattttgctgttctctgcgatgcatttatgtagtattgaactcaatgagtgcagttatacatatacacctaacaagaccagccagatatatatggttctacagcaccggatcacttttcttctaaatcaagtgggtgccctcctattgaatatttttttgtaagtatattggagtttaggagttattacaatgaaaccaagaaagagagaaaaaagaacacaaaattgcgaacaagactatccattgctcaactaacaggatgtcgaagcaaaactagtgatgtctcatatgtatgtttgcgtgctaattatttcaaaggaaaaaaggaatttttgccagttggaccgtgaaactttaagaacgtggacatgatcttcctattttggggtgattagtcctattgatgcctaacaaacaaactgataatgaagggatagattatctaacctttcaagtataaaacaaacataggagct

SEQ ID NO: 3166 - DNA, 2578 bp, Zea mays
  misc_feature (1)..(100): optimal_loci_137288_G1, chr4:29004725..29007302, Cluster 19
ccttattttcatggtagttgacatataatatttttatatatttttattattctaaatttatgtataacatattttactttgttagcttttctaatactaacacatacttgtcaaatagtaaggaatttagtgaggtatttcctcctgtcgagctcctctagcggcacatagatttccctattttgggagagtgcttttagcttagtagtcatcgagagatgttgatgcacatagcttcatatatgtatattcatgttgccgtatctgaacatgactaggtaacaagatttgaatcaactaattttgtattttaatttcacaatctaatatattttttgttatttttaggatgacgagcacgagcaacaacaatatcactagtaggacgagtagtaggatgatgaaaatcaggttagcgtcatggacgatgacaccactgaccaatgtgtttggatgaggtccatgctggctaggtagatgaccttgttgccagaggctcccgaggaagctattgaaagagtcatgtagtggctcctcttatagtgcccacttgagaggaatacaagattgttacctgatggtgatagagaagggtttctaatatctttgttttgtatatttattaaaaactttatggagatttatatcccaccttttatctgtaggtcatgaattgatgagaccttcacttgtacttctactacaagtaggttaacttagtcttaggtaacatctgctgttttcattggttagggatggtgactatgcttggtggtgagtgtgttcccaaaatgcacaagtagtgtgccatgatttttaggtaagatagttacatatttccttttgttattgatgtttttaaagtataatgcatatatttctttatcacggtttattcttgtagttacattttcatttaccaactgaggaaatcatatgacccatgcacatatagtgtttaacaagaatgcatggaaggttataaaggactaagtgtcctatgcctatatacagacaaataatattcattgcaaggagattctagggcaaccaatggataagaagcacaaccttcgtccatctatttgactgaggagtaatatctttaggaaaaacatttttaaatattttgtattatacttccaacataataattatctatttataaacaaatatatgtgtaggtgacaaatttgtggatggtgaaccattaggatgcttactatgctttatgtagaatttgagcttcgaaagaattctagaatatgtctaattagtatagaaggaactaataatgcaatgatgcatactcatggcaccaacaatcatatatgcaaggctaaatgcatggtaagctatattatatcatttatttccaacgactaccacatataacttctatataaggaattgtcaccagagtagcttgaggaaaatcaaggtttatattgctagacattagggcacatacttcaaatccagagtagttgtgcagtcagttatgcataaactgtatggtgagttgtctacactttttatttattatattgagttttattattagcttacttagtttgtttctactatagatgtaatatggtcagaaaatggtcaatcgatttggacaggattacaattagcaagtgctaatagttgatcctttagttgtgcacgctagtggaggtggaaagataaaaggtataatattgtattttctcaagttatgtattacaagtataaatttgatgttctgaattgcttgtgttataggtactccatatttaatggaatgattgactctagataggtcaaagctaaaaaggagtgtccttattgatatctctggatgtaggatgtagcagtcaatgaagcaacaaacaagaggagttgctttggattcaagaagcaatgatgttgcaatgagcataagaggcaacatcaagagtataactggcaacgataggactacgagcaacatcataatgagtatttctccagctacataacacaacaacaagctttccttcacatatgttcgactggtcttctattaccatttatagatttaaacatagccactggtgttttctctattttattcaaagaatatgttacaacaaaaggggataaacatcgagttccccatgtttgagatgtcaccactgctacaacgaggtcctcctttgccgataatttgaccttatataatcgcatatttagcaaacttacatcaattttaatggaaattagtcaattaatattaattataaaaatcacatttatctcaattatatctaaacttagttaatttagctaaattaactaagttggcttaattatagacaaaataatcaatctagttcgattatagcaagacttagtcattgtagagcaaattaatcaatctagctcgaattctaacaaaacttacttaatttagctaaaccttacatactactgtcatcataactcattgtagctaattgtaatctgcggagtttccagactcctccaaaattagcagcacctagagatgccgacaatgagaggtccaactcatctatcaactctacccatc

SEQ ID NO: 3167 - DNA, 2505 bp, Zea mays
  misc_feature (1)..(100): optimal_loci_138985_G1, chr4:39256937..39259441, Cluster 19
accatcttttttttctcctctttctcctccatactgtattggctcgatcagacactaatttctgtggatataacataaccatcattgtttcgcttcaagtctggctggcattaccaaatgtttttgtatgcttcatggtttgtctctaaaccttggatcgccattagttgttgtgtcgatgatgcagaagtacgggtaagctagatatggatgcaaacagcagaatattccatgttcttgcacatggcaaattctatataattatgggggtacaaagtaggctccttttgaaaggcacacatgagcatgcctataccatgtgtttattcatgttcctctatcagttcagagagattgccatgaacatgcttgattagttgattgccttcatttggcagagaaaccaatatcctaagattggctggtgaacaggggtgctctcacgtgaagatgttatgggacagaggaagattcttaattatgtaggatgtgcacagcatagcctgtttgtccgttcatgctttctatccggcagatcgacagagacaaagagagttgttgctgcatgctattgctacttcgctagcacaaaatgacatgcacatgaacttgtctgcatgcagcttttcagcccagaggagaaagttaagggttccttgtagaatatatattcttgttttcttattcttattttccaactttattcttgtttaggaatcaatctaaatgtgtagctaacagcccaaccagtaactaacagttaattagctgcctggatcaaacgatttatttcttaaacttactgtctagatcaccatctgcagaaccatttggaaaatcgatttctatacgaccttttcatcctctaaatacttgtcatatcctgttgcgctctatctttgactagcgagaaatatctagatacctaattaaaaatcaagcagatagttttttttctcaccaagatatctatttgcattgtatatccatgagaaagaacataaacaacatgaagttgctctaagactcttcatctttgccggacctgcaacaacttggataaacttgggcgtggtgacctttttgtttacttcttaccgccggtttgtaaaatggtaacgacgaacaccacttttagcgacgccgagcaaaactgacggtgatgaagttgttgttgttgttgttgttgttgttgttgttgttgttgttgttgttgttgttgttgttgttgttgttgttgttgttgtaatgatgaggaggttggcaactaatgcaaatggagaggtatagtatacctactagccaactgctgctagctactgtatatatatacgagctgatgatcagcaacggacgatggatggatcagatgcgggacaaaaccaacgctggcaagctagctagctctgaaagcagaggcagttggatctatatatctgcaggaacaaacagtacctgtacgtctccctcacacacagcaggacaggccggacaggccaggcagatcagcgtagacgatgatgcttgctggagtaccggctccttcctactatctcatgcatgcaggagtacgtacgtagatgcaggttgttagcggttagttcaagcgtttggtgtgctgctccatcgatcactcatcaagcccatgcaatacagttcggttcagttcatgcatgtatgcatcgtgtggccgacggtgccacaacgtcgctatacatttgctttttcttcttctttttataaagtccagcaaattaacggagggcaaggcaaacaaaatgacaaggatgaatcatgtaggcacaacaagaacacgaagcacgtcgccagcctctcttgtcattggatgttcgaacgtctaagtccaactctcgttttcctttgacttcacctaataggacaccaaaatgacacttccaatatatgtgctataaacaaggacatattattaattctggatagccaaatccagggaccaaaagaaacaaattaaacatacacttactttgttcttgttatcacattcaaactcaagcgaacccttgggtgcaaaaaaaaaatgcaccttcgcaatcacacaaagaagagttcttaatgcgttcatcgatggagaatcgggggaagcggaacccagtgctagaagtgcttgtgtctctctccaccaatcattagaaagtaagtacattgcattaaagtttttaggaccatctatgcattgaaatagaaaacacctctaatggtcccaaatatgttaatgacaccaacttatcattgatttaatagtatataacaaggaacaccaatttttttacaaataattatttacattaaagcaacaacatatgtagaagcatcgtatacttgtgacctgatgtctcgattgagacacaaccttgcttactagaatcatagtttcttgttaagacgctcctgcatctataaaaacagagggacatgtgtattctattaagacgctcctgcatttataaaaacagaggggcctaa

SEQ ID NO: 3168 - DNA, 2891 bp, Zea mays
  misc_feature (1)..(100): optimal_loci_1479_G1, chr1:7707315..7710205, Cluster 19
gtatatacaataccttcttatctcacattatatgggttgttttggctattaaatgggggcaagggcacttgtgtttgaccaattaatggggtatttgtagcccttaatcggctaactagccattactactaacctagataaagttaatgaccgctagaccgtcgaaccaccgccatcggaccaacccacagggtccaatgagacacaacggtaattgttgtactaccgtgatagcactagttgtttggacctcatccttgagcgcatgatccagtgccctctatcggaccaatccaatgcccaccataacttgtatagtcactttttatcacctattagaaccattcactttagtctaacgaggcatctgctcatgtggtccaagaacctttagccaaaaccctagctaaaatagtgcgaccatgtggtccaatgcatgttgttagacccgtgcgatgtgcccctaaaattctcaggtatgatcagatagactgttggaccaacatattagtttgatgagatattgttcacatgtttagatggtcgagcgctcttaggttatctatgtggaggcgttggaccaatctactatggtctgatgacatagaaacacagggtctagtgcctcaaaacccttccctcttgtccaaattcaaaatcatggtattgggttttgatccttacttgttttgggtcatctcataagacacatagagctaatagacagctagtgtgcaccatactgaactcattagaattatttaagttaaactactagttcataccccctttataatatgtcaaaggaaaacaacatattaaactactctaagtgattcttaactctaatcgacacttggaactagcccatccttaatcttgtctttttcctttcaaaaaacttaataaaatccataatatataggagaataggaaccatacttcgcccaaacatgttagtggcaataatcatatgtcgtcataaatcaccagaacacttgatggtctagatgctctctcaaagcttgtataacttgacttcatatacaatttttgttttttgataaacattaaaactagaaaacccccaaatttttaccataatcatagtagtatcatagtaaatttgaggctttagacttattaaagccttttcttggtacttgatcaacaccaaccctacatgactttgttgtagaagtcatttagatgctattaagcataaaagcaaggtttgcttgataactcatgttctcgttcacttaacaaaacaattctagaaagatctaacttaccattccatgttacttttaaattccaaacttcctaatccttctccaataatcaagatagacaaagatttatgttaggcatatagaagagaaccgacccacaccatttatacatacttttgaaaaaggctagcacacaagaaaaaaactgttgcctctatctttaaaaaaattaagccttatttttgacgaattgatcccaataccttgtcactactttgaaagatgtgcgaactaagttgttgtcctattgactaccacttgatatgtattgtttaaatccaaaacccactccataatttgtgactaacaccaaaggtattacatgtcgcatctcttgtgtccctcgatgcatgcaacttacataggggcattccttctctctcagttcctcatcttagtgatagccaccgatcaatggtctcctctccgatttgctctagggcagcgcaacacccttccctaatacgcactggggcaaggagtgggacacaccctcagcgatggtacaagattgggcagcctcaggcatgtcgggcttgccatgcaatggtctatccaatctggctcgagccttataggtagtggtggatctaggattgaactaaaggaggggctgattttatagtgactatcagtagagacaacacaaactagtagagggacacatttttctcccttcttcttcctcgtctcttcttctctaccctctacttctttctccaatagagtatggggctatttttccttcttcctcttctactcttcacctctatagttaatagagtttcatagttctatgggggctgcccctctagcccccttcagatccaccccagcttatagggtcatgcttacgccataggtgcaacctttggacaggtacaacattgtttaatgagtcaattgtgttgttctcatgtgtcaacctgatttatatggtgacatgctttgccatttatatggtgacatgctttgccagatctgagtcatgcctagctatgcgatctatttgactatctatacattaacacacaggtaggatgcagattggaggagaagatcattgtagatcagggtttagaatttcaccgatttatacaaaaaaaacattgattttcatttctatcggtggcctccgttaaatgtacttactagtgatttctattctattttgtttagatttttaaaatttacctaaaattctatgaaaaatgtaatttttagcggattttcttcggtttccgtaattttcatttctattagacccctccagtatctatgtttcaacccgtaggtgaacacaactacagagtcaataggtacatagggtcgagccgacaaatttgaaggccttgtactaaacttcaaaacagattctattttctaaaaaaatattcaaaattatattgtaatagaatacatgagtgcaaaaaaatactagataacacttgtgactcttcataataaatttgtccatagccctttttacgaaattatttgtaataaaatacataaataaatgtctctgctatattaaagcactagtttcgacggttgctccgtgccatatttttacaaataaccccttctattgtt

SEQ ID NO: 3169 - DNA, 2531 bp, Zea mays
  misc_feature (1)..(100): optimal_loci_153296_G1, chr4:135895446..135897976, Cluster 19
gacatggtctttccttatttaagatggagatatttgtccaggtcagctctctctcccacatctaattcttttttccatgtagaaatttgtacttggtcaactaagtcaaaccccaattaatgactttttatttgtaattgtagtcgaattatgactcttgacttaattgactaggactcttgtaaccctcacctatggactatataaagagaactatacaaggaggggagggactctccctaactagcgaacacattatctactgtattatgaattagattgaagttgtatgcacatatgtttgatttgaaaattttgtgggtgaattgatcgttttaacccgcaatatgatgatacattttaattttacaattgtagacacatcaatgtattttattttctatttaatgaattactgaacaaagtatatgtttgtgaagcatctttgagttcccaggcgccggtggaccctgtcctggtggcaagaccagtccaatatttgtttcttcacctagactaaatattagctctctcgacctttttctccaagtaagtcttctgtcgatacacactgaaatttttgcaactagttgaatttgttttttatatttgacattgtgtgaactgtactcccttctgaattaatgccaacacatggaaccttgatgatgttttatgtaataacgcacgattccaaaaacctacttgatttggtttaggctaaccctcatatttgcatgtctattcctgttctttgttgctcatccttttgcaatccatttaccaataattcatttacatgaattatgtagccattgctttatgaattggcaaaatagagctaatccatgaaaacgaagcatgtttgttgcagaattggggtaatgttggtatctaaaaaatgaaaccctatatatttggttcactctaatatctcaatattacaaatcaaacacccctgcttgtttcaacaatatctaccaaaaacatgtgattttttagataacgggacaaggttgaagcttctacgtcaatcgactgcatggtgataaagatgtatgtatatatattattacactaggcaatcgatgctgctatgcatacaacaaaatgtgtgagcacacatgctattctcatttgcaacaaacgactattgtgtgagttgtgtgagcatgatgattcccaaattcgagtaagaagccttcaacggatgactagctagcatagctcatgcaagtcgaccaacggatttgggtctcactacaactttgaagggtttcaactctagttttcaagcattagaaattgttttcttttaagatagagaggtggggaggtcacactccaaaaccccatcttctccatgttattaatataaaatcaaaaggtgattcatcatacctttaataactaatcactagcctcaaccgatgttttcataaagttacactctgaaatgtcttaaaaattgagacatttatttgggtctaaaaactggaacaagggttgatgacattaaaatggcgcattaagaaacctcattatcgacaatatatatttttttatatattttaaaacaaatcaatttttaattttgtatgctgacttcaataaattttatgatttcaatataaatatatattttaattaggcttatgcacttacacaagatcatatgaaattttcatgtggcgctactcatattatgtgttatggattaaaaattgatattactaaagaaattgtcttagatctagtaacttcttatgcaggggcgaagccacattggtttttcttggtacacaagcatcagggtacgccaatattttgctaacatctatattatttttagtatttataatctatatactttcctttatatttgacagagtgtacattaggattgttttagatttactatatacctagccaatgggttgtcaacacggcctgagtccgacatggctcgggccgatttagtcgggtcgaagcacgacatagggtctgtttggatgtgtgagactaaactaaagtaactaaaataactgactaaaatttagtcaccacctatttggaacaagtgactaaagcagtcatcaatggctaaaccaaccactagcaagcaccgattatttgaaaagtgctcgcatttatgactaaaccagccactaacaagcgctgggtgtggggaccagcaataaagtatgtgttttagtcggttttagctccttcttggaagctaaaggagctaaaagttttagtcacttttagtcctttgtgtttcaaagtttagctcctaaactgactaaactttagtcattttgcttgagtcacgtggatccaaataggcccatagatagatagcggtaggggcaaagaattttcctatgacccatgccaaatctactaaattttcttttcttcctttcatctcaaccatcttatactggattatagatacttatacatagttatatggatcaatcccacaaccatgaatcgggtggcccaagtgtaggtccaccctcaga

SEQ ID NO: 3170 - DNA, 1527 bp, Zea mays
  misc_feature (1)..(100): optimal_loci_156281_G1, chr4:153646043..153647569, Cluster 19
tatactctaccttttcctattgtggaaggagaatttacatgcttatatagaatagcaactaaaatacaatggtaatggttatgcaaataatttcaacagaattaagtaacattcataatgcaattacattatatttaattaaatcaaacaacatctgaattcatgtatacacattggtagtgtacttgatggctatatatacgaattattgtctagtataagtaaaaatccctgtatgtgaatgggtgtacaaacgagacattgaatgtaataaatataaaaaacaaatttgatttagtccatatttgatcctatgagttgtttaataactgagaaacaacaggtagctttttataaatgggtagttagatagctgaaccttatttataatctagttgattggattagctaaagacttttagggcttgtttgattgagctaagccttataaaaaaattgttatgaaatataaaaatgttattatatattgtgcgttacgaaaaagttacaagatgttttgttcaaacaagtacaaaacttatattgtattttacataaaacaactgtaaaatgtctctctattttcaatgttttagaaacagaaggcagaaactaaaagcaaggtcaaagttacatttaaaactctactaaccaaatttaactacttctaaaaaagtaacttctgattttcacccatttggttagttttgccttttttggaagacaaaacactcctaaaatcccaaccaaagacattgttagcaactttctgtactagctgtagctaagtcaaacatgatcatagcataaatttacctactaaataactttatggataccccacaactcacacattgctacaaaactttgttagacataaactcattgcatgtatgattaaatttaaatgttttgatttttttataaaaattgggaaaggcaataaagaaatatattaataatataataaacagatcatattaaaatgatgtaatggtaaaacaaatagcaatatatgtatgttttctatattcttatatgttggaagtagtggttgtgtttagtgaaaatgatgtggatatcttgttgacgcgtacccatacacaaggtaccctaaaacaacatagaaggtcactctaagagataagaactttgtgtagcacgagatgatcccaatcatatatcagacatgacctggccaacttgactaggttagccctgaccataatgagctcgaccaaaatttctccgacccgaacctctaggttagtcctcactagagaatctccttacttggacccaccaccaagtcggtcctgacctcaaacacctcaagcaagctctgatctaagtctccctgatcagtaagcatcaacctcggtcagggttgaaccagtcggtacatccatgatgggacaccatgacctagaagtgacataaaaagtgtatttaagacatgctgacctttaagcgtacacccctaacatagggtatacacgacataaaggagtgggtactatacaaagg

SEQ ID NO: 3171 - DNA, 1583 bp, Zea mays
  misc_feature (1)..(100): optimal_loci_157006_G1, chr4:157088738..157090320, Cluster 19
tgggctgaaccaaacaactgtattgatatccattcccttccgtaatctgattacgttataatttactgaaccaaacgccacctaaatatgttcggtatgtaataaaggggatgttgtatggttgctccttatcggagatgtgactttgtttttacctcggtttttttaaagttggcagttatgcatcccgtttaaaaaaacgaacagacagttcatccctatttcattattagtccttagcaatgtaaactcaacccacaaaaaacgttcatactcttgtatcgttgtccctcctttatcgattgtttgcaaattggccccactttgatacgaaagcttagaacatagttgtgacataaatcagactatacattttgaaaataattatttcaactttaatttttaaaatattttaaaaatcaataaaaaaaataaaagatattttttagaaatttaacaaaaaataacaatatttagagccgacgacctctaaatagagagcatgaggacagaatgattttgcaagcaatgtgaggagggcgatgcgatggcatcggagcaagatggtaccggccaaccatagcatgcacgcggtgaccccagcgtcagcgaagcaaggggcggcatggtgcaagaaggggtggcatttgcggattgcatcaagcaatgcgagaataaggtaaacggattttgaaagaaaaaaaaagatagacatgactataacaagcgaagtcatgctggttggtccagaccctccatagtgtaaaagtgtagcctaataaaagtttgatcccaacgataaacatgatcgctctaagactattttcaataatttatacatctttatcttttactttaaattttattttataaataatgcaatctatatagcaaaataacacaaaacactagcgactctcgcactgtcccggaaaaagcagttgcgatacgaccgaagccataataagtcacggagacataagccagcacgtggccttccttttatgcgtgcaatctgttctaatgttggccagtggagtatatgtactacatgacacgttacatgcattatatagttgttatgcattttgatttgggaaacaaataaactgttcgagatcatttaagagtacccccagcaaaacctcagccagattcctcgacacaaaggctaaaagatgaaatccttctatcctagaaatcgaggacatacacaatttcattcctacttgttcgcaaaccaaatgctacctaagttcacactcgacacacccatgcttgctgccgtcgagatcgagttggagatggtttgagaactggagtactggacagtaggatcgtcgtcagagctcagaacgccaaaggagcaagaaaggaccacagggcagccaaccgtgcgcgcacactgcgctgtctgcgcactgtgcaccacggcccgggcaacgtgcggtggcggggcatcaggagcgctcgtgcgtacgagcggataggtgtgcgctcccggcttgccacgtgcgccggcaccggcgcaccgccctctctctctctctgccgtgcggtcccggacagatacggacccagct

SEQ ID NO: 3172 - DNA, 1457 bp, Zea mays
  misc_feature (1)..(100): optimal_loci_159519_G1, chr4:172513963..172515419, Cluster 19
tttaagaatattttcgacgaccctagctaaggcacagaaaacaagtcgtttctagagtaaaaaaatgaccctaatataactgtccacataaaaatcacatattattagtcatttatcattcaacatcgtaccacatacacatgatcatgtcattattcaacatcatttaatattcatcacatattattcaaccaacatattcaaaaggccaagtctatcaatatatgcaatctatttcgtcattcaacatcacatacatattcatgtcatccaacatcatatcacatatgattcattcattatatttatatgaccaagtcttatatccataaagacaacggcaaagcaagtccagcaaaaagcaagtctcacgggattttaggtcattgtagctatgtttgctacctccagaattgaatatgttgttgagcaatctagtagcctcttcatcctgtgtaataaagaacaaagtcaccattagagataaattatgagttatagcattataagtaacaaaatgaatgtagttattgagaagtaacaaactaatctcctctctacatgttgatatcactggtagaagggtttggtagatgtttgccacatttactcctaatccttaatatatataagttgaaatagattaaatagctagggttacgttgagtaagtttagttagaacaagacatgtatagttacattctctaaatttatacaaataaagctaaaatctactaagttgaactgcattgactaaattgatatgaatttaggtaggtttactgaacgtcaactacaggagctcttggaggatagacttctagcaacatcagtggcggtggcgacaactgtcactatggcaaaatatttatatggtcatgtcgctgctgcaatactaactataaatacaacttattagtaataaaatgttaaatggtcgaatgctagctattttgaaatcatacatacactaatcatatttttttgaacgatatagttagcaaaatactcttgatgctacctatattactcttattgcttcatgttatactcgattgggtcatcaatgtcttctacaattctcgatggataatatattgctctgtgcgacaatatcgactactactaccacccaaactttgagagaaatatcttctctaagattggacatatcttgagtcggtcactccagtaaacatggtgtacctttgaaattcaaattatgtaaattttagttgaacataaaaacaaaatttaagaaaatataatttcacggtgcctttccactaccactagcatgcaccaccatcggatcaatcagtcccttccaccaatcaaagttcttgccatggcatataactatcttgtgttcatattgcttctacaactataaaataaatttataacatagagtctgaatgttttacaagtaactctatatagtgaacaaccgacc

SEQ ID NO: 3173 - DNA, 2393 bp, Zea mays
  misc_feature (1)..(100): optimal_loci_160237_G1, chr4:176533261..176535653, Cluster 19
aagtgtttaataacatattttttatcaaaaggaaggcttgaaaatggtggtgcatgaaacactattgaagaccccaacttaaaaggaaggcttcaaaaagcttgaagagctactttactttgttttatatttcaaatttgactttagaacaagacatactatctaggggatactaaaggtttgttgggttgatccaagtcctcgtaatcctctacatatcaaatacatgtaacctacaaaagctcgatgtttttcatccatattgttctctagtatgcatggaaccttcacgtcaaagagcatccatgaattatggactgagcctaaatgctctacctagttgattgatggtgggtgttgtgggaaggtatttgtggcagaactgcccaatttaacctaatcctaattgtacttgctagtcatttaacactaagtacataggagatcaagttaaatctaatagtttgttgagtacattcaaaggtagaacttgaaaatctatgttttcatcaaagtaataaacaacaagtgaataaatcttacaacattcttaaccatttacatatcacaaagttatgatttcatgacagtggaagcgtgatcattttatacaaagagaacaaaatttaaacaaattttaactttaatgtagaggtataagtgtataagtaaaaaactaccgcaatcataacataagaatttccttgttgagcccactaggaggtattcacgcataacaatgcttagctccatcacctaggtactacctataataggggaaacacaactctaattacacaatgtactcaaaaaagacttaaccaactaggtggatgcagtctcccgattcttaaggatgtacacgggcttttggctagttgttttggatacttttttacatataagaattactaatagggcatgcttacattcaaatttttagtagttaggttaggttcatcaactaaccattctaggtaagtacatgcactactttcaagaatgtggtaagcaatcatagcatatttcatcaatagacataagattcaatatcgcctccatgttctaatgttactagaatgatagtgacatgatcgacatgtggcaatcatatccaagcatgatggtgattgcaatagacgtacatccaactaggcaattccaaacacatccccatacattttgaaggagcatgtgcaaggcaaccattccactcatactaccaaggtgtgaaagtgacatggacacccaaagaacccaccataggggccccgtcctggatgagttccatctaggggtgtaatcggatcgaatatagacaaatcttgcttctatcatatttgttttcataattctttttggatttagatcggatacagatattactaagttgtttcgaataatatttaaatggatatcgttatcttaaatatgcaactttgattatatgaatacaaatacaaatcggatacagatcggatactgaatgcccggactcgagtacagatcagatccgagctctcttagatggatagaatttgaatacaggcggataatatttgtaccgttgacatccctagttccaacctaagtttaaccatggacattaccaggctctttaacaactcccaaatagaaacacttcaataaactgtttacgaccctcggtagtacgaaatactaagcattatggtcatcacatatctctacttagtggtttataaataagtgttctcgaactcattttgaactctctaattcgtagcttggacatacataccttgggagatatattgctagaggagagcatactggtgattaattgcaagaccaagaacttgtttagtgctagtagaaagtatgaatttgtttgtgacattgcccggtttaggtcaagtagaagttgaagcttgttactagtggtgattggcatgacctaaatgtgttggcacttgtggcttagtgattttctctttacggtgattgttgaaggcctaggatttctttgtgctcattttgagacatgccaatgacaaaagaagggctaactgtatgtttagctattgctccaacatagaataaggggttatgacaacacctcaacatcaccaccaaggtgggaatatattgtgtcctattccatttattagtttcagctactttgttgtcttcacatctactctcgatagatctctgcccaaaagaaagtcgtctaggattagtttaataatatttgttatatatagaccataaatatcaatattgttttgatgaaatttaaaaagaggactaaaatgacacttttttggacgacacaacattgtggtataagacacgtgtgcggtggagaatgtttttgatgtcgtagatgctacgtatggcagctgagctgt

SEQ ID NO: 3174 - DNA, 2160 bp, Zea mays
  misc_feature (1)..(100): optimal_loci_160492_G1, chr4:178082325..178084484, Cluster 19
gggaaagctcaaggagcgattcaacgcactaaagtaagtgttgttcccattgacgcgttgttactcgacaaatctttgcttcattgactttagaactaagaaggcatacaatataactatccacaatattgtggctcaactttgcttatgtgaccagaatatcaaggatgtagaaatgaccaaaagcactcttgagacgtttcatcccagcaacaaggtactccaacagcagaaacacaacatccaaacctaaacaaggaagctaaggctgttgtaagtagtaggatagggagctacttgtatatcctttcagagtggtgatgtagtgtcgtagatgaaactagaataaccttgttcttcatggccaaaggtgttgatatcaggatatttgtcgtgctcgtgtcattgctctagatcttctttacttctcatatggtatatttctatttgtctttggagataagcaaccggaaacaacttttgtttctagattgccatgtgcctttgaatggcctctagcccctcgatttctgcatcaacatcatcttgctcaaccagtagctcgagagctttcttttttttgcctttgatgactagcttcgatctagttggtgcctcattgtagtcttgttcttcagaattgttagtacattcggttatgacaacaattatttcccttcatggatgcatggttatatttgttaatgagttcatcggaggtggactataaatattgtggacctattggaattctaaaagaacaataacatgattattttgttatatccttctcccttttaaaggtattgaaggggagaagcatagagcaagtttagtgtatttgaatgacttttgtaaaattaactttttagaaataaccatttaattgcatgtgaatggatatgtaagacaatatgaaacaaatgattgttggtggtgagatagtttcatacaggaggcgataatctaacccaataatcaaatagatttggatatcaaataacatattgaacaaacaatctttcatggataagcttcaccattgttgtactttctaaggttctccaaaggcaatggcatgataggcgcagtgttataaatggccgatctttgtagtagtagtactattcatctattttatagggatgaactggtatacacattcatatgcaattctaactttgcccctattattacatagcattttttcattcgagtgagtatatttatgtcattttacaaccctgatgtgatgtacacatcttttctttaccttatagaccttttgctcttttcttctccgcagctttttctgatcaaaccaaagctatgtttccctcttctttagctacgtgcatgctttagcttgttcaatgtccaaagcttccctaaggatgataatatttaactttgaatgacgtacttgatctgataaaatggttgaataatgatttcattggtatggacctttgactagaggccctctccccaacaattactaagaaaacaaagttactatagatgacatctgatcacctatgcattacattatgatgatgcagataagcctcccctaagaatgtgccttgtatatgcagatgtcgttgattcatccaagtggcgcttctcaaatacatataccaaagaaccttcactaacaaattcaatgaaaataccaaaggtagtttcttccttcaacaaacttggaaatagtgattcttttttcaaaaaaaaaacagatatcatctatactccaaaataaaacctgaaacacttcgttcactatgcagtggtattcgtaggtcaaaatttcacacccaggataatagtctgtggtcaaaaattgtatatttatgtgtgcaaaactaaacataaaactaaaaaaatcaagagggggagactgaaatggatatgaagcttatgatgtgcttgttagataattatgtacttgtaagattaaattaatttctaaaacaaccacttcgtaaacaaggaataaaatacgtatggcaaaaaaagcatatccttgtagtagataaaatctatctcatagactcatcagtacttctagaggggattgcttgaacctagtcaaagatgagttcatggtgttgttgaagttcgtagaagtcgcagtgcagatcaactcggcgagaaatt

SEQ ID NO: 3175 - DNA, 1820 bp, Zea mays
  misc_feature (1)..(100): optimal_loci_162732_G1, chr4:190957892..190959711, Cluster 19
ttgaaagttcttttcattctatctagagttgcaattttttagattccaagaattgatttgaaggaactaaatctatatggtgaagaaaaagggacactgatactctaacaagagaactaacttaagtttgataagctaacttctaataccttctagccaacactttggctaagtcaagtaattagtaattagtttattagtctttagttccattgttagagcattagtgtcactttttcttgactgtctagattttgatacctttgaatcaattattggatcctcataaatttcaaactccatatataagatcagtgaaaagaaccttcaagagagcaaggcgcacctcaggcaacattaccactacatcttccaactatctcagcagctaacttagcatcttcctttgttggagatgtgactttttcattagtagttagaattgattcaccatctaaatatgatgtagaaaagtcatcgggtgaatctatcagtgtaatgtcattttgatttgcatgaaatgggcatggatcaatgagaaattttgactcacccaagcctattttttgccctaatccaaacttgaataacttcgattttataacaactaatgatgtagtcatagttaatatataacaccaacatgcacatcaagccacaacactttcaaagcatacaaacatttgattcacatcaattctctaaattagagcgaggaataagagcaaattgaattattatcttaaggcttggaattgcaagtgctctcctcataccaataacacatggcctacttcggaactagatatttcaaaatatataacacttgatattatgtatttgtttcactttgtatagtgtgcacatatcgagttatatagaaataaattttgtgtatttgacaaacaccagtttagtaaaaattgcgaccaaaagaaatgtccatcctatcagtgtaaactacaaagtcatcaatcagaaaattcaagccattttagtggagcacatgttttggctaatggaccacacttaatatggtttgtgttcatataaacccttagtcattaaataagttcgtgaaggatttacagggtgttctttgcatcattagcaacacaactaaattcattaattaagtcaagaagggcaatgcatttgaagttttatttgtctgcaaggctgcaatcatcctgtggtggtcaggttggtacatcattagaaatggtaagtctatgttgatttttcctttttaaaagaaacatgattaccccggttatatatgtatacatatttttttgttaaagaggacaaattatatacaagtaaaaaggatgaaaataagagaaatgcaagaatattgtagaaattcaagctagatgaaataactctcttttgctcgaagcataagcataggagaagttaggatgcatatgcaaaattgatttgcaattgagtttttttccaaacctaaaagagctagactaagtatagcttaatccatatattaatgactatgcatattgataaatataattttactaggaaatatttgtcaaatcgttgataaaatgcaaacatattcttatcttttgtgcatcacgtagaagccctcatctgccatcaagaggaggctcattggttgtgcatggaggagccccatctaaagggaacaccattgttgggtgtagagaaagggtcattgatgccatgtgtaggagaggggatgtcaccacctggtatgggaaagatgatgttgctaccaccgatgtggggaagaaagtcaccgctgccactagttgtaaaggaaaggatgtcgtcgc

SEQ ID NO: 3176 - DNA, 1725 bp, Zea mays
  misc_feature (1)..(100): optimal_loci_165218_G1, chr4:203481631..203483355, Cluster 19
tcttgtgtgtattaacaatcactgagatggcgaatggccaacagattccagttgactgtgtgtcgtgctagatttaggttggatttgatttgtaattttgaaggaaggaaccaatctaaacgcaggggtgcagacagagtgtattggagcagcaacccagcagtagcagggtttagtgatgctggcgaggtgcaaatgctgcagtttcgggcaccagggacacggacggcaggcacacaaacaagcgagagcgaaatcaaccaaacagagcacaggcaattccgtcgagcacacaccgtgcatctactattgactgcggcccacagaagactacagaggagggcctgctagggtccaacaggacccgttgtggctagattgggatcggcgtacggatgctgggcagcggcccgtgctggcccgtgccgcaatctgcaaacacaagcacagcaatgggttgtggccgagttcaggggcgattagacgacgagcgctgctctgaatctcgtagaaccacaagtggtgcaagaacttgatgcactcggaagaacaccaactgcaacagtcacagcctgcgcgagcttcacaagtactcaagtagcctcaatctgaataagagattctaagaccgtttacagcagtctacctaaagtttacctaaaaacactgctttacattgtagagttactgttcgtgtagactgcagtttaaatatgggtacggatatgctaggtatggatatgctagagataacctaatagaaacttaaacaggagatgaacaaaaaagatgcattctagagttccaccaaagagatatccagattgtaatctgcacatgctacattaaccttgttatttaggtgggccgtattgattaatttgtccactgcacactgatatgaggaagggaaatcaaggagaacgaggatctttttgctccgaatgagaggagatatgtataatccagatccgtgagcatcgagtccagaactagcgagaaataatctgaatgcaagcagcagcgatgtaccttgagatccgacaagccatgtgagacgttggcggcgtcgccgcactgactggaacgcaacggagccgcgccgggaatgcgtacacggcaggtggacgcaacgccgtgcctcggaggtgattttgccaggaaggatgccgcacagtggacaagacacgggagggagacgacttgactcacgggtcaatggcatgaacgcgtcgatcgacgagtgaggggtgttgtttgattcctgtatggaaaacaccggtttttaaggaactaatttataaaattgaaatgattctaaacatgttagtttatgacttaatttataaaaattagattctaagtttttaaaaaccaagaagttggactcttctagttaaaagataaaaactagttttcttaaaaactaggttacttaccaacaaggcctaaagtttaattacttttaatatataaaatattaaataaagtaattaaactaggcctttcaaatggaatttttacagaataaagtttagttcctaaaatttaagagggtgatttaaggaaccaaacactccctaaatatttgaatatcaactatgagtaccaaatatatacttaattatatttaataattttttctggtattttagtatttatttgtgtgattagttttataattagattatatataatatctttaatatatttaattataattat

SEQ ID NO: 3177 - DNA, 1966 bp, Zea mays
  misc_feature (1)..(100): optimal_loci_16535_G1, chr1:91780347..91782312, Cluster 19
caagtacattgctacaattttcatttatacttaagtatagaatataaaacataaatatatgtgtgttgtgttggataggtgggtgtgaatgtggacttagagccaataaccatggtttgaatcctcatttatacaaaattttagaatttttacaatttaaatgggccatgacgacggtagaaaccatggaaacaggaaaagtggtgatttaatatagtaaagacttatttttggatacccccacagaaaataaacactatttttagtgtcgaactttagtgagtgtcttgccgccaaaaataatcttgtagccgttaaaaataaattatttttgactaaagacattttgccccctttggtaaggctcctttaatggctccttcaacgacttcttgaaaaaatctaccaaaagggaggctctttgatgggctcttcatagaaaagagggaggagctcttccaaaaaccagtaggagctgataactagaaaaaggagcttctattggcttctctattatacttttctcttcgtcgacgctacatcgtagaagaagctacaagagaagttatatttccaaccaaacagggtgttttttcagagcttttcttgaaaataaggagagatctgttttcttagaggagccggaatcagaggtgaagctggcggaggaatagccctaccaaacgggaccttactttttcacgatcacctatatatatagtgttatttcgagggagtaactaatttactgattctagtatgagcatagtatataatctagatgctactaattatccaactgtctttcctaaagagtgtagcccaattgaacataaacgcatgaaaccaatacaaaatatcaggaataggtaagttttacaaagaacaaaaaatggcaatcaagcaagcagcaagggtgatcgcactggtccgtatataatagtaaatcatacagtatattgtaacgaacttatgtacggtagcatcgctcttatgaaaaagggtctagttgaccaaatgaattttaacttactagttctgatacttcattgccagaatccatgggcatatgatttgttaatcgcgcagaaaaaaattagcatcgctttcaggtttcagctaatccaacactaacggtctgtttgtttcaggttaataacctttcctaagaacattgctgcatgtgcatctttcaatttcttgtatgtactggaatcaagtgtctgttcaatgctatggcaagtctatgcaacaaagtttgcttcagtaccttacatggtccgactaaggtcatatttagaagcaactcagtttttaagaaaccagtttttattttttaagctagaagatgctagcttatggtatttaagaaactatgaatccaatttctataaactgagtcatgaactggtatctttggaaccaactcaattttcataaactagtttcttaaaaactgggtagttccaagcaggccctaagctaatccagataagaagcacatcacaaataaaagctctatacgttcgtgcgtgccacgaattggcatgaatcaggttgcaacaaacatgtatctgacaagtcagcccatagatattaaatttcgttctgacaactgaaccacaatgaaccaaagaacaatttttgaccatcaaataatgaaatgaaaacttgacggagtggtactgcagacacacgttgaaacgaacatgcaattcgagctttgcttccaagtactaagaattctatggcacataaaagcagattgcagtaaaaaagttgtccaaaatgactttatcacaatggctccatgtatacatttttcacaaaactcttttggttcctctctttttttattaagggaagaaagtaataattttggttcttagttatctgcattatgcacatttttggaagtttccaacaatgtggaatgttacttttgtgtaatgcatagttttcagtt

SEQ ID NO: 3178 - DNA, 1455 bp, Zea mays
  misc_feature (1)..(100): optimal_loci_16717_G1, chr1:92806072..92807526, Cluster 19
atcgctcgattaccatgtcctttagtgtctcaacttaacttggtgaaccattgtcttgacttgattaacatggtatactcctctatatgtacacttgcttgtcgatgtctccaaatgttagccacccacaagtgtaacatcccgacatctatttgaccgaaggctaccataacaaacaaaacatgctaacactacaaaattttagagatataaaaagggtttcccatagcatattgaaacacaagtacataaataacaaccatatatgacacaaaagttaaataagaatcaatccatatctaacatgagagaaaatttacctagcctagcaaattaaacttctctaactgataaagtaagtgtgctctttctaatatgcatctaatcaaatcgtctctgcatgatgcagtcatccagtacctaagaaccagaagaacacatgagtgagtaataatacttaaccaacacaacttagaaccagaatagcaaatcaagatatgaatcaatgaataaaaaccaatacaaatatatatgatatgtagtgatgtacgatccattatttcctttgtgtttactagtaaaggcaagtaaatgtgaccaacatttactcataagaacatgaacataagatccaaatttactaggagataaagtgaatgtaaatgaatatcttgaagtttgaattagaaaatgcatagccagatatattgagatagaaattgaataaaaatgaataatttaaaacttgaaagatcaaactagacataaccataaaaacttggaagatcaaaatgaacaatcacttgtaggatcttatgacaagcgatttgtcattgcacttaccttaatcttagtgaaagtttcacgttgcgctctcgccaagagtcgtactagcacctatgaaaaaaccaccatcataaaccatctgataactgattcatacttgaaaactagaataaaacttccacaaacttaaagcctagtgtaatatgttcttctaaaatttgagacagatttctgaagttgcactcttttatacatagctattaaatcccatatccaaggtacatcatggaaaacaatagaaaatttcctccaacttttgtgttgatcaccaagataaattccgtatggatattctctagaatttgggctaactttctacccaaatatgttttcatttttaggacaacagtatcgtttctatgattaccactaaatttctaattagattggaacaaaactagcgtcatttgaaaaatagtacaaaacctacaattttttattcatggaattgccaaaatcgtaattgatccataccatattttgaattataattgctgtttccagaccaacgaacgacgaacgatgaacaatgaaggatttcaccatgtctcattccttctcctccatctcccgctcttgaatcccttggagaggatattccaaggtaga

SEQ ID NO: 3179 - DNA, 1907 bp, Zea mays
  misc_feature (1)..(100): optimal_loci_167667_G1, chr4:216596435..216598341, Cluster 19
aatctcagctctgctccctaaatcagttgccaaacactctcaactccaaccgatttcgctcctaaaagacgtggggtttactctaactctaccaatttggagcagcaaaagatgtactctccacatatggagttgatacaaaattacccacttaccactgattacgcaactcaaactcttcgttttaatttatttccttcgtgcgcagggtccgtcgccgccgcctattctgtcgggatttgctagatgactgttcactcgcagggtctgttcacgtgcataatggtgtgatgcagccagtggcctcaggcgtggcatgaccagcagccctggcattgccttcaacgatttttcactaacagctagggccagcgctgcagcaccatcaatatataaccgaaatatattttcatactgcatatttggtgctaaaggtatcggtattctttctgcaaaaaaagtagtcaaaattaaggatccaagcagacttatccgtaattccacaaatatagtttgttccatgaagacaaataggcacccaaccacacaaggaagcaagcaaccgaccacatttggccaatcaggtcaggttcaagtgccattgcggttacgggaacagcatggcgcgatatgcctgacgcgatacaaaccatcatacgcggatggcaggtaagccacacgccgaccagaaacatacgcaactgcagcccagtgcaaaatgcttgtccttttattttgtttatctttcttatttttcattcttatagaatattttatttatttcttgggttttttaagctggtgccctcggttttctggtgtcctcttaaccgtgtttttttgctcaattattttttttgttattttctaactattttatgtttcttgttgtattttttcttgcttcgtttcttttccttttttactttatagttatttgatggtcttttattcttatcttcttattctttgtactttttatcttcatcccttttattttccgtttgcttgtttattttcatgttgtaattagttaattttatttttgttttccatccatatttagagaaaactataataattacaataataagtaaacaaatagattaaaaaaaagataagaaccgttcctgctgcacaggcttgtgaaatggttgggcgcatgataacaacaagaaatagacgctctcagatttgcgtgcagattactagcactgctgcggttgttgatggggcactcttcagcaagttgttgatcctgacagaaggatgcaagaaggcattagaaaataaaagaaaacgtctcttttaccggttactaacacaccacaccggatgcagatggataaagtctgtgatgaggatggagacgacggcggtgataaaagctaggcgcgggtcactttcctgcccttccctatctgatccctgtccctgtttccgccgttttactcgctctgtcgtacgtcactccgccagcgccaaccagagaggataaggaggaggaggaggcaacgacctcgctcacctactcgagcgtctcccaatccaaatccaaagcggatagatgatggcctgtatccgtccaccgggcaagtggttggttggttgccatcgtcggaaagtgcccgtcgtcgaacggattgaggactgggattaattattccataccggaaaccggaccgcaccgcgcctgtgttttgcaatggacacagtaaaagtgctctatagtgatgcagctctactatcattactaaccatcacaggtttgggagcagtccagtcgtcgaatccatgagcttttacggagcgagaggcttcggggagagagacgcagcagctacgtactgctgctgagctcaaatcaacgttccacattctttatttgttttttcccttccaaattg

SEQ ID NO: 3180 - DNA, 1429 bp, Zea mays
  misc_feature (1)..(100): optimal_loci_168190_G1, chr4:219466726..219468154, Cluster 19
ttttggatgaggggaagtagctacaagcgtttccacaacgtgatgattagggtaactactcgcggaagcaagaaagagctctatagtacgtgggtgatggttatcatgagatcgtgctcaacaaaatgtgtatatgaacatgcaaaacattgttttgcacggtagactatgctatttataggttggagattgaaaagggagtaaggaagcaagtgggattgagagtccttggaggtagcctgagcaaggaaggaaacccaaactgatctgcacatgagcgagaaagcaaaaccctcactgatctaaggggtggggatttaggtaacccaaaaaattaagttcattaaaattcaagtgttaaaaattgctatcaaatatcagcttaaaaacattactcaaaatttcaagcaactgataattcaagttcgggttttacttgatataaccaaattaacaaaatcaatattaaccaaaaacattttaaagaaataaataataaccatttatatcttcttgtcaaacgaacaacaaatcaattaaataatagatttacactgtaaatgaaccacttcatgtttatatattaaaatataaaacgatggtacctgttatcccttaattggtccaatggcggatctagaattttattatacggcatgtcgtctataatcttcatatatatttgattaaactatttaacaagtcaaaacaattttacatagtaaattttaaattttaatgttaagttaaaaacataaaaaaataagtcttaaatttgaaaaaataagttaaaaatattcataaattataatataaatagatgaaaagtcatattgataatttatatggctttttggtaataccaaacgattaagtaaattatacttgcatggattaaattctaagcactcacgtgtgattatacaaacaatcatataatacataccgagttgttaatcagccttgattttttatctatatctcgattatcgaaagcttaagacccaatatatagttgtttgggtgtttcatcgttttcgctagcctactgcctacacatagtagtctagcctccaacgtcatctcgcgagtcaagtccgttgaagaaactaagcgatcgagcgttgtatacggttgtattgtgcatctaacagaccacctcaagattttattagatagatcctaaggcatgagcctgaacaaaacgtaagcacaatctacaagactattaacacaaccttctttttatgttaaatatttttttattttttctatatatactatgtagttacctggggtatgccagggttacccctagatcatactccgtagatccgccagggacttagtccatggtttgggggcaaagtttgggtttggggcaaagtttgtacatgacctaccctctattctcttaatacaaagatag

SEQ ID NO: 3181 - DNA, 1436 bp, Zea mays
  misc_feature (1)..(100): optimal_loci_169233_G1, chr4:224944230..224945665, Cluster 19
tttgttgcatgggtgtgtgttatttgtttaacagaggctgaaagttgaaccaagactttgtggagataatgtattgcccttggttattaataaaaatgttttctttattaaaaaacaggtacttagtctttatacccaaacagtcaatttattttccaactcctgttcaaataaatctatttttcctgcaaaacatagttcaaaaagcctatagtcttcaaccttgtatttttgcccaaagatgtcacaaaagatttgactatccttttggaactttgtggccgaagttcattgatgaaacatcgatcagccgccaaattaatttgatcagcaacacaaacacgactacccagcagattgtggtgctgtgcctgtcatagaggagagtgccgccccagtgataaagttgacaagcaggctggcagcaaaggctatggtccatggacgtgccgaccttgagagagaagatagtaggaggagagggcgccgtccatgaccacgactgtgtgtgggcccgaccaacccaaatgccctgccatgtaggtcaggcaaaacttacaaacggataaagggttagtttttatattttggccaaataaagtgggcctagattaagagcagtttagaagcattagccgctaataatcatctagctaagagatcataactgatattagctagtttagttcaaccaatgaaatagctcattcagcatattctacaatagatctacagagttatgatctcttagctagagtatcagcaacagagttacatactctatgacaggaggactgtaggagacagtacattcagcatataaatttaaagcgtcaattttactaataaaaattggtagacgaatgatctgtcatagtctgggacacgtattgttgcttccgccaccggccacatattccattccaatttccaagttaggctatctacaatagcatacttctctctacaaacagagtgaaatctacagtttaaacaaggatctccttctaattatcgatttagcttgaggtggtgtatcaaaagcaagattttccggtctctcacactagcgattgttttagagcagtcccaacccaaaaatgtgtagaagccgagtccaaaataccacctcagcaaaacacatagatagaaatcacaacactcattccacaatttttttggatgggctctatagcaaattctatcctcttctatggagggcatgcaaaaaggtgtgggaagaaactcgaaagccttccaatacataattagcagatgtcttaatgcattggttcgcatgtcgacctgatttcccaagggagaaaccggatctacaatttttcttctctcccctcattaattttctgccattttgaatttttgttgatttgtcactgtattaaattctatagaaactagataacatagaggattag

SEQ ID NO: 3182 - DNA, 1528 bp, Zea mays
  misc_feature (1)..(100): optimal_loci_170338_G1, chr4:229733706..229735233, Cluster 19
ggttgcttcattgcttgtgtgtcctcttgtccgtccgtccgtagaattacgaagagcaactcgtcgcctttttgttcaacctggaacagtgcgagcacgcaccggtgccgaaaacagggacagccacatgcgggtgttggcctacgtacggatcacgcagcagccatccatgttgcagaattgccaatgcaagaaacgggagccgcccccgatctgatttgtagatggacgtaggccttttgcatttgacgatgtcagtagtgagcgacaaataaaggtgcccttgacggtgtgccttcaggttgtatttaatactgacaattgatatttaaatatttaaactttaactagataggaccagaccagactaagacatggtaattgataacgttaaattatgtttggttaaattcaactactacattaaaaactgatatcgaactatttaaacttattaccgctggtacttaagtgtgaaattgtcgttacttatattctgtgagccaaacaacaccaaagatagatcagcgagagtagcacgtggtccatctaatctatacataccttcagccggctctgctctcggcagcaacgacatctcgccgctttatttctcctagcaattttttctttcttttttttctttcagtgagagttgcgacaaggacaccgcaacatcacacgtggtcctgggtgcacgcgttacgctcacacacttgttttatttgtgacttgcgaggagtttaacaccgtaccgtactccctcccaccccacacacacacacacattcaagtttctttgcgtggtactgtcacaacttgcattggttgatgcatgcgtgccacttctcccgctccttaaattcgtttgggcgcagcgtcgtccagataaggctgagtttggtggacagtgaaacggagagtaatttatgggaaggaatttcttccatattcaattttgaataccgacgaaatttttcctatatggatcatctccatttctatgttcatcaaatccatccttagaagatgtttgtttggattataatctgcttagattgtttaatctaacaaattctaaacttaacactaaattcaaaatttgttcaattatataatctgaatatattataatctcaaataaacagactctattaattattaagtagaacccggcgtgcttttgtttgatggccacgtacgtacgtgggcccaagttttgcaacagatagagagagaagtaaaaaaacactgacatgttgtacgagcactgaaccaaacaacagatatagtggtataaataaagccacatttgcgtatgatatttggatgcaaatctggcaggcccagatgtccaccccacaacaaaaacataatgcaatgccctacagctacggacattgcaggtggcgaacttcaattccaacacacactgacacacacacaaaaactggctggtgtgtggacccagctacatgcatccttctttcggttgaaataaagttgacccaacgtacgccaccgccgt

SEQ ID NO: 3183 - DNA, 1501 bp, Zea mays
  misc_feature (1)..(100): optimal_loci_170759_G1, chr4:231993347..231994847, Cluster 19
catgcggctggatggcgtgggcaataggaacggacggtccagatagatgggaggcagaacgatataaccaggggaggcagactacctttgctgccttaataagtagtagagatatttatattatgtacttcggtatattatataacttgtttgtgtgcttgttgtcaaatcctggtcgggttggtgcaacaatagttggctgtcaggctcaacatattgtttaggagctaatcagcctaagtgataaaatgtcccaatgagttgtatatctgtacatattataagtcagataggttagttaggcagtgtttatctcctatagtctatagactacaaatgtacatttcccattgtcaataatcagaagacagacgcctaccaagcaatgcgtgtttcttatccctttggtgcatcgccaccctttttaagggttttctgaggtaagcgtcatgctgccctgatctggcctctagtagatcacatcaaggttgtacactttatcaccttactcttggtacattttgtattaagcattgttggtaaaatatgatagtatcatgtgtagaatcaatctactatttcatttaaagcttcatgttatagattggttttacatgtgtatcgctcacctgattgctacattacacgacatgcgactggaacatatgcatacagaaactcgagagtctgatatgcatctaacaccttgctatacatgtcttagtcatgtcattattttgggtggacttccttagaggtattgatccgtgttcgcgtgcatgggcatcgactcatggttacagatgttcttaggtcatcgttatactacatactgttgatcggatttgagatgttcttatgaacgactcactgtttatttggccctaagtttggtgtatggtgttggtagtcctgattcctttttggcccatttcttagtcttcgagtttcagtcatgtgcatggcatggatcgctctacgaccaatggtcttctaaatcatattttagacaagtttatttctttttctgttgctttcagtgcaagtttatttagttattttagctcactcagaaaatagaacaattgactaaagggagttgataagtgtgaccaacacaggccaatccacacgatcaagctagaatttgatgttcagtttcttgatgtgcacctatagagcaattcaccgatcaccgaacaacccttcctagcggacaggtcaagctaggttgcacgcctaaaaccctgattgcctctagcactcagaggtagttggagccacattaaagagatatgataataacatcatcatatctctcgactccacatgtgcggtctcttagacgacaacccgtcgatttcccgcaatgacacacacctataatggaaccaatacaatggctcatcatcaacattcccacattagagaagggcactcttggaaccagcgatggccaggatgtatggctagaaaacaagaccgagccgccccgctcgag

SEQ ID NO: 3184 - DNA, 1937 bp, Zea mays
  misc_feature (1)..(100): optimal_loci_171326_G1, chr4:235084551..235086487, Cluster 19
cgctatccttgtcggagttggtttacgttggttaggagtggaccatgtatatctaccaaagagagggattttgacatccaccagccatatacaattggagtccctatgcacaaactctgatgggtttagtccttgtaactgtatagtgaattattcttatccaaaaaaagtactgaaataataggctagataatattgatttttttgttagaacagtactgagctgttgatacagtgcatgctcttttctctgtgcatgttgagacccacccacatccaactgcctgtaccacactaaactagtcaaactcacttgacagtgtttttttcctagagatccggtttctcccggctttgatttaactatgctagtataatgacaaagagattaaggctgttaacaatcagcttgaactcaaacaatgatcaattattgtgacgattcttttgaattcacgcacaaaacaaaattttggcttgtcagcatcattttgcaacagggagatcatagtgagcggacccaataatgtaccaaggccagctgcctgtctaggtgaattaccacaaagatatacacaactacatcctcattacatgtttaattcgtacagtaatgacaacttgttgttataggacatttttgtgatgggaacttgaatgatgatattaatctaaaaaaagatttgatttaattatactagtataccgcacctccatatgtattgacgtggattgaagagtaacttaaactaaattacaccacaatccacttcaatatatatggattcaggtgttttgtgctgttgttgtgcagtattatccagaatcatgtgaacttgagatctgtcaatccactgcacctggaaactctggaatggcgaatgcatgccaatggaggaagactccccagtccacgccacgatcatagaacagacaaacgacctgccaccggtcaccactcaccaccgatgcatgcagctgctggcgttgcgcatctcgtggatggcacaatcaccataaatgacagcgcatcatgcatgaaattaaatacatatagtttatagtatatagcatgcgtctcggaatttcattgtgcagattttaatagcagggtcattttccctaaacctaactgcaatgcaacggtgtgatgatcttgacattgagtgtggccttatcctattggtcccgttgtttgtggaagccttgcacgtcagcatcactatagttaacattggcgtcccggcccactggtcatttcgtttcaaattttttttttctgtatttatatacttgatgaagtcatcttccaaacttccaaacttgttgctatctgttgacgacaaggctaacatccgaaagaaaacacgcaaccttgcatgcatagcaagtgggtgcaagggcacaaatttagagaagtaaatgcatggtttttattaatgtggcaggttctagagcagcactagcaccaagagttaacgaactacttgtgtcattgaaatttttgatgttttaggatttaaaaaaattatccttggaagcttgaaggttcagtttttggacactaagtttggtccatatcagcttgagactgcggctcttgcatgttagtttggtccatatatggagctctattttgagccggatgtaatactaaactagaaaactttttgttctcctccgcaacttaaaaaaacagaactaaatataaaatataaaactaacatgaaattagaccaggagtcgtacttatcaaaataagaactagaaaacaattctggatagaattggaaagaagttgcgtacctcgagaagttgataagttagctcctataagtttgttgggtgtgaaattaattaatatttttggcctgatgcttcttctctgaagaatgctgaagccactatgttccattatctacgaaatcagcaatata

SEQ ID NO: 3185 - DNA, 1412 bp, Zea mays
  misc_feature (1)..(100): optimal_loci_175041_G1, chr5:15558698..15560109, Cluster 19
agccttgagcgtggcatgtgtcatcacaggctcgcagccacaaagcatcccaccaacattggatctcgcaggcgggacaggcagatggctgactgagcaaggaggtcgggcgggcaaggcagcagcatgcatgttgtgtcgctggctgcctagctccccgctgcatggtgcatgtgagcaaaaggttatagtgggcctactggactgggccatatccaaaaaaacacctcagtatgtctgcacacatgtatcggaattgctcgtttattttcccccgtccccggatactccatgacatatctggcgtgtacacgtatctgatatgggatacaaggacctgacatatccatgcaactcaccataccatatccaagatataactaatatgcatggatatcctgctaaaaaataccaaacccaccccagtgccaacttaatctagatttgccacaacaatcgtgcatccagagatattctaataatttgttactagttatatttcatagcaagaaaacctcaagcaaaagtgtttatcagcgctctagtgatgaatcattaaaagtgactttgagaagtagcataattgtagatttaaataaataaaactatttcatgtttggtattgcataattggaaaaaaatgatatgaacccttgattatctcccacctgactatccacagtactataaattacctacatggtatttacttggaagtaaaaggaacaaaacaagtcaggcaaagcactatctaatcaagcattgtgcctcagtgaacaaagactataggttgttcattttggagtagaaggaaaacggaacagatagaagaataatgtcatttattgtcaaatgttccattgatggtaaaactgaatcagtgttgtcttttatacatcgcatcaaaaataagaatttatagtgcaatgaatttacaaaagcacctagttctgctcctgctgctcttaaaacaacgctaattgaacacaatgcaaatctaaaataaaaggttgaattggatgtatctagaataataatcctattagaaagtatacaataagcaaataatacataagaacaatactagctagttacccgtacattgctatggctatggtttctatatatcataaaggtagatcttgcttaaatgagatatttattcaaacatgattatattttgttttaaaattattagtacatgtatatatttacagcatctctcctttatataccacaaacagacatgagttgcagtggaaaaagccaagcgctttataccaagcgagcagggttcaaatcctctacaccccattttttggatattccgtgcaggagggaaaacttgtttgcttgttgcaccctctagaggaggcgacgcacgaagaaactcacgcttaaatatagtaaag

SEQ ID NO: 3186 - DNA, 1477 bp, Zea mays
  misc_feature (1)..(100): optimal_loci_177564_G1, chr5:28695785..28697261, Cluster 19
ttcactggtggacacaagctatcaatgataggacaagatggaagtggattgagaaaaaaaactttggttgttccctttgattgggggatcgtggcataattttaaaggatcgaaaaaccttttaggaaaagagaattggaaagaggatctgctgaaacatattttttttggcatcaaccctcctttattgtttggtatagggaaatgggattgcctttagtcaatctggcagaatttctcttagagcaacttcattagatctcatctctttttatttacttgggctacttagagtattatacaatacaacctctccttttgatcatgatataatcgatgttttgttattgtttcagttagatcaatttatacccttgttgctgcatatagtagcttctgtagagttagatcaatttttaatgttataaaattttgctacttatactttacctttttaaggttatatgataaccaggtaaaacaatcaatgctaggttttaaaaaaattatattcctttcttttatgtgttagtatcttggtttggttgttgaaccgttgtcctccatgacttcatctcagtctagtagaccaacaccaaggtcttcagctacactgtttggtgagaagattagagtttgggactcaaggtatgataaatttatgcttgaaatcctactattgaattatatagtttgaattaattggtggatcctaccactattttcacatgtcgcatccatcaatagttgagactgcaaattcattacaactagacgaacggacaatggctttgatcgatgtcggctaccgcgctgaagatgtgttcaaaaccatagcagcaccagcctaagtgatagggcgtcgtgtgagattattagataaataattttacgacttcttatatttgtttatcttactagattattaaattaccttgctcggggaagctaacgtcgacgtgcttagatatctgcgacaacgtgcagcagcgaccagggcctgattcttgtgaaaaacgtgacatgcactcctatcctgtctttgtatagagaatagaaattctggatagatacatatctacctattcttttattgagatgtatcgttttttctaattcagagaactgtctatatataaagaataggaaatatgggtagatacatatctacctattcctttattaagatgtgtcattttttcctagggttttctttcttgatctagattttctccgtgccgcaatcttaacaaaaataagaaaaaaggtcggctagcaaaattaaccaaaaaacaaaaaaggtccaaatgggcctgggaatcgacgacaagcccaacagagaaccacacaacccattgtactgtccaaataaataggcacaagtagtgtacaaaagcttgaagtggtaagcgaccttgagtttttaatctgacaacacctccttgagcaattgagatggtgctaaacctgtaaaccg

SEQ ID NO: 3187 - DNA, 3398 bp, Zea mays
  misc_feature (1)..(100): optimal_loci_184486_G1, chr5:72676800..72680197, Cluster 19
agagaatgctgaggctataaagctggtggaggcaagtcctctggatgctctagctgcggaggattccagtgggcatgagcaaggtaatgatgccaatttggcggaaactgaccaagttgggaatcagattgaggctgtctatgaggaaaatgaggatgaccaaactggaggtgataatcatgttcaatcaggtcagggtatggatcttattgcgattgctttagaggaaagttctgatgatgaacatgaatttgaaagatctgacagtatcttgcaagaacaagtggaatctgggagcttaattgataaagtgattgaagatagggtagagcagctggaggccagcaggaaggctgagaacacagagaagaagctgaaggtgtcaatgaaaccgttggagtgggcagaggagcttgagaagaggcaggcctcgtctggtcaacattgggaggaaggagcagctgcgcagcccatgcaactagagggaatcggaaagggcccaccagctatcggttacatgcaaattgagatggacaatccagtaacccgtgtcatgtcctcaccgtcatttaggtcagaccatggctctccccaggtgctggctgttcataggagctatatagcaatgggcacatctaaaggtgctgtcatcgtcattccaagcaaatactccattcatcaagctgatgatacagatgcaaaggttagtcattggtgctggagcgaataaggcatgtttggttcacactaattggtattgttgtatatttcgacttaaagatggcatatttgttatgcactgtcttggtgaagttcgaaattgttcttttaaaaaatatttgttgctgtatataactaggagccttaactttcttagtctattgtcttaaggaaaaaacaggaagggaccgagaagtactgttacatttctgattctgctaccgctgtatgttgcatatgtccatcattctttagatgtgttcttgtgatcagaatagcactttctctaagaattaagtcaagctgactctgaatttgatttgctgcaaaaaatatggtgtcagttactgcagaaaaatctgatacaaagataacatttaggtagaatttgcaggagtatctcatattgtaaatttggagtagaatatgcaacaagttctaggaaggtgcttagggaagggaactccattgtttgttgtggccctttaatggactccacaccatacatcagtgtgccattggaacatcacattgttttctttttcattcttgttgctattattttttctttaaaaataactcattgattgaatcgatggctgcacatgtaaatcggaggaacccatatgcaaaatcttgttggacgaacttggagaaactaatacctgttctagtttggtggcttaaaagttctataaattatgtgaatcactttgcggtataaacacttttaaaaaaactttcagatgctgttcttttggaaccaaggcgagaagactcaatcaccagtgactgccatgtgctttaaccagcaaggggaccttctgctagtaggatatggtgatggtcatatgacaatttgggatgtacagaaatctgcagcagcaaaagttatatatggcgagcatacagcaccagtagtgcatgcttgttttatccgccaatctaaagccatcactggggattcaaaaggggtagttctattgcacacattttccattatccccgtaattaatcgtttaactgtcaagggaactcaggtatggagaaacactatttcactctactgtgctcactagtttttgtgttgaacatgtggtctgacaaaaccttgctacaatttggcagcgtctttttgatgggaatactggaattgtgctctcagcctgtcctcttgtaatggatgaatcttttggttttagtaattcatctgcccagggaaatcagacaacttcctccagtggtggtcttggcagcatgatgggtggtgttgttggaggcgtggttggagtagattctggatggaagtttttcaacgaaggctcttctccaatggaggatggtgttgtagtcatgtttattatgcatcaacatgctcttgtggtatgaaccaattacaattttggaaacatgttctgtgattttagtagctagtatatgtgtcatgaatacttataatgagcataatatcatattgttttcatgttaggttagactccgtaccaatattgaccatgttgaccatattgagaccttctctagaccagatggagcacgtgagggctccatcgcgtatgctgcgtggaaatatacatcatatttgaatgaatcgtcatcagtaggtaaagtagcccttctttcatgagcattggcgctttctttaatgtgtatttcaatttttggggactaacatgatgatgctatagatgaagaacgagtgtcatggctagcacttgcatgggaccgtcaagtgcaagttgcaaagtttgttaaatcaaagatatttaaacacaaagagtggaagcttgatagttcagctgttggtgttgcctggttagacgaccaggtatgcaaaagttcctttttttgctattcatttaatattttctctacttggtaacaaattaaattatactctcttttctcttcagatgttagttgtccttaatttgagagggcaactctgtttattctctaaagatggcagtgagcttcgcagaactacctttgttcctgatggccttctttttgatgacaccatattgcaccatgcacatttttttaacaggtttggtaacccagagaggcattttaacagttcagtagcggtaagaggtgctacagtgtatattcttgggccatcttttctcacggtttcccgacttcttccatggaaagagcgaattgaagcactaaagagggctggcgattggatgggtgcactagacatggcaatgaggctttatgatggtcagacacagggtgttgttgatctcccaagaacggttgattctattagagatgccataatgccttacttagtagagttgctgctatcatatataagttatgtttttgaatatatttcaattgcgctgccaaatcatactggaaaagggggagaatcaggtgttctaatagaggcagatcgatccctgcttacacaaagagatgagcagtacgctcgtgtaggaggggttgcagttgagtattgtgtccacattggacggaatgatatccttttcgatacagtcttctctaagtttgctgctgcagaaagtggaggtaggcttattctaactctcagtagaagcagtaacgttatattttggctaagttctgaactttatttttcatgcctttgtgagcactaaacatttagtatgtcctataggtca

SEQ ID NO: 3188 - DNA, 1508 bp, Zea mays
  misc_feature (1)..(100): optimal_loci_196093_G1, chr5:151434153..151435660, Cluster 19
tggatctcagttgtgtattcgagaaaggagtatgtcaaacattggttagcatgtcagtcatcttccttattatatatatgaaaagttgttgcaccctcaattaagacataggagatgagtctgactcggtcccttgagcgagccaaatgagatcaacccaacaagacaagcttctagacaacagtgttgacatcaacttagttgataaaggaagttatatgcttttggtttctattattcataacttgcaaattcagattttgtcatgactgacaaacccatatatgtattagttgtaaaagagtgtgtgtttgttgcccctaagtttattgtgagttcttattcacaaaccactttgagttccgattcacaaatttctgtattgtccataccttatttaaccaatattggaaccttggaaaagtagtcatttcctatatttgtatacttgtagaaattgtagcttaatgtggtgagatttagccaaataaaagtggacttgtcctgtatacttgaaccgttgaaccaattaaacaaagcataaaagaaaagaagaataggtaatctctatcttccaacaaatcagaattcacctattgtccatcttgagacatacttttctaaattacatttcaaaaaactactaaattgtgcagcttggtagcactaagaagtacatggatggatgggaaattctcttgaaagctagtagagattatgatcatgtagcgtctttttaaactttttggtttttgtattttgtctaatccaaaggtgcaacaacgttatgtatctatgaagcattcggtcttctaagggacatagggatagagaatgcagagtatataaaagcaatgcaacatggcatacaaattccattttcgtgtttgattttgggtgcacacatgcattaaacagtttatagaaagctaaatagataacttattatatgagctagctacctctaggcaggttttcaagaaattcaaagatctacttatattaaggccctgtttgggagggttccatttcaaacattatagtttcggttttccagtttcatcattaaacaacttcaacatattcgtaaggtggtgttcaagaatgtttggcttgtacatagacttcaacttctataatacaattaatttatgtgagtttccttaattacccttgatgattaacgagtagagaaatatagatgaatcagtagtcatgtaaccaatgcaatggttttggtgcaactttatgaggaggtatataaacagtgtttttaaacatcttttaaggagcttcaaaaatttcatgaaactgccctctagtttcaaattttttatgctagagctcgtggagctagacatgtttggatataacaagcttaaatagactttaaattcttgaagtgaagctcttccaaacaggatctaaatggatatgaatggacttaaaagataggatcactcaaaggtacatgcatccaacctggctaaggtgtgtgacaagctcca

SEQ ID NO: 3189 - DNA, 1658 bp, Zea mays
  misc_feature (1)..(100): optimal_loci_200335_G1, chr5:175855855..175857512, Cluster 19
ggtaatgttttacattaataaccaaggatatgtgtcctaattataatttaaacgaagacaggttccctgttggaggtttatctctacaaggaatgggaggtggagaagaaacgcttccccccaaatcaaaaaaaggatctttgtgacaaaatttttgttgtggggacagaaatgagaaggtattccccattgccgttactaaaaataacatagtcattatctaattcattatgtataataaaatgaatgcattatcatgagtcacggccacggtaacaaaaaaagtttgtgtagatgcaatacaaagaattatcacttaaattcacggtttattttaaaaaataattaattccaccaatgagataattattaatttcctatgagactacgactaattttaaaggagtagagatttaattggacttagtccgactcgtaacagatgctagttgcaataaatgatgaatctcatttgaaaaattaattacaaatttgttgagtggttttaagacctgtcattatctataaaaaatattcagaacaagatggtagacaacattaacagttgagtcgaacaaaatactttggtcacagacgaaccacaatacccattacattttttagtttacaacaattttggagtcaatatatgtcgagaagcatctactatactcttaagtgttaaactgttaaccatcttcactgctttaggataacacgacgtttaagtgaatagatttctcttacagcctggatatctggaaggtaaccatggcttcagtcatctcctccagtggcagatctaggattggttaaagtcctgagacctaagccaaatttaatgtgacaaaactacaacatataataacagttaaaaatctacaatacaacataacataaagataaataatgtatgaaacaagcaattgcggaataacatctttactctttgccacttgttccaagtgcagaagtagaaataggtatataaggtaatgtaaagtaatttttgagaataaggaataggaacatgaagaacaagattgtttacacttgcaccaggcgggaggagctgcagttctacacttcaccttacacactagaatgagacatactagaagaaataataactatcacgataggcaagctattaattaagtagaacaatgagtcatctactttattcattcgttgtccaagaagaggcttcaagaacttgttctagggtcataatggtggtcttcacgaattcatatgatcattggaaccagttgctgttaatccatggcttgtagcaaatagcaaaaccaatagaattagctaccttgagggaagaagcgccacaaaaaatatagtccaagtattgccttacagtattcagatgattttaccagacccaaatatgagaaaagaacttccaaatgacactcccattgcacttgcaagtcacaaccttcaatgcatggattttgatactataatctgcacattagtagatgaaccaaagtatgtgttttttctgtgctcgatttaccagttcagttgcctccagtagcatcttcctgagctaggacataacatagttcacagattcttcatcagatggcttctcaatcttgtatgcgaatgtcatattcaataccagaattcatgcatcc

SEQ ID NO: 3190 - DNA, 1907 bp, Zea mays
  misc_feature (1)..(100): optimal_loci_200931_G1, chr5:178742474..178744380, Cluster 19
aagagacaatgacaagagtatggtcgacaacactaagtctatatgaccgatgaaatgacgagtacttttctaactatatagcttagcagtagacgatctttcatgtaagttcgactattcttctattactatttttagcgtttaatataggtaatggtgtttcatctattccattcatagaaaatgttataaaagacggggataaataattaaacatcactttccccacgttccatatgtcacaaccaccagcaccgcgacaacgggatacttcgtcgattcttggacctgatgtaatgacatgtttagccaatttagattaattctactaagaaatatccaaccgagctttttttctaaacatagttaatttagaaaaattagccaacatagctcaatttttagaaaaaaatagttaatttggtttaattatagcaaaacttagtcattgtagcataatttagtcaatctaactcaaattcttgcaaaaagtagttaattcagctaagctctatgtacatgtattcattgtaactcaattcttactaattgtaaaaaaaattagactccataattagcagccccctagaggcgccgatattgagggctctaactcatttgttattgttaacaagcttttcaacaacacttgagatagcggtgagaactctaatgatcatcgaacgaattaagttgagactcatttgatagacttatttgatgtatcaacattggtacttgctatgttatttggaacaaattagtattaattaaattatgctacttaaagatttctaatgaattcatagatatggtatcgatgatttataatttgtatgatgtggatatatatgtgtgtgttatggatggatataaatggttaatttgcatttccttttagctagggctcgccgacgaaaattagcttagctatctttttgtcgattaaccatagccaataaaacttaactagactattttttatcagttagccatagacgacggatattaatccggttaatttttcatcggctacgatgagccgatagaaatttattatcaggatgaggcaacgaaaattatctaattttcctagcaagaattaaagattgacgaaaactatctaatttctatgggtgacacaagttttgtagaccttgaccatgatactgctgtcgctgttaccctcaggaggatcgacatggacgagcccgtcttacacggaacgcaatgtgatcaagctacagcttgctttaactatgtcagccagccgcaatattggaataaactcgacatcgaatcacgcaattttcttctaaacaaacggggagcttgacctcaagtcaacgatgtgcgagcctgggacccaaacgattaaatacgttcttgctgctctgtcaaaaacgagtgaacatcacttttaagctgctatagcctgggacccaaacgatgcactgcagcgcacatcggaacggaaggattgttaggccggagcctggtcatggataacgacgactgaccatcggacaccgattcacacggcataaacatggaagaaggctgcttcattcccaacatgattttaacacttgacgctcctaaactaacactactgctgggacgccgttttctctggcacagaactgtttcgacgccattttttctttttctttttttttaaaaatatggctgctgtttcctagagcacaaaattgtttttgagtttttcctttacaaccatatctacagcatttttagggttatttttttatctactttattatagactgcacagactgcacgtaggaatgaattattttcagtcaaatgtaacatatgtgtgcataatttatatgtagtataataaattgataataaggcaaacaaactcaatttgatagaacatc

SEQ ID NO: 3191 - DNA, 1478 bp, Zea mays
  misc_feature (1)..(100): optimal_loci_201200_G1, chr5:180587878..180589355, Cluster 19
atccttttattcatcttcggcatcgaccagcaggcactgttatcgtcttcttttttaacgcgagaagggacacccgtggccgagagacactgttaccttccacttctacatgcagcgatatcatcgtccgcattcccttcactggctattatgttgtcgtcttccttcttaccttactgagtggataatcctgctttggatgctacaaacaccgaaggaatttttgtttcatttgagaccgtagtttcgaataattatgaacaccatttcacgatgtttcatacttagcctttttgacaaatagatgtttacttacagtttaatagtacactatgtgctgcaaaaactactcactgacacaatacgttgcatacatataaaattttttgttccaggtatcattatccgattaagaactatgttaattatatgggaactcatatattctttatttctctttatgtcgatgatttccacggagttgtgcctgttcatttgacaatttctattgtgactgttttgctcctctttaggtgagtcacaaacactattttattttattgatcacaccctttaactgcatgttccttttccagctgattattttgtagaggttgacaacatacgtgtgctcataagatttagctagaaattactcaaggcagtagtgtcacgaagcgtagctctttgatctatattttcaaggtcgccagttgatcattcttggacaaatgtccttgattttattcctcataataaagattgttgatggcactaaactcttgggggctctgacttatgttattgtcttagaaaagttggttgtatgctcaccaagaggctttttacttttgcaaagtacatgcaatagttgttagtggctttaaaactgacccacaagatctctttactctcgacctgttcttttttttaaatgtgtacttacagttcaattgttaataatatattaagaattcaatcaaacatatgggtactcagtcaattgttatttgtctttacaccgaggctttccatggagccgtgcttctagatttctcaatttctaacaacagtgttctactcatctctacgtaggttccaaacactaactcctccattgacaccatttgagcttatgtaatatatttatgtggaccattagtattaaattgacaatgttgattcatatcatatgctcggtacgaggcttctcagttttgcaaagtacatgcagttatttgatagtgtttacaaaactgccctacaaaatctctttactatgaacctgttcagttataattcttagaagtatgcatgtgcgtttcaattgttaatagcagattaatagtacacttaagtatataggtactcattgacgatttccatggagctgtgctcctagatttcacaattgttgacagaaatattctccttatatctagatatgttccaaatactctctcttttattgacaccat

SEQ ID NO: 3192 - DNA, 1426 bp, Zea mays
  misc_feature (1)..(100): optimal_loci_202267_G1, chr5:186975749..186977174, Cluster 19
atgccagattaaaggacgtttgattcgagaacaagttcttgtcaaggatgttatttttttaatgatgcatgttttattaattttcaatctgtaataccgtatgtaggaaactacaaaaggctggaacattttttttgtttccattatcaaaaaaaaatctaggtctgttctgattaagtgtgaaaacgttgcatgcatgatggaaaaatgcacgctttatactatataaataaattaacattggaggactgctgcccaaagtatttgtgcatttgcacttgcactgcatgtaggtcaaaacaaactgatcagtgacactctcggactcctggttctggtgtaataaaactgacaactcttttcgtctcaacaatctatcattgattaataagcaaaattaagtataggggcggcagaccggcagtttgtttgtcgtccagacaaactttctagcaccagcttttcattactctgatgtagtactactccagccatgtatatatagggaacggtgcgagatctataataatgcatgggttgtttctatctctagggttcggcgcaacaatccaatcatggtgtccctgtcacgctaagattttatctttttttccagatcgagcgagatttcaaaggtttcacacgcataggatcacgcgcatattctactcgttcgattcgatcgatctggtcatgtcagctgaccaactttatttcctcagcagctgctgctagcctgctactgctgcccccgcgttattaataattttcgttaaacaaaacatgagctagaaggagccggaagcatcggtctcatttgccaggatagagcaaagcatgccatgttacattgtccaaggaggggaaaaggtattatatatacgttctgcactcatttattgaggcatgcctcgatttatatttacattgatatcataaattcttaatctgaggctctagacgactcggccatcgtgacaccaaaattcgacatttttttatgctgagttcgtggtcgtcgtgtttgattaatttgatgcgcgctcttcctctttgctctcttttaatggctttttgtcttctttacatgacactacctctaagggcttgttgccttgtttggtttgagggattggagaggtttcctcctcaacccccctaaccaaacaaattttgcaactcctttttttttctcaaacctgcgcatgatacaattaaagcagaaacatgataaataatttcaaccgaagaattgatcataatttcaccaaagcacgtcttatttcttgctttccacatggcccaacaaatagcggataccccaataatatatacccctttaacttttgtcatatttttagcaagccacgtccaacattgatccaagttaccaggaatgtaaccagtgtttatacattttttgcca

SEQ ID NO: 3193 - DNA, 2442 bp, Zea mays
  misc_feature (1)..(100): optimal_loci_202653_G1, chr5:189050964..189053405, Cluster 19
tttcaaatttgatattgaaatttctgtacatttaaaaaggatgtgaaatcccacctagtttcgacaaacatgtaatttatttacctaaagcatttttttcatattttagttttattatatataaatagtgatataccatgctgaagaacatatcaatatgagaattatcatggaagactaagtggctaactgcaggagaccaaatattatgtttttaacattgattttatatgtagtaaaataactgaaaagataagaaaacggtgctgataattgacttaaatgaagcccaatttgaattcatgcggacttacttgttatctagcagaatgcagtctgatttccataattcttgcagcatacatcttttagaatttgtctcaatcaccgcatctgaataagtggttgaatggtatgttccaaactcaacagatgttatcttcattgcagtaagcttttggcccaatggcaaccagaaagctctatcagacactataaggatcttttggtcgatttgggtattagatctaaggattgtctcgatgacagataatgacggatgagactcctgtaattgcttctcagctttcagtcgagcttcaccaatgcagcgttgaagatgtcttaacctctcaggaataatttcaaaggttccagtcaaattgcctacatacagataggcggcatgcagaccaaagaaacataggtaatatgcaacctgttttaatgcatacagtacaataagctccatcttatcttcatatttacagcagctatacaggccttctgaaccttcccctgttatcagttcaagaagcttttgctttgaaatgcttaaaccttgcccatcggagaaagaatgccttaagtatgcactttcttgcaaagcagatgtataacttacatggatgtcattgataaggccttggataatatctgagaggttgacaggatgaatttctatgagtttgttaactttaggtctggttgaaattgaagctgcttgttttgaagaggggatgtctaaggtagaaatatcctcagcttttctcactttattagtgccatttctcacattcaagtagaagcttagcccattggactgtgacgttgactcaaacaaggatgattccttttctgaactcaatttatccatgtgggtatgacctctaacaacattttctagcatgttcttttgagttgcttccaaattagctgatggatcatgagatataggcccaggaacataaacctcattctgcttgtcctcatgttgaggctttgcacttctcggaaaatcctccagaaaaccaatgtcaagcgctggcatctgctggccacttatttgtagttcagaatttaaactgcaaggctttacctcctcaaccatgctctcataagtagagcaactctcccggttgcatggcccttctgataaaagatgccaatccaaataaatcccatctgctgcagatagaggaagtggttttagggagcaaagtacttcttctatagggggaagcatagatcgcattgctttatcatcatgtaaaataggtgtaggtagtgatttgaatgtatcatcaactagagccaattcagagctaaccactgattcatagaaatgttttgcttgatcaaagtcgtctttgaatatttcctcagatgtattcatctcagctttctctgactgaataagaacaagtgacttaaaggcatccttggaaggaaagtcgatgatctttacttcctcaaagagaatgaagcaaggaaaatgtgaacaggtcccatcaggtttgagagggtataatgctgactttttatccagtaaaataccatcattgatccttacaaaatccattactgctacatcatttgctgtaattggtttatctgcttgatactccacaagtggggcatctttgcaaaccaaggcaaaaatgtcaatatcacatggtctcaagaactcatttgagccaaatgatggaagacagacttgtgctccatcaaataagtgttcaataatactatgaaaaaaattggatatcattgtttttgctgggcactcatcaagctcccaagaattcatactaacctccaactggggtattatttgaccattctctagtcctatgatttccatgcagtagctatctttagcataaggacagttatcatcatcatcatgttttacagggacttctacttgataaattgactccgcaaattcagctgcatatggtattcttgtctcagtatcaatatcaatgaaatcctgaaataaagcagaaggatgttcgaggacatgagcacaccgagaaacaataagaatgtgatgctttcatttcatacttgataaatcacaagggaatcaaacaaatgagcatgttaatcataaggtgtttgctcctgaaaccatgggacaagaaaacactatgttat

SEQ ID NO: 3194 - DNA, 1792 bp, Zea mays
  misc_feature (1)..(100): optimal_loci_203702_G1, chr5:194821624..194823415, Cluster 19
cagatagttagtattgtcgatgctactgcgctcaattactggacaacaacacctttcttgagagggagaatggcgtgacgggtatgagagactatattgaggacacactccacatgttcgatcacaaacaatattcacaactttaagttaaatgaacctttaggaagtttgtattaaatttcaaataggaatttagatgttacaattatgtaatgtgtgcttctaaatagttatgtggtgtgcttctaaataatcatatgtgttctccttcctatttgtggtgcttttattttagtatttgcaattgtcaatcaccggtgcggacgtaagaatacacctgttagtatcggttggtgtctttaaccgatattgataaacattggtatcgattggagacacgaacctaggctaatggcctctatataggcacgatagttaaaattggtactgatgcttgtatcaatatttgttgtaaagtaaccggtgctgatttcatcttatggtggaagcatctttctccaatagtacttgtaaacaagtccttatgtgttccacatgtttgatgtacatcgttaaatgatcaaaaaaaatataaaatataagagcatggaatcattttattaatcatgtaatttctagaactttgaccaatatgagattttcttttaacattgttgtccattctactgtatagatagaatttgttaatcatgtaatttctagacctttgacgaatatgaggttttcctttaacattgttgtattgtatagatagaatatattatacatataacaggccatccgtccactcaggccatgctaccatctacgtgaaaatggtaaagtgagtgagagaataatttgatggcaactttctggtgcggccagtcagttgaacttttcttgtgaatgaccaactagctaaaaaaacaatagggcagtattcgtctcatgtactactataccttggcatgagacatgggcggacgtattgccgtatatgtcacggtataccctgtgatatcttgtcgtacgtagtaggagagcacatcggctgccgcttgtacaagtgagatttacttgctgcctggttcatcatggagtgtagtcacagacgtctcgatatagaaggaagtcaggggctcaggaacacagcgcaggacgaaccaacaagtgtttcctagtgtttctcaaaagaagccttttctggtgtttcttccacagattagctagatcaatagatcaacttctcagatcatgtgaatgtgaattttgtatttgtagttcatgcctttttacaatttaatatttgaattaaaaagactcatcatattttttattgcttattcatcgaattgggttatgtatgtattgtatagttttttttactgagtttaaaaatggattttaaatttttatataggcgtgccctttgataaaatccgagtcaggactcaggagagaccgagagagatcagagctgagcaaggagcataacactgtgatgatagaggaggggcacccttttggtttagaaaaatagtgggttgcagtagtagtatcaaaccccttgcggatggcttaacatatgataatagtaccatgtggacagctgactgcaggtgcaaaagcatggtgtttattgtcatacatacattttccttctcactttctccacacgacggcctcgatcggcctcggcctcggcctctccctgctcctcgtagtgcttttcatggctggaagattcttggtctggtgacgatgatggcggagagctacaagagcccta

SEQ ID NO: 3195 - DNA, 1806 bp, Zea mays
  misc_feature (1)..(100): optimal_loci_204991_G1, chr5:202193307..202195112, Cluster 19
gtctgcaagtccacacggaaacacacaatacagaagaatcacacaacctatacaagacttaaaaaactagatgacccaagactgtgcacatttgctaatgaattagtccagtttggtgattactgattagcatggttgcttaaagccttataaaattagaaccagctcattctttccttagcatcaatgtgtcatgtcatttcaaacttaaaagtcaaatgttatccactgcaagccttccaatttttaaatcaacaatcttggaattcaaatataatttatactgttacagcataacatgggaatgtattaatgctaatttataaacagcctacatgttatacaaagtaaaaaaatgcactgctaatgaaaactctgcacatttgctaatgaattagtctagtctgattagcatgattgcttctgcaaagccttataaaattagaaccagctcattctttccttagtatcaatgtgtcatgtcattgcaaacttgaaagttagactcaaatgttatgcactgcaagccttccaatttttcaatcaacaatcttgaaattcaaatataatttatactgttacagcataacataggaatgtattaatgctcatttataaacagcttacacgttctaatggaaggaagaaggcagaggcactggaagatttgcttccagcattcagggcaacagcccttccttgacaatcaacaacaggagaaccacttgagccacctttagtaccagatgcagcctaaagaaacaaataatcttattactgtacaagcactagcaaaaaaaaacaactgtatattccattaagtcaaaatagacgaccaaacacattatcagcatatcagtatgaactagataatgatacatgtaacatcaagtagctaaaggaagttacctgcatatagaacgtattgaaatcattatatccatccctggcaagaaattaaaaagaaaaagaaaatatgaacagcaatatagataatgtaatgtgtcattaagcttcaaacagctagcctacagcatccagttcgacaattcaataacaactgtaaaataacaagagtaagattacatatttgaatttttttctcaatcatttcataaagaaaatagaaatgaactacaactagagtgtaatttgtataaacaatcacaactacagataggagagctaatttttgtgtatgttgtttcctttttgtatgtatggtgtgtaaatggatgtcctgattattagttaacagaaggagcaggccatgtaaagataggaaaggtgtacttcttgtagtatggtgcttctctatcaagtcgagcaagtgttcctgccaaaattgaaacctgcatccagtaaacaccagtaagaaaacattgaaatacatagcacaatttatcagaaaaacattgcaaagaatgaactacatccaggccataaaacatacatccatgcaaaacttctgtggtgctattagaagcgcacatccaaccagcatgttacattaaaacgtgtcagagttataatttaaaccaatttgttccaagtcatttcttaagtttgccatgacaaatatttaatttgctaagttgtcagtgcaggcagattttacttttgcaggcaaagttatcaaattagcatcttctgggccaaccaatgttaacaactaaagtctaaggccccgtttggtttgggctaactaaagtttagtgattaaagtttagtcacttttagtcactaaagaagcaaacttattgactaaagtggggtgactaaactttagttctttagtacgaatca

SEQ ID NO: 3196 - DNA, 2237 bp, Zea mays
  misc_feature (1)..(100): optimal_loci_205867_G1, chr5:207123257..207125493, Cluster 19
gaggtttataagaaaactacaaaagaataacaaatcacgcttacatgacaaagaatggttgattatgagcagactagtaaagaaaccatcaaagcttttgcttgaaagagatcccatcacgataagggcgtcgttaggttaggtagggcgacaagcctaaagtggtattgttggtcatcatatcaagtgatgaacaacatgtttaggaaaataatcttttgactggaacacaccgatcgatatgttctctatgttttcaatctagatactttcaaagttgtttatggttatttttttaatgtttaactagatagtggtcaaaagaccggagggagtgccattttaaccgtgcatcgtagagacaacgggccgagggatcaaatttattgctcaaggaattgaagcggtcttcttgctgcgaaattttaattaatgtacaactgcacgaaccaatcgcacacatgcaatgaattgtgccatgcatgcagcgctaattttacaggtagtcagtgttttggaaccatgcatgcataaagcgcctgagcgccacatattttgcttggggttaggcggtcggccgtcggcacacgcagatgtatcataaatttctgcatgcgcacgttattcagttcgtaacaccgtaagtgctggtttggtaacaaggaattgagagagattgagaaggaaatgaacaaattcctcctccctttaatccccctcaattctcttgtcaacaaatcagccctaagagcatccccaatagcttgctatttcactatatctagagtcattatctttcctacatggattgaaaatatggagaaaacgagaatagataacgaagatcaaatagatagaagatttcaagtattccaaaaaactgtgtatattacgtgtggtactaaatactagttgtgagatagattacaatttttatttttctctaagctccacatcagctagctatttgacacaaccattgtggacgccctaaaagtttgtttgagagccattgcaatattaaggtggcaattggcatgtcgatctcactgccaaatgtgaccataataatatcacatagtgctaaccatcaagcgctaatgtttggataaagagtgaaatatacggaactctagcataaaccttttctggtggacgtctctagcttaggtaccaaaacacattttgatcaaagaaaaaaacaatgtgattgctccggttaggaaatgtacaattgacatttcaccttcatcgattggtatatgtataatttggctccatgcaagaatgtcacgttcagactggcagcatgttatattactactttattgggctacatgggcttggaatttggatccacaaatatatataatagtttttttatgtttatgggatcaatcagcgactcctttcatttgtcgcttttacaacggttaggagtgcgcaaccatatattagcttataggagtatctctgacctctctttgttcattttaagaaacatcaaggatcgagtctgaagtcttagcttggtgggtaaaattcatgcagtggcgtttcttaccgtaccaccatctaggcggatggccagacggcccagtacgtttaatttacggatgaaaatcagggaggaagtgacgcaagaacgaatctaactgataatcgcgaacaaagcagtacgtacgtagaactcccaaagcttgacacggactggagtacatttaatacagaattagagggccggatagaagtttagctaatattttgaaattagcgacaggaaactttctctctctcttttgagccgcgcatgaatgggcgggattattcaaacgcagagtgcaaaccaatttcaagttcgtttaaacgaccgtccaaagtccgactgatggtgagttttcagactgatctgagcacacctgtcgggttgtccatggcgcccaccacatcaggatcatatcacgtccacaagatatcctaccagacacgtggggcctctgaattgatagcaggcgccaacgcatggcgttgttagctgaaaaaaactagcatatacatgtgtagcatctctcttcgttggaggtttcatgttcatccgtgggcatgcatgcttgatgagtacactaaaaatactccacgcgctgtcgatgtgtgcatagcgctgcgcgctgctgtgatacgcttgcttctataccgtatgcgcatatgctgtgaggtattcacgtgacaccacagta

SEQ ID NO: 3197 - DNA, 1788 bp, Zea mays
  misc_feature (1)..(100): optimal_loci_206113_G1, chr5:208355719..208357506, Cluster 19
atatacttatggacgacgtttcccatgtcaattgtcaagttcagtataccaacgaacatgcatgcacgcgtccatatacagttctttgtctatatacatctgaataaccgttatgagtatatccatacatgtgttttctacttgatgctttccggaaatatatcatgcatgtttaattagacaaactaagccgtcattagccattcatcttaataattctgaccagacctgtgttgcagtctcgcggctcagatcagccgttttatttatgtatcaaagcttatatactatacataaggcgtgcaacctattactctcagctttaataaactactattttgtatatatgtacatatttatttattaatttgagtagtatatctatatatttgctttaggatattcttatccccaatacataatttgtttaaagaagactatagttttaatacattaatataatatattatcatagcagtatataaaataagtataaccatgtgctctatgtatatagacttttatactcgacatatatcccggatggtttagtatgatcacatactttatatacatatacttcgtcgggtcgtcgtatatacatcctaaattttaatatatacacctataggagtagtaactaatggtataggtagggtcacttgtattctcatgtagacaacttggtcaaatacaaaaatgaaatgtatctggccgtatctaccattagttaaaaggctacgtactaaaataatcttcttattactagagcggcatgccatgcatgaaggatgggcaggagaagacaagcacctactctgaataattttctttctgcacgtagaaaaaaaactaccgttagcattgatgtagcggagttaaaaaagaagtactggtcatcagggctaacaaattaaaatgatagcagccatgcatagatgtgtgcctctaggttcagatagcagctaaagattcttaggtcccggcatgagtcatccaaaggtacaacacataaaagacggcctcaaattctcaccaacccgtgcttccataggccacatctttttaatccgtgatctgctgagatattcgctgacgctggattgactggtaatagatgaattcaaccatgttgtgcttaagaaagaaggaaaagtttagcagacagttctcgtagtgtccattcatatctgtcgatgtcgtagggccttgctgtatggctggcagctaggatctaaggtcggagcagttagggccctgattgcgagagacgacggtgaattacatgaatgcagactgagaaattatccgtccaacggatcagatcatggcattgccgaaaattcaaaaatgaagtttcagagtttgagttcaaaattcagtcattgttggaatttggcatatatagcccacttgttggtggcccaactcaaataagaaagtcaagttgctatgaagaagaggggctttagtccatattatttatccagataggagataaccaatttataagtaaggatgtatatttctcttcatatgtgacacacaaatgactatagaagctgctatgaactgaccaaacgtgttcgctcgtgtttcgtgttttttcgcgaaattaacttctgacgagcttggtcgtgtcatgaccgttttaaacaacaattttttttgcctttagtttatttggttatcgaatatcacacctaagagtctaagattgtcacatcaattgggagtaatgagtgcgcacgtgcgagatctccgagcgattgtatgtagagacgttct

SEQ ID NO: 3198 - DNA, 1571 bp, Zea mays
  misc_feature (1)..(100): optimal_loci_206934_G1, chr5:212364931..212366501, Cluster 19
tagattgttgatttgcaatcaccgtgatatggttgttgtaacttccttctgtaagccaccgcaggagggctgttctccttgcctatattaacacggaaccgagggcctgtattggtatcctcgttaatctacttttacagtgcacacctactcttctgtgactgggttgtggaatgacaggtcaagtgaatggatgcgatgggaacagggtggtggatgggggaaatggggaggctatgcagagataataaaacctccatatggcagggcctttgtcaatggcatgctacattttcttgtcttcctatttcggacagaggaatatgtaatagttgcagtggatggccaagggaacacatgccgagtcctcccatggccatatgattttttccctgcagttggttttattggtcaatcacagggacgccttcattgtatcactcgattggttgaatgtaatcgtttcagcgaccctggtctgtcgatctgggttcttgaggactacgatacagaagagtgggttctaaagcatagcctgagcctctttgccagctggtcgaagcaacaaatcttaaatacaattcttactattctattgttgtcattcatacagatcggaatttgatcttttttgttcatcgcttataccagaaactgatatcatacgacatggatagcaggcaagtgcaagttctgtgctccttagggcacgattgtccttatgttacccagtatgtccccttcttcaaatcgttatgaagcactgaagttgttagcatgtggggggtactctttggatgttcagcaagtgttatatctcctgagtcctaagcttgaagacgctggcaacctcgatagatctactacaatcgggtcactcctgttttttttttttttttggttgcacggattggatgtctttgtccttatggtgttttgtccgttacagttggccaaattatgcatccgttgtaagccagctttatgtatgctactaatgaaatcagttaccgaatttacatgatgtgcatctatctttttgtttctgttttgaagataatctgtgcatctttcatgtgttctgtgtactaaatgctacctttcaggtttcgtatttagatataataattctatagactcgaaggatctttcttttgtttcagtacaactccaggcgagtgatcaactgcttgaaacttcatttttttatatagatatttgttgtgtttatttgtattgaattgataaaatgttcatcagtatgttgcaacgacgcaggaatctgaagggattaattattatttttttcaatttttgaaagatcggaatctgctgtcgtgcattcgtagtgtatgaagtgctaatacaaagtgcccttgtcattattacggtgatcttgtgataataaactttataaatcttcaagtggtcgagatgctttaagtaaccactagaaaacgcgacattgctttgtcgctcccttcttggcgtataccagcctatcgtttgtaacttaccttgtataagtgtattagtactttgatgagcatcttctgatgaagaagaaaaac

SEQ ID NO: 3199 - DNA, 2374 bp, Zea mays
  misc_feature (1)..(100): optimal_loci_207807_G1, chr5:216844733..216847106, Cluster 19
tgtaacaccccctgacctacagacttgtaaggaaatgttgttattttacttattgtgcttaaataagcagaatggaacgtctgctaatgatttttcttatgttgttcagtgtcatttagtgctctttgttcagtgtcatttagtgctctttgtgtttatgtgatttctctctgtatatttctttctatatatcattgcagaagctatctggtagctaaatcgatctatatatcgatgcattatttgaataaggttgttgtatgcatcatagggctgacatctggtaatctttttacccctccgtgcttaattaaaatgaaagacgtacagaatatccaacgtgagcattctcctaaaagttgtgtccttcgtttctgagacatgatctttggtgttgggcacgtgaattggtagcttgtgcttccgggtgctaactttacaccgcatattattaatgttgctgctggtgaggtaagtatgatttatgtcctctacttgataaaagcattctactcaatactttcatgcattgcatacttttgcttcttgattgatgtcctttgctcttgaattagcattctttagaatccagtaatatttcttgttacaagacgtttcattttaatttcatcagtattcttaccaacttttatcttatttgctaggatgtcagtatgaaggtcatatctttctctcagcaagatccaagggcaatttgcattctatctgccaatgggattgcaaatgttacgctgcgtcaagaagactcatcaggtggtacatttacttatcctggatgttcattttcctcttgcacttctacagtgtttgttaaatagcattacagtaccatgaaagagcagtgacatattcatgcacttgccattatactatccttttcctgaactaactatataatcacttgataaagggacaaatactatgtcataattgttagttaagtatgttatcagctatcttttcttggacactgtacaatacttggatctgataacaaaaatttgtacctcttatataagtttctatttagtttttttctgccaatctcttcaagctaactcatgtacgtgtatgaatcactttctcacattgtcaaattgtcttactatgtctattgtttcattgcggtttaccttaatctttttatatttgtttgttcatttatattttcttgcagcgtacattgtcttaagaggtaatgtgtggacgcctcccttctcccttaatacgagtatatattttagaaaatatgggatgaactgtgtgtggagtatgttcgtagatgcagtcacttttcacacctaatttatggtagtcattgacacttcactgcatgagtcatcatttgattttgtggtcttcttgatacatgtttctctcacattagacacaaataaattactttaaactataattttgtgaaatgcttgacgcaaaacattgtcgaagacatctccattaatcaaatgtgatataatgtaaataacacatttttttgtcttttcgtatgcatcaagtacttttgggaaaattctgaattgcagtgtttctgtagtacaagtatggttttatgtgttgaagtactgtactccaagtcttgaaagtgcttctcaatgttgttgcttcaacaggttatagaggtaatttttccatgcatggccttcttacaggttatagagtgcggatgtggctcccgtcgacgcgtggcacgagcagcaagaaaacacctcccggacccaatattttattgaattcagctctgagcattcccaatcctctctttcttccccttccactatttatgtttattcagctctgagcaagaaaattttgttgtgccataccccctccccaaaacggacatagttgctattccagattttgcagccggagccatgaagaactatggcttggttacataccatgaaacagcattgctatttgatgagatgcactctgcagctgccaataagcagcgggttggtcactatgcaattgtattatttcaattattgtacttatatactaagttgataatgtgtaattatgtatcttcccatgacatgtaaaaccatttgaatcatgccacagtggacaatgttgaacgtgaccgcacatcaattttctttttgccaaataatttaatagtcaatagtgcaaaaggatgcaatattattttgtagtggtttgatcagatttgtagtagctgttttattcccatgtgctgccacaccaactatatataatgatgttttgctatttgtatatttctctatccaggttgcagttgttgtagctcatgaattagctcatcaatggtttggaaattttgtcacaatggaatggtgggcac

SEQ ID NO: 3200 - DNA, 1921 bp, Zea mays
  misc_feature (1)..(100): optimal_loci_208071_G1, chr6:680336..682256, Cluster 19
tctgggccgatgggaattgttcagatcgacgggaacactactaaccaacatccatcataagcttgaatggcggtgtgcatgaccgtgaggtagttgagcgagcccagcccacttaaccgaatccattcttaagcggccgggcttcttttgtttgtagaaaaaaaaacacgcacacagagacatgcatatatagagagtcgagtatcagttgatcattcagcagagaggaatggtacaataatggacttagtaattacccaacccaagctaatgcatcaccaaagccggccagttaaggacgatggatcgagctaccacgtacgtaactgatcgattaatgccaagtcagatgaagaattggctcgcacctgtactagctaggattaaaagcaagaagcgcagtcaggctggctggctgtgttgtcaatattggatgctttcaacacatcgtcgtcgtccatctatctagcttgactgtgtctccctccctctctctctctctctccttgaggtcaagcgtgctgctcccaaccaactgacaagccgccgctagtgcttgcttgcatcatcgctgtctgggtttactttagttcaattatagcttataccagctaataagcaggatcgagcagactggtagctagctagagcgggcgcagattgtttcttccttgatctggtgatgaattggtccacactacgtccaaaacaaattacttttacgacctggtggacaatttcttttttgcacttttagctaggacacttattgacagttacttttacgagcaaaagggtctttatcgtaatggttaatgtttccgattcacaccttcacgtcccgggttcgattccctcagggacaaatttcaggtttaattaaaaaaaaatcatttcgttatgcccgcccgctctcatgttacgtcctgcgtgtcacctttcggctggaccgttgcagagtgggtggtgacaacccactagcgatgcagtcagaggcttttaaaaggggagggacggggcgtatctgtttgcacaacaccgatgctagctggtggattcagtcagtcagcagtcgtcaaagtgtcattactgcacacggatggatcgaccatgtatagtatagatcccatcaggcaggcaggcattagctagtaattatattcctttcgttctaaggaaaaaaaacctctacggttgttctaattaagttagctcattttaagtttagcaatatttatataaaaatgatactattatctatgacataaaattaatgctgctagatatgtcgtacaacagtatgttgtttataataatataacagttggttttatagacgctgtttttgctctcttttaattttatgtgtaaagcagttggtcattcaatttaaagtagcttgatttatgctaaaaacaatatactttttcagacaaaggcaatatatacctagtcaagtcaaacaagagacttgctcaacctatatatacctatgtatgatgtatacgtagagactcgcgcccgctacatccagaaactgatgctactatacataccacgccacgcgtcatcacacgtcgctgctgcctaatactttttttcacctccttttaattactctggtcaatgtctcgtcaaataatcgtttcttgttattcgtaagccaataataacactagaaccttttatatttataagtttcggtttagtcatataagctactcaaaacacctattatgtgatgcgctatttgacaatttattgcgagaagtggaacaatttctaagttttaggaagtgtgtatgctcatttttttcatctctacgaggcttatctataccactatataatcaccggttcaaactttgcaaatcacccccacaccataacctacattaaatccaccaaacaaactgcacat

SEQ ID NO: 3201 - DNA, 1497 bp, Zea mays
  misc_feature (1)..(100): optimal_loci_208978_G1, chr6:7172807..7174303, Cluster 19
tatgaaatgctatttgctagtaagcctctatttaggcccccactcggattttgggctaggtccgcccctatacatatatataagtctaacaatttcatattaggttgaatataatatatgatagtttatatagagagaatggatagagagatataagggtagaggattatgttataaagtaagtaattttattgactagaatgtaaatagtggtatagaataaaaatatagactgcggatatccttataagttttagaaagttctattcatccctctagctagctcgccttcacggcaatgtaggtacgtgtatatatactcctctagttcatccctccatgcaaagaataatacaatcaccctcttgatagtttctccctgaatgcaagtctctgcggctgctttcagacggcgatcaagaatgttgactcgaacgaaccttccagagctagccatcagtcatgtgtgtaataatcgtcgggaaagttttgctggtcacactcattttcctcgcgacaggggataaggcggctggcgtgcagcttggaattcgcaacctgcaagccggccggccggccttcttctccctgcattgtgatttgtggacgaacgagctctcaacttgcagcgaaaaggaaaggaatcgataatgtttatattgcttaaaggctaagggaatgaaatgaagaatacatgcaggattctcttggttcttcgaaaaggatatctttttttgccactagagcctagagggggagctagtggatcagattgcgatggtataaatcttattttcgacggttttgaccgtcgaaaattctctattttactgttgtgctcgttcaaaccgtctaaccattatgtatactaaaatacatagataactagaaatatacatattacaatataaaaagaaagcttaaagctttaaaaaaaaacactacaaaaaatagaacaaaattaatatacatgacatcggaaatccgaaacaaaataaactaatatccttagatctataactttcacttgaccaatctatctattaattaggccagacaaaagaatgacaataataacaagcacaacaacgttagtaaaaagactaatatcaaataacataaatgccattagagatcagctaaaagggagaccaaataaggaaaatgctaattacattttacttggtaattagagggctggtgatagaccagacatttagtatgcaataataaaataacaaaagaggaaatgaaaataataggatgacctagttacgcaagacgctattacggattaatatagaaggggaacacaaataacatcgtcaactagctaattaaaatatcaagtagcaaattgagtaccatgtcagtgtttgttaggttcttagtttacgtaatctgcatcagaggaccttatgtgatcattttagttcttcagtggatgcatacaaagatgcagtttcgggtccttatttctcttttctgttcccctat

SEQ ID NO: 3202 - DNA, 1680 bp, Zea mays
  misc_feature (1)..(100): optimal_loci_211377_G1, chr6:22129561..22131240, Cluster 19
ttgttattgaaaatatgcacaagcaccttagaacgagtataacttgaggctacaagagtactatagacaacaacaagagtactttgctaactacaacacccatcagcaagtactttgctaattataatacccaacaatatttagattaccacaagcataaattataatatttagggtttgggccatttagcagtactaacaagttgcatatgcagtcaatattgcaatagcatgttcttgtcttgccatagtggcattcgtcgccgatgtttcctcggtttccatcccctaggacctccttgagctcaggttcgttgtattttctcaaatatattcaaccttttcgattctagatacatttagtcaattgaggtgaaattaatagattctagacatatttagtcaatctactatatctcagctttacaaatttagttggtgaaaccaacatgattgtgttgtagctaaatatcctcaatcgtagctatttaatctatttcagcttgtatattctagggatatagagttaatatgccaaatgtatatcataaacctccatgaccattagtggcaggttattttgttacatttcaataactatattcatttggttaaatataatgctataccctctaattagttctctaatagttgatttgttttttattatagggcgattgggctactgagtttattatcaacatattcactttcgacggtagcaggcataactccaatgaccttcattggccatagaaccttgttttctcttgatgagacttatattcattttctttgtatcgtaatggaatgttgatgaatgcaataatacagtattattgatggatgagacttataatcgtctactttgttggaagtaatgtggctatattgattgtggtggtatatgtgactgaaggtgatatgagaggatattctggttttctctacaagtctattttcagcgattgtcgaaaataggtctgacggtatttattttcggtggctaattctggctgccaaaaataatagtcatttattttcgatgattagagccatccgccaaaactaaatattgctagacatatttttggggtttagggtttagggtttgcccagcagtatatctaaacggcggcggttgccaaaaataactaattttcaacggcggttgccaaaaatagccgatacttttggctaaaaatctttgtcgggataacactaacgaaaataagctaaagctatcgaaaaataagttatttttggtgcaaatgcttattttggtggcttgaaaatagcctgttctttagtggcggctttgcccagcagtatatgtaccgatgaatataatggatgccaaagaaggtttagagcatgtttgtctgagcctatagattataatctgtaggtagttgtttaattgcctagaatataatctgtagggagagaagaacgccgcacgatggaggaaggagacgcctatacctgtgatttggagataccggtactacatgcgatttagggaaagtgaatggcagacttcttaattttgtgaacataactatggatagtatacgtgctatttagggaaagtgaatggcagacttcataatgttgtaaacataactatggatagtaagtcttttgtcaaaaataattttaataagctcccttgatgag

SEQ ID NO: 3203 - DNA, 2037 bp, Zea mays
  misc_feature (1)..(100): optimal_loci_217658_G1, chr6:65497457..65499493, Cluster 19
gatcgatacatgcgtgaacagcatagaaacagcacaaacgtagagaagcttttcacaaacatgaccaaaaaaagcacaaccaagctcatgacaataatttagcatgtctatcatttggattgatcaatccagattgatcaaagccatggcacaaaattaggaccactaacaccaatgccagttacccaaagggatttccaagctagtgcctcaggacacagaagtaaagacgcattagggaaccagttataagtattggtggaagaataaaagtagtaaataagagtgtggagaagaaataaaatcattctttagaacaaaatgagcaactcatccagttaagcttgggcatcccaaccaaaaacatgaagaatatatgcatcaaatctacccgagtcaagaatcttatatgacatcaaatcgaactcagatttgtcccatcggtatcatgatccaggtcccaagttgaaatcacagcaaaagaaggatacatgaaggaaatagaatcatagacaaaagtatatgacagaatagaaagagtaatgtcacattgaatggctcagatttgccccaacatcaacacaacactcgcagaagaaacatgaactcctccctccacacgctaaacgaacttttgagtaggattgttcacttggaaatataaacgacaccaccgccacagcaatggcaacaatcagttgcaaactggttgcttgtatatggtacaagccatccaagtttaacaatatattgagcaaaataccaaaccctaaatcctaaaccctaaacaattcaacacattcatcccattacttgaaatccatgtcccaagttgaaatcacaggaaaaagtaggatgaatgaaggaaatagaatcacaaacgaaagtatatgacagaatagaaagagaaatattatgttgaacggctcagatttgccccaatatcaacacgacacatcctactctaaatgaacttttgaataggattgttcatttggaaataaactggttgcttgtatatggtacaccaccgccacggcaatgaggcaatcagttgcaaactggttgcttgtatatggtacaagccatccaagtttaacagtgtattgagcacaatatcaaaccctaaatcctaaaccctaaacaattcaagacgctaaaaagtaatagctcaatggggatgggacatttgacatcacagccaccgaagagtagttccaaacaagaaaggaagatcaacagataagcgacaaataaatatctagaaaataaaggaatgcatagagcgtcatcacagccacagaagaagagttccaaacaagaaagcaagatcaacagataagcaacaaaaaaacgtcagaaaaaacaaagagatgtatagaaactaccaaaatgaatcaatgctgcaccctgcacagcttcttttggggtgtttgtatgggtgggtgggtaagggggggagggatcagtttcgcctttgctcattcatcttaatatttgacatcacagccgctgatgaatagttccaaacaagaaaggaagatcaacagataagcaacaaaaaaatatctggaaaacaaaggaatgcataggaactaccaaaatggatcaatgatgcaccttgcaagcctataatagttgtgatggcctacaggaagtaattgctaaaacacaatgctctcctaagtccaaagtcacccagctacaacaggagtactgagacataactcaagaaattactgaaataaattctggatgaacaaaattatcaaaaagtttccatcaagcaaaacaatactatcgcaaacaattatagcagaatcaacatcagaaactagggaacatctcaacctactaatgaacagaatccaaatgtaaatgattggtgtgttccacaaatgcaacaaaagtaatggagtcataaaatatgtaggtttggaaagaaaacatggagcaacaacatactcaacagaagaagtgaagatacaacataatgtgctttcttcttcccttttcgttgtgtgtgtgcgcgcgcgc

SEQ ID NO: 3204 - DNA, 1798 bp, Zea mays
  misc_feature (1)..(100): optimal_loci_217787_G1, chr6:66455234..66457031, Cluster 19
gaaacaacggtctacaaaggcagatcagggatagatgttaaaggtcactgattttaagctatccctgttataattaagaaacaacgcatgggaactcgtttaaaccgtttctttgatactgacatgcttttaagacgctcctacagcttatcctagaagaaacaatgctctacagaggcaggtcaggtgtacaaaagtgtctgatttttaggctatccctgttatacgaaacaaagcatgtgaactcgtttaaaccgtttctttaatactgacatgcttttaagacactcctacagcttaggtactgatatgcttcactcagcggtgatgcaaagcaatcaacatcctttttaaatggacagaagaatataagatcattgccaatagaacagacatgcacaaacttccacacaaattatagtaaataaatatcatttctaactgtagatccaaaggtttacttgatttaatttgtttctttcttacatggcactggagttagactgaaggatgggacagtacatgaagctgatattgttgttgtctgtgttggacgcaaatcattgactgctcttttcaagggtcaggttgctgctaaggagaagggtggaatcaaggttactttgcttctgatatgtcattttcagcttcgagcaaatcaccacacataaaggtgattatccttcattatctctgcagagcaaactggtaaagatgtggttatccttcattatctcttaatttcactcttccaatttagtgcttgtagttcgtaagacctttaactaattcaattatacagtactgttgtcaccttatgcactctgtgaacttagttagctttgtcttaaattgtctcacctagagtgaaatatatattaaatctaattagattctaacaaacttatttggtgataacaaatattatggttgttcataaacctaattaaatttaaaaaagcttgacaatgacattttctatcagaggtgcggctccacatcattatcatgaagctttggctagcgagcaccaagggtgagtttaagattaaacgtcctgaattaattactgagctgagtgaattatttttgctgtgtgatttaggatatgtagatactgtttactaggtaagttatgttataagttatatatggtatatgcatttctgttatcttgaagttgtttgccaaaacaaaaggggcataatgataatgttggctttgtggtgtcgttctttctgttggatcttttataccatgctaccattgtctttaatttttggtgtctattgctttatctccaaagctttgtgttctttcactgtattaattaggttaaaaaatgctagagtccagctgaggcatgcttatgctaccagcatataagcgagtctaatgtgctactggtatccctaacattctaatttccgctctagacgattaagtgccatggagttaaatatgctgaagcataaagcaaagagtaatgtaaaagatcatacaaaggttgtatctaaggatgattaggttacactgaaaggatctgtgctcttcaatggagcttcttctgaacaagctggtgcataaaattaatgattggctagccatgccattgtctctttagatcttgcaaatctgctcaagtgtttgtttgaataggatctccaatcatgagatatgacagtttaatgttgcaaaagtttctgtgtagctatatatttagaaaaattaaaccctctactttgtattgttctctttatacaattgctagcacgactggtatatggcaatgtgctac

SEQ ID NO: 3205 - DNA, 1685 bp, Zea mays
  misc_feature (1)..(100): optimal_loci_225308_G1, chr6:109998275..109999959, Cluster 19
tgttagaaccaaataacccgaagtggccacatagccatgcgattatacgaatttataacatttttaattttgaggaagctacaatctcttattatttaattttgaatagtaaaggattccagcccctaaacctgtcaattccacctgcttctaatattcaccccaatctacatgtgttaggtggattggggtgaatactagagtacccctaaagggaaacttctgaaataaagagaatgcccattgcatgtcttaatttaacagaattcattgcataggatataactggagcagggaacatgtgactgtcaactctttccagataaaaacggttcaatttacaacattaaaggcttgtttggctacattagcatgggaggggattgaggggcatataatccgttgctattaaaaaataactagtaaaggattgcatgtccctcaattcattctaatccccatacatccaaacaagccgttaaaggcaactatatttcaagatttggagtggaacttctgaaataaaaatgcacattgccagccttaatgcattaaatagatagaactcgataactcattggtaagaccacagttgttgtccagtacaaactaaacagaaaggagcaacagagtacaaagaacattgagaacatatatcataaataggtataggatattctacaagtgttcaaacagttcacacatgcatcggcagtagcttagcacaaccctagtcttgttctcaaagagagcaagaaacatacacatcttgaagactattcttacaacaagcaactcacacttaggtgctaatatatattacagtaatttccctggttatttatcacagaagatacacgaaactacaacaaaacattgaagaccctataaaacataaacgctatgttatcaacacacatggatgatggatcctagatacagaatggaaagaaccgaatgttattttcagttgacataagcaaagccaattgaacacggctggtgttttacatgctgcagccaactgccagcggaagtgcttgcatccatgttacagcttaattgctttccagtattcattcatcccagtagaaagcataaccataatattaccaccacttaacctcccctctggagcagagatcagtgtgtgaacagaagcctcagcaggatgcgcaaccaacattgtagtaccttgggcaaaattggaagagatgaatgactcaccgcttggttccagtgttgttcataacagatcctgacgaacccatagcaccatagtgtctcaccacttggtagtaccaggctgtcttccaccagagcattatgtgcgacacacaatccattcttaccccttgaaaagcgctcgcgagaaccgccagatcctagttgccttgcagaaatcagtgctcccctgtgcactcttgaatcttgatgcagccagcaaattgacatcttttgcccccaccatgacgaacacagcagtctgttcgtcctctagcgctcttggtgcatccgggtacaacacatcgctttgggcagccttcagctccacatcagtaacaacagattcagaaggtctgacagtcaaagataacttaaggtccatcacaggctgcttctccaaagctctcctgtcattacaagcattcgtgcccaattttgatgtgccttcattacacaga

SEQ ID NO: 3206 - DNA, 2620 bp, Zea mays
  misc_feature (1)..(100): optimal_loci_226602_G1, chr6:117575279..117577898, Cluster 19
ttgccacatgtccccctccaatcgacttacctcctctatcgacctagagagcctatatataccccccatgcttggggagtgtagaaatagccctttggagctcaattgtgaagagtagaaaaaatttgagagtagatacaacctagagagcttcccccctttatattggtagattaagtagttcatgggagttagagatgagtctgagctttacctcaggagttttggagttctctttgaagtccttggatataactcttctagttatccttgtgtattactctagtactacttttagtttaacttcaagtatttgcattcaaatatcattttagtttacctctacttctttgttattgttgtggtaatctaggaacactttaactcaaggcttatgattgtgttagtctgttgccattcatatcttgtctatcttggaagtatagtttggttctcttacttctcattgtcgtccctagcaactttacctagctactgaccttagggttcttcctcatacacctagctttcctatctttggattgcatttaccctcatctaattactaatgtgtacatttatcaagtttacaatttaatttcaagtttgagttggttagtttaactgtagtcttccgcttccgtgtggggaacatgatacctagaatactcacagtgaagggctacatcagtctccgtgtgcatgaggagtaaagttcaattggcataagaaccaccaacaaagataaagagatcagttttataaagaagaatatatcattaaaactaaaagtaattaggtcggaccactgaaatggaggagcacaactcacttcgatctggccctccctcccggcaaggtgacccgcgatgaccagatttgtattttctatagtctgatcaactctgcccttaaagatatcagtataaatataagtaacttatctccaagtttcttaggaatgacatccacttttgtggggctaaaaaccttaggcaaaggtgacataggattggctactatttcattctaattgagtccactcatattatcccgatgatcgaagtacacaaccaaattcttaacttttaccccaacgtgagccatgacaattgtgtcctataattatcctcatgccatctacaactattttctctggcactaaccaataaaattttaggtgtcgagtaaccgactatccaagttcttacacaaaattatcaaaccatagcatggaccaagtacgtgactccgcataatcaaaccaagaaaccctctcatcaagataacttctgagattaccatgcccaacaaagaaacccccatgatgaacttcactattgtactcttcaccgccatcatttataaaggatggtaactaacacaatgggtcttttgaccgaccaaacacagaatggcaacactatactaaaactgatggatatttaaccctaaatgaaatgaaaagttgatgcatttcaaaccccaactgacattgcctactgaaaacatcaaccctaccaatttatgacgcagacctaaactgagaactaattcacaagaactcgccataaatgggttgcttcccctttctgccataatcgtgaccccatcttcactatctagctacaggatgggacacgtgcacatgcctcctttcaatggtcgtctttcttctcttcgacacgaaaaacctgcactcgtcgacaatccaaagctctcgtcgccttcgtctagatggggagcttgaacgataggacaaccaaatctacgggaatgacctacttgcaaataaaacactccatgatattgtccacgtggcaacggtccccacgtgcaggcccattaggatgactaataagacccaaacacggatcaaggatttaattgatgcactttcactgtttaaggaccggatggcacaaccgtaagtttaggaaccagagttgaattttgctcaattttttcataagaaccggagtggattgagctcccgccagatcggagcacatcggtgcctcgcgaattttttttatcatggaacgaaatgtggtcagactgctgtgggaacgagccatacattgacaagacttggttacatctttcttaaaataaatacgactagatcctagcgaattagcaggacagaattatatttattaatgtgtctacggtatagagagattccccaaatagtccattcaacttttggttttcatttttctgtcgtgtatttgacccccaccgcggcacgagacagagagattgtagcagtgcgcacgaaacagaacgtgtgcgaaacccgcacgtttatgtgccgtatttcgtcattctcgtacaaacacttgttttctgcttggttccagtcttcgagcctgaccaaatactcctgaaagctgaattgagtttatcaagctacagtctcttcttctcagttaacgagttacatacaaagacgaacgcatgctgacaagcgcaagccgtctgtggttttctaatgcccggaggcttccatggaccacggccgtctggctcaatccatggagccattcgctccgtgcttcacgggagcacgccggcgccagagcgccgcagctttgacaaagaccataggaacctg

SEQ ID NO: 3207 - DNA, 1467 bp, Zea mays
  misc_feature (1)..(100): optimal_loci_231274_G1, chr6:140283832..140285298, Cluster 19
ctgaacatacagctggttcacagtaattgaaaagcctataccagaaaatatgcccccactaaatgcattatcagcaacatcaattatttgaacagtaatatttcaatactatgtttgtggcacttgcgagctatcatttcttgcaagcactctttttttgtgaaatgcttattgatttgaaggtgctttcagatcatgtttccttcaatactgccttgggaaacattaaggatgcttgtttcatcaggtgacttcacatcaagatcgattccaaatctactggtattacttgattttttgactgtgttgttagctgcttctgctgtgctgttttcaatgtttaaaatgcattcatttccgtactttgatactgcattttgtgctactgatttgtgccattctgatctggcctcaagttctaggagcagctaagtcatatggaccacaaacagtaatatacaatgaggtccctccttgatgtaattgtatgcataggaggagcttgtttctaatagtgtgctgatgcagtctgtgccacttaaacactatcttcgtgggcctgtttttctgatgaaatggatgcagcaaaggatttagatgaccttctcttaacactctgagacctaagtttgaaaagattctgggaattcttcaatattaacttccatgtctatattcaagttcttttgctttctttctccaaagttggatttgatctttattgatttgtttacaactttacatcatttcttcaacctggaatttggttgctgatgaactgctttattgaagtttagtttgacaacaaccagaagataagatatagcataaggcaatcaaaacctatgttccactatcgctttgtaaacgatgatgtaatgaaaatgctttccactgtcaaaattgtcagagtaagtgtatactcacatggatttatgttagcaccatcagcatatccatctgttcatagtggtcatgaacagtatagtttgtgtagtgtgcactatattgaaaaggtgctgatatgcctattgttgttcctacttcaatatttctaaaagtgatagcatacatgtgtgtatcctctaattttgaatggaggcagtaatgttgaaatgcttagctagtgcgatgaattataagatatcatacatgtgtgttcatgtaacaaagtgatattggtcgaatttccaagattcatctcgatgcacttgaattcaatatgttaacctaatggcttgttatttttattgtatggtaggagtaaggaattcaacacactaaaaattagtttttctcatcttaatttgaagtttgtgttttcttttacttctgagtttaaatattgcttttttgcatgcttgttttcatgcctttgtgaatgtatagatgttatcctattttgtcagacgaaggtataattatttacttatgcagatcggagatcaaatttgagatgttcctgaa

SEQ ID NO: 3208 - DNA, 1653 bp, Zea mays
  misc_feature (1)..(100): optimal_loci_232487_G1, chr6:146127156..146128808, Cluster 19
ttgacggatattatcaaaatggtgctcataaagaccaacgatcaaattgctaatatttatataaagagtttgaacaagtcaaagtttgagaagttttgtgaagctcttgatatggtctaaagtaaactctaaagaaaatatttcctttgatggggaatgcaaaaatatgcaaaaaaaaagttcactcaaatatttaccatgtaagaaacagagccaagtttctagaaacttctataatagtcatggcaaatcatagcgatgcagggaacaagacaacttctagcatattataccataatcataacaaatcataaagacatgcaagaaacaatataaaccttataattaaccataaaatatgcatgaaataaggcaaggttctagaatcttttataacaactatgacaagccatgaagcttagatatttatttgttgctatggtaaattagctttagatatttgttgagatgtgtataagtggcagtcatccatagctcatgtgttcctatataagaaaaaatctaccattatgatatacatcacaacacaccataccactccaccccacacacatagaaatgagcataggtagattatgtagagtttgtgttagctacctcaaaacaattcaatcgtgttgtgatatattaaatgtgttcttgttgtaagtgttagtctcccggttataatgtatagtttctaattacttactacacgtgctacgattaatctaaaagttctaataatgtgttttgtttcactagttataaattcatccaattatctgtgctataattcatcacatatatcaacattagcattataaacacttgtccagtaggagtgattatttattgtacgactaatatctacatactcatgaagaactttttaaaaaacaaactgcaaatgcataccagccaaaatgtgaggaaataccagtaacaaacagatattttaccacagaatagaagaaatgtatacataagtataagaaatgatagtgttattcacttttcttttgatgattaagaaaaacagttataaacaaattaaaacataattaacataagaaaaaatgtaaaaacttcgcaaatattacatgtgtttctcatacactaaaaacattagcatttagtaaaaagttggttctttaaaactgatttaggtattgggacactatatacacgacgtcgtcactaacatatctaaaatagaataataataagtacaagttttacccataataatttgtcattaatgcagtcttaaaagtgatagatgcttagaacagactcaattgtatgtcacacatgaagaccacgaacggactgatctattagaagggcccgccataatagcaagtgagtaaaaaaccataccaataaagtttaagtttataattgtaattttagattaagtaaactcaaacaaatcaatacatgtcgagtctacataatcactaataagactcatccgaaaaatcttaccacaaatttgttgaaagaaatcttataacattttttagaacaccccttctgttgacggattcactaccgacacgctaactgaagacatgcagggtgacgatgacatgaactcttggttgagttgagaatctctaactttcttagtcgctcttttacaactat

SEQ ID NO: 3209 - DNA, 2339 bp, Zea mays
  misc_feature (1)..(100): optimal_loci_233306_G1, chr6:149373963..149376301, Cluster 19
ccacgttctattgactgtgaagggcaaaagttcaatagaagagaaatgacatagcgacaagtagcaaagagtccctgtgtgaagaaaaaagatgttaaagaagatatacaaggctagttagaggattactcaaactaaattatttgagaaattcatcaaattgttggattacttcacatggacgaagatatgaaaggagattaaggatccacaagctgttcttaaaatagttgacaaagcaatcgaaattaaatgaggtagaagcgaagaaaaaggtgaaagaggataatgaggaagggacgtagtggtgtattaattatttttatgaactatataatttttatcttttaagtcacatgtattttaattgtttttttacaaattatgtaaattttatttacttaattatgtaatcgaatgtatttatgtttttaataaaacaatgtgttttgtgtcaactaaaaatttgtgaaaaagttgacgtagtgctgagatagtgagatgcatgtgtgcatggaaatgtcgatagtagaatccatagtacgattggtagttgatgtggcagtaatacatactcgtagagttgggaccagcgtaaggagttagacatgcatggacgttgtttatactcaatataaataaatgtttgcgacagacataatatttttcctagcataacagatattatttgtgtaatcgagacaatccttgtttctatatatatctaattgatacccacatacatataaactcggaatccaatataagatgtaaaataaaatacggggctactgataactgttatctgttcatattcgaaattcgcaaagatctgtttctcgcgaaaagaaacctgcaaatcgaagcgaaagttacgttcgatcctgaccttgtactttctgcgaatcctcatggcatcatgcatggacacacgttcgtccccggctttcctcatctcgtctcaggctctaaattaaacggaataaggaacaaaacgagtcgtgttacgagctcccactgcccgtttcctgctttgaatccggatgactagatgtgccaagccttttcccgtcagtccttttttttatgccttgccagagcaccggtttattagactaaagtcatcaattttctattttaaaatttacctatacgaataatacagtctaaatttcgcatctatgaataataaatacagtctatatatccactcgagtactcgaccgagtacacccacgctcaacgcggatcggaggtaaggtgaagcttcgcgcgcgtcgtgcagattccgtacgtgagctcgagctaaatctgggtttggcggttcgatcgaatctgattccttgactagacatagcacttcggatattgttcgaatctcctgagagattggaatctgatgaacactgttccacgtttggagccgcgtgctgccattattttttgtttctgctgagctgggctagttttacacaaatctaatcatgggtcgctggattcgaaaaaaaacgcagctcgactcgacccactcagcagcgtgggctactgggctgtcatttttagcctggtgcaaaaatcaagtcaagcacgggcctaatttttagctcgttggccaaccacagtgccctaatctggatctggaaatagtttggtttaacgttaaagtaggataggagggggcgataccgtctcatcgatttttgtgatcatgttaccacaaaaaattaagtcggtgttcatcttttttctacgtgactctcatctaaacgttattaaaaatatatctgttttcttccactcttctcatacgtccaaccatacacaccctaaatgtctatttcaaaaagctcgagccaattttatacctcctcgtagagtttaagataaattatacactgtcactaactaatgtgcttgtaccaactctacggtaactttttagatgaattgcaattgatagaacaaattctgcactcacttacttcaccgcataattttctatgctcttgttaaaagctagttaaaacaatcagctgaaatattttggcgtgtgctgttttttctcctgtgtgatgtctttataaactgaaccagaattcggtaagtagaagtcgaaattgcatatgcttcatagcttatcaagatgcagatgcctatagtaatatgaacactaatgtttagacatagcacttgcattctctctcccattctcaaagaaaggtacataggtcatcaaaaagagaggaatttcatctcagatttaaagttttctccaaattttgacaccctaacatcaacagggataaaaaaactcacgatccattgttgctactgtcatt

SEQ ID NO: 3210 - DNA, 3144 bp, Zea mays
  misc_feature (1)..(100): optimal_loci_234615_G1, chr6:155438267..155441410, Cluster 19
taatacttatttaaaagatatagctaataattagttacggcccgatggcccgtttggccatctctactcacaactaatacttatttaaaagatatagctaataattagttagtcaattagttgatcgattctaaaccgtcagctaattttagcagctagcttctcccctggttccgcgtcttgctctggtctggtatgcttggtcaggcaggtcatcatcagtgccactgccagtgccatgcatgcatgcttccttgttttggtgcctgcaaactttctggtcctgccgtaaaggcaaaggtcagaaatcagagctgcaacgagtgacatgaatgaatgactgatgtttttcctctcactgtcgcatccattcaagttcggttggtgccttgtctgcccagatcgtctcatactcctatgaaaacaccaaacatgcatggtgccaggggcccaggaacacctgctttcgggctcggaggctgtaccaggagtcactcagcactggtactagtactagtaccgagggatatgaggatggcaggattttgctggcgctgcgggactgcgggtcatggacttgcagtgccagatatttgtgcagcactgtatgacatcccggtcccaccttttagattcaatgcaccgcaaggtggtgccatttgtgttttagttttaaatactaacgatgaatatgattgttgaattataagttcatacttttaacaatttatatttattattattattattattattattatatatatatatatatatagagagagagagtatagcacatttatattttgatatcagtgtttcgttgctgatcgtcgcatctatatatctacactacatcaagtgggatggctgcaaatcactctgctttagttattgcgctcacgggtactaggacagtaggctgtaggcctccgaaacgaatgttgttcaaatgttcacatactcgtgtgaagaatggaaatcacatttttggggagtgtttataagccacacaactgctcactgcttgttcttcgtcacctcattatggtcggctcgatgtttcgttgttgatcatcacagctacatatttgcattatatcaagtgggatgactatattgaccgacaaaatgtatgtatgtcgttggataagcttctttctcttaggtttcaattaggttactctctactttgtttgtgttcatcatgttaagatcacgcgtctacgtttctattgtcactaaccttttatcataccttttctggattaaattgtaactaaaatgtctaatcttctagcatattaggtactttggtgtgaaatctaaactaaattccataccattataccctaacacatatgaattgaggtggatagatatatggattaaagtggatatgtgtgcatctaaactagctctaaggggaaatggcatttaattcctcctcaaaatttctaaatttatacagtagtaaagtacgactttccatcgtccgcgtcacacgctttccaccatcacgcacgaagtgtgtagacttgcttttaatttacatctacccacttccatccactccttaaagaagagttgttcgtgtgtcctcctcctccaccccgctcgcccgttgcctccctgatccgctcaaccgaccacacggtttacgtagttcatgtgaagtaggactggcgaggttggagaggcaacgatgcatcagccaacaggaatcttatgcattgcgccaacgactccgtcgtgaccaccatccaagccatcccatcttcctcctccggtggtgccctttcactttcactatcgcgtgtcgaaggccagtcaggccagtcactgtgcgtcagcctacctcctctttcagctttcatcacctccaccgtgtgtagggagtcccacacattgtgcagcgatggcggggagtggaggagaggaggtcgtcatagttgcgggagatgatgtcgcgcctgacaccttgtaataggcaatggaggaggatgctattgtgtctggggtcgcgcccgacatcaccaatattaagcattaagttatatctacctaattgatgaagttataatcgttgatttcttaggttggttggtgatgatctggttgtataattagattatagtagtttgaaaaagatcattgtctaagtttggatttatttcaatgtaacatattgcttactttttaatttagtgtcactaattagattcataaccgaggatttgcagttttcacatggacatgtgcaagttagcatgctctaaatcatttgtttcgtgtgtactttaaattgctcagagtgtgcgttttgctatcaaaagttgcatctccaatttatttgattctttttactaccgagggagcaaattttctttgtttccttaccatgctatgtcatagcttggttagactttcttaccctgttagttaagttttcattcttcagtattgtctagagtatatgggcttcacatttgtttaactgattcagtcggtcaaagttattgacctatccgtctaagcaaattgacctctttcatacatggtgtttggtaaggctcgtgcctgaattctgaagcggctgatctacaagccattgcattgcccttctgaggacacccttcatccaggatatttgtgaattattttggtctggattctgatgcatctgaggtcggactagatgaatggaccgaacctgctaggcttgttcagaactcaagtgctcttttgacaaaagaacatagaagtaggctggatgcattccacctatttcacgaagagtcgaagatgcatctgttcaagtaatttggcttgacttgagtggtgctatttatgaatagaaccatgaatttcacgcaataaaactttgacgcgctatttgcatcctatctacaaaaataacttcttctgcttaccatgactttcttatgcttacatgcagaaaattgttgtggctttgtcaactggcaaggctgtataggatgccgtgtgatgaacaacgatgtggtacacgaattcaagaggtcctttcaggatagtatgcaacttttatattcgctttagtgttttaagttataggcagcggcaaatgatctttctgaccttttgttttgtgaaaacatatac

SEQ ID NO: 3211 - DNA, 1556 bp, Zea mays
  misc_feature (1)..(100): optimal_loci_235800_G1, chr6:161368366..161369921, Cluster 19
tgtattttattatattggttccgttgatacgcacaggcatgtatctagtacaaattaagcattatattaaaatattcttgaatacaaatctaaatatataacatgcatacactaaaaatatatgtttttttaattaatggtcaaagttttaaaatgttggttttctaaaaaacatgtacgtttaattttatcaggttccgtcagcccaactgcatcacacgcgcgatcgccatcccgcccaaaatgctatcttcgctcaccgtcgatcccgcccaaaatgctgtcgcctcgggtcggtacctaataataaataaacagtctatcccataaaataaaataagacatatatatatatatatttaaatatatttacagtggaactttgaccattatttcttttttaaaaatataacatcaacaaatacaaattaaacatcatactaaaatattcttaatacaaatttaaatatataacatgtataggctaaaattatatgtttttgctgaattactggttaaagttttaaaatattgatttttctaaaaaaacatgtacgctttattttatgagatgaatggagtagaatctaaggtcgcggctgctcagttacgccgcgcaccgtcaaacgttgggcttgcggccaccgcaccatgcaactcactcacgatctatagcttctacaagctagcctcaccatcacgctacctctcctggatcatatgaatacacaacacctgtcagtgcgtcagatcagtatcagaggcaggctacgccaggctaacctcactcgtcagtcgtcgtcaagtgtgattaataacgacaattagcggctcaagtgtctaaatctctctgtctgacgatcattagcactaaaccgtcatcagtcagttagtcgaccgaaccggtcggcgctacgtcggcagtcatcggggctcgccgccaatcccttagagcgagacgtagctttatccgtggtagctgagctcggagaaatgccggtggttggcgggtccttggcccctcgctcgatcggcgcgctctgttttcgctggcctgctagctccacatgtctctaacagtctaaccgttgggtctagctacttgtactaatcaatcaattaattagtgtgctggcctgctggaacatgagagctggcagctgctggcttgctgtttggttcgattctggttaagatcttgccctaattgcttcgctcactttgggagaggctgtcaaaatcgcagtatactctaactaaactaaattagacccattagggttgtttgagagtaaagataacggagagtattggagagactaaaatcattttgttatttaaaattgaataacacagaaattttagccctttcaatctcctcactaaactctaaaccctaaataaaccttatagaaatgtagactcagataactagtggtaccataaaatcaaataatacaaggacgtaaaatggtatgtacactaaaaatcaacgtttttaacaactatgtttgggaggtgtgggtgagaacctcctcctctgcagtttctgcgat

SEQ ID NO: 3212 - DNA, 1884 bp, Zea mays
  misc_feature (1)..(100): optimal_loci_237012_G1, chr6:167950570..167952453, Cluster 19
ctcttcacatcttcattttgttgctctaaagccttcacaatatgagcatttggacatttcttccaaccatagagatagagacgaaagatcccagcttagtagttgaactggtggaggatactacttatgtcttgttggtttacaaaataagatcaacaccatgtagccacatgcttatagacatcgaaagatgatgcgttgttggtgttcgacaaaacagaaactatagaaatatcaaacaagtcaaaaggcctttagaagtctactactttaattcgtcttcttgggtatatcatacatcattttttgcttttttcttgaggtgggatccttctaattttcttatgttgtggaagatccttgtcctcaaatttttcctattaataaaagttttatgagtcataataacctaacatgattatgagcagagccaagtttaaagtttatgaaagttgtagatggagcaaaggacatagtaaaaatattggctattgtctactagtagcatggtgatcacgggagatgacattatagaaaagcaactaccatggggcattttgttttcgataatatcgagttatatcaatgcttttgacatacttaataatgttttatatgtccattttgctttcaagttgatagcagccaagtgaaagtgtactggtcctctaatcattacaattgcaatttgcatacattttgcatatgtcatttttagtaagctaaataaggagcatacctggttttcatagtctccaaagcttcttttgtttgaactctgagtttcttcccaaatgctgaaatgtagaaaatatgtagaaggattattcataataataggacctaagctattagaaaaaatataacaagacataagctattatgggtcttcataaaactgaaactaatatgcaatatttcactggactcaaatacatttattacaaacaaataagtactattctttttgtatgcatacatagatatataaatatatagtttattgagttttagtatagaaggtaaaaatcaagtttatcttaatcatacccaaatggttcatgtccatatcttgagtttcttcggcgtcttctggctgtgatgtgcattgctcctgaaatattttatagaaacattgtaattacttgaggatagcttatttgaatattaagaagttggtaaacctgttttttatgtctttggtggtaattggagtcaacaatggtaaatccttgtattatgtcattatagaggaagatgattctgcttgtctattcacgagttaataaaacataccttttttagatccaccagtcttctattttttagtaggtaccttaggttatcctgcagtaaatagtattacagaaaaacatgttttaaattttgattagcaatagaacacattcataaaagacaatgcaaagaacatattaaaaaaagacaatgtaaagtatgtgctagtttcagtttggtcttatagagatgggaaagatgttctagctatgaaagatgttactacctgctcggaccataaatagttccagattggtttcatattcatattttgctataaggtgacgactaatgggcaatttattttgtttgggattagcttgaatatagcaatgaacaaaccattttttgtggtgtttgatgtcacgatttatggtaaattttccaaatcctgcaagtcttagtatgaactttatttccataccataggggtggctacttgaagcctatggtaatgtatgtattcagagactaagaagaattttaatatttagatgactgaatccctcaattccttccaactctcatagtttcaacagaaaccgaacagacctctgcagagaagctctccttccacatttttctgta

SEQ ID NO: 3213 - DNA, 8267 bp, Zea mays
  misc_feature (1)..(100): optimal_loci_238232_G1, chr7:5489505..5497771, Cluster 19
ttaaaattattaaaaaatatttttttaaatattttttaaaaataattaattgcaatgcaatttcaaggtctaaaagggaaaaaaaataaatggagagctaaaatgactttttttttataaagtttgagggtcaagtaagtcattatgccgatacaaaattccaatttattaatttatccttgttatacccctacacctcaagtgcgcccctctggcactcaccccttgaggtcacttccagtattcatcccctgcaatagtcctctcgagataactccttgggaaaaccccttggcgcaactaggggtgtacattcggtcagtttattttttctataccaaaagccaaataaattgaactgaaaattatctgttcggtttttgatatttttttagttggaaaaaaaatctaattgaggtacttataattttatttcctttaattttttcatataattgttttcattcttcaatttactatatcgtatcacttttaattttatttttatttcaagttaattataaaaatattaaaaatgaaatcaaaccattaatgaactcaaaaaaatatttactttttatatggctggatatatgaaatttatcataaaaaaataaaatgactatcataaaaacaatggggtatatgaaattaatcaagtaatttttacgatatatatataaagtgataaaagattttgctaggaaatatgcaatttcaaattatccttactttaatatatggaatttatcataaaaattaaaatgcatagaatgcatatcataaaaacatgggtatatgaaatttatcatttaatttttgtgaagatcataagtgaaatatttattatttaatttttatgaaatatatatatataaaaagtgataaaagattttcccaggaaatatgcaatttcaaattatccttacgtttttaaattttttttatttatttcagatttgatataaaaatataaaaagataaaaatatcctgtaataatatttattaattgttttagaatttgggtttttgatgcattattagcgacatcaactcaattagacacttaaataatagtaaagataatatataacattaataatcgaaagcaaaacataaaatttgcgtatattatttatattattttcgtatatttaaaatattataaattatataaatttataactaacttatttgattatgcatatttttaaaatgtaagtatattcatatcatttttcacattaatttttaatttttaatttgttcatatcatgtctcagttcttcccataatttgcagggtttagcttccatccattattatcttatacaacttatgactttaacaatttatggatgagctttacacatttgaatggttatccctcactctaaagagcaatttctccttaattcaaggtggatgtgattgcttgtcaagtgtgacaacaagtttttgtaagatattgaattttcaaaagaattttttttttttggaaaattcaagtatatgtattatattaagtattatttttcatgtattatatgttagttacctctttcctatttatattatacatgaaattttaaatgttattccttcaacaattttaataagctttatttttgcaattatatatgtagttgttgatgcgaaaatacaagtttagcagttgatggcagttcattcgaatgttgagagtcataagtgatctattaagagatggggataggggagaggagctcttccatttccatggctttcttgtgttgagagaatgaaaggagtcccccttaagtcctaatggttggcttatagagctgtcaactcttatggaaaaagtaaggggcatataaggccatatataaatagcgtgtatcccacatatctatagtcatgcaacactttggcgaggttatctttgaggatgatctagcgaggtttggtgtacgtgatggctgacttggtgagaccttttaagtgaggtaaagatatacaacaatagctcccttgtcaaaaggaaggttataaagtgaccttggttgagacaaaataatgttgaggatgtcgttgtgtttgttggagttttaaccatgcttaatcgttcctatttatgtcgaacttatattagaacaacaacaacaacaactatgttttgtcaaaactcaaaggtgacattttgacatattcgagcctaaatgttgcactagtatttatgatagtcttaaacctacatctaaaggcttgaaggcatagaacctatctacatcttgtgtggcttaggaacagaggagacatgcttaaacaacttgagctttatccttatccaataagatgatggtatttgatgtgttttaaacttgtttacgacttagtcataaatttttcaaaatttatcaatgataatttcatcattcaaagaatgagataaagaacatttgaattagctttggaaaatttgatattgatacaatttatgggattatttattaagataattatttagataaaaatcaatgtttaaaattgtgatgaatacttatattttagttgttgatcatgttatctattttttttgaacacattgaagaaaagcctataaagaggttgttaattgacttcctcattgagccatttgggggtgtgtttagacactcattgttcaacgatttttatggatagatattgaatgtaatgtaaaatatttggggatagtgatttgtaaaattttggttagattgagccatttggggtgtgtttagacactcattgttcaactttgggatgcaattatccattgggaaatggtagattgagctttagctaatagttgtaccaaatgatttgttgaataaaatcattctctaagtgaggcttcgcagatgtaggattggtgaatctgaattgcattaaccaatgtcatgtgttgattctctcattacttatctcttttactcacgttttgtactttttatgcaaactctctaattgtgtcccaacttctcttctaatagaagatagaagaaaattgttttgaacattaagttgaaacaaagtgcaaaccaaaggctttttcaatgttgttggtaaaatgctctcataaggtgttgctaatataaagatattccttttagcaaaaattttatgtatagcctttcttgcaaaatcaaggaaaaaatattattaattttgactagaatttgactactctcgtaaaacctaaaaaagtgttgagcctcgaaggttaaactgcttggaagataatttgagaggtaagatcaccttgtaggtaatgcaccttgtaagcaagtgaactgaaggtatgatagccttaccatcatcttgtaggcaagtgaacttataaggtataatggtattggaggtaaagtcatcaccatccaggcaagtgaattcgagaatatatgatagccttgaaggtaaagtcgtcgccttgtaggcaaacaaacctaaaagaacatgatagtcttagaggaaccattgatagagagaggtactagaaaggatataccgagtcatagatttatctgtcaagactattcctctttaagggaaaaatatcgagaaagtaccaaccaaagagttagtttcgtaaggaaccatcacataggaaaaatagaaaacttgaatggttacttgaatggaagtctgttgaatattatagaccaaagcggtccacagtagacggttagtgcggttcataagagagtaacccaaacaacattgcaaccaggatgaaaggtaaaatgaaatctagcccgccaaaatggcgagggtcttccttagccagatccattggtaaagtatcagtaagtcctataggactgaagtaagaaaaattgagtttgccaaggacgaatcaggttgctatgacttctactttataagttcaatggtggaaaaagggaatctatactagtagctgactacctaacaatctgaataaggattgaaaattatgagtaaaagtatgtccgggaaggaaaacaaataaagaaaggaatgtacataaggaaaggacagagtttgcggttatggtgagacatctgaaaagctatcaagacatgtcgaatggctataggatcagctaaggaaagatcacttagctacctatccgcttatagatgagttcagggagagaaccaaagaccaccaactcggattaaaagaaattatcttaagaaaatcatggagtaaattgtgttaagtttctatttttattacccgacaagtttggggctaacttgcatagtaaagaaactcactgagttcttttgaacttatagaaatttggcttgtgtctataggactcaaagagtgatcgaggaccttgaggagggactaagtcagattgtgttggattaagaatcattgtcagtaaaagggtcatgcacataggaatgtggtacctttaaagggttcgcctcagggtcgaatatattgtatttaaatggtttcccttagagtcaaggttggagatagtaaatttttgtattaaaatataaagtttttgatgtaagagatatttatttttcaataaagtctgtctatatattattaagtttcaagtatggtacttagtccaaattggtccatttatgacattttacacccggatttggtgatcaagtcgggtgagggtgttacattatcacacaatgtcatgagatgcatgatcctaaatatatctttttttttcccatatattgtactttttattcaatttagtctctggacttaagttaagcatatatttcgagtcctaggtttggattaaaactcgatttcacatactttcattagggaacttatactttctactgctaacataatttcatgataggttttatatttattcaatttggtttctaatgttacaaagttaacaaacaagccgaactaactttatgatttagccttttttattaggggtgagcattcgaccgaatcgaatcgaatcgaatcgaaaatttttgagttaatcgagttttcgaatctcattttatcatcctaactttatttgaagttttctcgaatcgagtagagtgagatggaattcaaatcgaatcgaatcgaatatatttgttcgagttaaattttaaaaaataattttgggtccttataaccactgtcacccatcgtaataaaatttgtccaccttaatcaaaatttttattaactttcatcacctcataatttatttattaatttgtatatactagttagcttctttgcttgcttagttgtttcaattatcttcagattcttgtcactatgtattttgaaattaaaaaatatattaaatataaaaatatgatttttaataaaagttattttaaaaataaaatgtgaaattgataccaatataaaattttaacacgaatattttatggcataattaataattcaattttaatataaatattcaatatgactaaacaattcaataatataaataatataaaatgtgaaatttaatttaataatataaatagtagatataaataaaattattactatttatgtttagtgatttttttggataattttgattttttatttgagagtaaagggtgagaagtaaaagtttagggggaaaataaaaagttttggggaataaaagtttgagggaaagtaaatagggggagtaaaattttagagggaaaatattaaaaaaaaaattagaggggggagggtttggggtagatgagaggtgggatggggagggaataaaagttttagggaaaaagtgggagagagtaaaaattttgggaaaaaataaaaggttttgagggtttttgggagtaaaattttgagaaaaagtaaatgggagagtaaaattttggtgggaaatgaattttgggtagattgaggggaggggagtaaaagttttggggggaaagtgggaaggagtaaaagttttgagggaaaagtaaaaaagtttgggagtttgggtaaaaatgtaaaatattatagtttgatattcgaattatttgagttattcgaattcgaaaactcaactcgattcgaactcaaaatttgaaaaagaaattcgagttgattcgaataactcgaataactcgattcgtttaactcgaaattcgaatttttttattttttcgagtcgaatcgaattttgctcacccctatttttgataatctaagctcaatatctaacaatttcaagtctaattcatcaacttatcaggcaactcgctaaaactttaacaattgattaaattggcatatgggtcagctaaactaagctctcatgattacaaatctataaaaaaattcaagaaaagggtttgaatttcgtaccttattaatggtcgaatgttcaagctaaaattttaggttttctttcttcaatgaacaacaagaagaaatgaaggggaaagatgattatccataatcatctttcccactttcttatatatatacacaccttaattagacttaactaatcttgtttaattcagcttaatcaagcttaaattatgctaattttaatgctaatcaatctaagtggattcccaaatcatcatccactaaattatagttaagaatggtttaataaccattttgtcccttcggttaatttctatttaagtcttcaagcctttggttaattaaaacctataagcgattggacttttacaatttagtccctaagctttatttaactatttaattgactaaattgcttgatcattatataatatatatttatattaactccttaaatatttctattttatatttacggacttggtttacgaaaatgaggttctaaaactgcactttctggtactattaaaaatcgggtcgttacaataaggcaacaaatttgccttaaaggctattatatttttattatttcttgagtttgcttgtctacaaggtgacgagtttgcctccaagctatcatatattctcgaatttacttgccaatagggcaacaactttgccttcaagtccattatatcttttgggttcccttgccagttttgcctccaaactcccagttttcttgcttacaaggtggatttacccacaagcaatcttacctatcaagttatcttactttcccggctgtttagccttaaagggtttacatcttttcaatttaccttttcaggttgtgcaagagcaatcaaattacattcaagattcataatatttttttcttaattttgcaagtaaggctatacataaatttttgctaaaaagaatatctttacgtgagtaataacttatgaaaacatttcgccaacaacagaaagatgtcttcaacactattttgccttaagcaaggtcactttataaacttccattcggcaagagggtgttattattgtacatctccactgcacttgaaaggcattaccaggtcgaccattatgcatagatacttatttgctcgattagccttgaagactgtacaaacccaatttctgcccggcccactaacaaataacccagtcattacagcattaaacccaattacaaaaccagccctaacccggagcccaaaccaaaggcccaatgaccaaggcccaatttcacaaaaaaatcagcctagggtttcagaaacagaaaccctaggcgccgcactagggtctttgacccttggcctcctgacagcgccgaatctgctgactcttggcctctgccaccgccactgtcgcgccgcacctgccaccatcccatcgccacttgcacctgcagagaagaaacaacaaggaatatagaaacagaccacaaaatcggggggatttttctcttcttttttctctttgctttcggttataaaaaccgatgattgtaaaacaatggggttcgacccctctttcatgatttcaagaaataaaaaggcaaagaaaacatattcaaaaagctcttttttggaataagcttttttttttctttcttttctctttattttttttcctttcgtttgcaatcaattttttatatttttatttttgttttatttttaaacaatgtaaaaaacaaaaacaaaaaaaatacctttttaggattttctggccaccgtgtatggtggccggcgcgatggcgccgattgcccgagcactcgccgaatgctgaccggagtctgggttgaaagagagagaagggagagagttttctgaaattttttttaaaagagggatgaaatgatttttttggggttttttttacttatataaggatccaaaacggcgccgttttggaagggtca

SEQ ID NO: 3214 - DNA, 1571 bp, Zea mays
  misc_feature (1)..(100): optimal_loci_240290_G1, chr7:17240765..17242335, Cluster 19
tattttttttattttagtttctagaatgcaaattatatggtcgaaggaaggctcaatggatggcaataactgcacttgaatccggagaagattaaatatgaagatgtaattgaagattttatttcaaaaaacgtgagatacaagatactctttactagaagctaaaaaaatatcagtgagtatcatacattgctgctctaaatatttaaatgaacacagtgaaataaactttagattatttttaactttatatagtatatattataggggcccaatgttatgttttgcacatgtgccaataaaactcagagacggtcctgctctatatccaagcatcactacagttcttctagtttagtcgacaacaactcagcaacagcaacagtaactgcagatcgctggtactgagctacagattttatcattttcctctgcagcaacaataactaactttcattctttggagaagtagagcttatgaaggttgtcaagaaacactgagcatttagcatgtttgtttttaaaatcgcagttcaccttttctggctttcatgggcgtttacggtcaccggtggatctgaacatgccaactctttgcaggagcaagtccaaataagtataagtccaattgattggactcagttgcaagaaattgagtggataaagatccagtagcttggtcttctagaaggcgatgcttctgtcatgtgattttttcccctttggcacaccatttcactgctttgtggtttcttggttctgtttctttctactaattctctactctgtttggatatccaaacagacagagggtctgatgaacgtacatcactgtattcagttgacattatgcaatagagtctttaaaagctatgcatactgctgccctaatttgcctctggccatattatttctgtggagcagataagttgttgcctcaatacctctgtataaccaaagataaactattctggctttctcagtttcccttcctgatagagcactgtattgttcttttttgtgtatctattttggtttggtttttccccgactgcctatgctttgcaggttggtgcatcagcgtcaaatggaacattccaaagaaacgtatttggtggtatataagcactggttagttgatcaggtcactgggtaacagaatatatgaaaagatttcaacattttttgatgtgtattaactgcattataggctactattctttggatctcagatcttcacacaggcataccaagaaataggtctcttgcttgatcaaatgggctactggagctcaaacttcatttttttacccatgttgtatattccatatctgatcggttagagtatatactatgtctaaaagaattaagcctcttgcttgaacaaatgaactgctggtgtcatcaaattgacattcaaattttgatagaattgtatcctacatattaatggttagtgtatgtcaaaatttatttaaaatatgcttgattcatacactagaatcatagttaccatggctaaaattgccagaccaaaattctgctatgtaatcagcgtcctgaagatgaat

SEQ ID NO: 3215 - DNA, 2889 bp, Zea mays
  misc_feature (1)..(100): optimal_loci_244521_G1, chr7:41546861..41549749, Cluster 19
gaagaagaagtagacaggtttgtggctaatcctttcttattcaattcgtcatctctgacggtttatcagtacaagtatttataggccattagatgggccagattacaatcaaagaaaagccacacaatggcccagattaaccctaatgcttctagaacctcatagatctccagatctactactacaccgaactcacctctgcttcagtcattacacatgcatggtaaccaaacagtacatgctctctattaaatacatacagtaataaccaatagaaaatacaacacttttttatttaattatatgatggctatggcgccccaccagcagcaatgtatgtactcctctcattctttttgcagcaaaggcccaacataaattgtacttaataataatcaatatatgtggtcgtattattgaagaacatctcatatgttccatgcctttctcgacctcttgcgtttttcataatgcttggataaggttatacggcaacctaacaaaacaaacaaacaaataaagaaagcagtcagtagttcccttataattgatcgatcaggcggctccgtcccaataaatgaaccggaacaagaaagaaagaaagagtaataaaaggaagcatgattgcttttttttttttggcgcatagagccgccctgcaccgacctccacttccactgacactgacgacatcactctcgtggcttgcccgtccatctccatcacgggcccaccaccagcgccatttcggcccatcctgtggccacggctgccccgccctgcagcctcccgatggaatacacagaattaggtcaccatcacaggcacagtggtaaataaacaaagacagagaaaatcgtagccacactctagctagctaatgccactggctgggcagtgctgccgtgccggtggttgaatcccgtccacaaaagtgatcacgccgcgctggacaaaacaaaattccagtatattattattattattatatttagtatatattatgtgcgtgtggctacgggttcttgtcacgaaatgctagccgaactagctagatccacgacgacgaccgatcgagtttgggtgggggtgaaaaaggcgtgcctacgtgcgtgcgccgaccagaggatgagaatctgagccgaaatcacatgacatgaccggcaactgaagaaaagttgccgcgatgccgtcacgtacgtacgattggattatagtatttgggttccaatataatccgcgtactacgtatatatatatccaacggcgacgggtggtcgacggatgtaatgaacagcccatggtttcatgtatatccttggatatatatgatgggacgcagcagggacggcatgggagttcagttcctacgttttcttgcttctgtcgtggcactgaatgccagatgcttgctccgatccatgtggcatcgtactgtgccatgtgcatctacgtggcagattcatgctctgacgtgcttggttgcattgctactacagtcgtgtagtgcgccgcccaaacccgtagcaatcgcaacagtgcgcctgatctattgatttctacctactttataagcgattcttctcaacgtgttttttgaattaatataaggtatcctccaaataaaaaagccactttgtccacttctctagttttaagtgacaatttaatgaagacgtgttttagagacaatttaataaaactaatttgattatgtaggtgttaacgtgtctctctattttattagagtttggtttatggcatagataaagtagcctacgacaacttatttatgatgaaaagtgtactagtatcatggtataagaatattgttacctcaagcaatttacttcttccatttatttttataagaaacacacttgtcttaaggtccaacctcctaattaactaacaattggtcttacaaggtgtgaattttttgttacagatgagtgatctcataggatgcctcaattttgttccacagaagtgatatcattggatgcgtgtgttaatatggtatcttatataagattacaattacaattttgtcgatataagcattaaagtatacaaaaagatttgtaggtcaaattataatatttgagatggtttcatgctaaagctgagaatgaaagccaccaccaccactactaccatccgactagtcatctagagcacttctctctccatgttgcccctccccctccctctccggcgaggttgctggtggaagggagagatgactcgttatttctcatctacaattaaatagttctttaggtatattccaaataaatgtaccaatgaaaccatcacatgtgtttataagttggaaactcattatctatgagactgatgattttcacaacaagattgccgttgaaggagttaaattcattggtaggagaccaatttatatggtatgcaaggacaaagatgctcaccgacctcatcgttgatagtcgttgagagagaaaaattaacatgatagattaagagttgaagatgttgaatatgtagcatgttttgcacctgaccattcaactagcaatgttgttttttcatcgattcaaatgtgtttccgtgtaattcagaatgttggatctcgtgggttccgtgtgttagatttggcatgagaattatatgttccgtgatgctatgtccatctacaacatcgactaacaatcaaagctactcggaaagaaggcgatgaaatgaatgttcattttaacttttaaccaagatctagcccactcatttcccaaaacaaaaggatgagacgaccccagccacaacttttgagttagcggagcagttgaagcctgtgtggtatagcgtgatgcatgacttgaatctttgtgtgtttcctagccgtcttgttgtctt

SEQ ID NO: 3216 - DNA, 1717 bp, Zea mays
  misc_feature (1)..(100): optimal_loci_25102_G1, chr1:152168975..152170691, Cluster 19
taccctaaatctgggagctggaacgacatgcaaaatagccaatactatttctccattggtaaagcgacactatctagatcaacataggttatctagagggcgtcctaaaagtaaaatgagattatatgaatcaacaacacagacctcaaggcctggttttaacttgtaactgaaggtgaatgaggaattcggtgtgctgcttcatgacaacattgtcaaccagtaaaggctctaaggaaagatggatacatatgatagaacttctaggcaggaagttgcttttcatggtctagaacagaagatcctaacgacaatagtggcaagggagcaagtcttattatcagagtgctacctcctctatgtataaactgctaagtataaaaaagactcctctataacagcatatagttgtaccaaagggcattccaataaaatcatcatgtggattgtgaattgagcttaggcgggaacaaaaattgcatgaagacatgactaatattgataatggcgggagagtttggatagtgtaatagtatggcggggctaatattttgtggagggaagcatgattagtcatttgaggcatatttggagtaattttagaaccaaaagactgggaacattatttgagatcagatactgtaacaacacaacctattgtagatgaatagaggaatagttttcggagaaggaatagcaatgtgaagcatatatatgagaacagagacaccttgtggctcttgaacactgattgaaatgcaattcgacagttcgtcagttcaacaaacacgaagaaacatgcaggcagatgttttttggctagtgtagaaacccaactgatttttacaggatcttcgagagtagaaaacaaggcacatcctgtaaaatattgtttacaggatggatacggtggaatcctttagcataaaaattgttcattcatcacatacattattttcaagagtagaaaacaaggtcgaccataccttatggcgcgtgatgtaggcctacacaaaaggtgctagaattagatataggctccatacaacagcacctcatgaatctacacaatccatacatagtctaggggcataacgtagaattgaaccaatggaacacacttaaaattcatgaggcacacgtgatgaagcgcgtcaactaactgaattgctgagaaaatcaagctatgagtgtcttcttgcagaccccaccaacaataataacctatgaaggggaaggctaagcattagacaaatgtagtctagaatcaatttataggaataacatggaaccaaaccgatcatacacgctaaaaatccacgaggtacaactctgcaagcatgtcaactcaccaaattgatgaaaaggaacatgcgatgagtgtcatcttgcagaatcctccaatcgtcgcctagctagcaaggaaagagccagacattaaaacaagtagctcaactgtaattataaatggctcgctcaaatccaaagtgcacacaacaacaacaacataagcatcaattgaaagcaatctagacatcgacatatctttatttgggcccatctttatttgaccacgaagctaaagatagcagaagggaaaaaacagatgggacataatcaacaaaaaaaatacgtggcaaacaatactgtagataaaagccactcatgattcatagcacacatccatggcaaaacaaaactaatgtccattcgtcca

SEQ ID NO: 3217 - DNA, 1570 bp, Zea mays
  misc_feature (1)..(100): optimal_loci_253701_G1, chr7:105744250..105745819, Cluster 19
tgttattttggttatgtattttacctttttacacaacaaggatatgtataatttccattggttataaactgacagaaattagtgttccctaatggaagttagctgatttgcgtcatcttaggtaacttatgtcagttcccaaccgacgcttgttaggcgatggaagttagctaacttccatcgaccacaagcagctcataaaaattacctcaggtcacactaacttttatcggctaggagtaagccaatagaaattagctaacttcaactaacgaaattttttggaagattaactttcatcggcctcctacttggcgaacaaaaaataatggtttcaacacctgacaaatagatatttttatttattttaccacataaaccatataaaatacattcatccatagcacacataatgattcaagtaccatttcatttaccacggtcgcatttatcacatggaatagaatgttcaatagccaccctgggatgattggagtatgggctctacctccagaaggatcaccaaagattgcatttacaaatgtacttccaatatccatcgatcccaattatatagaccaaaatatgtgattagcaacaattagacattgatatggaaaaactaaaagcttatgaatataacaagcactaaatactcctgttgtccaggtgttggtatcaatgtaggtggaatgatgagaacatagacaccaactatatgatcaaggcccaatcaatgatagagtcttagtccatagtggagttgaagtccaatttattcgtgagtctatatgtggactgggcgtccattttagcgaagcccactcctgtagcccgaaccaaactctcgaataaattggacttcaactacactttggcttgattgggccttgatcatatagttggtgtctatgtcctcatcatggagtatgataactcagatgccattatcccactgattcctgtgtgaaatgtacaaataaggtcaaatgagcaaacttagtttaaattggtcaagtctagatgcaatatactatattttgctagtttgagtaaatttttctataatgcatcaagtaggaggacaaatgtcaaaacttagttataatttgccaattttaaaatagtactatatgtttcactagtttgagtaggttttgatataatttatctagcaagaggccaattgagcaaacttagtttgctcaaactatgtttaaacttcattaagcaagaatactatgtttgaatagtttgagtggattttgctagaatcaatgtacatagaatgcatggcttacttgaaccctaaagtctgtgtagatggactatggtaaatctaaggcccttatttcatcgacccctattaaaatatacaaatgaggccaaatgatcaaacttagtttgactttgtcaagtttagaggaagtgtattatatttttctagtttgagtaagttttgctagaatgcatcaagtaggaggacaaatggcaaaacttagttacaattggctaaatgtaaaaaccaatgctctgtatttcactagtttgaatagattttgctagaatt

SEQ ID NO: 3218 - DNA, 1471 bp, Zea mays
  misc_feature (1)..(100): optimal_loci_253720_G1, chr7:105928705..105930175, Cluster 19
aatgttacgaatttaccttttgcacttatttgagagacgactctaaatccacatcttgaaatctaaattgtagagatggctagatctagacccaccctctaaatataagaatattttctatagacggctaaaaataccgaccgtaactacataagcctttctagagacgggttagtttgaaaaagcattttaaagacaattttaatttaagctacctcgttctataaaaaggcacatctgagaatggtttttttgcggtggtgattcgacaagaagaaatcatatttttacttgcatgtcattttagaagccacttattttataaccttcttacttttctcgaaaggagactgacatgcctaatttacatcagacatctcgttatttggaaagtgtggcaatagaaatttcttcaaaaacaagttaattttatctaataagctatagctaacaacctcctagcccatcaaatcacgctcgggaccacatgccatgtcttcatcaactagacataaggctctgtttggcatggcttcaatttcacatatttctactcaactacacaattttagtggagtaggctctacatagagttggagctatctaggaggagatgtttggctaatagagtgtctctagaaaagagatttttacggctcctttgacattcttgccttttgttctatttttaagtgaaacaatttgtgtacaaatatttttaccttgcatatgaaacaaaatgaccattgaaaacgttaaaataccaacatattacatgtccattatctgcaacagtatatttcatagtacaccatgttattaatttttatctagttccaggccaaggcaatagaagtagccaaagtatcacgaaatgtatccatggtaacaaagcttgattctgaagttgatccatcagaagcatgctgcaacataacatatttattgtacctttctaaaatagtaggaacaaagtttgggtctcaatcgaaattaccgaagtcttcatcctcactttcatgcgtatgtatgaaattttgaagaaccatggtagctagggatgaaaacggtcaaaaacaatattgtctatacaaaaacgatagtcggtcagacagaaattcacctagtttcataattaatctttttattaatgactataatacgatgttgacaaaatttttaaatacgataattttcggaaatggtattgtacttacgaaaacgatacaattactaggctctggttacataatttttggtttcagttttcatccctaatggtagtaccaataatcttattttgtgtaagcatggaaaagtatggcatcttataaatgatctaccattttgtatttaatatcccaaatgagctatctatgatattacatatagatgagtgaaattgtgtagttgagtagaaatgtttggccaaacatctcctcctagatagagttggagtaggctcaatctt

SEQ ID NO: 3219 - DNA, 1779 bp, Zea mays
  misc_feature (1)..(100): optimal_loci_254676_G1, chr7:111343634..111345412, Cluster 19
ctctcccatgatctgatctaattcttgactattcgggcttgcccactggacaatccgacgataccagtgctgtcaattttagtgttcaacgttgggctacgcaaaatagtggctccatttttattatctaaataaaaaacctaaactatgtataatttatgcaaaaaaacataactatgtataatttatgcaaaaacatggaagtcaagatatctaactaagagcaatatctttccacgaatctaggagactagggacattacacagtacatgatttatggaattgaagtgtttagcaattcaataataccactatctaggtagttgcacaacatgataattaatatgttttcttagttatgaaatgctagagtagtaaagagttcacaagctcatcgacatggtaccaacacaataccttgatttagtacataacaaaaaaaaacttattggtgcaagtgaacaactactagtgcaatctattcatcaagcatatagttatctaaataagaagaatgcacacttgatgactgatgatccatgtgaataacatttgcatattgttatgtatgaagctagctcaagtcgatcttcattacattcattactatcaataaactttatcttccttcttcattacattttattaatttttggtccaccatgaaaattaaaaatagtgtccgctatttaaaaatagtgtccgctatttaaagctaaagctacgacatttagcggagatacaacggttgtagttgaaatatcatctaaaagtaaaatatcatagctttacgttgtaggaaaaggttatagcaccactatttgaaacctttttttagtgttcagactaaaacataatactctaacacagatacccgttagtgaaagatagaggccgatgatatttatgttcactttagcgaatattgtaaaattgtttaaaatgtaaaaaaacaattttaaattattcgtttagacggtagcttaagaaagtctttagttcaaaagcatctctaatgacagtttttaggcatacaaataaactcgtgaaacaatactacatgtcttcatgcgaaattactttgataggtttagggtacttggtaaatacttcctcatacataagttcaagaagtcatggtgcctttttattgttcgcacacacggtatttggattgattttgtcataccaaaggggcccctgctgtgcccgaaggcgaagctgggcgacgtcacaagcagacagtaaacttatatgtagttttttttaaagttaatcgaatatttataaaatataataaatattattattttagttgtggaatgtacttttattgaaaagttatttaaatgcaaaaatattaatatcatttatatagacttagttaaactaagagtaatgtacactagcggtgtacgaatttggcacgctctcaaacttagaaaaccgggcgaataggttctcgaactttatcagttcctgcaaaactatccaaaaccgggtttgtaaaaccggcttattgtcatagtgacttgtctatagacaccacaaaacattttttaagcaaattgatacacgagactccccgttgtcctatttaccgtgtatacagtttgacggaggtttttatcttgcttgcaggcaaaacaaaggtctgggtcctttttattaacggcgtggatgaactgatctgccagcccactaggttgtgctcttgtgggtggacgtgggtttggttttgtttctattcttctttctcgccccgaacttgcgagctg

SEQ ID NO: 3220 - DNA, 1847 bp, Zea mays
  misc_feature (1)..(100): optimal_loci_260570_G1, chr7:143234045..143235891, Cluster 19
ttttctttcgggtttcgtttccattagaatggctaggttcaacgttggcttgccaaacctatcacagcatcgcccaaattattttaaaatgttttcattttgaactgtgcagatatcatggatggagaagtttgtgcaaaagggtactcagattatagcccctgtacctatgggagttccagctacgacaggtatgggaggctttgaaaggccgactgctaagggtgacatcttgcggtcagatgcaagtgcagcgctaaatgtcggtgttctccatcttgtacccacattggatgtatttccattgttggaagatccaaagacgtaagataactgttctcatgtgtgtggaagttagttaaatttcatattatcgaaaatgaaacttcctaggtagtttagttctatttgtcaaccctgaaatgactatttaaacattaaaatgttgtagtaaaatcagtacacaaatggatctcaacttctgtttcctaaaaggctctagaattagtgctaaacattattttgcatcaaattaccagttcgtaaagcttttccttgataattattacaacaatagtaataaacaagtttctgcatcttttttctagaatgcaagaagtttcagcatatatccaagttatccaaccttttaaatcgtgataattgatctgttttgcaggtatgaaccaaacacaattgatcttgaccaggatgagttcaagtattcttctatgtctcttacttaaatatatataatagaaattgagtcctttggttatatttgagatcatcatgctaggtactggttcaagattttgtcagatcattcgccggacctcgtggacaaggtatgatgttgcacttgcaaagacatctgcatagttcatcttttatttattcatggcaatgtgttaaaaaaggtttgcaaatgtcgttctcattacaatcgtcaagccatccgagactctgttttcagtatttgccatcttaatcagatatatctccttcagtttccgaatccgtctatggaatggcatctctggtacagtcggaatgaggcggtctgtaaccccataaggctagaaccacacatcatttggagcagaaattgtctcacccttgatcttgtgttaaccaaatccattttcttaaaaatatctaacttcgttattgttgggtccttacaagtaagtatatttgtctgtaaactgccggctacttgtagtttgcaacattatacacaccacctttattggtttccacataagcaggtatgcacctggcacaaatgtttgccaaaaggaacacagagtatcccttgttaatggactagttaacttgagtaactagtagttgtttccgtggcttagcgagcttagctccttgactgtattgaaggcaatatttccacttcactatcatcacaatcaaatttacattgaacttgcatattttgggctgaggtagtacatgtatagtttttcattttgtggtaatactgtatgaatttaggatatttacctgaatatccatttcttgtctgtttgggagtaaatgggatccagaaactgtatattcttgagtcttgactaacctgtgcattctatcatttgtaggcagttgctagtgaaggtgggactgatgatgccaaaagacggggtgatgcatttgcacatgccttttctgctcatctggcaaggtaaaaaatgctattgcatggcattagttccgaggtttttgtttctttgtgtaccactattggctgtggatagaatgctagtctcatatgtcaatattatccgttctctttgctacctaactggtgtctaaggttagattgatggagg

SEQ ID NO: 3221 - DNA, 1983 bp, Zea mays
  misc_feature (1)..(100): optimal_loci_261793_G1, chr7:150053268..150055250, Cluster 19
cacaaatttcatgcagtctcctctctaatttacttgcaccaactgtaccatctttcgttagccaatccataactctttcacatatccatgcatttgtagcattctttgccttctcatttctttgcgtgcttgcacaattatgcttgatcctatgccttcaaaactataatcaaaaagaaatgcgaacaaatacaatggaatataaaaaataacatgacaatcctatgcttgcacataaaatgaaatataaaaatatatagtacctgaaatatactttttcccatcattggtcttgcaaaaatatgccatccgcatctcaacacaatgagctataaacatccccggttcattcttgtcaatgttaaatttaaattcctttttaatttcctattgacaagatttcccttatcatgtacaacaataggaatgctaatattgtcatcttcggtaccttcccaattagcatcaacaatatcctcctctctaccatcctcatcactgtcgaccaccacatttgttactataacaacatcaataggggtttcaacaccagacagagctacaacatcctaaagaacattatcatccaaataaatgccctcatcgtccacaccaacatattcaagctcgtaagtcggacctaataattcaagctcatggacatgtttttcaacaccctcttcttcaacaattggggcaggggtgacttgtgcattgctctttcttagatgatgttgcttcagctaagaaggtacacataatgatagcattttcgagttcatatagatcatggacaattgcttgctatgtaagcctccttacatcccaacattgacaaaatgcaacagatcgctctgtttaattcaagatttattttagttagctgttgtgattaatttttaaaatgactatttaccccctctctagccagctccttgaacctatcagcgtgatattctatggatttggtgatagatgatgtgtgagtaccctttatatataaacatctgcatttgtacaggatcttgaaaaaaaggtatggtgatccaccaataatgtgccgattaacatttaaagatgctcggttttttcaatctatatttggaatgaatccacaaatagatcgttgtgaggaactaataaaatgtaatctctccttttcgaattacaagtcgttttcaacttttttcgaaggatgaaatttgatggaaattatgaaaaaattataaagtttttttatatcgaaccatatatttattcgatgccgtaaatctttgtaattctatctataattttggacaagtttgatgccatagatctttataatttcctctattattttagttgacattaaaatattttgattctccaatgcaacatggttaaattgtcttgtagatttacgatggagtgagtatcaaagaactcccctcccgtacgtgatcaattgatgtgtatctcttacggttacattcaatgattaaaacatcctggtgggtctataataaactagtttgaagttgcaagctgctgcatcacacgtggctgcagcttccacgacatgtcatgaagcacaccttcagttatctttgagtgtgatatggggtcgcgccgtcacactcacaagacgtgcgtgcgtcatgacacagagtgtgcacctttattttatgtgatatatcggctcgatcgagacaaaactgaaaattgtgtagggcccggagttgcatgcttgcaacaagatgagacgtttttagtgacgacgatggggagaagaaatgggtaaccctcctcccattgcactggcggcttaaagcacaaggttttccttttgcctttgttaatttagctagaggctaggacgggaagatacggctagctgcggcctgcgggtgcaattagtttcgtgtgcacacactgttccaggatctagataaaaggacgtcacgcactaaaaaggtatttggaaaaggaaggatagagagt

SEQ ID NO: 3222 - DNA, 1851 bp, Zea mays
  misc_feature (1)..(100): optimal_loci_264497_G1, chr7:164249103..164250953, Cluster 19
ggctaatggtctgatatatgagaagatttgcctactttgcttgtttttcttgtcgagagtacaaatagcaaagatcggtgtcaactggccaactgcaaacggtgcaatgtcaggttgggtattcaatttgctcccacaacttttcccttttctcaagattttagtggttgcggtgtaactttgcttccaaacaaagaaacagcaggccaattcgatgaaagtttattaaatatataatgaaatgtctcgttgacgttgttgtgatttctaaagcaagtgtgacagagatactgctgtatttcgaaaaaattgagaaaatttacagatttctaatgctacagattaaaaaaatacgccgttgccggggatcgaacccgggtcacccgcgtgacaggcgggaatactcaccactatactacaacgactgtagatgctgctcagtatggcgtcacttatttgtcatattatcgggacggtggatatggcaaagagcgatgatggaacaagaaaaatcagtgttgagaaaacaggggatttataactttatatggaaggcgctcacgaatcgatagattttgaaggatatagacagaactcaatagtcagtaacataagagatcggtatttcatatggaaactcggctatataactgcgagctcggccaagttggcctcgagctggtcacacaaactctgaacagtgtcaaccagttcagcactatacctgtcctgctccaagttcatctgagtggactcaattgactaatgtttcttttgatgagtgagcatgagtaggagtgacttttcctcggtcccgtccaaaatttcctacaaaagatatcatcagaagtagggatttacaagatgggctaggatttagaaatattagtttttagaagtcgtcagcgtactatcgaggcttctttaactagtgttggtaattctgccaagtccaactttaccataagatattgtacaaacatcactaagacttcattgtgtttggttttagacacggtagtcttggcctcgcacagaatttcctcgataactagatcccatcacttgtatcagtcaacaactcaaaaactgcattgactacatgagggttcaatagaaatataattacgaggggcttagggatttgtggaggaatcggtacaacaaatgtcatggcagcagcagtcttctcagcccatggctttgtgggagcaagggtaggttccatgtggacaaatggctcgactaggcgatctaggaccaaatcctcgagggctccaaaggactcgacacttgttagcacttagttggtgttggtatagtatcattgtaggctcaacactgataggagcgctggtcgttgagtcctctcgagcgatagagcttgccttatctttaggtaactctattgaatgtcaacaagatcgagtttcatgtttataattattcttataataaaaatcatagctacgcaacagtcacaccttacagaattttgaagctctctagatttcagctctggtggctaagtcctctagcctctctagatcatagctattgttggcttcgagtcaccaccgaaggatgggaaggtgccctgaccgggatgttggattgggacgattgtaccaccatggaatcgaaaccataggaggaggagcatcatggaatcgaaaccataggaggaggagcatcatggaatcgaaaccataggaggaggagcatcatcgttgtcattgtcgttcgagacatcgactcatgccaccttcctcctctgttgtggcctgtggaggaggggttggtttcttcctagtaacaagaggagcctcgagggctcgctcagtgagctgc

SEQ ID NO: 3223 - DNA, 2484 bp, Zea mays
  misc_feature (1)..(100): optimal_loci_265679_G1, chr7:170942043..170944526, Cluster 19
tccgtatatagaacgagatacagagaatgttgttattagaaggtgaagatatagagaaggaaaactttagaagagactgtaaaagatagatatagagaatggatttagataacattgttgaagacattctgacagatggagtcagggaagtgtcggattgagagtgagtccaacgcccccctttctcaaagttcatgcacgtgtattatttactaagtaggtggttgtgcgttgcaacgacataaaaattattcaacaaaatgttggtgcacaacgattacataaaaacaaacatcatatatattatcgacttcaatatctcacaaatctttttgacaacaaccaatgtagaactaaactgatataaatcaaattatactataatgcaaatatcaagaagaaactaatattaaaaaataaagtctaagaagtgagtataatgctcgtgcgtaacaaatgggagcaaaaaaatatgaatatttgtttttatcctatactctgaaatcgtgctaacgctacgtcaaaacaaaatgaagtatgtatttacaaataacaccccaaatacacatcaacttgttattatatacaatagttaggtaagtgtgaactattactttaagcatcattcattatctgtttccaagatcttcaaatgggaacaatacctgaagtgtcacttctaaagaaaaccttaatttagtacactggtttaagtttgacaagacatgcactcccctcaactgagatgcaagggatgcacaaataaatataaggggaattataacagccaaaatacagagatgtaaacagaacaaaaccaagattagtggcagcagtggcgcagttaagatataaaaaattacactcacacacactacatgtgccactcgaaaagtatgagatggtgtcaccattggccacctggactctagcaattttgttttgatcatattgtagtgactatgtaaacaaatatgacacagagatatgatttgagtggagagaatgagggcaactatcgattggagagcggagatggggggaggtgaagaagaagacagctatcagcattgttgcgacatcctaaatataaccaaataacttgtttaaatgtacttactatattttcttgtagaacagtgtcacgattcacaacatttggtgacgaatgttgctcgtccactgagttgtgcattttgtgcatctttggcatgttcagatgctccatctaagttttccttgtcaatgtcaaagaactcaagcttcttcacttcttgtctagatgtctaaaagaaggttacttgggctgcatctcttttgcagtggcattagaccactcagtgctagaagtagcaacaaatggagcaggtttcttgaaatggaccacaataaccgttgtgttaccacatccttcgcaaccagatgtaggtgtcacacagcagctgagcaacttctcccacacacgggataacttatgctcctattaagttattaggcggatgagggaacaattttgatatgtaaaggtatgaaacacaacaaagttctccacttaccgtctatagctgtttgtgtacaaaatcgactacatcttgacttgatatgcaatccctgtatgaaggcctcaactggcgaatggtgactttcatgcctgagccctggcaaccagggcacctcaatgaggcgccagacttcgagtccttgttgaaaaaacaagaaagaacgttaaatcgaaggttttgaaaaaaaatattcggttaaacagggagggcaaaaagaactaaccccttgcatttggagcaattgacattgcgcgaaagagagagcttctttgagatgccattgtaaagatcttccacctgctacttccaccagacaaaaacatataaaagccagttgtcacattgataatgaagcataacataaaaaaaaacagtcacacatgaatataggtacgatacctccaaaagagggtccaaagaactatgagaagatgtcaaattgatcaacatgagatccaccaccacccattccttccttaaaggcacattcaccataattatcatagatctcacgttaaggatcaccattccttccttgttagcttgttcgagctccttgaaccgatataaattaaaaataaagtttttactctataaatcatggatcaaaaaataaatttactaggacagactgagccagctgagagagggaacatgtatcatcgcatatgccacttctatattttttgttacttaaaaaaattgtcattgtataaaccagcagtgttatggtacacaagataagcatgcaaaaacaatattattggttcaaataatgtggttgtcgtcgacgtgctgctcttcgaggtcacctgcagtcggtgccccgtcgtgacgctgcccaacaggagcccggtccactttgtgcaaagggtctgggagctccaagaagccgggagacctttcgaagccgcggacgcat

SEQ ID NO: 3224 - DNA, 1487 bp, Zea mays
  misc_feature (1)..(100): optimal_loci_266113_G1, chr7:172916582..172918068, Cluster 19
ggggagcacgacagcccatcgtgaaaactgacgctttatatagtagatagaagaagaaatattttattctaatgacacccatgggattgctagatagggatctcaagggagtttgagtttccaaactagtccttagacgttgtttctaaaaaaagtcagtttcgaagttaaggacctgtttaggaatgctctagctccaaaaaaattagtgaatttggtagaacggatcattagatgcttaaaaaatcatggagctggagttataaatctttagaaaacatttagataaatcattctatttctcatttagattaaaatatttttaaactatttaaatttatattataaattatagctacagctggattctggaaccttaagcagtttgaaacataagaccttccccaaaagattatacgcatgtttttttctcaaaagaaatttccaaaaaaatctaaacatttgttcctgctcagaaaaatataaaaccggtttcagctcagaaaatttgtgtcaattaaaaattaatctcctagcagcgtggagttatttgaatattttattgtcttttttacgactagatgttttcgctgcctgttataattagtcaacgttgtcagtccttactacctagcagcagaacaagtgacttttcggtatctaccaccgcacctctcgtatctttgtgttatataatgaatagatattatatatatactcacaatttaaaaaacaaaaatatatgtttaaataaatatatcatttaaacaagatctatctatatggtttatagaaaacacgagaagtagcaaagcccacgtgacggccttgggccgcttaagctgcatcctctttccatctgagaccgcaactaaaacatcttacgcctctgcaagagtttagcagaagcagagaattgacaccaaacaaagccctgccactctcaagtagggaagctgaaacctgcataacgaaggatcacgcgttattggcagctagcatagtgctatgagtgttcattttttttttctatctgaaactccaatatctagaattctccacccgtccagtaatctgaagtatgatcagtacagtaggccagtggttcacctaacgaagcctacagaagcatctccaccataggtgctgtgcacttggtgctgtttatttgtaatataatgggcaactaatcgtgtttgtttatatttaaccgtaatcgaataccacactagaaagtaataccggtttattcaaacttattatctttagtactttagtgtgaattattatcattacatttacgttacattttataaacaaaacggtaccttgatactatcgtcgtctctgttccgctcaaactgaaagcgacggggcctgcaatcaccgcaatagaacaagcagttcgctgagcctcccccactccccatcccactggttcaccgatggatgcagacatcgccagccaaagctctcctgtcccctct

SEQ ID NO: 3225 - DNA, 2478 bp, Zea mays
  misc_feature (1)..(100): optimal_loci_267618_G1, chr8:4411423..4413900, Cluster 19
catttcaagtcccaagacaatcagacaataacttgttatagcctgaaacatataggccagggggaataaaagtccctacacagttatatcgtcaaaaggtggcgtggtgaggtggccgatacctcgaaacccgagaaggcaataataaggatctttaagaaaaaatccttcaaatcatagtatatccttggaactaaccagaaactttgcattatttgtagttgacatgtttcaaatagacgagaagcacatcataagttaagagatctatcttaaacaatgatggcagattcagggaagatcttgggaggagcccgagcatgcaatgaaaaggaaagacaaatttcaaaatccaatcataaaaagatggaatcacgacatcaactctggttccaagatttttagaaaccatctacgtatatcacagataaggacatcatagaaccaaatattgtcgcgcattgaaaaggctcactgaaaggagtgcagaacacacaggggaaacatcatctccgccaaactaaagaacaactcgaccggtccaagtaacccatttttctccaactcagtaattttcccgtcatataaaaagtatgtgaaccattgaaactacgtatcttagataagtctatcctaattcgtttgatatttgtctattatattcctacattattttaatttatgagtaaatgcagttttcatgcaatttgatggcctgatccatgaaaaacgattctgtcttacaaacaatttaatctactcgtcattaggcttaccgaaaacatctcggtcatttactatgaccgagatactcgggggctagtatactagataacttatggatccaatttaaacatgtctttatatatatcacccacttctcatgatttttcttgaagaataaaatatgaattaggcccggactttgcttgatctggtcatcactctaagggtactagtcgatggccccgctgctaaaaatttatgaatgactcagcccgaacattgttggggtccctcaagggaaaggatgtagtatcacctacatagctttgtaaccgtctcgtgcggaagtcctgaaggttattccctatttcttacaacactttggtagatttaggggtattgaggggacatgatcacccctgttacaatgatattggactcaatctagataaaatagggctccctcaagggaagccgacaagtatcacatacatggctctgcttgttgcctgtgatccattatgggatagaaaaaattcctctcgatttggttcactgacatgacaatagattgatccttccaagggcaaaaactcttccaaaaacatctaataagctgagtccccaaacttagatcccaaattataaagctcctcagggagcatcaaaatttctaagtcctaggacctagcctctaccacaagaccctatcagggcaacaaataggttgagcacctgtgaccggtcttctgacaaaaataccttcgcacatgttctttttgggaaccttttgttcgatgaaaccaattcggtctctaactactctagcctattccatggaagaggtaccggaacatttaatagctccaaagaaaggaatgatcataactatacaaataactaagcaatgttatttaggtttacttgcaggtttcgcatgacaccatatggtcacttagtgcaacaactaatctcgattatgagaaggttatcagtgataaactcgtaggcatacatcgagtctcaataataaggtatttatgacacatggataccatttggcctagggactcggccgaccaaaaaaatcatacccatgaataatcaataaacaaagaaacccacatcaagataagttaattaaatatcatgtcaactaaaattatatattaaaagaccaaagaattcgtaacaatgtcctagtgatcaaatggtaatgtcaatatattccagaatatcggccaccgcaatttaactatcattaagaaggttgtgtaatttttggttagaacaatcaataacagccccttcttaaatatgaaaaaatattttgcaggataatgatacctggtcaaggacttgattagggtgtcatcccactccatactatcttaggaaaacatcaatattcgcttggggagcctcaccaatttctatggcaccgactaattctgtactttggaatgtgacctatataagcgatcaagcatggcatattggcgtgctttcactaagcttaccttcgcctctacaaatatttctaagttataatttaggccaaaggaagttttaagagaaaatatgaatgttgaggacatgcttaccgcctaatcttctttcgacaagttcttatcatgaagagtgagctttaacttctcgaccataacagagttggtggtcatctccctttcaagctctttcttaaattaaaccaagttctttaattattcattacaatgcaacaacttattc

SEQ ID NO: 3226 - DNA, 2730 bp, Zea mays
  misc_feature (1)..(100): optimal_loci_271566_G1, chr8:26764378..26767107, Cluster 19
cttatatcgagaatccggcctgcataatgtctcctatgattttatctttaactttcgattatgcaacctattactatcgaacaatcttttgacaacctgtaagcatatctatgcttgaaagtagatcaaggaataacatactttaaaagtgaaaatagataaaattgaagttatgctttgtttatgaacctatttagtttcgtgcatggctaataactttcatgcaaaaactgaggatgaatgaaaacttctaccacgagaacaaaacagagaaaccatggtgatataattgtgcccggtgcactctttacctcgatttgtaatccacgtcaattgcattataattttattttatctctcattgtagaaatttgcatgaagatatatgttttcatcatcatctatccattcgtatttttttgtgaaatctttcaagcactcttttattgaattttttgaacgggggtataggagcattggaacaggatatgttctcgtggttatagtattcatagatcatgacccatgattagcatttttttggcatagcctcatgctaccaattgggccagagaagccatagcctttcggtaaataagtctaaggtacaaaatcatgagaaatactttttaattttcttatcatatttccaacaaggtgacttaaaatagtaccccaataattaaaatactacatcatttaaagtgtttagaaaactaaaaacatatcgtgtcccaacagttaaacctgaaatcatatattctaaagaaaatgtttttttagaaaacaaggatagcacactagtttggagtatagtatatttaagtcactttatgttgtgacctatattttttttgaaaaaaaattgtataataggaaactgttggaactatatttttttatgtattgagctatatattttaaaatagggcactaatttaagacactgtcggacacactcttaagagaaaaacaataagccactcagccacaaacactgcaaaataaaaccatccaaatccattattgttcagacaccattactctctctctctctcctcctcggtaaaacaagatgagatgcacttgaaagacccaatgaccaaagtacaaaaccctggtaataaagaaaggtactactccagcgctggttcatttggaaagggagcccatgccccttggaatttggaggcacccacatctgaagccagttttttagtgcatccaatgaggtttaaaggtgttttaagattgttaaggagttcaaggttgcagacacgaggtgggaattggtgcaggcctccacatgcgcgcagcagctagctctgtgagttccaatccgcctcccctccgtccactgccactgctagcctctcgctgtctctgctatactgcctttggcgactttagggttagggtttcacaccctgacaaacgctagccccctctctctctcttcctcttcctcggcggatctggtgtagttgtgtagagtcttctggtcaggagctatttggtactgtacagtactgtgcttcatctcaagacggtgaagaggataaggtttaggggttgtttggtagtcccttcattttagtctatgttaatctttatattactaaaatataagggggaataaaatatatttcctccactctttagttctatgtttgtaatcgatgcaaaaatacattttgttgatgcaaatgtgtggcgtgaacgaagaacaaaaaaaatgttcctattcacagttttgctgttcatttattacttattatgtcacagaatataacgtgtagaagggggaaaagtgtcttttgatggccataagctctatctagtggaacgcaggtaacaagctcttgaataacttgttcaactcaatcaagtgcacatgcctgttatcagatactcccagtaacttgttctgcaacacatgtgatggatcgatcccatatagttacttatcaatttgagggttcttgagggcattgtatctctattatttaaatccaaaacagcatcagttagtagtatatagtatgctcctcgcggaagaattaattgagaacatcaaaccttaattatgggttaacactcgagcataatttatctagtgacacttagaagtaagtagcaataacccaaatcttgaaattgtaatgataattacgaattaataaataaaaaatataccatttcaaacagttttattgagtgcgtatatatcgaacgttatatttatgaaagaaatataaacacatatgataccagcagtagcacaggtagaaccctctttgactagacattcttgttactcagtttttagagattggtatctggcacatcttcaagagattcacgcatgcagatataccaaatatgaacaagtttattgttctgaaacagttagctaggtcaatcactagcagttaaacgcttaattactgcagacaggaagcatacagactcgcagcagtattcacaaaataccttggatcgttctaattaatttctcttcgtatcttgcagcttgcattgggtgaaaaaaacagtcacttgcgttgcgtgctaatgaacaagaaaagactcctcttttcaaatcacaggaaaaccaaggccggccccggcatgtaggttcgcatactttcacaaaccaaatgctgcggtgaacatgcggaaaagacacgctggtccaagacgcaaaacacaagtggatcacaaaatcat

SEQ ID NO: 3227 - DNA, 2139 bp, Zea mays
  misc_feature (1)..(100): optimal_loci_283492_G1, chr8:107108481..107110619, Cluster 19
cataaattttgatataactgatgcattaccacacatgtgaatcgtagatgtcatttcagttatctcccattacaaaaacagagttttctgctacttgctgcatcaacatggttaagaaaacaaaaggcaaaacatgaaaattaacatgctttttttacaaggatttgaaaaatacattctaccataaagacaacattcttgcataaagcaaaagaaactatatttataaaacattttatatgtgcatgttgctgcatatgcattcaatttctagtagaaagaccacaactgacagttgtgtcaacaaattaaaacaactctttgtattatcaagtcaaccatttctagcttgtatgtggcacgtagagatatagcaatacgtttgtgttcgacaaaacaaatcctattttcattctggttaatcctattttcaagtgaactgtgactgatgccatcaaactgatacttagatatgtcgaggaataaggtttaatttgaacaatatgaaacaaagaaatgtatgccatgttctgatgttcatgctcatttagtgaggttagcaatggcacaatacacagaaggcaacacatgaaatggtggtgagtaattatcaccataaggaattcaattagtatcatatgtagatatcaccacactaaggtagatactttgatttaattaacatccaaggacaaacaaccaagaatttcagatcctccaacgcctaatctctgatcaaagatgttgataatatttgacaaaatttcttagcatagtacaagtgctaaaaatagtatagtgggaagagtagaaaaccttaccagactcacagaacgagaatcttttttaacaatagatttcccataaacaaatgccaaagctgtaaacaccacacttattgttgtatggcttaccatcaagaacctacagaacatacaaagaacagggacatccattttatttttagcatgggaataactaaaaaataatgcaggttatggaatagaaaagataaaaaaattagtctaaaatcaattatgagatgcttgtataattatagatagtgtctcattgtacagatgacacacacatgatatggataaacaagtacttctagagacctgtaataacggatctgaaaaagaaaacagtagaagcttgacttgaaatccacaaaatactattatagcataaaattcagactgttgggtggattcaaacaaaacctgaatatataactaaatgggtttaccctccatgcatgccgatccaaaatcaattactttcactctacctgttgtttttaaactgcaaaagtcaccacttagtcatcaggccacaagatgccaacattggcatcgagaagaattaactcatgttggagctataaggatttttttggttttagatcacaatgaataatgccaacatctttcatgataatcaaggcatccaatatctgaaagaatatacacatcacatattgtaacagatacatcatgggttttcaccattatccggaagaatatccaatatcttcaaagcgatgtaggcaagttaacctaagtggactctgacaaagaaataaatccatcatggggtttcaccaacaccgagcagtatatgttgtataaatcaatacaaaacaaaggaaagaagttatggcatgcaacaaaatattcagttatgaaatactctccctattccaaacaattgacgttttgacttctctagaggcatacatagtaaacgcagtgtatcaggacaaactaaaatgtctcataatttagaacttgagtgattgtaaaactatatctaactttgcgaacgagccagttggagtccctagttcctaacataaatatatagcttggatgtgtgagatagagcagtttcttaatgttgatttgtagtaaaagcaatatttacagctaaagacccatactatatatgcaaaagtcaaagcatttcagaaataatagaccccctagacatatcatttagtcatgagctagctcaaaataaaggctaaagtgacaaatataattataatcataaatatttattccagttttataaacaagttgaccaactccacaagatatgcagattgttaacctttgtcaattgctcatatat

SEQ ID NO: 3228 - DNA, 2667 bp, Zea mays
  misc_feature (1)..(100): optimal_loci_2855_G1, chr1:14556693..14559359, Cluster 19
ctattaggtgaacgacgtacgttgctacaaagtaaacatgttataataaaatatattgaaattcagaaatactaattgctattttatgttcatgaatcaggaaaattgattacaagaaatgtgagtataatgttttgaaggtattttcttatgtgtatcacttctcctcgaggttattcgtcttccttcctgttggaggcaacatagttagtagcaaagttactgagacccaacttaaacacgtcatggttcaccccgttctctactaaaacacttgtcacttccatttttggtaactggaaataagagatgaatatatttatcagtcacgatgacatgaagacatgattaccataaaagtaacttctatgcgtgcatacatgcaattgagatggcatatatgcattatatgagtcagtgagtgcaattacaatacaatatgaccagacctacatacttacgccttatagagtgttgtatttttgggaaccaagtgtatgcaagaacccaaatagcctacactgcttgtatgtagttattttagtgtgtttctacgataatcaacttggtatatttattgaaatatgccatttgatcctaataaagccaaagtattgtttttcaatcatatagtgtagagaaaaacgagcagacccactaacctataattcagtatttttaagttttttgttctctgaagtaagcttggcatcccttacaatcataaatacttgagtatgaaatcaattagcacgtctagatacccatagcctccagcaatataatagaaaggcactaaaaataacattctagattctaaattttgtgtatagttagagaatgaggtgaaaacaatacagataagtgattactgattcaatattcctgttctcgtcataaaaacatggatttgtagggaatcccaattttcctatggatcttctggaaatgcccagtcttgtgagtccagttggagaatatttccttcatacaatgaccaagagaaaacaatataatattcaacattctgttcttacaccagataaggcatctgattcagaaaataaacttaagcaaggaacacaaaagcgtgtgagtgtgtaggatcattaaaggaatgtatcattaggtaaacaatatcatgctggagatgcaagtagtagctctagattgttcacacaaagtaactgtaactggagtgtgttgtgtgccaccgattttcttcaattctctcacaaaacttgttcagtaaatgatcagctagttgatgaaagcctaataagccttaaacacttgaagtttcatacctgcaagagagaaggttgtgttggtgatagtgctagattacttgagggagctcactgccaggcagattaaagcatagtcagcccaactccaattcaaacgtcgttgaatcctacctccaaaaaaaacaagatacacaaatggacatgagaacacaagctggaccaaacataaaaaaggcttctacacaaataaggacgttgattcctgatccacaatgtggacgaaacatttagagttgggagatccctgtctacaagtaagacaatgaatggatcacctcgaaagatgtgacgaaaccaccactcaaccccatgcaggtccttggccaccgattcttgatttaggggatgttgactcatatcctaatcaaggagaaacatcaacctagtgataatctgatggctgcaaaaccaagaaataattaactaacatatacctagtgatacatttacaaccataaaataagaatagcaaagtagatattttcccagcatcacaagcactttctcccaacaagaaagaataatgctctaattcaacacattgacatattattgtattaactcaattgcattttatttgtccatttttcatagtgtttggaaacttatagggtatacagttagatatgttacacttgtgccagatcaaaatgaaatgtgactggtcatatatcaaagtgcagaggtttgtttatatctctattttttattcaaaaacataaatattttgtactggaagctaataaattaagggttgtttgggagtgctcggctttaaaaaatgaatttcaaagatgtagatttaccatgaagcaactccacttcaaatttctgaagtttataagaattgtttggcttgtaatacaacttccacttcagaaataagatgttcacttagaaattgcctacgggaacacaaaaggggtgggggagagtgattagagccatagtttttaaggcgtccgtatggcgattattggacatataatcatcattcatcgcatgctgaccaaagcttggttgattatgccattattaaggaacagtagtggaagatggatgacataatcattactcatcaccatgttgaccaaagcagggttgattctactattatcaaggaataatcgtaaaagaatagagacatggagtaatactttgctctatacaattattgcattattgactgaagtgatgtgtttagcttattcttctgtcatgaaatggactcaatcagcacatatgtatatcgagattgtcagtaatttcgcctatcaaacaagcttgtgtcaccaaaaggaaaggtgcaaatgacaacaccacctaagtgcagttctttgccagcctttgcgcgggt

SEQ ID NO: 3229 - DNA, 2116 bp, Zea mays
  misc_feature (1)..(100): optimal_loci_290661_G1, chr8:146015414..146017529, Cluster 19
tttacttatacaaggttcaagaaggctatatgaataacctttttttaagaaatatgttgatcccaacctacataaacaagggatttgttcaaatgttcgacgtggttgagataatatcgtgcgggtaggatacttacatagaccataacattattatttgaagatcgagatcgcacctttggtacaactaaaacaaggctttatattcgaccatagtgggtctcttatttttttataaaaaatagattcagtggggataacaacacagaaaaaagctgcaacccgcttttacactatcaaacttgtagcattcatgtagttgacacatagatattgtgaattcattaatctccctcccggtggcatccaatgttgtctttttatactcatatgtgattgtgccctatcaatttaatttttgtcgatgagcatcttgtcgactttctccatgcttactttcaaaatttcatctagttgttgcatctctggcaaatcccaagtgtattcttcttggagtctatctcgaggcccaagtgagtatatcatttgtttggctatatatgacttttctagcaactcgttagggactcttacacataggaagttatcaaagttattgtcacttcatacatgcatagattttaactctaatagcatgatgttgctttgcaatttcctcgctccacaacccgaataaaatggtgcttttctatcctttctcattatatattttttcaactatgtagcactaaagaatccaccctctacgccacgtagcatatgaaaaggccatcaccagccacgataacgatagcaagtatatttctaaatgcatcatcattagtaggcaccagttgtgtgtagacacccatttcgttattagtaacgatctctttcctgattagacaagtttccttgggagggggagggtatgttagatatgattacatcagcaaaggttctcttacagaacattgtcaccattaccccatgtttattactctatattatctagtctttcacgacccctctggtaatcaagtgatacagtatgtgttccatattaataaatcaccttaattagattttgtaatctctgcattggcagtacatgtagcattgatctattgaattacatgcaaaataagctttggcgggcatgatgaggtgttgtttcccatcaagtaccacatatgtcagaccatatatccacactctatcaatcactgtgcgaaaaaggtgccaagtgtgtgaggtcttgacacataattatttttgcttcatgccacataaaaatagagtaatataagataataaaaaattagagtctttatggataacaattgtagctcaaaacaatgagttcctaggtatcacatggatgtgcccatcaaaattgaaaccgccagcccttttgaagaacaattattctactttatatcatacaaaaaaatagggagactatagtgtacgaaaataaaaattagagccttcaagaaccagctaaaacaattgggtatcatatagatgtgttcatcaaaattaaaattgatagccctattaattagaaagaaagaaaaaaaaccctactatactccatgcaagaactaaagcatcacatactaacaagcaacaaccatcaaatcaatcgtataatttgctagaaattaaatgggtttatatagatgccaatctctcggaacatagatttaccataattcgaatgcctttgacctttaaactaaggtgacaataatagggaccttcattgtcggtttgttagaacctccggtcattttcgaatttttagtaaaaaaaaaacttatcacggtttaaaagcaaaggttagtgattctgtgattggcctacattgaagaccggttctacggtgtgatatctagggtgtatttggttaaacaggttggccataaactgatatctagtgtgtattataaatgaaattaaaaatatatttatttgtaaaaaaatattaggaacataaatgtgaaatcagtttattaattaaatatattgattaagtgatattgttaaacatagtgcatataaataatatacatttggtttaccgtggataatagtttgaaccagacgattt

SEQ ID NO: 3230 - DNA, 2380 bp, Zea mays
  misc_feature (1)..(100): optimal_loci_291068_G1, chr8:148277606..148279985, Cluster 19
ccaccacagcagcacaagagaaatcaacaggccatgcatctgcatgttcttgtcctgaacacacggccgccttgatactgcagtctgcaggatgcatgccagtgaaaggaaccagatttttaacatcccagaggtgaacacaagcaatggagcaactcaagagcttacgagtcaacgagaacagacgagtaatatggacggaggagagaaacgctgagacgataccaccggccggaaccggaagagactggagaggaacaggccgtctgttggccttctggagaatgctagctatggaatggctcatggatccaaaacgcgaggaacaaaggtcttaaatagttgaagaggagggactgacatcatttctatagctagcccatacagtatgtgctgctgaccacctctatgcatgtacatttatgttgttgcttgggcgtgaataatgaagataaaatatgttcgtcatactacaaataattgaatgagtttttgatactggagtttgggtgaataatgtttctgccaattcaggagaaacttactaaatttttattatataaacaattcatttggcatcatatagtgcctttactttcttgttactttttttttgaagcacactcatatacacatgcatacgctaaggttactcctatatcaacacaagggtttaaaagttctatcttttttagcaccttcacagtacttgaactgctgcatttaaaaaaatgtatgcctcgtcatcgagggacatatgatctgccatgaaaaatagacgccatacatgcatgagagcacaattgtcaagccgaagcatttaaacctagataagcagctggtgtttcaataaagagaactaaccaagttacacactccagttggctgctgttgctgttagcatagtgacatgtgtgaaaggtagttgaagccacagccatatagcaccaggggaaaatggctactgatcaggcccaatgatatcctgctaatttttgtgggaaaacctattagttgacaacaaggttttgtttccgcttcaatcgggagacatcaacgaagataaatgaagttgcatgggcgttcaagcaggactgtgtgcctgcacatgcacaactagggttgtgaacggacggaatcagtcgggataaatactttctcgtttttatttctttaattcgaaaacggattcaggatcgaaattatctaaaacgggatcggatatgggatgtgtggatgacgaaacgaactaatccaaacagaaatgcatcggtaataacaatcggaattataaaacgaaaacaccgtcatcatacatagtctcatcaatggacaacaaatatatgacaataatatttaatatgggtaacataagtacatacctatagattgataattggtctataaaaacatgtaacaagctagtatcgatgtgtaattcattaaacagacacacacaattgcccaaacatactagtagttcacaaaagtcaaccacgtataacactataactcaaactgaaagctcaaagctcaatatggtcatcaataacattagaatcacggtcaatgtatttgttcacttcatcatcctgctcctggtcattcccctctatgtatttgtcatcctataactttgcatacataaatacgagatataattttacacatagaaatacggaacgcaccatgtgagtgagcatggaagtggacatactgactaacaacataaaacagatgtaccgtatttgaatatggtataattccatattaatacggggtaaacgaaaatggtcgggatatggtctaaaccgttttcgtttttcttattccgttttttggtaccattttcttatttgtccgaaaatacgaatccaatgcaagcgaaagggaacagttttttttttatcaacggcttacgtcctacatgcactatcccttgtcgtccacacccttctcagctccgagttcacctgattttaaaattccttgctgaagcacagcaattccaagatgaatatatgaacctcttagttctgctttccaagcaaagttgttaaattaccagtaaagtttctttttggtactttactagcatttcttggaatatttacttggaaaggctctagttaaagtagtagtagtacagagtgcaagtgcaaaaaaaaaaaaaagagagagaggctggaatggtccatctggaccctctatgtgtgttttaggcctagctagtatatagggacacgcatatcttgttggttggtaggtcattcccaatcccagtcttagattcgttagcaagttccaacaaaagcgcataatactaggcaaactcctcaatctctcatatataataactaactataagcaggctaaatga

SEQ ID NO: 3231 - DNA, 1986 bp, Zea mays
  misc_feature (1)..(100): optimal_loci_291571_G1, chr8:150540783..150542768, Cluster 19
gggagaagtccaaattactcccctcacctcacctatgaatgttatgtgtaaattattttttagtttatcttaatgctgcacatattcaggtcggtttattatacccgttaacaaagtttgccttttttatttttatgtacaaattatgttttcagtttaaatttattggtaagtagttaataacatagcttagtttttttaaaaaaatattataattttttaattattttttatatgtcagagagatgagataatatctccaatgatacaaaactaaatatgaaataataattaaaacttcttctaacatactttttaacataagttatgatacccacaatcatctcagaaaaatataaacttaaaattcaatttgtatgtggagaaacaaaaaaaaagacatctccatatacaaattaaatttcaagttcatattttttatggtgatcgaggatattataacttttgttagaaaaacatgttaggaattcttcatcgttatttgatatttagttttgtaccattaaatgtactatcttatttggtccatattttatcaaattaattataaaaagtcatattttggctaagttacgacattagctactaatcaacaaaatttgaactgaaaacctaatttgtttataaagaaataaaaaacaagttttgataagggtaagttgaaccaactcaaatagttgaaggtgcaaaataaactagaaaatactttaggggattatataaacatcgtctataggtgaggagtaatttagatctataaagccaaattactacgtctgcattgtcgtgagccatccgctatgacatccttagctctggtaggaataatttgagactagccttccatgacaacaatgttggcagtttttatcatctaaggatagatcaaaataacactacattgataaaatttagctttgttttccgttagcctctagttctcatatattaacatacaaaaattagctgatttttttatccgtagttgacagaaattattaattcttgttggcttccatcgtcctacagggtcaacaggaatttgctaatttctgtcgacagggttaatttacattggattctgcatgcaagctggcaaaactaattcttctaattttcgtcggctatggctggtcaacagaaattagcatgtttaatttttgtcggctatagtcaacgacaaaatttagtctcgatgaccactggtttaattattcacatctaccaacaatattatatatatatacacatccaatcacaattcaatcataacagatgtatattcatccacatcatatcatatagattcaaaaatacatatataacaggatgacaaatgagttatacccctcgacgtcggcgtctccaattgctgctaattgtggaggagtccaaaacctttgcatattacagttagttgagttatattgactactatcagatgattttcacctaagttaactatttttggtaggatttaagttagattaactaatttactctacaatgactaaagtttcgtcgaactagattaatttttttctagaattaagctaagttggctagttttgctaaaactaactaagtttagataggattgagctaagtggggtttttagaattaaggtcaattcgctaatttttattatagttgacataagtttactaaagatatgattacctaaggtcattaaagcatcgacagagtaaggccccattacggtggtggcaccagcgatgacatctggaacatgggtaaattaatgtttatctccatttgctacaatatattctgtgaatgaaatagatgaaacatcgataattatgttaaaatctataagtaataatggaatatcagccgagcttactcaaaacatcgcttgctaatgtgctgctatacatgcgaaaaatactcgccacacttccgctcgtagtcctaatgtcagcaaccatactcttgatgtt

SEQ ID NO: 3232 - DNA, 1776 bp, Zea mays
  misc_feature (1)..(100): optimal_loci_294384_G1, chr8:164948216..164949991, Cluster 19
caacggcgctgctgctcatagttggtgccttgagggaagccacacgcacggcaatgccttgatgtgtaaggtcccattacgtttcgttacaggagggcaaaaggatatcttttccctttcattcacgtcggatcactatctatatcccaattaacatcacatttcgatctcctttagttcattcaccatcttcttttccaaatttccttttcacaatcattaagtatagatcacaccgtgtctaataagatcccgtgcatgttgcttggactggcatcatatatgatatcaagttatcaaataaaaactagagaaatcaataataaaacaataaaacgagagttaaatgcatcggtacccatttgtgtcaaaggatgggttcacgaaccctgaaaatgcatttatagcccctaaatttgccaaatctaagcatgggcaccatgtagagcatcttatattttagtagaaattttagaatgaagtcatatatagtgatattctaggatagagggaggagagggaaaccttttttgcttaagggcgtgtttgggagcaagaaaattggagagaattaaggccttgtcacttgcgtgggaattgaaaggtttgaggtggttaaatccctttatatttaattttaattagaaaggaatttaatcatctccaatccacttcaaaccctctccgaacaagctctttggctagtggtggattgatggctgaaatccctctcaatccatttcaaaccgagcaagatctaaaagggttaaaatctcattaatattcaaaattaaatagcaaagtaattttaggcccttcaatctcttccacccctctcccaaattaaacaagcactagctaataggcaaccgcctgttgtcttttgagcttgagacataccggcctttctttgacgcaatggctgtatcttcagccatttgaagctttgacgttgccgaaagacagctaacttggagtttcgtttctgataggcaggagatacagccactgctgtggccaaacaaaaaaacagtgtgttttcttctcatgtattgtactgtacttaattatagtgattaaaaaggcactaaattgattacccaattctaaactgatggatccaaatctgggcgcaaattagagaaagacatgagctagctaggtgtcgcattccaatcgagttggttcaaattgtcacggagcacatcaacgcatggctccataaagggacaggaatggatcgagcatcttgggcaccctgatggccagatagcactgtatgatacttctggcactggcttggacgtttgcgacgagttgcttgctacgccccaaacttttcactgaaatctttaccaccactgcagccttgcatctgtaccttgtgttgttttccttgtttcgtcgggccttcagctgctctgctcatctctcagtgaacaagtacgtcatccctgtcttgctacgtccactcccaactacggaccgttgagcctataccagtcggatcgtcgatcgagagctgattagccgcgtgatggaaaacgtatatactgcatactaacgtatgtaccatgttcaatcaaaatactacgtaaaaagagtatcatgaattattatcactagacgtgtaacacaatgtaaaaagtgtatcgatatagtaacaaatgtatcgatatagtgataattgtgtgaggtatcaattaattgtgtgaggtagaacaataatagtacatccaacttggatttcttgtcttttccaatatgaaagataca

SEQ ID NO: 3233 - DNA, 2199 bp, Zea mays
  misc_feature (1)..(100): optimal_loci_294389_G1, chr8:164955950..164958148, Cluster 19
atctagcttattgaattttgattaatgattttagtcatgtgttagaaaaaatagatgaaccctctttctatgtaaggagcgataatgataggtattttttctgaagttatcgtagatagtggatctttttatcaaataagttgaaacaagtatcagttgggcagcttacgagattatgataatctgatctccatattatataatttaaccatgtttgtttcatatctagattatttaagatggataccatcgtatccatatgctattaccactgataaatgaattgggcagaaataatcctgtcgtcttctttttgtttggaacgacgggcagtgctcctgtgctagaacagaatataataatgaaaggaaagatcacgcacagcacggagcgcccctgccgctgctggttgcattgcagctagcagtacactagtacttgtacctgcaaggctgcaagtgagtgaccatcgatctacaatgcaaagctgaagaaaaattcgtgagaccatgtcattttcaggtcatggaccccgagaggatcgaatggttgttcctcgcccatcgcctggctccaaatctggtgggcatcaaccatcaatccactgtgcgtatctatgtccgccctggtctcagacgcagagagaagagaggaaagctacagctcaaattaaagctcgaaagaccaagaaacacacaatagatatgagccaataaaaaaattcgttcaaaacaatcttgaatttactctcattcctcgttcgaaagccttccaatatcaaagagctaaaaactttgcggggaacatgcagggtccgttcattttaatttcaatgtatgtggacgagattaagcaggtttagtctctaggaagtgaaaattattattgattttttttcaatcctatccaaacaacatgaccttcaaagttattgccattagatattttactgaaccacttgacctagggacaaaatgatctatcttgaggatcttcatgactttgtttaacttcgacagaagcttcgtgatgacaccatgtgtcacctcctgttaccacttgaattttgaggtccaaactcataaaacatttgttcggtggtttttagacctaaaccatcaaacccctcatgagtaatatatcctttatgttttctctatgatctcgatgtgtgtcaccacttgatcacaaagtcctctagcacgtctctgcttaccttggtcaaccactgtattaacttggtcaacatagcctgctcccctatgtataatctgtacttgtagatgtccccaagtatcatcacccacactcagtcttctagcctctttggtctcttagtctaagtctcggcatctgttccttcaccgctcttgatctacatttaccatcgccgtcaacagtctccataatctacgcttgcacaccacatcaatgagaaatattatacaacactaactcacaccatatagctaattctaaattcaataaaaatcgatcatctgcttaataatctctcattatattacactgaacaacataagcattagaaaccatactgtgttcgcaaagctaaaggtccaaccattaccgtcatcgtgaatataatggagccctatacatagctagcaaatgttgctgctgctagctgccaagacttttcgccgtagcacagctttccgtcgatctatcgatcggtcgaaatgggcctctcagctcaccctcatgctcctttccgacagatttcacttgctatatgatagctcaggttcagaactacaggccaaatgtggcgtggaatctctctggactagaaaggcatatgatagctgacaccaatccacggagaatacatggcaacccggccttttccctattaattaatataattcagcgcatacaaaaaaaatgtcattgtctgataatactcctgctagctaaaagaaacttcaaataaaatcctcaccaggatattattcctagcctcttttgtttttttgcggggagaaatatttaccatgcatgcatggctaaggaaaatataacatgtactctctctacatccacaaatattattaggaattgtgtagtttttaatacaagctagttatgcagggtagaaaaaaaatatttcatatatgatggcctctcactagatcgaagtacttggatgctcaaataatgcacaaaagttgaacaaaa

SEQ ID NO: 3234 - DNA, 2662 bp, Zea mays
  misc_feature (1)..(100): optimal_loci_295651_G1, chr8:170431414..170434075, Cluster 19
gtcaacgcgagaaccttacgagcaagccaattgggttgagcctagaatagagtcaacaagtgttaccaaattcttactcagcacgcgtgggctcttcccatttttggcatcatctatgttacctgattggttattttaccattattattagtggtttcagaattttgccaccctaagaaccttaccagcaagccaactaggttgagcctagaacagagccaataagcgctaccaaattcttactcaacacgtgtggactcttcccattttggcatcatcttcatcgcctaattttttattttgctattattatcagtgggtacagtattttgccccaccgataaccttaccaacaagccaattgggtcgagactagaatagagccaacaagagttaccaaattcttactcaacacacgtgggttattcctgtttatggtacccatcttcgtcgttcaatttgttattttgttattattatcagtgattcaaaattttatcattatatctacaaaccatagacatacacgatccatagatcataagcatatatgatataacaatgtcaatgtcaatgaactcaatagtaaaatggatattatttcatctctttttctgtcatatcttccatgctcactcctgaatcggaaacacctttgccatttaaaatatttcaaaatagtatcgccttgttcccatttctctccatgcaccatacatttcttctgggtttttagatatatgttattataaaaattgagtaatttaaagatgtcattataatccatgatacccgatgtttgtcattattcgataaaaattttggtcccaaccattatctatgatcacacgtgtactctacattagtattgtcccttttacccttcttcctcactgctcttctctctccctgttgagcgtgttccatgtcaaccccgtgctggatacgaggccagtgcgtcagctattggggacaaaaagattagaggaaatcagtgtgaccgtgcgatagagacttgaggtagaatgaagtctatggccattttcgtcttctcagacgaatcttatacgcgtgaatgtagataatggcacaaacctttttttatcgattaatgaataatgacaatcaatgtgtatcataaattatagtaacatctttagaatactcgatttttataataacatatatctaaggaacctttacttctttgaaggagatgaagcttcaatgacagcactactagacctgttcaaaagtcgggttagatcaagtttgaatcggatcgtagttcatttaacacgatccatattcaacacgtgcctagtattgggtcgggtcaacgtggtccatatcttcctgtttgatgtgtcatgttggatttttgggttgggttggttttttgttttgagttggatttttttaggtgggatcaggttaaaaaatcaagatccatatttgattcataaattgttgtgcgtcaaaaactatagttcatacaatcatacttatcccatgtattgatcggatcagatggatcgagtggcctatgagagcatctccaaaaggaaactaatttttttccccaaaacctgattattagcggcagacaaaaacttattagcggccaaatacaattttactccagcagttccccaaaaaatgaaaactgggtcagcatacatgagaaacacgagttcaggattcaggcatcatatgtttcagtatctcagtacaaacagacgaataaacactcaggataatcagctaaagcttttgatgcaaacaaaggaataaaaaccaggataatctgagacacaagtttttgatacactaggtaaatgaaatatcgacactagctaacagtttctaattatgtgagacaaatgaaatctaacagtactcagacccagaaactgatgaatgcattcaaactctatgaaacacagcaacttcaagttccaaaatgatgaaggaatgtcggcctccacccagaatttgatgaatgcaaaaaaaactgagaaacaaaaacacatgtcagaatcataaagagtaatatagtgaaagaagataaaaacaaggtaaacgaacccataaacatgctcaaggtagcagtgccacttgcaagaacaaaacaggtagaacctgctactagctggaccatcttgctccctagtactgctgaacaacagctgccaccaacctagtaactgaagataatgtaattccaaactcaaatgacagaatgtcgacaggataaaaaggaaaaaaatcaaagaatgtcagattacatgaactgcaagtacatttcttgaaagtacggttcaactagcatactgtttgctggaagatcgaacaaaacatgacgaccatcactgcctccataggaggatgcaactggatcagactcaaatctggcaacttggatagtatgtcgcaagggcctccactgctgcgccactgcggaaggctgtcgccgatgcagaccacctcccgcaaggcctggcagtgacagcgtgattaggctgacagatttgtagcggcaggaatacatctcagccaccgacatgccctccacctccaggctccaacgtagccgaatctctccctctgccaccaccgcttcctacctccgccaccaaaacaacgtacgcagcaggaaaaa

SEQ ID NO: 3235 - DNA, 2103 bp, Zea mays
  misc_feature (1)..(100): optimal_loci_298834_G1, chr9:8614624..8616726, Cluster 19
acatgaccccatacgtcttggatcgaatttcgtatcaatcatcactagacgtgagttgttatatctcatatgagtgcgggtcatttgagttgtgcagtttgagaagtacaaaaagtggataccaaataaactctctattttcgggcagttagagggaggtgagagaaatagggatgattttttggctctttaatgtatacgtataggagtgcagaatcaaaaaattcacaagacatagttctgtatctacatatcctcactaaaaagtatatagcacatccaagacttaggcctcctttgatagggttctttcctccttattatcaagaaaaacatcatatttggttgaaatatagcttctattgtagcttattctatgatgtagcgtcgaaaaagagaaaaacatgggagaagagctgatagaagctcttttttctggctcccggctccggctgttttttggagtagcttctccttctgtaggaagaactcataaaaaggctctcgtttggtagatttttttcaagaagccgtgaagaagtctttgaaggagctattaaaaagggggcttaatttgtaatattggtattggttctccaaaaccgcctggtgggggtaggatgtcatccggaacaagggatccatgatccagatatcattagttacaataaatttgtttgtcttgtgcagttatgccgacgataattattagggagaaggtctccgaccaacgatcccagataataacactaatttgtacttgctgttttaagacaagaaggttgaactggtttgaagggctactaccttcgtccactgacctctgtcggattgtataggaggtcagcctctataaatagtttagcagtgccaccgccagaatagtcaatcgtttatgaaatttgcatctggcattatctcgtttcgcctaagagcttcctaagctataatcctatatctgaagctcatgtcttcattcgtgtgtaccttttgctactcttatctgaagcttcaataggtcgcagtcccagacagcagcagttctctcccaactcggttgaaaccatcgcctaggctgctccaattgcatgcctgtgaggctgtgactcgtgaacggctcctgtaacctcgcccgtttaatccaaatgtcatgtgtgtaacatctgaatcatgctttatgatgccacatgcccatgtgtcccaaatcatggttgccagtgtgccttgaacaggcatgtcagcgtccctaaccttctactcctacatcatgaacccatatgtcagatgcgcatgcacactgaatgggcagacaatgactctcatgtataatttaatttgttgaattttgaatggtttgtcaagctagaaatattgtgcggctgtcgaggaaaaggggattccatagttccacactgtttggtagttcacaattattgccagttagcctcacaaacattgatcaaactgtttggccatttggccgcctatggatcgtagcctcattggtgtcttattcacctgccgacacaagccctgaaagcgaaacgcttggagggtccttatgaggctatgagtcgataatgagataaagaagctgctgctttgtcaggcgtcaagctgtatggttgaaacttgacagactgcatacacacgcaaaacttagatttgtccagattatgcgttcaaagtcagtcagatctaatccccatcacacctgttccctactaataggggtctaaacagtgccaatattattcgagcatctatgcgcctgaagaggctaattatctggctagataatcttgataacttatttgtaattttcggctgacactagaatattttataaatttaattgcattttaatgattttctacataaataaattaataatacacatgatagccttataaattcatggatttttttcgaaggtgtagcataagtccacatataatcctaaaaaatgtttgactcaaggaggtgctaaatgattacaagaactatgatatttgtgaaatagtgtattacacgatatccgacaaaaatattttttaccgacggtttccgtgtctgactagttccggattcgatacatgacta

SEQ ID NO: 3236 - DNA, 2354 bp, Zea mays
  misc_feature (1)..(100): optimal_loci_303563_G1, chr9:34909782..34912135, Cluster 19
catgtctctctatccttccgcccatgtctctctatccttccctctcacacagtgcaggcctgcaactttctactcatgactcctagccgccgcctcgtcccagtagctggcctgcacatgctattgattaaatctcaactagtgatggctgacactgacaacataaggcaaagtagcaatttaagttttctttgttatgatacttaacatgtgttatgaacaacaccatgttatttctcgaggatctagcatttacttaagacgctataacatatggatgtcactatgacactatccctatattttaggaagcaatgtaaaagaaaaacttggtagactggtttaacactgttgtgcaattgatttcttccttaattaagtgtttctagtatatttcccttgtataaaaaaatgttacttgaaatgctctctttatgggcaatattcctcttatcttgatgtttataaatatatggattttgtcacaactcacaatggattttttggttcctaagcagcccacttatgaatcacttttatgtcattttattagttttgcagttcagaaatgatgggaaggttttcctttttgatcttggaagcacacatggatcctttatcaataaaaatctggtaatatgtattctgaataaaatctggttttaatatttttatactttacacaatgaaacgacattgatgcattctgtcatttcaccttgtttttttaatcataaagcagtgtgatttgtgttggtattatacctgtactcatatgttgctgtactatatatttatgatgttgcactgccaatttaagaagggcagacccggtgtagtggtgagagctgttccaccgagacactagggtgtgggatcaaagcagactctctgtatttacgaggagaaggcttgccttgttttattccttcctaggtcccactcatgtgggtgcctttggcactaggtctgcactgccaatttgcactgtaaatttgcgacatttataaccttacaaaaaaattaaaccatttgtatgagatgctttgttttatgcccatacatcccatatcttttttgaaaaggtaacatcagattaatttgtcacgttcatttgctctcgtactttttacttctttgagtcacacaagggttgttgaatagtatctgcaatgctaaagctgtaatgagtaatctcttaaagttaaccttttagaatctttatttggctggcctttgtttctatctattgtttcaagttattggacttccctgtttattgtcttattatactttttgatgacatgtactgaactagcagatcaagaagaagctgtacacagagattcatgttggagatgtaattcgatttgggcagtaagtaagcttgttaactaactattcgtccattccttgtgttcaattctagagatcttgtttctattttttctttatcttccatttcatatccagaagttccttcgtaaattgcagcactgtggtgttcatttattcccaatgctatctctctagggcttcttatgtctgcatatagacaacttggttgcataccgttcttatttcagagttaagcacagtctctggtcaaatcaatacacatagcaggcattggttgtttgatatactaacgttaaacagtttttatatccttgtggctaatgcttcataacttcaccatttccttttgttttactagtgtttattgttgtgtgtttgtgtgagttttgggtgtgttgtatattttatgttcttgagttctagattcaatgatattcttgcttacacaagaaaaaataactagggtttactgtgcttatgctttacacaatatgcatattagattctataaactaggactggattatagacttgacaattgttcttcaaatgtaaatagaaagtaagaaagattgcagaaggatataatgttggtaaaataaaaatgccacttttatctgtaatttcgtgtcttgtctctgttagttcttgtattaagttaaatttgctttccttcgatgattacaagattgtaccttttgggagcctgtttactattgatctcatgtcctttttctcacttcttgggactcacttagttctatgtattaattagatcatcacggctgtacatttttcaaggaccatctgagctaatgcctccagtaagattctaaagctcaatcaactcatctaccactcttaaattttgtcatttctttaagtatctatcccgacttgcatgttgaggcgagtactacagttcctccataatcacacagaatgattcgacaatgcaacaagtcagcctgttgctatctatttctaccatgttg

SEQ ID NO: 3237 - DNA, 1456 bp, Zea mays
  misc_feature (1)..(100): optimal_loci_307907_G1, chr9:64274863..64276318, Cluster 19
gtcgaagctctgttgtactccttgcgttccttttgcttcactgttataacttcgacatttggtccttcgacatatttgttaagattaatcaaaaatggtttgttagagaaggagaccctcaacatgttctagattgagaatttttagaggctaacttttgtggtcgctttttcacccccactagtcgtttttttatctccaatatgtagttaatctataagctaatttataagctttttaaataattgttcataatggaaaaaaattagaaaattagaagttattgaattgtcaattataatggtaaagttggatgatttatatataaatttatggggtcctttttataatcagtagtaactttttaggaaattgatcggaatggattgaagctagcttattattctaaaactttcacgaaactgacaaagtacaataaatcagccaaagctgtttagtgcatgaccaagttccccatgatctccgtaaggccgtgatgtgtttcggatacctatttaattgatagttctgtgccacaaaagattcccttttgcaactcataattctcagctgagatgtctgtgcacgaggtgcccacgatcgcagtgtttttatgtaccgtaggatcacaaaggaaacatctcttaaggcttaagccaagcaagatttatataaaaaaggagctaagatctgtcagctgacctcatctcgaatataccgaccgaatgatcctatgtacgatattttatttgtgaaaaccaatcatgttcgtttaatttattcatctggagctagggccgatttgataatttgagtgtgagaatcgaaagttctagtttattgtcttcactattttgtatgttctgtttctttttcagctcatagcacagacgtatgtgtaattcttgcttccaactgaatgttcacatattttatttaaaatctattaaagacttatttgttttcccgctaattcaaatggtctggaggggatcaaactgaattgaggaggattttgattggttaagaatcaaatctttctgaatctcttccaatccaattgaattggaatttaaatgagcaggctctaattgataatttataactgttctattttagagtttgactataacttttacagttgaaacgttttcaattgtttactgagatatcatggttggattagaaaaaatggtaaattcatttcttatttgaatatgtatataatttgagaagaaaaatggaggccgtagcattatggctctaaatatggtggatttgtagtcgttcgaggaagcaattttcaggcagcccggtggctcaaggcacatcctgtacattggaggttgagagggaacacaataaaaaagtatatatcctcacttcattttctaattataatttaattcccgtatatgtacatattgtcattaccgtggttaaagaggttgcttga

SEQ ID NO: 3238 - DNA, 1851 bp, Zea mays
  misc_feature (1)..(100): optimal_loci_320153_G1, chr9:134157793..134159643, Cluster 19
taccgaaccatgggaaatctcgatgggaataggggagttcttgatcttgatgtctttggcctctagtgctaacaacagctgattaagaagactcgaaccatagatggagcatagtcatcattaaaaaggcatctaagccaacaaaaactattcatattgattttctaagaaacaaagtgtgtgtgtctcccagtttgacggttttttggatggtattgaaaccaaatcattggccttccgaatagagaaaagatgaatatctccaccggtgccactcatccaacatcactagtcattcttcccctgactcatagctgtagttattaggtcgaaagaagagatgtagagttatacaaaagcacatataatctagagatatctagaaagcaatacgtgaatacatgagagctaaaatgcataactcaatctagcatgtgttggattgaagggatgtgaaccaaattgaaaggttattgggtttaggattctaggtggccaagttttttgcaccgcccttaaaatttttctctcgtttggtttgtggtaaaactttggccatgtctgaaaatggcatgtctaactagtcatcaacttggttctagtgattaaaatagttatgacatttttggttttgttatccctaacaatattgctaaggtgacatattgtgattgattgcttcagatgttgcacttttgagtttacagtttttcggtgtgatttattttttaaaatatgtgttctatttaagttttgttacaaaacaatattttacataagtatatttcaatatacaaatctttataatatatgtggccccatataatagacaaattagttattggcttgatcacaaaaccaagcatttgtctaagttttaacgaaactaatttgtcttcacaagataatccttaatagcacaattgatttgcttgtcccatttagcttggtcgtactagtaaatcaaccctcctctagctagaatcaatgggtgcaaaacaatgtaattaattgtttgctttcatctagttagaccatagagataaactatttggttgactcactcatgtgctcctcttgcatcatcaccctcatacctaggatagtccacaacacaatccaagcccaaatgctacttgagggttgaggcaactaatttaaagtcaaacctacatatctgcatattgataaactaatccaaataactaatcaaacttacaagttttcttgagctataagagcctcttcaggatactctctataagactttttatcatacaattagaaaatagaccagaaataaagccccaatagatttaataaaccactcttggtttatttcactatcaaaaattatctttcttgctctctatattaatagagagaccacattgctctctacaattcaagatatggtagttctattatgaatgatttttcttcatgcaaatgaaattatgataaattactaaagtctagaaaacaaatcttacaagactatcaaagacacgaaaaaacatatagagagaatattcataatattacttctaaataggggtatacattgttagggacaattgtgattataccattctctgaccttgcaattgtgattttatccattgtttttcaactttatgattttacccacctgttttgaaaaaaaagaagcccccatttgctccgccagttttgaaaaaagaagcccccatttgctcccccttaacaccgttaaaaaaacgaggggtaaaattataaatgcaaagtgagagaagggtataatcacaattaacccaaaaaatcaacattttttagggttaattatgatataccattctctcacttgcaatt

SEQ ID NO: 3239 - DNA, 2440 bp, Zea mays
  misc_feature (1)..(100): optimal_loci_321267_G1, chr9:139526968..139529407, Cluster 19
gtcttgggatatattccgtagtagtactatctgtatattatatttaataaaaaaaataaaacactgcagatgcaggagacgttgcatgaatggtacacagtgatgacttcattatgcaaatcatgtcgacgacttgcatggttgtgtgtattattgcagttggattaagtggtacgagtacaagaaaaaaaaaggctcttcttttgcaactcgcaatgcattactaggatattgcggcagtactcacagcgcgggtacgtcctgccatgtgttgggttggttgactagagattgcggctttcccttggtatctgggatgtgggggaaatggatcagctgggagtacaagctgtgcatgtgtcctgtcctagggctgtccaattactgtgctgctgtgtcctcgccgaaaaacctccgtttccgatgacatgtttcatcagcaccgtaacagtatgtgctgccaacagggaaattgcatccgacagctctagcaattactcccacggttcagttcatatgcttacaatattagtcaatagtcagtactcaacggttttaatattgtgattcaaacatggtacagttagatttgtaaataaaatatgaataccatctgataaagtaataatcatgatcatcggccagcgcttctctcaaaaaaaaaaacggcgccggatcgcacgtagaggagggcttaggccatttggagttttattgtagtttcattcttattaaatgagataacatatcgtcatatttgatgacataacacggtatttatgataagatagatagatggagtttttcataaagagagagagagttcatccagatgaaacttaggatatagggttcggtgaccagtcggcgtcattttctggctttccgaagttggcctcgctatctactacgatttgtgtcgcagagccgatgagcaagccaaggccgatgggcaccatatggatcgtcgtttggaggaccagtaggcgcagaacagaagaacgtgaagaacaaggcagtagtaattgtaagacgggacggaatggccactcgtgtgatgtggcccctcagcaggctccggcccatgggcagcccacgcgagcgaaagggaacaatatcatttttccttttcgcgcggacaagagaagccaacttggatttcgccaccatttcctaatatggatgattgatacagttgacaccgttgggcatgacataaataaagcccttgtacctacgagatgaccgctatctggatgagcctgcaaccgatgctaccagagctaaataaacgttgtaataaaataactccacgaccacgaagttggctgttcgtccctttcacgcgcgcccagtcccagctttgcatagctttacaccaatcaaactctatattagtatagattggaattaaattcataccttaatctatacccaaaataatctaaaactatttgaattattttattcgattataaccatcatagagtatgatccaatggttatggagggcacgaattatatccatagctcattaggtatgaaacaaattcataaagatatcgcacaagtttatattagaatagatgaataaaaaaataactagttttaagagatacatgtattagatgatggatttaattctaccataggattgggtgtgaagtacggattcactcaatctaaatctgggttaaatctatggtggaacttcatcccatataaaggcttcattggtacagctctagagcgtacagcgaccgtacacgacacggacaaggttagctagctggagagaaggagcagagcttggcgtgctagtatatattagtaccattttttataatgccacccgcagctgacagttcaccagataacaaattttattagctacgaagacgaaggatacacacaattaatggcgtgtgtggggctggctccaaccattcaatggcttaatggcctttatcttggtggcactcaccggtacaggatatttttgatgtaccatcatggacgaaatcatcattgtcatctccttctaccatcttggagtgacgtcacatgcccgccctgaacctttttttttcttttctttttggaaccaaactgctgtatttgaatataggatgttctcctttttctcttgagacgacgtctgagtaagtgaaattggttaggtgaaaaggcgaaaagcgtgtgctcctagaaaggtaaattcgtcaggtcgccgcttttcatcacaagttcccgggggtaatcgagaaaaaatttcgtcatgttacattgttacccgtacgaagcactaatggtgtgtttggtttgtgtagtcactctatgtttaatgaggtgatacatcataaggtcattccatcaattttgttggaatcaacatactcctcatgtatatactaattattagcttatgaggaatgaagtg

SEQ ID NO: 3240 - DNA, 2482 bp, Zea mays
  misc_feature (1)..(100): optimal_loci_321862_G1, chr9:142817057..142819538, Cluster 19
cagagctgcacgaagaggaagcatggtgtccgactggccgtgcccgaaaccatcctgtctgcgtaatcatggctgggccagatccaacgggagtgctagtagcactcgatgggaatgagacgttatcctgtatttctgtctctgtctggcatgcaacgtgtgtgctccgtgatttgattcatgggcaacatgtttagtttttttttcttatctgccctgattctctgcgttgtgtagtagtaataggtactgcacactatagtatcacgttcagttaacctcctgatgcagatgcacggcatttcgctgttgcacgggctcttgtcctacattcggaatgattcttcttcttcttttttcttttttcccgttcgtcctaaaaagaaggttgcagtagagaagttttttttttcctgtagacagctggactggacggtgcttcgagctgtaaagaaccccgtagtcagcttcatttaaaccaagtgattaataaaagaactgccaaggacaggctttgaccgcagggccaagagttacagttttttaaaaaaaaaaataaacggagggacagcggacaaggcgcagagtgtacagcagtgcacagctgcaccgcagttgctcacattttcaaacggacatgaatgaatgtctgctgacgttaggcggagtaaattactgcaggccgtctttggataaagaatgaagtcatactttataattacaatttacaagccactccctaggtcgaaaatggtattttcaccgatcaagttttactaaatctaactaaaattataaaaagtttctcggtatttatttttaatatatttattataaaattagattcaagaatctatctaataatactaattatataacatacatacaccatattcgttttcttctcttttttttccccaaaaccatgccgtctctatcaatatagaaaacaaacagaatgtaacgcaataaatgtgcatctaaatcagtcacttttacaattataaatgacaatataaaataactctcctatagatgtatcgccacctggtagataatctaataaaacattaacttacatctaaagttaccaatatgtggcattattaagaacaactaaaatataccctggactcttcatctaaattgtcagcatatcatattgagtattgacaaaataaataaccataaaatacacctatatatgtatttctagatcgtcactttctaccgctaccaataataattaagttgaattgaccatatatacacgttatatatcatcatgcaaatgaaatatgcatgtgtaccgtgtacgtaaaagataaatgtatatttctactgtctaacaattgtgaaattgatcccttaatagaccacttactaatgatacctaagttcactttaaattaatattgatacttcatgataataacttacataagttgttattgtatactttctttgttctaaattataagatgatttatcttttttctagatacattatgtttactatgcacttagatgtaaattatatttagatatgtagtaaaagtaatgcatatagagaaactaaaatattttataatctgaaatggacgaagtagaaatttacgcatcttgaccaaaactttgaattatatttacatgaataacccgtttggatgtagatattcaagactagaattgggaattggaatcatgatttctgaattctactctttggttgtctaatgaattcagagctagaattaaagctcaatttcttagaattgtactttaactaaaaattgtctctcacagttcaaagccaagactctaggtattggatggaattgcaattccagatacatccaaacaacactattccaaagaacactattccagataaatccaaacaaccagaaggcatctaaaccctaaacctatttccaatactagacagatttggtattggatctaattcaattataacatcaacaatatctacatctaaacaggccctaaacactctatttgtcgcaaaccaacacaattgcaagggaaaaaaactttgatggagaaattttacatctcttattatggttagagtatattgagtcgatgacaccatgcaagtaaaataaaaacatatggcatggtgttttatctgtgaaagtgtataatatttttctctatcgcgccaagtcaaactacacatgaaaattttaccgggcgtgtgatttgtacaagattttaaatctttctcatggcaatgttacgtagcatgttcattcgaagtttttttttcatgtgactatgcattctgattggcattacgctgctgagtgctgacagtttccacaactgtgttggagtagcaaacacgtcgacttaactgaagtaccaaggcagctaaaagaaaaaaaaagtaaaggagttgttttgttttctcgaaaaaagagggaaatatatatgaaatccacatgcatattttgga

SEQ ID NO: 3241 - DNA, 3145 bp, Zea mays
  misc_feature (1)..(100): optimal_loci_322830_G1, chr9:147654122..147657266, Cluster 19
cgtcttggcaggccggcatgacagagggattattctagggagctaacacgctgcaaagtgcagttccaagctgttgttaaaaagctactgtttacctataaaacgaaacaaagggtgcaacatataaaaaaaagacctattgccaaagttttttttacgtgaatcgggtgtaagaaaaggataaatcaaagcaaaccttctccccccatactaataattatataaagagattgtcttcgaacctgcaatcagtaattataaaccttctcaccattacaatatgatgttcttatacacatatgctgcccgcaatgaatcgtacgtctaggctgtgtatggtttaagcgtacatggaattaatggctgatgctagcttatggctgttcatgacgaagaaaccagaacttcgtgaaatttatttcctttttcacatgctgcatagttatcacaattattctagcagtcatgataacactttttctatacatattatatagaaagcaactaactgatgagtggtggtaatatctgctgacttccgagggtgatcttcgttcctcatgggtcacataagcaatcatattagtacaaaagaccggataattaaaaaatagctattgcctataataaagagatcttacaggacacccatatctgagaatttcggagattcagtacaaaagtttgagatagagaacttacctatcgaaaaggccagctttcccctgcttgctttttggcgcaatccacggctgtttctatcatttaatttgtgcagaaattcagaagatatataatgtatgcatgatcacagtttagcctaacatatgtttcaaagtagtctgggttgtaggcaggggcggaccgacgtttagagtagtgggacatgcccccacacaattttttagtttagtggactttttatcttatttactataatcacaaaagtttctttataattaacccttcatttaggtctctattcagatttttggttgggtccgtccctggctgtaggtcaccgttagttctccggaaatggagttttgttcatatcaattttataggctatgtgaatatatatatgatgtgtactacatggaagctttttgttaagggtatgtagttctggtgggtcgtccatcaagaaaaaggttggtttgtgattaatgatcatatatgttattcaataattgtgacgtttaatctaagtaagctgggacccgctaaggaatcgaggtcgcaaatagccatcagcaccaaagcacgtatatagtgcatgtgtgtggtgcaagcgcatgaggtggactcgtcttatcggcatatatatcgatcaaatcgtgaaccaatcggagcgtctccaaccacaaaaccaactcgttaatcagtccactgttcggttagaatcatgcgtgccgtgatggctttaacgtctttaataacaccgtcccaaagagcatttgttcggcgtttgcattaaatactaaccggagagattttcattttcctatggtgtttcttttttagaaggaaagataacatttactcttcaaccacttcctagctagtagactgtatgatgattcagtagtgcactagtgcgagactgcgagcaaggcatgttcctgcttttaaataagtgattctatcacatatatggttcataaaatggacggtttatagtacacaaataactaactattagctcattttatttttaatgaaatgtgcaccgtgatttgtcatttttttgtcttcttaattaactcttattagccttctatttgagttttgtgcatctacaaaattattgaattagattaataaacactatatgtagtaacgaactcggatgaatacatgttaggaaacaatctgtttatgaatttccatattgatatataggtaatggacaaacaatttaataaaccttgctaaaagtgtatgtaccgttacttcaatgacaccctaaactattagtactagtaccctagtagataactcaagtttagctaacctaaacctacctaagctcctcaactcccgtaatgcttttatctcaaaaccaaaccaaccgatacctatataatttcctttttagcctaatatcttgacctgctattcgtcttgaactgtttgtccactccaatccacaattgtacagattccatttttctgatacttttggcggtattaaaggtcatgtcattgcaattcgctcattcgatatgtgtatcattgtcaacttctttttttataaaataaaactataatactttcttcattcttcactccaaactgtaagttgttttttttttctagatacatattttttccacacacatggatataatatatgcttccttcgtttttttgtatgtgtcgcgttttaatttaaaaaataaacaaagaatggaggtaatacaataatacattatatgcataacaaacgttacgtgacttaaaaaattagacccttgtaatgcaaaaacatagagagtagctaaaatgtgcaccacagttctaatcatttgaatctgaagtttcatattttcggcttgcatgcttttgtggaatgacaacgagcaaaacagagtagagaatccaagttgttcgtcttgattcagccatgtgcacacgtgttgctttccagctatagtagtaataaattgttcaaacagaaaccatcatttctttcatgtttttcttctctaataaatactgtaggagtagcccttatcatgtcctatatagcaaaccaacccacgaagcaactgttccttcaacaaccgttgtcaccgaatccacgttttttacatgctaccccactgagaatgtgatgcaccagaatcgtctgtggaaacattttaacaaacttttttctttgaaaaagagaaaatcgaaagaaaaaaggccacacaccgctgagcagtctcaccctccctgagatgctggggacagcgtcatggccacaccactcccacacaggcgcgtcgcaagcgcagggcagaagaatcagctgcccaacccaagcaaagatcaccgataaccgaagcaagtcacagaagcgagcaaaacaactgcaaaagcagcgagaggagtggggggtggtgggaataaaaaaaaaaactcaagcaaaatcccc

SEQ ID NO: 3242 - DNA, 1433 bp, Zea mays
  misc_feature (1)..(100): optimal_loci_324328_G1, chr9:154804004..154805436, Cluster 19
tgcataaataaagggtattgctttctctaaaatgaacacaagaaaagaaacatgtaaacaatttttttgatttggtacacaagaaagaaacaaaacatgaaatgaacacaagaaaaagaacatgtgaacccaaatgaactgatttgagataaaaaaaacatgtgaaaccaaatgaattgattcgaggcgtaagaaaggaaaaaaacaagaaatgaacgcaagaaaaagaacatgtaacacaaatgaattgatttgaaacacaaaaattgaaatgatcacaagaaaaagaacacgttaacccaaatggattgttttgagacacacaaaaggcaaaaacatgtgaacggaaatgaattgatttgaaacacacaaaaaaaatgaacaaaagaaaaatgagcatgttaacccaaatgaagtacaaacataaaaatataaaaaacatgtgaacacaaaataatttatctgagacaaaaaatgttcaaaataacatgttaacctaaacgaattaatttgagacaaaaaacaaaaaatatgaacacatataaattgatttgggacaaaaaaagtattcgctagaaggattgttttgagacacacaaaaggcaaaaaccatgtgaacggaaatgaattgatttgaaacacaaaaataaaatgaacaaaagaaaaatgagcatgttaacccaaatgaagtacaaacataaaaaatataaaaaaatatgaacacaaattaatttatctgagacaaaaaatgttcaaaataacatgttaacctaaacgaattaatttgagacaaaaaaaaacaaaaaatatgaacacagataaattgatttgggacaaaaaaattactcgctagaaggagggcttgaacctccgaccttgtggttaacagccacacgctctaaccaactgagctattccagcttgatgttcaatacttaactaagtcatatatattctaatgagtaagccatgtgattaggtcaccacatcaagcaatagtgtcagctccatccagatgcagaaaactcagaacgagttagttcaccttaattaggttgtgtttgtatttagcatatataataaatcaaatggaagcgactgagaaaaatgtagccataaaaaagaaaaacataaagcatggcatggcatggaatggcttcagtttattttgatcataaagaacaattaagtggataacgttttcaacaatgctttccaacaaagctgaaacaattttttccttttatcgagcggggcaatgttcaatgcccatgagaataattcctctatatttttagtgttccatactaattttttatatccaaaaggatgttctgactttaccatttcaaaaatggtttaaagttcacatgagacaaaatattttaccttatgtcaacagaagttcttatgttttaataggctatcatata

SEQ ID NO: 3243 - DNA, 1660 bp, Zea mays
  misc_feature (1)..(100): optimal_loci_32585_G1, chr1:199893755..199895414, Cluster 19
ttaggaaacatcccggtttaatttgaaaagaaaaaaataataataccagcaatgctacgttactatgtataacatcccttcttgaggccaaaagacgaaaagaatatcgatgctagaacttgcaacgagagaatgacatatctccatcagtcgcctactaaatttgcatcaaattgccagcggtcaccgcaaacggtaggtgtactttgtcttgggatacaattattctttccataaacatatacaagcactttaatatttgggagacgaagacaattattggtcattgggagttgtgtttttccggcaccatttggtgtatgaatggaaatggaagtgaccttgcttaggaattggagttgtacaattgttttcctgaagtgtaatacggatggaactcctggcatacaccgacacaatgaacaagaaccgacacaacgaatagttcttttccatttgtttatctaagatgtcatcaaggttttcggactctgtaagcgctgggtcacttctttctgctgatgctgtataaaagtactctcattttttaaaagtttttgtgagtttttttttccatgtgatgcctctggtttcttgtctactaatcactcatcgattcattatccacctttccctttgaagtcataaaacaagtctaattcatacgactggattaaaagagcattccagttaattgcatatgacttgcaaaaaaataatttcataagactaattaggaagagtattcctgttaatctcacaagactagattagaggaatattccagtttggacagaattccttcttgtaagggtcaacttatacaaatcagagttgatttcaatgctatatacattcagggttccacgtgtcattaatcatccttctccaatgttgcaattgcgaatttacccttcgtttttcaaatttatgatgttatcccttgttttgaaaacgaacttatcactgttagtgaaaaccaaaattagtaattaaaaaataaaaaacgagagctaaaatcacaattgcaaggtgagataagggtataatcacaattaatactaaaaataatattaaaattttagagttaattatgattatatccttatctcatcttcacaactgtgattttacctctcattttttatattgtaatcaccaattctgatttccactaacggtgttaaggagatgggtaaacgacggcttcgttttttaaaaataaaggggtaaaatcataaagttaaaaagcaagagtaaaatcataataacaaagttagagaagtgtataatcacaattattccaaatttaattaaataactgttgcacagctgatggcctctcattaattaatcgacaacttattttaatccatgttaacttttttaagacttaaacacctcaaagttagacaactagagttgactccagggctctgtgttttcttaaagttgatcccaatagtgttacgtgtgacattcctttgtgcagccaaagaacatagatgctaggctttttcttatgacgagaaagggcatcaatcaccaagctaatttgcagcttttgagaaactccgaaacttttgtagcaaatgatctcactcagactaaatttaactctgacgctaaattcgctaggtacaatttgttacctttagat

SEQ ID NO: 3244 - DNA, 2321 bp, Zea mays
  misc_feature (1)..(100): optimal_loci_32612_G1, chr1:199994670..199996990, Cluster 19
ctttcttgccgcgtgcctaaaaagtagccgagctctccagatataagccggtatgagccttcccaatcttgtttttgtccatctactgcatcattcgttgacacaaatgcactccttcaatcctgcctcctccctctacccatgtgccaaaaaggtgactgccactacagggacgaacaactcaacaacaccttcaagataaatcgtacaaacgtgactcaatcatgattacttctatcaatcaatttcatgcaatactattttttaagttcaaataaaggaaattgttggaggatgagctcttttttagatctaagtatttttaggaagatcctaatgtgaaggtattggaagttaaaaagtaagaaggtgttggagatgctctatggtatgacactataaaactactacaattacccaaggtacaacttgcaaaatgtatcatgtgtttctaataattatttttgcaagtcatatgaattcttgatgttccattgtttgctagtcataacaatattagttctgttgcatcagctgattactatgttgataatggcatttttcataaatatcataacattaggaatcatgttcaagcaccaatgtccactataaattctttgagtatcatgttactagaaacatacaatgtgcatatccttattcattagttataaattcatgatatgaaagaactaactatggtgactctaattatttagccaaatactctcaatttttagtaccataagcatatgttcatactcataatttggcttgttatactagtacaaatttgacaagtttatgcgaatggtaatactcatgatttgactttatatttactcctatctcaagtcaaatcaatgaaaggtgagttaatgttaatactcgtgattctaattcacatgtcactactaactctagttgaaatgagaatttagctagatattctcaattataccttgctaaacttagaattgtaattttagactctctaaaaacaagggctagacatgcggaaaatagttatgacatgcttagtgcccgctttgggataactagtgagatgttgatcatacatgagccatcaaatatgattgtaagaaaagaagctttgctagttggcataattgacaaacaaagaatcgattgggatataagtgagtgctcagttattaaagtcaaacaacaaaccattatttttgaatcaatcacatctcaagaaacaagtttggctacaaaaaatatgggaagcacaagaagctggctagagttgattttttagagctaaaggtgttatatgtttacttagtgactaccacatcatttgtgaacatcaaattatagcgaaacaatgtttggttgacaaagcatataaaagtactgaagattaaacacctaaaagtaaaaaataaagagatgaagtttgtatcacagaagtcagccatgcctatttcagcatctactcataggctagcaagaccaagtttgcatcggccaaactgacttcgcctgcctaggtcatccaggctgggttacagtcagccaagctaactttcgttgtgccttttactatacaagttgacaaactagggtgaaggtggctatgctaacttcccatgttcctaccattgtcgatgcatctatagatgattcggacactattgttgctatggacaacatcatttaaatcaaggacatacacttctctaacatgaccaataaggtaccaaatacaaatattttgctaaatttacatatattggtgatattcttgttaatagatgtaatggatcgttgaaaatgtcattttatttgttaacaataaaacaatttcagattctatcgaccaacatagtatgccatacgacaaggccaatagtggtagtgtgctacagtcaaggcttcccaaaagcaaccacaaagtttggtcaaattgactgatgtcagatctaacccatttgtttacctagatctaaagtggttttagtggcaaacagattttaaatcagctaccattaactgattcactcacaactcaaggccctaatgcccaagagagatatgtggagccctcaagtgaagacaatgtcattgtccatgaatttcaaattgaagccattctagaggacaatgatgtggtcggaattccagaagatgttagggagcaaatgaaatctcttcaactcaagcaaagaccgattagtcccattgaataatggaaaccatctaagggtcctctttggtgcatgtttatcaagatggggagaaaggagaatacccgtagagctgatggaggtaaaggccatgacaagctg

SEQ ID NO: 3245 - DNA, 1966 bp, Zea mays
  misc_feature (1)..(100): optimal_loci_326491_G1, chr10:10523263..10525228, Cluster 19
gtttgtgtgagacttggttttttttgttgaactttgctttggcgttgtctttattgatatgagatttgatcgttttaatgtgatggatgaatgatatgtgataaatgtcgaatgacgttaaatggatagtatgtgatagacttggttatttaaatgtgatggatgaatgatatgtaatgaatattaaatgatctgaatttgtgtatgtgatattgaatgatgaacgtatgctatgtgatttttatatggatatgcaggggaattctagaccctagaaatgtcttattttaggcggcttgacgggccacttaaaataaacccaatttattttcgacagccacaaccaactgccgagaatagtagactttattttcgacggtcggctataattgtcaaaactagacgtgtcaggtttatttttatcggtcttctggccataaaataacttattttcaatgaccgttattgaaaataagctttatttttagcgacaaactttcagcgaaggctgaaggcctatgtcgaaaataaatcggtagccgccaaaggctatagtgacttgtaggtgttatgttgctttttccaaacactgatctagaagatgccacaaaagaatttatgattaatttgacgtcaatggaaaagaggaaagccaacgaaggctattacagataggactagattaggctagaagagcatgagcatcattagtttgtatatattttagggaagaagatgctgaagatgaactagcagcaaaagcatgttttatcttcaaagtttactaggtacatgcccgtgcgttgcgacaggattaacaaaaattggtatgaatcatactcgcagagtaaaaaattacgcatagcaacaaaaatcccgctctcataaatattgatggtatccttgtgtagatcagaatagcatatattaccatggttgaatcattgaacatgtacaataaaaggcactaaatatgggcataaccttagacaatgagtagctaaatgttgatactaataacaatgactaaaatgatagccactatcagattgaaaatattacctccaaccaaggattaaatgccaaagcattaattgtccaaaatgtcttttaataccaccaattttagcttgcatgttttgatacattatcatcgaaactaaaataaaaaggctcttaatgtagtgaatagcaatgtaaggcaacacatctttattttcttagagggttaattgaaatttgaaagtggttcttcaaaaaataaaaaggctcttcatgtagaatgagaacacacaaatgtcatctatgtggctctgtcaaaagaggtgtttaattacatgtttattgtttttttctcagttcaagtcactgggtaagatacttcagcttttgcacaaattattgcttgaagacatggtttcccttattttttgctgtaagcagcctgtattattgcagataattttgatggatgagatgtttggataggcttggtaaccctggtggatcaaggatcgtcacctgaagctgtttgttagtgaggaagtgcaggcaataactacttactcttgatattggcccattctaggtggctcccatgataataaattgagggggcaaaaattgaaaggatgaatgacatgaaatgttttatgccccctctgtcgtgtgttctgtgtcatgctctcgatgttcattgcaacaggttgattaggaaactagttgattgaattttatatatatatagagagagagagagaggcttgcaggtttattcagttcaaagtgcaaaactctacctttttcttttttgaattcagagtttcagacatgtaccggttcttctaggaatccggtcagctgtgtacatgatatattattaggtgtttgtaggtaaaaatggtctagatggaggtggggtttttttgtacaacccacatgctattcaagcttcatgtatataatc

SEQ ID NO: 3246 - DNA, 1476 bp, Zea mays
  misc_feature (1)..(100): optimal_loci_326516_G1, chr10:10571093..10572568, Cluster 19
attaggagagacaaagatagagggttgtgaattgaacccaccaattcatccacattatatgcaacttagacaagaaaacagatcgaactacattgcgaccaacaaactaagtcacaacaaaattgaggatggaagcatattgaagaaaaaacatccaaactaactaaccaatctgcggatggagagagagcagacaggttatagtacctactgaactcctctccgcctcgtggccactcgagatctcgtcgtttcagttactttcagttacttagtatacttagtagtgtgtggtttatcaaacaaacattgttttactgaatttatattgtttagatgtctatttgtagatgtagacatcaaattgattatttaggtattaagatgccttcaatggaaaatattataaactaaaaatatatagagatatgaggtatctataaatattatatgaacattgtaacctatacgatgttacatgaaataaaacccatgatttttatagaatatttatataaatcaaggaaaattagtcatataggaagatataatttatataagaattatatttaatgataaaatctccattcttttagttccaagtgttttcttgaagtaattttggtactaaaatagaaaattataagtctaaatataaacattggatcaatttttaagtatcaagacaatctcaaatgaagaattcctaactataaagttgaaaaatatcttctctctctataaattttatataaattatatatttatctgagttcaaatataaaagatataatattttccagatccaccgatagtactttccgtcgattcaaagttttaaattttgtagtttgagaagtcaaccaatcttaaatttgactacatttatatctccaatagttttaatatttatatcttctaataggtctattatagaaatgtatgatgcttatatagtattacaaatacaaatattctttaatatatatttgatatgagatacagacttattttaggacatgagaagtagctgtatacttttttttacttagacaactatttttctctaccttgcatcaaacgatttctcatatttacacaacaaatccatatgtttcaacagataatctctcatgctgttgcaaccgaaaccaacatattatatgttacatggatatctgatgatctctaacgctgaaacagaatatatctcctttttttttgcagtatcttgctgttggatggtgtgcctcgttagttaatggactgagatgtttcgatagatgatttctcgtgttgcagttgcagcaaaaaaaaacgaagaagagatgttcctctatatctatactatacttaaaaacagtgtctttctacttttttctctctcccctcatgtctctaccttcgcgctacccgattctcggcacagggcgtaggagcaggcgcctcctccccgtattcatccgacaccagtcc

SEQ ID NO: 3247 - DNA, 3319 bp, Zea mays
  misc_feature (1)..(100): optimal_loci_326665_G1, chr10:11305464..11308782, Cluster 19
aaagcattatcttgtaataagatagcaaaccacacacaaatggccataagggaaaacttaatcactccttaaagtaccaaagaaataggggttggtaaactcatttgtacgaggacaagccaccctagactatgcctcctaaccaccaatgcttttctcttaaagaagaccctacccaacaagatcttggatgtcttgtttttcaacatctaagtgtctccaatcattaacctcagacaacattagggtcttcattttgttgatccactaaaacaccttaggtacatgagtagatgtcttactctttcttattttgcaaatgttgaggacatgatcaatttttgtgactacatgccatgttatccttgggtgtcattcttgcttcaacataagctatctcaatcacaacattcggagtagaggttactccactagtggtctcatttaccaaaactaagcatagagctttcaccaccttagaaaagcagtccaagacacaatagtatgggtgttaagcttcttggaggcaacatgatttgtccatgtccaccattgacagacctatgctagaacactgcaagccaaaaggcgcttgttgatgtagagtgcctaggaaggacacaagatggtagggtgaggtaccacacataatgatacatggccagaggctagggcttgctagaactgaaaaaagtgatatgttttctaggtaatataggtgaggtatatgagggattaaatgcgaagcactagacatagtcaatgtcataatggcaacgcaatgttctatagaagtgtcatagtgcttgttatggacctagcacttaacaagtgtaatggcctaaaatgcatgtttaaacttagtggagctaattcattattggactagtaaaacaaattggaatcatactaagtgggattgccaacaaaattttcgagtcttgccaaaaagaaaaaatagatttaagagtagcttttataaaactgaagcatgtgggtagtttcgatgtagatttatgagtgttagcttatgttagttttcattatggaaagttatgtaatttagatgtagatttaaaaattattatgttagtcttttatactagtagatttgggtagctttgtagagtaaatataaataattatccaattagattatacattatataaaaccaatggcgggatgattatataatgtgaatttctatgatttacccattcttctcaatgcatatggatcactttgttgaacttcaggtaaaacaaaaacagtcctattagtacatgatgctcttaagattagttcttctttgcaaaaaaatctacccactctatgaataacatattgcatgaacccatgagaaacaaacattataaaacttgtttgggataatgaaccatatcagagacgatatgaatgggacctgtctctgatatgatgccctatggaggttacaacaaatacatgttagagttcggttcagtctctattgagaagcaagggccatcataaatctgtaatagtgacgcatacaattgattcaatgtgttgaacttcgggtaaagcaaaagcagtccaactagtacttgattcttttaacatcagttcctctttgttaaaaaatctatttggcatgtcagtaacatatgacatacatcctatcatgagaaatgaagattatatgacttctttgttatgaagaatcatatcaaagatgatatgaatgggacctctctctattgtgatgccctatagaggttatagcagagacatgttagagtctggttaagactctaatgagaagcaagggccatcacaatctgtactagaggcgtgtacagttgatactacctctaaatagttatcaaacacatgtgtagttgatcagtctctgaatagtgttttctttgtgatttctaaatagagtattggatatttcataaactagcaattccacaagattgctctagaaaaataaatgacttgatttaatgattattttatctcacgtacagacacacatctgttgcacttcatcagttgaccgtaacaagttagtggcaaaaaagtatagtcaattatcactaccaattcaatcatgataattatatgtttcctaagtaaattggtgaggtatatgagggattagacacaaagtactagacatagtcggtgccatagtggcagtgccatgtcatataaaagtgtcatagtgcttgttatggacctaccacttaacaagtgtaatggcctaaaaatgaattttttttaaagttagtggacctaaattatccttggtaaaaaacaattgaaagcatactcaaagggtttgctaaaaagaacttttctgtcatgccaaaagaaaaagttgacttaagagtagtatttctaatagtggagcatgtgtgtattttcgatgtaaatttatgagggtaagcttatgttacttttcattatagaaagttatgtaatttaggtgtagatttaaaaattattatgttagtcctttatactggtagatttgggtagcttcacagaagaaatcgatccaattgtccaattagagcaaaactaaatgtgaaatttctatgattaaccctttcttctcactatatggttcattgtgttgaacttgggaaaaacaaaagtagtccaattagtacatgatgcttgtaccattagttgttcttctttgtcaaaaaaatatatatacagtctatcaataacatatggcataaatcataccatgagaaacaaagattataaagcttctttgtgatgaggaaccatattgggacctatctatgatgtgatgccctacagaggttacaacagagacaggacaaagcatctccaacaggtccaatcgctattcccaaaacaatagttttggggtaaatctgaaaaaactcgatccaaccgttcttgatctatgcctctaaattattcggtgcccccaaaccgaagcggcgaagcctcttcctacatatttagggtcgacccactatcacctctattttagtttcctgcagcatgaaaagctacgcgcgccatctccaacctcctagtaccgccgtcgtggtggtggaccccgaccgcgcaggcctcccacactctcgctcccgccggccggcgacgcagcccagcacgagccgctaccgatctatgggtgacacccgatgtcgtccctgtatacatagaggcgccatttcatcgtcagtctcctggcccaggtgcagatgccccaccctgaagccatcctgcctccgatctagggacactcacattggttcacacagtcagttcacataatctttg

SEQ ID NO: 3248 - DNA, 1952 bp, Zea mays
  misc_feature (1)..(100): optimal_loci_33537_G1, chr1:205234666..205236617, Cluster 19
aagttttcatgtcctttctaggtgatattaatttttagtacattcgattgtaacaaacaaaaatgttttaattgtttattaccttccacacccatggttagtgccaactttcaggtatatgttattgtagtatagagtggtgattggtcgagtaactatttattatatatatttactttgatgattataaattttctcatcctatatattgtaaagataacatagaaataattagatgtataaacattattatgtgaaccaagattttagttggattccacttaaatttaccaatagtactattaaggatctaacaccaaatgtttgacaaggaataaatacagataaagagtatcagataaaggtattatgcattaatagtaaaatattttaaaaataaatgtataaatactatactagaatatagattaatggaggaacaactattacattaccttttggtttaacaatgtctagctatatgtatatttggggtgccttgctatatgctagatttctaaaatatgccttatatatggtgttcaatgtggtgtcccattgtgtatgccatagaaaaggagaagattattatgatttcttactatgactcgagaagctagcttttgctagtccatatggctaacaagaaattgattgtgttttaaactagtgtcaacttaaaatatgttgtagtttatgttcaagggaacacactagctatgcttctcagctcgattacaacgatgagatgagaaaggaatgcatcatctaggaatgttgcatgttagggtctataataatgtccttttacttttaggcttaatgtaataagcttttgccacacgtgtaaattgtgtgtttatgatgaatcttgtaacaagaatgatatgattcatagggaatgaagccaaatattgtactcgacatcaaaaagtatatattgtgtattgttacaaatgttcttatatgacttattgagtaaaaccattctcataatatatacacatatttcttagaaaaaggtaatactttcatagataatggaagaggtaacatatactaatatctataatgactaacgaacattaaatgttctaatcattaactatatatgatagacgactatgtattaataaaatgtggtagcagattatcattccatatgtgaagaaacaaaacaaatgatactgtcagttgattttgtgttttgataaaactctagcaatagtttcctatagttgttaggcccacattgataagataccaataactttgctcaagagaaaattaaatgaccaatgagttaattataaaaatgggtaaccactttttcatcattctacaattatctattcatgacatgtcgtaaattattagaacttaataatgcaagaataaagtttcaactaataatgtaactactaaaacatatgataccactagctatgtatctacaagcttcagcagaaacatactgaagttaaagaaaatagtgcatggttggtagacaaatagatagaactaacaatgaatttactcaatatagggcaggggcgtgaagaggagtgcaaatgactatagatggactcaacaaaaaatatgacttggaaactatttggacattgttcaaacttatcttcacttgtagttgtatagagtacatttgaggcctaaggattgtttttcaccttgttcatttaaaagttatttgaatttattatatttttgtagttatcagtagattgtgcttacattgtgtatgtttatattttgacatttgtgatgtagtcataatttcactagattgccttcataaagaaaatagttggatgtttgtgattttattttcttggcttagctattttttaattgatgacacattcataagaaaataaggtattcatcacttgatcatccattgtttttcccaataatgcacaatgtgagtagct

SEQ ID NO: 3249 - DNA, 2202 bp, Zea mays
  misc_feature (1)..(100): optimal_loci_33933_G1, chr1:207022302..207024503, Cluster 19
gtccggtggcatgttgttgcatgtagttgcacccaaaacgagaatgcatttatatttgtttttccatcatatcttttaaataaaaaatttaaccatcgaatcgatttatattcgtgttcctggatttttgaacaaaattaaaccacgcgtgctatataatatttaaagatttatctattcactcttgtctaacactcattttggtgtagataaccaaatacaagctatatttgtcttaaatgtaaatatgtaataatgcaaacaaccaaataaaagtctatgcacggatttagtctgtgcacgagtccgacccctcatgtataggacaggctaccactgtacaacaatcgtatatgttttttcaaggatcgtacatgcatgcatcgcactgaatcgaacaatttgatacaaaaatcgaacacgattcatcagaactgtcttcggccatgaccacgttttttttcacaatcgggtaccatccaggatgaggcgggatgctggtgatcagggtcgtctcgaaaattttgaagtcccggtgcgaaatgaaagtagagatctaatttaacatactaaaataagaatagtagtatgtgataatatattgtcataaaggtgtgaacttagtattgtacctggtacataatattcacttgaaaattgtaaatattttttgtgttctttgaaatgaaatcttcaataatatattcataatcaatcatttctagtatgtctcccttaactgctatgacagtcaatgtattaagtctttctggtgtcattgtagagcgtaagtaggactttaatgactttagcttaaaaaagcttcgctctgtcgatgcaacagttgacgaatagtcaaaagaactctatatgcaatggttgcattgggaaaataatcatgctccttcagaaaattttgaatttcaagaggaccaatatttttctgtggaataaaatcttggagaaaacttaattccacgtataggtgatttgcatcaatatcagattgtccatcttttaaagtgcatcctcaagatgatgacaataagattttaaactctttttatctaatgactgcaatgcatcacaactaaataagaaatcaaatatttttttataaccttaataatgttcaattctccttgtgagtgaagaaatagcttgagcaacaataggtataaaatagattattctaaatgattcctcttcagactgtatcgtagcatgtgttatctggattctcatcaaaatgtctttttctcttaatttgtcacttcatacgaaatgtactaccaatatccatgtcaagcaatttcttttgcctcctctaaggtttttatgaaaccagagtctattggttaaaggaagaaatcaaaccctgcacttcccaataccaacatcaatgaacatatcctttgattgcaattccttgcttactagattaacatcatacaatacaagaggtcataccaaatgactattgccactataaattcaaactcttcaagttcattagttgctaaagatttagcctcactacttatcactggatcattatcactattagataattgaagtagaacctcccaaatatttgcacattgaaacctgatagctttaacactatcaatatgactctcccaacgagtagctaacactgactttagagtcaatcatgtaatgttatctattatctttaaggatttgctatctcttagtagaattagtaaaaattgtgtagacgtgttggatgatccaaaaaactttagctttaccacaactcttggtcatatcacaaagtgttaaattaagactacgacaaccacaagcaaaataaacagctctaggattaatattcgaaagttttcctttcatatttgctccattatcaaagcctagcctagcacgtacataatagaaattagaaaataagaaaactatcaaaagtcatatctcatattgagggagctcgtccatgtctccatgaacaaataaaacattctaatatgctacgaatcacatacaagttgaactgcaggatcgcaggaacagagtgcggaggcacacatccgacgtcccaagagcggcgacggcgtacaggcaagcgacgtataaacttctaggtcatgacttaggaacattggcataggagatgggaataatggttctggccttctggaattttgtacattttttattaaa

SEQ ID NO: 3250 - DNA, 2743 bp, Zea mays
  misc_feature (1)..(100): optimal_loci_34049_G1, chr1:207624501..207627243, Cluster 19
aaggacatatgagaaagcttacgttaaagtacaagatgatgaatatgatgctaatatgcagtttgctctacattagtcacgactcacgggaggagcatgattacaaacaaaggggtagtggatctaggtcgagccaaagggtacctcaagggttgggctcaaggatgatgacaaaggactgatcacaaattccatagggcgtaagaggctacaatcttggttctagctctagcccacagcaagaggatagatattggcccctgaacaagagtacgagttcgaaaggcttattggaagggcttaggcaaaggattgtcatgccattgacatacctggtcacaacgcgaatggccctttaagacaacaatcatagagactcaaaaacaagttaattgatgcgaacatttttattgtatttgatatatcttgtataaatatggatcattactagaaatgcaagtattagtgtcaccatacccaccgaaagagggattgatagtaaatatttgaatcaaaagataagagtttcaagtagagaatgataactaagagaatgattagaccgagtttggtgtcactctcatgtgtaattatggactaaatcaacacacaatagtatcattagtgttttgatttattgcaattacatgatgtatttatgaaagtcagtatatgcaactagagcttcttaagaccatagatttataatgcaggtaagttcctttttgggttgttacttgatttatatttgttttaattttcataacaaaaccccaacatctaacataatcgtattttatgtgataattatatttaaaataggcacaaattcaaaatgaacaaatttaagcattagagaatgagaggcaaaccgaaatttagcaacaaaatccaatgagataatggcaaatgtcgaacaaaaacctcagcttcttgccaaatctgtggccggaacaagcgtgtgggcaacgttgagccagggcaaggaaccgatcgagcaggcgacatctgatgtttctcacctaagaaatgctatcaagcaaccaaatctcgccgctgcacaagcgaagacgatgagttggttgagttcaagagtgtggagtgaggcgaaagaggtagggctagtggctttttatgtaaatgggctaatggtatacccatgggttaacagattcggttgtttttttaactgcctaatacacttatatttaaatatgggatatatcagaatactcagaaaaaagcatccaatttttaccataattttttctgatttttatatttttttaaaaaatgaaacaaaatttgccaaaacaggaggggggaaacgtttctcggccaggaacgaaaaaacacagaatttattttggttaggaaatttaaccctgcgggcgaccaaggcttgaaagcgcaggagtgccaaggcgctaggcgcccaaagatgttgcaacgctctccgtccatggtggtggatcaggtgacctccaccgacatgacaaaagagcattgtacacaacacgaatagtgtgcaaagttaactaagatcatgtcatgcttaccgatgatggtacaggtggggccttcgtgcctctgttctccttgctcttgaaatcgaaagtgttgatgatgaacgatcaattgaagaaagtgtaaactataattttcattgatctctgaaatatatctatacattggaaaaaagtgtaaaatataattctcattgacctctgaaatagatttatacatatgcataagatgtcttcaacagacacttattggaacaatttgaaaaaagaacagttgaatgaatggaaagagataaaaatttggggggaagagaacagttgaatgaatggatatgtcccatcagagacatggttaattgaccaaatctatctctagttgcatgtgaatgaatgagatcatcatttgaaaatgtgtctattgacatcaggcaccgtttcacaacattgcaaaggcaaattagcacacaccgaaatatagttactaatgcgaatgctaaaacaactggagtaaacacacaagcaaaagaccatgtacaaagttgtaaaggaataagcatacctattgggtaattaaattgcacagccagtttcaacacatcatgtaaagcattcataaaacattccatccattaagaagcaataggtatatactatatagtaaccatctgagaatgaatacgaataatgccaataatttaattagcaaaataacgtgatttggcttatccatctttagaaagacagatgaaagaaatctaggaacagaagacttcccaagtgacaagtaggggatctaaattaaaccagaagttacatgttctagaggagaccatttcaacgcgtaaacacaactaaactttgtattacctgactatagatgcatgactgaatagtgaatggctactttgaagctgcttatgattggactggtattgctgcatagtgcataccctcaccaaagaatccagcgctacaagtccatgttatttgcagtttagaaacacatgcaaatctaaatactatctccatcccagaatgtaccacattcattaactttgcatcttgaccaaatatatcagttattgtgttatttctcacaaattactacagacatcccaaagctccaaagcagttcacactaactgggaccagcaaaaatcatatcaaacttgaggaaaaacactttacaccttcaagaaaaatgtactcagatttat

SEQ ID NO: 3251 - DNA, 2101 bp, Zea mays
  misc_feature (1)..(100): optimal_loci_34083_G1, chr1:207726698..207728798, Cluster 19
ttatttagcgagctgctctctagattgatagcccttggcaggataacagctagctagcacggcaatccgatcgagaagatttgattcccctcatcgttcgttttggtcatagttttatcggtcggcatgcaggcaggcaggcacgtacgctgcacgctcatactccagcccacgcacccgggccggcccgcgcgccatgaaaaaaaaaagaacagatcaaagcggagagatagagagcgggagatggagacgcgtgcatcgaatctagtctagcactgccagatcccgctttgcgctgcacgacgtagatcgataggcttcttttgggcgggcgttcaaagttgctcttgctcgcgtcgcgcgcgcagaggcgattctctctcttcgcttagaaagctacttgtagcatttcccttcccaagtcaaagacgccgacgcggcgccctattcttgggctttctaccgttctacgtgccccccctcctttctcgtgatactgcgttcttttgttgccacgcagtgttttgcttctgggtttagtttactactctatttgcattgaaattgtaaatcattctagcttttctatcttcgtttaaattgtaaaatattttaactttttatacacatatctttcttatatatatttaggcatacactatattttgatatatatatatataagtaataaatctgaaaactaaaaaaatctatgatttagaatatggatggaatagtttagaatgcagagattagaatctgaaaactaaaaatatacgatttaaaaaatcatcatcatcattgttgttgttgttaaattagttatgaaatatatttttattgtaaacatattgatactattttctgaattttatcaagcttagaaaagtttgaacaagcaatcccgtgcttgcctagtgggcctcgctcgtggtttgtgacttcgtggcctgacacagcatatgatctacatgccaatctgtgccatgcctggctcaaccagtccgtgtcgtgctttagcgggttatgccagacgacctatttagacatctatagatcttctttaaatatagaagtaccttaatctaaggccttctttggctgagtttttcaacttgctttggttttttttataaaagccaatcaaaaaagagttggctcccattaaaatccacaaccaaaagcagcttttatccagtataagtttgacaacaccattacttctactgtcacatgcttttgaatttatactatttacaaaaattgtttgcatgtcactagttatagaagatatcactttttccatatacgtgattgtttctcatcgcccacaactatagtctggacagcaagtcgtctagaacactagggcaccccggtggtggcatggtcaaccctagtggtggctcaatcgatgtagcgtgatgtgtcacagcgcgatgtgggcggacccagtggggacgaggcctgctccaacacggcacagtaagccatggtggcagtgcatctagccctaatgaaggcatggataacattggcatggcgcgacctgtcctagatgcgtgtgaggagaaagagacggacgacctacactgtctataagagaaaaaaggggtaaattagcgaggttcgcttgtcagtgacagacatatttgagtggtgagaaacatggatcatatatatggttcactttaaagttttttttcgaaaggcaccgttctcaacctaaatagctcttgactttataataacccatataacacaacagcgttttcacagcccacatctcatagcagcattttcaaaactcacaactcaacactacaacacttgtgaccttctatgacgttttctttatgtcaccaaaccttgaatttatgtcatccatcatgaaattcacttcatcacctatcatgcgtagcattgcatcatctgtgatgtttcatgattttttgtcataaatttagtgacatattatatgtcgtcatagtttcgtgacacactattttcgtcacttaccatctctaaaaaacgcaagatcatgcttccacgtagggtaaaaatgtcataaaagtagacatacaaatgacatggcatgaca

SEQ ID NO: 3252 - DNA, 1907 bp, Zea mays
  misc_feature (1)..(100): optimal_loci_347279_G1, chr10:134077683..134079589, Cluster 19
tgtggtggcaaagtgtttggattctagtagcattcgtggagatattaagcaatgctggagatagttatctatttgtggccctcaaatccaaaatatgcatactatagctgtttcaactgtttgctgggctatttgcaaagctcataatataatgtgctttgagaatgtgttgatcaagtcaccttttgagattatctactatactagtgcgttgatgatttactaggcagggttaagcaagaaggagcttcaagacttgattcaagaaggcactaagttactggatgctcctacggaccatggggacactaatgatgatgaagcaagtgaagattagttccccttgctagttgggtggtggtcgtggagttctcttttgtctggtggcattgtatgcctgctcatgaatgtttcatcgtttcttgtttttagctcctgcgtgagcctttcagtagcaaatgcgtgctgtcttatgcgggtttgccactttaaaaacttagtttgacccttgtcgtgtgttggccgtcctgaatcaaggtatgtccctttggctcccgcttttggtaatatccttagattcttgtaaccaatttctatcatagggagttagtctattggtctagtcctttcaatgtgcactatgttgtatttctgttatgaaaataatagaaatgaggatctcctcttataaaaaatttatcaccagatgtaagataagcatttgttaaatttactaacaagaataataaatccttttactccaaagcaaattggatagagttgaaacccaaccgaagccataaatcagggtttagaattcagatacgtagatagttgtttccattcacttctattcaatactgaatctatttttttgttaaagtcaccaccacttaggccaaccagactagtctacagttagctaggatggaatgaagtcgatctgactgaattgtctaaagacgacatggtcgggtttggaggctgcccatgcaaaatattagtcactcggtttcataatcaaccaactctgattcagacacttaaacatctgtcaagttatctttggaaccaggtgaagtcacatgaacaaactcctcaacactagacctcacacaacagagtcaatcaaaccataaacaaaactaaaaacaaattcacatcttagaaagctacctttgtgaggttcacaagtaaaaagcataaaacttcacaaatctcacaaaagcaaaatttagagtcttcgcataagaagcttcatttcaaaaatcaagcaatgagagctattgttctcaccaaagcactagcaaacgatgacccataagtgttgtatatataggcgacttcggtgaaaagtgattatttgaattctttatatactcgacttcgatcaaacttgaccattacaagtttgaaatcgaaattgttcactttttcaatgaccaactctaaagctcgaggacattgttctacctttatataactaaacaattctatgtaacaatctaatgttgttttagactttatataggtaaacctagaatatgtgtttaggttaaaaagatttagttacccttatataactaaacaattgtatgtaataatctaatgatgttttagaatttatatacataataacgcgaatgtgaaacctagaatatgtatttaggttaaaaaaagactagattgcccttgtacaaatgaaggaatatatgcaagtaaacagagaatacccttacatgaccaattagttgtatgcaagttgccatatattagtccaagttcagtaaacttcttccttcttgctaagatggctatagagtgtcatggtcgagataataaaaaatattttcttccaacctgctattttctttttatgcctttcaagcattcttttgccttttcag

SEQ ID NO: 3253 - DNA, 2139 bp, Zea mays
  misc_feature (1)..(100): optimal_loci_348016_G1, chr10:137774111..137776249, Cluster 19
ttttctatattattattagagagtaaaatttagaaagatggccggagatgctctggtgttggtgctgaaaccacggaagttggatagtttatcacatcatttgacagacaccatgcagcaggaaattcgacacaaaattcacgcggcagcgccgttccgcgacctgtgtccaaattgctaaagttaatttccgcttttggccggacaagcaatatatacgaaccagattttcgttaaagctctcgcgttgctttcaggaatcaggacagtcaccagactaagaggcgaatgaaatatacgagaaaaagaaagggacgattttttcgtttcccgggcttcactaaataatctttatctttactatattaaagtactagttttaatgatcgtcctgcgttaatattttttaaaatgatctctaattttttaaaatcaacctacacttctataatctcttctctattattataataggagagtttgtgtaaaaaataagttgaaattatatataagtgagtgtttcaaccttggttgttggctctatattcacactcacatataattaatagaaaacatatattttatgactagtgccataaaatatttcacatatactcgtgtaaatgttagtaattattttagggttttttaaattggtgctcttagttttggtggtgtgctcacgtatacccttagtcgtgttttttgctgggggtatatgtgagcaacgtgcttggttaagactccgtgagtgcaagcgttaatggaatggttaccgccgtgattcaataaactgtttggtgacccacagtcccggaggatccagcccatttcctggcccaaaaaaccacagaccgaattatcgccgagacttaaaaaaatgtgtttggtgaccacgctctcgatccgatccgcgggagactttaattaaaccagctaattttactccacctatatattaagttgtcgcagaactgctaccgctgctgtgcagataaatatcagcgcttatctttttctttaaccgagcaaacaatagccacatgagatagcccaagtaaaaagaaccaaggttaactgcaaagaacgacaacgcttctatctttttctttttccttaggacgcatacaaatagaatggggatcaataattcagtaggaagcatcttactgcagctgatatataggtgagcacaccaccaaaaccgagggcaccaatttgaaaaatccgttattgggttttttaaattggtgactgtagttggtccagacttcatcttgtgggaaccacatggttcacatcctgccgctttggtaattgcataattcattgaaatcctttgcatggtccacaacttgtgtgggtttagtttcaaacttcaatttttcagtattgtttaagaagtccttgcaggtcgaactggtccagcacactatggagaattttatagtgctttgtatggtctttatatagagtttatgaactctattttttgttggatggattacaggatatgattttttttaccaagtctgttactttgtaggtaatattacatgtagtaaatgctgaaactatactttgtaatgactagcaaagatgtaggttactttgtagattttgatgttaagcttgagagtgttaaaatatggtcattttgaacagagctactggacgaaaatgttagcttcataacagttagtgtaaatgttaaatgttaggaagttattccaattccattttctttcaacctcacaaacactgtatcactttcatacagattatacattaggcggtggccgtgttagtggcagcaaaaggatttcttcagaacatgcatcaggtagtggccatgttagtgtccgattgttttagcttaaaaagataaatcgacaaacaggtagtttatgtaaagcactcaatttctaatttagtctactctctacttatacatgcatattaccaactaatttctgatttagtctactctctacctatttgcatgctctgatttagttaccttattttgtttctttgtaatgtgttgctagtaaaatctgcaatgagcttctgctgctgctcgatccatccattgaaatcttgaggtaatcattccatcagctgtcagatttcctgaac

SEQ ID NO: 3254 - DNA, 2970 bp, Zea mays
  misc_feature (1)..(100): optimal_loci_348673_G1, chr10:141468832..141471801, Cluster 19
atatatgttattatattttaggacggagagagtagtaccggatatctaacaaagtgattttgtttttcgcgttccacatatatacaagagtgattagctttttatattcggctgtttaattagcgcgacaagttaaaaaaacaggctatatttagcttgctgtttgtccataagaatactaaaaaaattcgaacatatatttttatctatacgtttttttcctctaagaaaacatttatttgtgatacagagcttattaacggacagttagattctgatttagggagcacataaaaatatttctttaaaaaacctaaaaactaaaatgtttttataagaatctgaatccacaccacacccactgttagggattcagcatacaactacgactcggcaacagtaagcgtactgattagcgtacgtgctggcacgtcgtacgtagaatacactgctcatgattccagctagcccacgatacacgcgcgcaaaggaaccgataaactagtatacacaaaagtgccaccggccgtacacgttcgagcttaatttgttgacatccttgtcttttgagaacctcacctcacccctggtctttgcgtgtatcgagctactactttactactgtctctgacagcgcatctgctgggatgaggatgagccatgaacaaagcaacatgcatgcatgtcgatcgacacaatgatatttatgccagaaatctggccaaaaacctcggaacatgctaacgtgattgccaaagttcctggcttgctttttcatgcgcgctgttcatgtgtcatgcatgcatcgcatcgcatccatgtggctaccatgcacaggtgactgcacacaggagccagatgcaggctggtagttcatccgtgcccgtgcgtgatgctgcacgccgggtagggtaggtaggcattgctatttgctcagctcctgtctggctagctaccctactaaaacaagcttgcgttttaagagactgttgttcttgtaaacaaaaataataacaaccgtcgagctgttgcacgagaaccaccgtacccgagactgtggcactgtttgatcctatgtgtaaagattacctgattaataaagttgaattctaaagtttagaccacttcagcccatttggtgtagtctaatgaactaatgatattttctttttgtgagattggattaagtttagatatggttttaaatcacccgtttggagtatcgagagttaaagcggtctagagtttattaggtaaacattaaaccaaagagtccaaacaagacctatgttgtatggctttctactatattcacggaattggtgtctgtttttttgctcttgttaaggccatatgtagtaatttggacattgttatattatagaaaaaaaataaaccacctcttgtgagttagttgtctaactaaagttgtcgcctaaaaattcggcatcctaaaagatagcaattctcccatactcccatataagttttaaaatatatgggacattaaccttatgcaaaatgttctcctagcatctcctctaatctgatttgtgcaccccattccccccacttcaaacttaaaatcctggctttgctcctgggtaccatgtgtgtttgaaagcagagggagcatgtccttgcatgaaattgcaccgctgccaatatggtttcggtctaccaaacagtggcgtagctattgagtggttcaggtgggccgtaatataccctaagtcggtccatcggaccaccaccagtctaccaagacccaagaaaaaaagaaaatggtatatattatatttcattttgatgtatgtatttatggacttaaatgttaaatacataattttatgtactattcttatttttatattctgaattgtgcaccaaattattataggttatactaaattattaatgaaaaaacttcctacgacataccctcatacctcatgagaaaattctagctaccccactgctaccaaacgtaaacatcatttgaaatatggaaaaaaaacattacattaccctggtagaccccatgcaatctgtttgtatagcttacatcacgacagtacgttcatcttttgttccgtgcagaggagagcgcatgtgaaggtgctgcacgcagcacgctcggtccaaaaagaagagaagaagataatggagggagcagagcgagagagcgagagtacgagaccacctcgtatacagtatacgcacgtaagccggtcgtggttggtcgacgacatggcacatgcatgcaggtcagtacagcacgtatactgtgccgcgcaccatgctttgcacggatcgtggatggatggacgatgatgaatcatgggccgccgttgtttcgtgggcgaacacttttgtacacccaatagtgttcgtgcgcagtagcacgcacgcacgcctgcctgctgcccgagccgagcttctttgctgtggcgcccctacctaaaaaaaacttatgtgcacttaaacttcacgtataattattgtgtaattaaactattaaaagttatagaaaacaaaaaataggtatactttattatttaatttactaatatactaaattttaactaataattaatcatatgttaaaagatataaaaaaaaattaaaaattctatgcagcataaataattaaaaacaatagaattttctctttttgtatattttaacaatttacaatggattaaacttaaaatttatatagttatagagtaaacaatgaagaacttttttattttgtacttcctccgtctaaaatttagtcgttttagattttttatagtttgatcgcatgacgtgtacgtcctgtcctggtaggctggtccgctggtagcctggtactgaacacgcaacgcccggcagccggccggttaattaggctgaatgacactgaatactcatgtacactgggtgtgtttcaaaaatacaaaataaagtacgctacatctggtt

SEQ ID NO: 3255 - DNA, 2470 bp, Zea mays
  misc_feature (1)..(100): optimal_loci_36257_G1, chr1:218734356..218736825, Cluster 19
ttattggctcgtgaacatcttatttgagagttttagggttttggaggattaggtaaagatttgggatgcaatccaagattatcttgtgcgaatatttttgttgactcttatttacctttctttggtcgtctgattcattccttcatttgttggagctattgttgtatttaaatatttaataatttttttttgctttcttcgagaactgtatagatgtcatcgttgaacaggtagttaaatttaaaatatggtaagacgatttcgacgtagcagtagtcgtttgtatatagaaaatatagttacccgaccgttttaatcatgaaacgctgctcaaacactacgtgcattttttttcctcaatctcaaatattcgccacgaaatgcatcttttcattagaaatgtagtacttgtataaatatatatcgctaatagtttaagttattcttgcgctgtgtgacacgataacaaatgatatcatagcatttttgacacgcacacagcataatatcggctctggtcgtgtcacacgtacgaaatgcttcgattgtgatgcgtgatgctgtgcatctgtccatccaggccccagcaaaggaacgacgtgtgcagagacatgctcccccacatttgtaatctctttgcacaagttttttttttctttttcttcttcccacttcatttttcgatcatgtgaccgatgttgattttataaccaaatggttcttaaaatagtatattgtgctcgaatcgtctgtgcttatatattagtgtgtgtggtacacctattttatctgtaaaaaacaaaattaacaaaaaaacaaatttgagcaaaactaaatcagatctgtcgctgtcttggcatccggctggttcaacgaacgcgagcctgacctgaccagttctgaaacggccaagcaaaaccttgctctggctggctggctggcagtgtggcggcgtcatcggcacgcgcagacaaggacctgatgagaatgagcttctccttcatcgtctctcgcgtcgcgtggactaaaatattgcaacctgcagcttgtacgtctctttcttcgactatcagctgatggcaacactgaatgcatgtagagtctgacgagctgaattaaacaagtgcacaaatcagaacttcaattcagctgataccttctgcaagatgccctttacttgtctgtgactgtgggatgatgcttttgctgacatgaggaacagtactaccactgctcctccctaatcaggattagggcacacatccttttaatactcctagatacatatcttatcccagattcttcagatcaggaacaaaacctacccaagtgtcaagtccccaacctaccacctgttctttccagactgctgtaccagtagtgatgcgcatcaaggtcacatctgattccttactactaaaaaccttctttctaaacttatccccctttcgcccccctggtaagagtaaagggatggactgtcaggctggctagccctccttggcatggcagctttggcctccactgaattctcatcatctagattctgggctggtaagagttgagaatgcacttgccatatctagcatagaccggactttgtctaaatgcatgatgtgcagatcagacatgggatttttttcctgttgaggtgacaattaatttggttgataaagttatcatgatcgatctgcagcgccactagacaaacatgagcgggcaacggaaagccaaaagaaatcaggattgcataaaaaatctgttccaacagggcgagggaagaagagcaaaatattatggtcacaacaaaataatgccttcttcgtgttaaaacatgggatgtgggaggctagcatgggcatgtcgtgtaggataacgcacatgttcctgtgccctgacttaaaggctgtgattttctttttctttatcaagagtttttagtgcttggaaaataggttgagcaataactagtaaattactcgctcctgtaaaccttatatgtagccatataatataagttggagatggatagatatgtttagctcttcttggcattgcagctttggcatccgctgaattcttgtcatctggattctggtctcggtaagagttgagaatgcatttgccatatctggcacagaccggactttgtctagatgcatgatgtgtagattagacatgggatttttttcctgttgaggtgacaattagtttggttgataaagttatcacgatcaatctgcagcgccactagacgaacacgagggggcaacagaaagccaaaagaaatcaggattgcataaaaatatgctccaacagggcgagggaagaagagcaaaatattatgatcacagcaaaataatgccttcttcatgttaaaacacgggttgtgggaggctagcatgggcatgtcgtgtagaataacgcatctgttcatgtgccctgacttaaaggctgtgattttcttttc

SEQ ID NO: 3256 - DNA, 2720 bp, Zea mays
  misc_feature (1)..(100): optimal_loci_36579_G1, chr1:220803529..220806248, Cluster 19
ggaaattcgagaccaacaaagtggaaattctttccaaatggacaacattgttaggtatggttggttaatgaggttcacaaaacaccaggggataaaagttcatgtacagaaatcagatataaattgctctatcaacatcaaatataaattgctctatccaaatgacaagaaaacttactaatatatttgatataaatacttattcaacaatcaaaataacaactttggttgtagctgcttttatgtccactgtcctactggatttcgttgccctatggacacttgcttaaaaactgaaaagagacattgaattgacctctatctagaatttaagaaatactagttggaacattagtattaataactaatacaaagaagatgaataagatatcttcatgcataacgagtaatactagtgaacgataatgattagaactctgaaaatgggaccaacatatcgaagcaaaagattcagtttactcctgtttccaagcacaagattcagttagtaccccttctgtacgaatccatgaagagcagcaactcacatttatcacattttacctattgctcatctcgaatttgctaaatcaagcaaacgaaacgatgtttatttcagtgttgttcactgttgttcatattatagctactgaacatcaaacaagcatatgtacaaccattaacgagcaagtaaaaatcaaagagtatattatatgtaccatgccggatttggtggtcgatgtcgcgactcaggtaggtacgtgatctgcagaaggaggttgctgcgactccggcgtagagggcaaacgtgacgtagtttccggaacacgctggtgctcatggatagaggcgccaacacggggcttcacagctacgcatgaacgacgtagtactgagcttgtctccacctctttacttggctccatggtgacgagcaagcagggacgagcaagcaggaatggggagcagataggggccagcggacatgaccttaccaacggcggcggacagggacggggagcggccgggtagagtgcccgtccggcgacggtggatagggacagggagcgacctggtatagggccttaccagcagcggctaacagggacagggagcgagcgggccaagagtaggagctggcggcgccggactgctacagacggacctagaagacgaagaagacatctaggcgcaagagaagagcacgcgcgtggggatttcgtgagggaagatctgggcacgagagaagagcgaacacgggagaatttcgcgagggaagagtgcgcgggaggtgcatgtgatccgccatgaaaagatcggtcacagtaggcgtttgagcgtttcacacgatttcatgtcttgaaaacgagttagcaagtgtcgtgggcatgaaactggttccttctcttcatcatttaatcagtgccatatcatcaaaaaagctaacgtgttagggtaattaataccatgaagctagcaccctatgaaattcccattgtgaatagactaagatgtcgttaggtttacatatttgtaacgtgatggataactagtaatgttagatcatgtttgtttaggtccaaccgtaatcaaatactgcaataaaaactaataccggcatattaaaacttgttatcactggtactcgagtgtgaatcattaatgttgccatttacattatattttgtgaaccagacatcacctaattgacacatgtagtcaggatgtatttttcttctagcacatggacgaggatctggtctcaatgcaagattcatagtcattatacatgctctctttttatgtaatgtttttccagtctgtatgcttttatatatatgttgaagtggcttaatgaatattatcaaactctgtaaatgtcccgaattaagaaaagtagtcactcaacttgtgctcctgcatgagctagaatttcatgaagcagcattagtttttaatcaatatttccaactagtaaaaactacttatatcaaattgcacattttttacctttattttctaacacaatagacatgatagatagcttgtaatctctattgtaaccatattaattattaatctatatctttttcattcataccaagagttgtttccatttcatggcacatctttgtattttcaatataggttgagtaacccttctcctatagatgtctaaccaaaggacatgtgagacaactttgcatggtcaagatgttttgtgatatttgtcggtgtgatgctcacaatacggacagatgtcctcaatttcacggggagaaaccaagttctttgacctgtggttatgctgtggatagattttgattttattacatacctttttagcacaaaagtaagcctaaaggggaggtaacaatatctatggttaatgttacagggggtgttctctctgaggcacaagtgatctcagaattccagaggctggtttccaataaatggaattgggagattattcagactagggttaattgcttcaagacctctttcccaccatgttctgaacttgaccatatgttggaatggggggtgcaaacaaaacgtaatgcatcgatgaaaattgaggaatctgtgattcgggaaaaagcaaaagtggagcttaagaaggtttgggtccagttcattggtttaccatctgtgatgattcaatttcttcttatatgggtggtgggttcaattttaggtgtgaccaaggcagttga

SEQ ID NO: 3257 - DNA, 1978 bp, Zea mays
  misc_feature (1)..(100): optimal_loci_3673_G1, chr1:18956449..18958426, Cluster 19
agcttcacaatctagcaagttacattatgataattcgtcggctagcattgtcttgtcctttttttccctaaaattccttgcccattctctctactcgcttcactaaagcgttacaaaattccactctttcctttgatattgatcatttccagactgtagcaaatggagctacatgagctatgctctacaccacgggtcgagcggccccgtgcgcgggtccccttgggcatgagtgttagtgacgaggtcgatcgatcatcgatgataactttaactatgatgtaaatatgttgccaacggttaaaatcttccttgttagtctttcatgattaacataatagataaaaatagaacacatagacacaagagataataaggctatctgtattcctctaaatatcgatgtttacaacatatagctttacgtctatatatacatagttctatatctagacttaaaacatacggagtaaaattaagatttatgtttctcattttctttgagctggagttcatatattttgaggacaaacacagtcagactgaagaaaagattacaaatcgccgctcaggatccaggcaaccgctactattgaacaatcaggtagttgggctttccacataagcagcaagtggagtaaatattattagtgtggcattccttcaaaagtaaactattccagcaaaacttggaatcatgaagcatataaaactttatttaaaaaatgtggccacagtcaaatggccgaccttctaacctagtttttcggttagcgtcgccactgaatggaatagatcccctcctccgcctttcagttttccatatatcagcgaagaaatttgttacgtaaagtaccccgtagcagttttctagtagagtggtaacgataggcatcagttgatttgtaataatccaaaaagaaatagacaggatcccattgcgtgattcctgtcctgatatgatgcacaggcatacatctgcagttggtcacggctttcagatttccttaatccttagggacgagcgagatgtactccctcggtccttgtctagttgtctttaagtgccgctgggaatcgtgtgctagctaagttttgtcggatttaactaagtttatgaaaaactttaacagtatttatataacaatactaataatgatatattatcaatattttatcttatatattctgttaaagtttaatacatctggacttgtgagaatgagaacgacatgtaaaaaggaacggcaggagtacagatatgagatatgacacagatctgatccgacgtgggacgtttttaaaggaaacatgacattggttgttccagctttttgcacttttaaaaggcactgggttgcgtcggcactaatccagtgggtgataatccaattgcatgcttccaaaaagcgcttgcacaataattgtacacgaacagtagttacgcgtctacgcacctagtgttggattaattagatttgcctatagttaattaatctagcattttttaaaaaataaacatctaccaaaaatacttataaaaatgagatttgtatcaagcgacacacttaccgccggtaagaattttaacttaaataggaagttagttagtgcttctatagaaaagttgatgggtgtcattcaatttgacagaacagcacatgcaaagctagcgtagcgctcacctatttttgttttttgaaaaaaattagaactactactgataaatgattttgtagtagactatatatgtgacagtcagttggtcagtgttttttattctctagtagcttggatcatgtgaacatatagtcatttgtataagttgcacatgagcaaaccgcagcagactatacataagggagtcaattgatttcatctctgatagaattgaataataatggcaaatagttcttgctcaaataattggaatgcatgtatttaaccaagccatgtgttaaataaataatttattact

SEQ ID NO: 3258 - DNA, 1450 bp, Zea mays
  misc_feature (1)..(100): optimal_loci_36750_G1, chr1:222162668..222164117, Cluster 19
aaaactgaaggacaacaatctcagctagacaccaaagctgaccttgagtcaaaagctagcacagtattttggacaacttgctttatattctaaaaaatgcaggtattcatatgttttcatagctccgagacaacaagaaacactaagaaatgaaaactcattagaaaagaaaattatttcagacgatcaacaatactaatattatcttcatttgataagagacgaactccactaaaagccaaataaataactttccaaatatcaaacttttatttgcaaataatgttatacaacctgtccaaatatatatattcttttgcatatgtgatactttcttggcaagtttgttcgagaaaattttcagaacaattccgacatctgacattatacataaaatcttagaggggggttttcatgtaaagagagtgatttagctgcccattcaaactatatgttcacaaataaaaaacagataaattaagtgaaaatagtgacgtgactcacatcactaaatgtttttctaagataaaacttattttcttttcaatgtatatgcttaattccagtgcactatataaaaacaattaaacaaatattaaaaaaatgcaacagtatttgtaaaacactataataccatcttatattacacaaatgtttctcttaatttttactggaaattagtaataagagataaacataaacaaatttaatatattacattgctagaaactcagctacatgagtatctgttctatttcagacatacaatattaatttgtcggtatttacatatccatgtaaaacctataagatttatataatttttcgagcattctttacaacaaaataagtatcgagttttaatataattgaataaagagctaacgttgcatacttaattaaaagtacaatatgactttaaattctttaaatacaattcgagatcgtttaagccgagatctttcgacctacggtgcaaattaattagatagaaacaaatatcataaaaatcgcttataaatcattgttaggaacgtaatattacttcttaactacattgtcttatgataagggattgatctatgttattgtttttcttcagggtatataacttttacatttgacatatattcaatgtctatcgttgtctccttgcatagattaatgaaaacttaactagtacgttcctaacaatactttattagcgatttctataacatttctttttatctaattaatttgcaccgtaggtctgaaagatatcggtctaaataatcttgaattatatttaaacaatttaaagttggattctacttttggtttagtatgcaaggttactatttattcaatcatattgaaactcgatacttattttttatagataatgctaaaaaaattctctctaccttttaggttttgcatgtacatgtgaataacaacaaattgatat

SEQ ID NO: 3259 - DNA, 2678 bp, Zea mays
  misc_feature (1)..(100): optimal_loci_36922_G1, chr1:222961259..222963936, Cluster 19
taaaatatgtttgttttagacgaattaaaagaacagtttgattaccgaaaaaagaatttgaccttgtttatgggagtgcttgaacctgcttcatctatgtttttttagaatttcgtttcatatttttaagtgaaaccgttcaagctccacacacacaaaagagatggagttcacccttctcgctaaacctctttattagagttgcaccactcagcttgatcatgagtgattcgtccaaacaggttcatgacttaagtgtgtcttatttcatatttcttgaactcatagcgtgcgcatacaatacgctttaatttaagaaagttgagttaattaggttaatttctcataacgcaattaatcatttattatagacttcgaaatttatttggcttacaagattaggctaagcctaactaaagctagcaaaaatggtgacatagcttgttattattgacacgggcaccacgaaacaaaactaaaccctttataacacatatgtttgctaatccaataaaaaatattgttcaaaaacaattaaccttgtgtttaggagccgaggagtatgaagacagggcggacctacatacaagagagtgagggcctaggcccccactcattgctttgttacaagtattagtgtctagattttcaccattaagtctcttgctgagcctaattgagatgtcctcactcttgttttgttctaggtccgctcctgctgcagaggaagaaggatgacgaaatagtcaggacaaaaagtcatttcaaacctctatcagatgccaaagtagcatagagggaaaaacgatgacataaatggcataataactttctcgattattcatatgaaatttagatattttataataaattgtaggaaattggttttagcatgtctaattgtttttattgaggcaatatgccaaagttagagaggcaattaaacaaagctcttgaacagcacaagagcatcttcatagaggctctacataacagatctcgaatggtttagatgatcttttcaaatagaaaactctctaaaagaaccagaagggattttaggaaagaaacacttatatctagagtggtgttcatgacacaacgataattatcgaattcacgtaatagcaccggaggcataaagagctatttcaagaggcactttatatctttcctaattgaattggacatccaaacatagatatcatgtaatccagacttcttgttagccaaatataaaaaaaaaagtgcgagaatgactctttaaattgtgtacacaaacaagtctccaaataacgattgaaagagtaagttttacttcttggagatgcattgagaccatatcaagagtcttaattttattacccccaaatcatcatgtggagagttattaaaatacaaatatctttctatatcggtaacttccgtgtatcttgtgcatactctagatagctatactcgctatcttttttttttttttgaccatcgaaaaaaatctgagataaagaatttcagtatttaaagatcaaactaaagatattcttgaagatatccccctgtagtggccagaagcccagaactacactacaacgcccaaaaatgtgcaatgacagagaagatggatgatgttttagattatatgaaaatatataggaatgtatattagatcaactggaaacctatgggtgtttgtttctaaagcgcaggtgtagtatcagactagattatttcttgggctactggtagcatatctctttttcatggaggtcagtgctcactgatttgcagaagaaacatttctcccttgcaactgggtctcgtcaagcgtagacacccaacacgcatgaaaaaggaaaaatggattgtcagcccaagtagctgggcccccgttttttggtttgcctatgcaattgtctgggcttgggttgtcgatttgtgctacagacatctggactggatctccagaagtcgcaaaaaatgtgttggccagacaaacatctacaagaacccgtaaactatgcttcaggaacagcgataggaccaataacaacagaacggtctgtttgctgcggcttattacgaaacgatttcatttttttataatattatgcctctataattacagctgctgcagttcgaacaggaccaaacaaaccgagagttctattcgggagctgaaaaggggcgatgacagagtgagaacacagtaaggactaaggaactctgcttttggactaaccaaacaagaaaagcagcacagcacaggaatctgatttggatttttgctcctgggagacttcatgttgagcaccaaagagtctcccgatctatctcgcctctcggctctcgcactgaccggccgtctagtctttggaattcccggggtgtcccattcaggtgagcacgtccggataaagactaggatgcagagcgacgtgagattggcaaacgccaacacaggaaagctgcctttacgggccagtaacgacgccccttggttgcatcagcatcacctcaccggccaatattgttcagcggtgcggcggcgtttgtgcagttgggtctcatgcatgacgcagctgttggatcgatctcaagctaaacttgatcaaataattgaacgtccgtcctagttaaggaacgcaacaattaattgattgtggtcctccttcacagcg

SEQ ID NO: 3260 - DNA, 1662 bp, Zea mays
  misc_feature (1)..(100): optimal_loci_37332_G1, chr1:224751210..224752871, Cluster 19
actaggtaggccctagtgtgtaactaggtcatagcccctatcagtcccctacctccaatgtgctcgttttgtaataacactttctgtaaggcattcgtatccgatatggcgaaaagatcaataaaagccttagtcgtgatgatgaaccttctgtcgtcggtgtattgccctatgtcagacatgatgctttaagtgctttgtttttacttgagtatataagcaagcgaagcattagtgatcatggtcaattagttgtctcgactcctgttgaatccttaggatcgtgaactgaaatctgtcaggttaacattccatttcttttaaattctttgcatatgcttggttagggaactagtgaaactgagagatgaatccatcttttttgatgcagtgaacatctgccgtttgctatacaatcatgaatgatgctatacgagctagaatgtattcatcgtgacatgaatgatgctacgcaaatgtatatgtagccatcgtgacatgaatgatgtttcgtgagcacataacttgtacctgcatttacaagttattttattttatcttggcagaatcaaaaagcctcaaggtaaactaaaattatataataaaataataagtatcactagttatttgattagttatgttttttatagtatacctatttaatgtcataaatgtttgtatatctttctataattttaacccaaacttagatgctttgagaaagttaaaataattataatttaaaatatagggattacttttcgtacattttgtagcatatataaatggctgaaatagctcagtttgaatacaagtcaacttggacagggatttgcccctaaaattcaactcacatatatacggtgatgatgaattaatatgctcatatatgatgtactcatgataggaagtggatataacacagttcagtcttcctcacagataaaaatgcattcactcataccatatataataagcatactacattgagaaacacatataaagggcagcaaaaatgcaccagttagtccctcctctccgttgcaacgaggagaattcagactaaaacatcagcagttaaataatagcaatcatataaacaattaacacagcgatttatatggaaaatcaaaaaacatggaccgacccagccggtccggtcctaactttcactgtaatcaatattgattacaatgactcgtctctagagctttcagaagattacagagacaacaaaaatgttcacgccgctatcccaaattcggtaggcatgtagattcatgagcccctcgtaacatcctacttttgtatggcacaaaaccactatgaatatacaacacatgtcacaagttttagagatgaatttgaattcctttccttttaaaacatgtgtttccttatatattccaaacagagaaaggaagaattttttttgtataaaaatcctcgccgtaaaatgagttcatactttgctgaagtatttttcttttttttttgaaaaaatcaaagccatttcgacttctttggtttgaatttgaaaattatacttaaattccaattctgaaaatggaaaacaacaaaatagtgtaaactgtgcgacccagccgaattcagcccaacaagccacgtgtgcccgctctccccttctccctctcactaaga

SEQ ID NO: 3261 - DNA, 1469 bp, Zea mays
  misc_feature (1)..(100): optimal_loci_39461_G1, chr1:235692220..235693688, Cluster 19
acaacaaactaattgatgcttattcatctaaatacgctgatatgggatgccagtcagaacatcatatattttgctttaagaaatactcgacaaagttatttattttgaatcattataactctatgtaatctgaaattgtttaatactttaaattttctcgctatttattttgaaacattagagctctatgtaatatgaaattgtttaatactttaaattttctcacttgaggtaatcgtatagatttaacattgttttactattcttattttcttctattttactataattattgaggatataaaaagaaaaactaatgacacaaacattgagattgatctagggtcctccaaaatccagagtcagccctgagcataggtacatgcacaatgaagcaatacaacaaaacagatgacgagacatcagctaacttgagtcaagagttacttgcatgatcgagacatcagctaacttgagttaagagttacttgcatgatcgggcaagcatacgaggtaggcatgctaattcttatcagtttgctcttagtgatcagacttctagattttttgtgttgaccatggacaaataatacagagttgtgttcatgtggtttgcttaggcacagacatgtcaaagattagcatggtttattaaacatcttacgataaattgtattaattcatagatttcttaggcatgtactgtaattaaatatagctttgattttgttgtatcccatcttagttgcaagcttctattattgaactgaaattgaggttgacatattttcctttctgaattttgtgtcgcttgccatttggtaaggtctaaatctgaaagcatgaacacggttttcttcctctttttagattactgaatggatgagcaaccgatctataaaagagatataagaatgtatgatagtctatatttttcccactgaattttatgttgccaattttctcaagtatataagtgcaggagattcaaatattagtcagggtgtcttgatacatgttgagccttcgcttcaagttttatgtctagtaacatataaattttttattctagacaaggatcatcagttcaacaatctcctctagctgccccttcagctggatctccatctcaagctactgcaaatccacaaggaaccagtggtattcaaggagcctcttctaccgacaataaattcagtagcaggaaacaacttccagcggtatgtcatatatgattagttgcatgttttgtgtcttctaacgttaatgagcattttcttgattgaatgtcatgtcactgagtggagttttatttgacaagcactacatatgttgtcaggtagttaagtgaaagactctaaatgttgcgggtttgtaactaggtagcctttaggtcgtgctaactacttattatctgatcattgcaacttataaattttggacgatgaacaacttataaatgtaccaag

SEQ ID NO: 3262 - DNA, 1938 bp, Zea mays
  misc_feature (1)..(100): optimal_loci_4674_G1, chr1:24043440..24045377, Cluster 19
aggactataactctaactttgatcaaactattaatatcgtctacccttaatagtatgtccaaagattaaagccataacacatagtctaattgttcccattagtaagtccacacttagacactaccatgtcattagcacttataaatgtcattgtgccatacatagaatccaatcaccaagggtcgagaaaaccaaataacctcaatgtgaattactcttttccataagcactacaaaacaaaattagctgcatgtttcttatgttcatcaatcactaaatattgaattaggttatttaatggttttgacacacatgagtgtgcaccctatcacacatatacaaataaaccaattaaaacacttatgcgtgagccatgagcctcacacaaataggaagttaaaaacaattgcataggatctacaatacaatgttgaaatagagcacctattgatagcatcacgaacaactctaataaaaaatactcaaagtattccttgttgaatagaatgttcctaaaaacactagacaaagtcacattctatgatgatactttgtttttatttttgcaactataagatgacacgttacatgcacaccactacatttttattttttcaactataaaatagcaacacgctacactcatgccaaatgcacaccctaacaatatctataataagccacaaaaaagattgtgtgtgattatgatagaaataaaccactaaaacacttgtagtgttagcgtgagtctgataccatgttggacatttaaaggggagttctaatagataagttcacgaccaataatagtttcaatacaatgcaacttatgatactctattagttggagtatccatgaaacactaggaaaaatgaccaccaagtacaattaagatggtgtatatgcatgtgtttggacaacataggatccttgtgtacacaaatggaaagagtataacataatttccacctttgtgtagtgaattgtagctaatgcaatttctgttgttcaccacttcactctggttggtgcacctgtagtgttagcgtgagtcatgataacatgttggacatttgaaggggagttctaatagataagttcacgatcaataatagtttcaatataagacaaattatgatactctcttagttggagtatccatagaacactaggcaaatcaccaccacttacaattaagatggtctatgtgcatgtgtttggacgacataggatccttatgtacacaaaaggaaagagtataaaataatgttcatctttgtgtagtaaattgtagccaatgcaaattatgttgttcaccgcttcaccgtagttggtgcacgtagcaaatttcaatgcatattcaacccatgtttctccactttcttttacgaaaagatactggcttttcaaccaattttgcgttcacgcaagctagtgtaactgtttcttttaaactttttagtggcgtgacttgttacgttggcaaccatctatgagtggatcagttatactctaataattccgagatcagatcggatgcgaaaaccacacaacaacatgataatgtttttatagccatcctgcagtccaagataaactatacgaactttgggtcttggatgtcctgaatatcaatataacagccaagccatggcctaggtagtactcacattgttctaatttataatctgtttggctttttgtgcaccaatttaatcggcatgtcctattaacaattctgttattattattgtgatatcatttagtatataatatactttaagtatcgctttgaatttttccaaaaaaaattaataatgtgaggtagtcaaaattgattttaaaaagtcaaagaaattatgaatgggaacagagggagcataagtttattgctggatacaaaattcgtagcatgtattctaaaacggtccatatc

SEQ ID NO: 3263 - DNA, 1545 bp, Zea mays
  misc_feature (1)..(100): optimal_loci_50545_G1, chr1:293611650..293613194, Cluster 19
tttgtggtgttactaacgagcaatttatcgttcttgaggacccgggtttaaccggtggaataaagcccgacaacccccatgacccatgttttcggaccgtgggccgatcctaccaatccgatctatttgagcctatctccaccgtaaaaatacgagaacattatatttttggatcgaaacaatgtgtttcacacgtttgccatttctaacattggctttacaaaaataagactcaaaacatgtcacacttggtttccataccattttagacatttttgctcttctatgcccttatgtctttttaaggatgaaaacggaataggaaaatcctataacgatcaacatcgtgtaccgtaataaccaacagtatatcgtatccacaaaaaacaacaacgagaatattcctgagaaaagtggtgggaacatgaatggaaatgatcgaggtattttctcgaccgtatttatggatcttgtatttatataggaaaaccatgttggtattttcttttctatttgtataagaattaagctcatctaagcaccccaaacctaccaaccacactcaacccaaggcctcatacaaataataatagacttgtatgaactataggttgttgcacttgtagatttttggagaaacttatttatttcatgtaatctatttgagtgtctctgactagagtcaagacatattaatggttactatgtttgaacttatgagctactatcctctctcctgctataggttcttagttaggaacttatttatggttgtaatgttttaacttatgaacttatttgttgggttatgctactgttgttggtttgggtgtttgatggagcgataagcgatgcactcgtgctgttgcatataatcgtggcgccgtgaaatggtgaattattatgcatattgaaactttaaaggcttatatataatatattatattattgtaaggtcagatgtatttgttacgttgagttaaacgtttgaagtggttagatgcatcgatattctttattttaattactgactcctaaccgttaacgatgtattcctggtcgattgtgtcatttatcgtcatctcgttactcctgattttgtttccttttcttgaccggtgattctgctaccgttctcgatttgagattacaatatagatttgaaagtggttggagggttttctcaaccgtttccgtccgttttcgtctctatgccgtttactcttttatatgtgtatgtgcgcacacaagagtaaaaatatcaaaaacgacattaaaactatatgtaaattattttgagtcctaattttacgaagccaacattacggatggcaaaagtgacgagtacatagtaccaaaatccatttttttcgtgaaaacactcatggctccgttggaacgcataaatttcacaaaatgatataggaattttataattttctcgtgaaaacactcatggctactttggaacgcataaatttcacaaaatgatatagggattcactaattaaattttttttggttacaaaggacccctgagccgtt
